United States Patent 7,365,185 (GENOMIC PLANT SEQUENCES AND USES THEREOF) - sequence listing, part 89

SEQ ID NO: 80759 - DNA, 12651 bp, Oryza sativa
accgccaacgcatcctcgccatgaagatcgacgaacaggtgaattaaccttgattgattgctcatccgggttcctgttcctttgcttggccggctggttaattaatttcttgctcagataaagagggagatcgccacgttgaagctgctcaagcaccccaatgtcgtccgcctccacgaggtgagcttcgcaacccacagagtttcagcagaaatcctttcttttgtgttttttttactctcttgctttcttcctcttgctgttcaacgcctcttgcgccattgatgttgccgtctgaactcctctccggctgcgatatagcactaattttttttttaacttggctgctaatacctctctttggataactctcccccttgtgtgcagtagaataattgtcctttttactgtttcttgacctggacatctgcataaacaattgagcacacgaaatgaccacccaatatgtttttttcctgctcatggaagtagtaggacaaggcaaagggtctttcagtttcagcaagcaatattatttccctttccttttactgcgctcttgcttctcggagtattttagtcgggtgatgatgcgcccgtgcagacttgggtttatcagattcccctgcagcaaaaacaaacttgggttgtcacgtcaaaccctgcgaatctcatcacggagaatcgcccactggagcattggaatacttgctgatgagatcatgtggctattaggagcaaggttcatgtgccatctgagccgtacaatctgatgatccgatggccgtcgttgctctacatgctctgaagcctgcctggttaagacccaatccagaagccaccaaaagagctttctgacgaggttggccgacatcacccaataatcagagcgatcttttactagtcacttttaggcaactttcagtcctgcaaggcagagaaaacacagaaaggctgcacgacatgagcccaccacagcaatacgtcatcatatctataatgcaattcagaagggaaagtgttaaacgtggttttggtaccatttttgtaagtgttaggttcaccgaatgattgcattagtggataaatgtccgtgagaggcttacttcttgcaagcggaagattagaaaatggagctcctgactctaaagcaaaaacatatgcgcaccagtgtgactgcccaatgatttggtactgcccaatgatttagtagagagagagagagagagagagagagagatgttgcggctgttgatcagatctctgcctcccgattgttcattaaaccttgtttctgtaggagatgcaattgacatcaagaattagctggggctaaattcctccagtgaaaaccttccccctatccgtccaaacctgattccctgaaacatggaattaatctttttattgttgcagtttcagaaatgtcaaaaagaaactacttttcagttgtacacatccacattttgtccttgggaagcctgagatagattactggtttttcccctgcaggtttcagctagcaaaaccaagatatacatggttcttgaatatgtaaatggaggagagctattcgacaaaattgtaaggattttgcttctcattttaagcatgcattaatgaatcaaaaacaactgattgtgattagggttttacacaactctaacaatctgttgatgcatgacaggcattaaagggtaagttgtcagagaaggaaggaagaaaactcttccagcagctgatggatgctgtaagctattgccatgagaagggagtttatcatagggaccttaaggtgactacacagtatcactgatctatctttttcatattttaattgtaagcaagaaaataaggactgatccaaatggaacacacgattaacatatgctattttctgtgtcttctgtagccggagaatgtcctagttgatgcaaaaggaaacataaaggtttcggattttggactaagtgcccttccacaaaatcaacgggtatggaattttctcttacatcaaatcagctgaataaattcgttggtgtctaaaataaggctccaatttcagaaagatggattgttgcataccacatgtggcagccctaactacatcgcccctgaggtaagaattaagcattcttaaactgaacctattattgtttcacggtctttagtttagtgcatatggaggatgtagttctgacagaggtatatacaggtccttctcaacagaggttatgatggctctttgtccgacatatggtcttgtggggttatcctatatgtcatgcttacagggaatcttccatttgatgaccaaaatacggttgtcctttatcagaaggtataaagcaaggaatcaaagattacctcagcaaaaatttggctaattttatttggctcaatatctcaatttaattttgtatccagattctgaagggggatgctcgtattcctaaatggctttccccaggtgcccaagatatactgcgaaaaatcttggatcctaacccaattacacgcttagatataactggaataagggcacatgagtggttcaggcaagattatactcctgctatgcctttcgatgatgatgacgacaacaatatcagtgatggcaacctacatatgactgaggtaacccaacgttaggtgtactttttgtttgccatataatccattgctttaactgaatggtatagattgaactcaatctgtgttctctctcgcttttttttttcatggtgaagaatcaagatattgaaaccagcccagcaatcagccaaatcaatgcattccagctcattgggatgtcctcatgccttgatctatctggattttttgagaaagaagtaagtttgatctttctttcttgaccctatttgctaattccttaactaacacctacattaaatcctagcctgctagccaaaacagacacacccaaaggtcaagtaggccgtaaatggaagggtcccatgtgaactcatcagaccataaatcatgaaataataagttagtgaccagcaatttgacaaagccatggattgttgtcttatatatccgatgtccctactgagacctctgctacgttaatgcccttaactcagacatgtgactttgttacaggatgtttctgaaaggaaaatcagatttgtatcaaattattcccctacttctctatttgagaagattgagagcactgtcacagaaaagggtttccaggtacagaagaacagtggcaaggttagtgacctcagatgtatctacctgtaatattaatatgagctatacttacactgctcatgcatagatgttaaactgaaacttatgctatcatgtactacagctaaaagtgatccaagtttgtaaagaaccagcaaatccaagaggacatggaaatttattgatttctgctgaggtacttctatcacattgaacatccatagcaataaataatcaatagtgtgcaatgtgccaatgtgtttctgttaaacatccatgattcttaatattgatgtactgcgttttcaggtgtttgagatcaatgaatctctttatgttgttgagctaaaaaggtcatctggggattgttccctttacagacaggtatttctccctcccttgctgaatcagtattttaattcattttctgatggaaaatttaaactaaattattttgtcctagagcattgttcttacttctcaaacttccaatatgcaatttaacatatatggtattgtttatgttgcagctatgtgcgtcactttctgaagacttgggcatatgcaaaaggcaacagcttttgaagaaagattctatgagacaagacctttgtcgatataacagtagcttttgataaaagggtctctctagcttttagttgtgaaggctctagcatttttaacaagagcccccaatacaacgacgtatgacacagttttgtaaaattaaactgtaaatacaaaacaatccaattgtacaccgaaaagagtataccgatcatccaagtatttcctttaggagttcattagtttgtgttctttttgcctttactggtaaatcgctacctcctgggcaaattggctactgacagtgtataaaagtatgatgtagacaatctaagtgtacataaatagttacctcatcttgtgttcctttgaagttatgtgttgaatgtgtaagtttgtgtcttgttttggtaaaagcatgttaagttcaccagtaatccttgcatgagcactgcccttcactgaaatgatggaaacggttccggtctctaacaatcaacttgcgatcatacaccaaggagatcaacttcatagctgaatggcaatcttcacaagctctaagattcttcgttattcgaatagttgacctcgcaggggtagttagcagcgcaaaagcaatggccagcttctcactatgttcagccaaggagcgttccttagattgctcatcaatatcttgcaataccaaacctgtcataggcttataacctgcttgttttaaccgatccatcatctcttccaacactctgtagatctccttggaccttggatgcaatctatcaccagagacaaactcatgaatcttttcatcccattcaattgaacttcttccaggaatcctctgaatattgtcccttctaatcgtcttcctcatttctgcaacaccttcccaagagtttgcctgtgcatatatatttgacaatagcacatagtgtccatcaccaagaggatccagaactcgcagtttggccatggcttcctctgcaatctccacattcttatggatgcgacaggccccaagtagtgctctccagataattgtgtcgggttcgaatgtcatgctcctgatgagttgtcttgcctcctcaacatggcctgaacgccccagaagatcaaccatacatccatagtgctcaactgttggctctataccatgaacttcattcattgatctaaaatacttcttgccttcgctcacaaggccaacatgagtacacgcgataagaacaccgacgaaggtgaccccattcggtttcatcccttcagatatcatcttcgagaacaagctgagcgactcatggccaagcccgtgattggccagtccgataatcattgaactccaagtttgcacatccttctctggcattctgtcgaacactctctgtgcactctcaatgtcaccacacttggcatacatgtcgatcagagcagtgccaagcttcaagtccagctctatcctgttgctctccacgaagcggtgtacctctgcaccaacggccagcgctcccaaatcactgcacgccgagaccacgctcaccaaggtaatgcagtccgggatgatgctggcggcgtgcatctcccgccacagctccagcgcttccttggatcgccggctcttagcgtaagcggagatcatcgagctccaggagaaggcatccctgtcctccgtcccgtcgaatatctccctcgccaagccgacctcccctctcatggcgtacccatggatcatcgtgttccaggacaccaagtccctcatcggcattccgtcgaacaccttcctggcctccgcgacctcggagcgcgagacgtacgcagcgagcatgacgttgcagaggaacacgtcgcgcaggggcgcctcgtcgaaggcgtcccgcgcgaggtcgacgcgccccgccttggcgtacatctcgacgagcgcggtgcggacgaagaggtcggcggcggcgaaccccgacctgagcgcgcgcgcgtggagcgcggcgccgacggacacgggcgccgccgcggacccgcacgcctggagcgcgacggagagcgagaaggaggtggcgaggagccgcggcgcgcgcgggaggagcccggcgaggaggcggagggactgcagcgggaggctcgcgcggaggtaggcgcgcatcacgccggtggcgtagagcacgtccggcctcgccgacttctcgaggcgcgcgtgcactgcctgctgctccggcaacgccgccgtcgccgccgccgccgctccccgcttgccgcgcatcgagtcgagagagagggagatccccccctagtttgtacatggcgttttaaaaaaacatcaaaatatttgaaaattttaataagataaaacaatatgatatataattccacgaacatacaagttcgaattcggtttatataattaaaaacaaatatgataaatttgattgttatatttattgtcaaatttatatttttatacttatatataaattaaatttgaacatacatatttgtggagtgatatattacatattgatctattttattattttataaaaacgaggaaaattgctatgcacacaacatgtacaactaaaattgattaacggttgtaaacggttgcaatgcatatgaacatattcttttttattgatctatgttgtactccttccgtttaaaaaaatccaacctcctactacgatgtaaaatattttatctatgtccagattcgttgtcacatcctagtacttgtttttttacgaagggagtacgtctttagttgtactcgaaaaggagaggagagggctttagcaggagctaagcagttgcgtgagttaatcccgcactctgtataatgtacagctatagtggttcttcgttttccttttatctctagggatttgtattttctcatactctatccaatgaaaaggcactccgttcaaaaaaaaaaaaaaagagaggagagtttcccggagagagagaaaggggaggcaaattgctcgggaaaagtcgggtgcttctcggccgccagatcggcggaagcgatatccgacgggtataacgccgccacgtagtcatccgcacgaggcaaatacgtggagcggcctcggctgctgcttcttccattcgctttcgcctacccgccgccgcgacacggaatttcaggcggcgccgctcgccggagaagtggtcggcccccgtcgagagggagggttagacagggagaaggagaggatgaggagcagcgaggccatggagctcctgggcctcccagcgcacacccgcccgtcgccttccgaggtattcatcttctcgattccctctctcgccgctccaccgacgaatctccaaatccgatgcttcttcctgggggttggtacggccttgattaggtagctcttgctcggaagaagcgattttagagctggattttggcgggacggggtgccaatttgagaacctgattgctatgcggttgggagttctttgagtttgtggtggtgttctgaacctctgaagcttttgattcaggttaaggctgcgtataggagaatggtgatggaatcgcatcctgatcgtgtcccgacgcatcagaagtctcaagccgagtcaaaattcaagcaggtcaggtacagattgatctctgatcattgtggaaaactcctaggccatcatgtttttcggtttcatggtgacggtgtgcttcaagcatgaactttatgatatgtgctttccacaatcaaatggccgatgtatgcttgtttttgtatcactagctttccaggacttatcataaacatgtatgtatatggctttgcaatactgcacgcggaagaatttttcatgtctgcatgataattagcaatactaatccgtttccagttggatgaatctgaatgcggatttaccaaatgagcattccgtacactttctgaagttgataaagtgtgagttttaacgtttcgtgcttctgttttttcagatatcagaagcatattcttgtttgaaggatggtatgtcacatttctgctcatctaaataatcaacgcaaactcattccctttacctatattgctactcactcaatcgcttaccaatgagatttttttttctttgttgtcgctgttttcaggaagaagatatgggagtaggatggaaggtaacaaaatcaatttcatgaacacaaaatttgctgttctttgtggtagctaatgagattcatcatcatacatgcagtacatgtgatgaggtctggtgttccgacgggatttggacgatcaaataagacattggttaaagccccttttctactcataatttttgcagcggtttcattgggtggattcagcgcttcaaggtaattcaaagatcccagagtttgccctctccattctgtttttatttctgaattgattgaggaatcaactttggttttttgaagagcataccagcggcagaagcaatgtgttcctctcagaatccatttcttccatagagcaaggcaattgtagcatttccctattgacaagcggagcagagttatgtgtacattgtaaaacaatcatgctgggaacagaagcaccaaatgcaagtcccatgtacattgtaaacaatcatcaagtttgtgaataaaagcatgagttgctctttgtggtttaccatgatagggtgctattatttttctgcctgtgccaagacagttcgtgctataaaacatgaacacataacagcattcaacaagtaaatggtctactgatgatttgtcaatttagtgatatttgttttcaacttggcacttttgtctccaattggtcagtatgacaaatgaagacatcaatactactcaactagcaaatctcttctagttgaactgttcatgattgcgacccaattgtcgtgttttcatttttttttcatcgtttgttcgactgctgataaattgtggaaacataaaggattgtgttcttgccgaactacgatgaaaagacatcaaaagttaactctaaatttaagttttaaaatttaacatattggttgtgactaataatccaacgagcaaacgatggacatattcagatatacattttgaactgaaaatatttcatatatagtgaacaaagaaagatcattacataaaccacgctgcaagtgaggtacaaactcagatctattgaagttgctcgtgctcatcctacagggttgttagtttatgctgattaaagtactgcatctctcttaaacacaaggatcaaccggaactccagcatctgtagtagcaatattaactcattcccgcattcctgcttgagttgagtgtaagtgttcgcagaacggctggattacattacacgagatacaactcatgcaaattatagtagttgcaacatgagaattcaagcatctggcagaaccagcggccgttaagagcctattcgcaaatcctaaggattaattactatgaatgctattcgattcacagaaattttcctttccaagttgttgagagaaaacatagaaaattttccatccactcaaacctcatgaaaaaattcctatggattgaagtgtgcatccattaattcttatggattgaagtgtgcatgcatttatattccttcaatattcctattcctatgtgtcgaactccaaaacgaatagcacctaaatagatttacaagaaacatgatactgataaacattagctgattcccagccttccccagcagagtaagccgacaaaaggataactgtggagacaatgcaagcacacaacagcacaaaacgaatatgtacataaatcatagcaagtttatagttccatggcacgctggcaaggttaccaaggcagctctaagcctctaatgcattactgacaatattgacatgtaccacaagccatagcaggggtagctttgtatccactcgaagactcagacacattgattaaatggacagcaaaggatctctgaacatcacatggttcattcatcgatccattcgtgttaagacgaaggggcttcaacttcggtactccattgaactgaacagcttgaatagttagcatattctggtgccactatggcagatttccacaaaatagacaataatattttgagcagatcataacctcccaatatcaggcactattatactgcctgaacaaaagatcgttgttctgtatccattttgctgattgaagaaccactggactatccttatcataccattaaccaccacctatgctgttcctggagtactggaagaaaaaccagtgacagtttgatcccaagttcccaactaaccactaagcttaaactagtaactatttcatctttagaagaaaggtttggcatactgtagatgcaccatcatactaataactttcaccagagcatagcatttgaagaaaccaccagggcctcaaattatccatctgacatgagcagacaaatgtaccaaggctaagctttcccaccagcacctgtcgtggcatcaaccactataatgttaaacgacaacggctgccaccctgaagaatgcggcacaaaccacttctttgtattgattatgatatacaaaatctgaagaacttcaccaagggcaagatgtttcaagcattgattctttaagacaattgcagcttgatacctgcaaacagaggatattgaaacaccataaaacagaattcaagaaaaagatacagaggattaacacatattgatgggtgtcaggccttacttggatctagaattctttatagcagagctgccagaggtggaagatatgaacctatgaacagcatcaaacgtatcttttggatattttgcatttatatccattatattcacacatttccaaagattttggttcttccccaaatagaatgacataggacctaacattttcaagacgatggcttgatgctgaatggcaagttcaagagccttcttaacatcaaaatttggtaagttagcttctccataacgtatacaatctgaaatatgctgttctattggtggaatcttctctgtcttcaatacttccaaagcacctaatatatttcttataagaccttgagggtcagaagatggctgtggatatcctgggttcactccccattgtccagcattttgcatgttgctgggcatactaggtggtgttggaggtctgtaactattataagcaggctgaacattatgaggagagccagaatggttagggtggtagttcatgttcacaccttggttgtcatgaattcctctggggtatccagaaatatttatccgattcaaatcaggataattaactggtgggctgtgatagggaggggcacttggccaggattgcagtggtgcagtaggagcgccattatgcccagctgatggtgagcatgagttggttctttgtgaactcaatgtatgatgaaaaatctcagatccactatgaggatgagtaattgaattttgtggtcttggagactgggaggtatgaggtttatgatgttttggattatagccaccaccgttgccagagtcaggagtaccattcttcgcagcagattccgctgaggcaccagacttcttactattgaagtcatgtggagcagtcttttgatggcaatgagcagattttgcaggctttttaggcagggaaaagggctgaacttttggtttacttgactggttcacctttgccccatcctgtgattcagagcttgatgatgaagatgacgatggcatagaagactgagttggatggtcagtagtgtattctttagaattatcagcaacttcaactgaattttcttcgttgcttgctggtttagatacattgtctgactggtttcttcgaggttgcttcactttagattgcttatctgccttgccattaccacccttttgatgatcagactggagaccattctgagggtttgtgtctgtagtagtgtctgaagaatctgaattaatgttcttagacttatctaactcaaccatattgccacttgctgtgctactaacatatggcgactctgctagaggtggttctccagctacaaggcttttccagagccaaacacttttcgctgcagcagtaagggcctgagacacatttggaggctgtgctagtagaatattgtaccgtctcattgtaagcttatgaagggcattagagaaatcccgatcaccagaaattaacaaatagtttgctggtggagggttgtcaatagcccagaacagcatgtcaactaagatcttcttatcacttgcatctttaatacctgccagttgataggaaacaaattagttgatatcaattctgtcattgtttaagagaaaatgaaactgtttaataatataagtcttgcaaattcatgaatctttttatgcaaaaaatttgcttccatgaaacaagctctagtttgcaagaataattaagaaacatggattcaaaatcagcacgcagctatgccaatgacatgtataatcgccaacattcagaagaatatctgggatgcaatatagtggttaaggctgtacaggtccggttaaactggattttgccaacccacacaggaataacatggtatgtgcctgtatttattccagtttgacaaaacataactaggttgattcacccctaatagtaataactcaaaatcattcttcaaaacattacacaaatcgtacaactgtggacctaagagaagatgaaaactcgaagacgcggttattagaaaacaaaattgacctagtctactacacaaagtcaaatggaagacatggctactagaggcttagaactttgtaacccgtagtatcatatccgcaaacacaatcaaaatcataacagcaaccagtacaaataactactgcagaactactg

SEQ ID NO: 80760 - DNA, 6014 bp, Oryza sativa
gggggttccgtttccgtaccggcggggacgtggttgagggagatgccggtgctggagagggcgtgggtgacggcgttgccgatgcggccgatgtcgccgtaggcggagatggagacggggccggtgtagccggcggcggcgagggcggagctcatgttctgggcgatgaggttggggtcgcaggcgcgggggacctggcagttctcgatgtcccaccacaccgacgtcttcgccgtcgcgtactccgccatcgccaccgccgccgccgccggtcgccgactccggtgatccccccctagggttcgccggcggtgaggtggggggagtggggggctggggtttgcgggcgtggagaggattttttattggttttcgacggcggcggcgtcgaggtggactcgaggagaagctattcttttgattttttttagataaaaaaatataattaaggacgatatttgtatatggataaaatagtttggtgcgaagtggagagaagtataaaaaaaacatatacacggatatccgtacctggatttgttttttctaatgcggggggagtaaagttcaatggatacaataagatctttttacttatgctaagtcaaaatttaaattttaaaatttagttttagagttgattttgtgattttttttataatgatttattttacagtatttgtttttaatcgttaaggacacgtatataaaggttatacgtataagttattttctaattgctaataaacctgtcgataagcatatgaataagcgaaacgattgcaccaaataaagtatttcctttttgaaatttagacgtacgtttttggaaggcatgcaatcaaatttgtgcaggaatccaaaccattagattttccatgcacacattattgaacatctgtagtagaatatatgcacgtggattttcattattactaaaccattttaaatttttgattctaaaaataaacccccaaatttattgaaaaagtaaactttttttaccacgccatccgaaggggagtagcaagacaatgcaaaggcagggatcaggatcctatgcagttgactgctccgtgctgttatcactgacatgtgataaatgcacggtaaagtgactgcagaggatctcatcaatccgcaagggcagtagcctaccacgtcattgcgggtgccatgtcatgggtttttttactggtgccaattaaaatagtatgattagagatgtttaaatatagcaataggtttttggatgggtttttttcaaaaattttaaaaagtgtttcaaaaacaatccatggttgttggttgctatctgttttctccatagaaaaggtaaaggttaatcatgacttgacagaaagattttatgtttttatacggaaaaagagagagcccacatagcagtgcgtatattcattcgcaaatgaaggctctcacagttcgctctacggctaataaaccatagaaaaataaacgagtcaactgaataaaaataatttatcggtgtaacttttattattctttgtattgtaaaaatcaaaactaaaatgaaaaattttatctgcaagtaaatctttttggcaggtacacagagagcacaatggtgatggtgcatacctaccatggaaagcaatgacctactatcaaaaggcgcagaacaaactgcatcatcaggacatggaaaaaaagcaaagctgcgtcatcgaaagctataatacagagtaaagtagtaaaaccaataaaagcagattgggctatagaacaggaaaatgcactactttaaagaagttaaatcagtgaacagctaaaggagaatgggccgatgagttaatttcttctcctttttattagaagaataaataaatgaatttagtaaaaagaaaacatggttacaaaaaaaatgatggaggcatcctttggaatagagaaattttagagaattttcgtatgaattaaaccaattactgtgaaatcctacaaaattcataggttccaaaagacttcttaagggacatgtgctggcccatgtagtagtccttttgcttagacaacaagaaagaacggcgtctgaagaaatggtttttgcagaaccgtgtaacttttttttaaaaaaagagaatcgcaacttaaaaggtttatgttccctcttcatgagagtgtacttatcttatgttttttacattgtgttttgtatcacatgaatgattaatgcgcaccatattgtttactatctcattgactcaagaaacgtccacactttgaggttttgttaagtgacgtgttcgtcgctgtctatcacggccctcgttctagcactggaaggccttgcctgttcggccgctccagtccccttcctcctcaatcttccgcatcctcgccaatggcaatggcatggagaaggagatccatatctcgtcctagtcaaataaagtttttaggtttttcctcaagtaaaatccttatagggttttagatttccgagataatcgagagtttatctttgtctatggattacggaatctagacaattattgacaagatagaatagatcttccctctgttggtcaagtttttatttaattggcagtatcggctttaggacctggtttgccgacatgttcacttatgccagttttctaactcgttggaagaatgaagacgatgatcgatgctcgtttatatggttttgcacatgttgaagttgatcgatgttgtgactgcactcatttgctcgtatctcttgtggtaatctaagatatagagcctctttgttctattttctcatattcttcctttcttgcttttgtaacaacagggttgtgatatatcctcttatttaatatatgggagaatagcatatttggtccttcaacttttgcttggagatcaatatggtcattgatatttcattttgttcaaactggtcctcaaagtctatctttcagtctgctatggtccttagacccaccagaaaacatcacgcacacataccgtctcacaatcttatacagatttgtcatgaaatgtctaatatacccttacatacaacataagagagaaaaaagaaaaatgtcacacacatttgcaaatactcaaatatatcgatttgtctatcaatacatctaacataatcaattttgtgtatatatcaattcttgggattagattaaattatctaatcatataaaattaattagttacagtatttcatatcacatacaaatggacagatcagacatttcaccatccatttttaataagatgatgacatggcatgtctacattacgcttctagtggacctaaggttcatattggaccatatgacaaagtttatagatctgattggaaaaaataaaatatcaaggaccatattgacctcaaagcgaaaatttagggaccaaatgtgctattctcccttaatatattttatcatgtttcgaaaaaaaaaacagaaaatagttcatgctttgttaactttaggatgaactagttggtgctaaactcaacaccaagcttttataacccctaggtgcatacttgatttgcaaaattccagaaccgacagcacgaggttttctccccagatcaatggacagagaagtttcaaaagctgcaaactatatgtagaacaaaagacattcacttgatgaagttagcttactactgataactatcaaagtacaatctgcaccaagccatgaagctcaacaagtacgagaagtatgaacaatgccatgtgcgtggcagaagaattctacatttcgctacaaggcagagtagagagagagagaaagagagagaggagacttgtgctcatgctgctgcaaagctgaagtgatgaaaccgtggcaactactgtagaaggttaacagctataggtggctggcacttgaaaacaatattccaaaccagcccaggaattacaagagacaagagcaacctaattaattacagagatggtatcaggacagggaagccttcaaggcaagggctcctccgaatctcccaaccgtgacaagtgcaggtaagcatcggtgcctaaatgacagaaaaggcaagactggtcagatcaacatatagtggattataaatctagaatttgtgataattgcaaaacaaagaaatacacaaaaaataatcagttaaacatggatggattgttcagcatctaattctataacaagtaattggactttgtcagcacataaaaaaacagaaaacctcagctaaacaaaggctaaattattagacattcacattggttagaaatcagaaaggaaatgaagtgtgggaataccgtatccttccatagagatgatttgcaggtcaccaccaaaatatcgagcatacaggcgactgattggaagaccatagccatatccagccatagttactccttcactagggcaatccatatcaggtggattctttgcagtgctatatagatatgtgaaaattcttggaaggccgctccttggtattccaccaccttcatcactaacctgcatcagcataacattgatgttgaaacacttaaatatcacttcccttattttatgaaaattccaactccctgatgtttcctcacatggaatatttctcaaatttattccaactagaatacattatatattgcaccaaaagattgagcaagatgtaacttctaacgacggaaagcatctgccacgtaaaaagacagtagcacctatcattcttgacactgaccagtttctagtaatgatagtaatgatatgccccacaaataacatggcagctgtacagaaaggcagcttgacttgcatcacataataacagtatatcaaataatgttcttcagctaattaaattttctgttcgtcaatattactagaaacaaatataccattcaatttgcatccacttcaaagataaaatatagcatctttcttactgccagattggtttaaagttgagacatgtcctgttcagcagccagcgctaattcttacctgatccttctgccagtcaccatccaactcaactaattcgatataactatataagtcagagttattcatatttgctatttatgccaagaatgttaagatcgtatgataaattggtgccagtggaacttccattacagtcatttgagtctaaaaacttgtaaaggtacaactcatttaatgactgctcatacccaggagctaggatgctattaataacagatgtttggtgatgtaatagatgaataccttgatagttacatcctctgccccatcagcaacgataattctaactggaggaacatctttatcggaattcatatatcgttcctgtactgcacgcaaggagttcttcaccaattcaaatagcatgagatgtagatgtgatgaaacatatctgcagtttacaaggttaaaggagttaacacattagtatgccaaaatttagtaggcagtaaaagatgaccccgaacaaattatgtcttataagaatagtcaaattgaacagaaaacaagctctatgacaatagaagaataatcacacaagatgcactaacagaaaacatgaactggactaaaacatggttaatgaagtttgaaaaaaactaatgttaatttatatcggagacttacggaaatgtaaaagttgggtctccatagatgtcaatctcaggagctgatccatattccctcaaacaaatagaacgggcatcttcactggcagcttgagccacctgtataggggacaattctgtattaatgaggcctatgacgccaggctctgggtcaggatcatgcaaagccacatgctgccctgaaattaagcaagttgacaataactcagaacaagaatctatcaataactagaactgcactcttatatgattagacaaattagcacataaaccaccatacgatttaggacaggttaggagataaagttgactaaaaaaagatgtcactgccggacaccaaatccagagttgcattatgacaaaaaagcagtgtcaagctgatgaagtact

SEQ ID NO: 80761 - DNA, 5883 bp, Oryza sativa
atcaatagtgcgtaaaagcgagctcgtcgttcctattcctcacttctggaaagtatctgatgtcgcggaaagagtccaagtaccaatcccgcaccttcaaatatggcgaacaaacccaccatcagtcccacaataagaaacttaaaatttgcatgaatgaattcagctgcgaaaattccttgattaaatatttactctgtgctgactccaaaattattctagtacaggcgtgataagatcaataagacagcacaacataaacttgaagcaaattaagaacccccgaccccactccaagagaacaaaattcaagcaagttggcgagcaagaatatctaaaattgccccccttatcctactttttttagaacacctttcgaatattaacaacacaaacacacaattgatgctgtgtcaagagttatcgactactacaccaatttcaaccaatacaaatcgcacattttaagtagttgcatgtggtagtgatgtaccttattcacactccactcccccagaattacctttcaaaaaaaatttcccagaattaatgataaaggtgatattctaataataacaaaacatgaaagacatcaaaggatccatccaaaaggcgccacctctttttagaataattcctattaaacatcactgcaagataagcagattcagataagcatgcaacggcataacccatccataatcaaccgagccacacaccgaaaactcgccattaattcatcatccatccacgggccaaaacgacagaacaaacaatcgccatgattcagtgtgggcatagagtaatatacatccaatcgcccaccaaatcatcaatcaatcaaccaatcgatcacaacgaacacacagagagatagagaggtgcgcgtggtaagtaactaccttgaggatggcgggcttgcgggagaggccgaaggggagggactcgagctcgagcgcgcggcgcgcgatccggattgggagctccttctgcaggaactgcgcggagagcagcaggttccgttccgtggggcgcgacccgaactccatcatgtagcgcaggctcacccccgtctgcttcatgctcccccacctccccacctcctccgccaccgccctcgccaccggttccgacgccatcctccccccacctccacctccacttttacctccttcaccggcggcgagatttggggatcgacgagcgcggcatgggaggccgagccgagctcgcgcgcttataaagcggaggaagcgaagaacagaggagaggtgtgtggcgtcaagaaaaataaaaaaataaaagaagaaaaaaattgctggattagcgctgcactggtgtgtcccggatagaaggagaggaatatggtggggcccaggtgtcagtgggagaggggtatcccgtgcaaggtctgtggggccgaggtgtcagtgggagagggtggtttactggtgtccagcgctaggtctgtggggccgggtgtcagtgggtggttggtcattggaatctgttgttagccacatgagcttatctactatgaattagtgggataaatctcaggacaatcgccccagcttaatcatgtgtttttttaatctatcgtttcgacatttccgtaatctttatccaaaagtatgttgtgcttagtgtaaatatgttcgatcagaatttccgaaacctcaaaattcaaaaagttctaattggatcgaataaacaagcattcctcgtatattaatggccgaaggaatatttttgaactaaattaggcctatgtttagagtacaattaaactttagtagagggatgcggtcatggtcgacgacgaagacgacttcacacggaaatttggtccaatggcactaccaggagaatgaatcttttttatgctaaatgaatcatttcatttatgctaatttactagtggacactattcatggaagattcaggccacatgctcattttccccccacatgcatgcacaacaccaccaaaccgcagaaaatgaccccaaacgattccaggcctcaaaattctccaaaatcaagaataaatatccatgggttaaatttttaaaattaaccatatcagtaggaaatatcacagtggttaagaatctttcagaaagagatatggctagctttataccataagttgtgatctaagtgacaaaggccattggagagagttccaggcatggagcgaggcaggatggccacaggtttggatccatggtggtggagagatccaacgattcggcgcaaagggagaaccataggttttgtttgtaataatcatcagtgtaatacgttattaccttcgaggcttaattcttttcggattatttatcgaattgttgaaacgaattgtttacttcacgtttttaaaaaaatattcatttttttgaatgaaaaaaactttcttctactatatttgctcagagaacttgttttaagagattatcaagtttatttaccaaaacaattaacttgtgtacaaaatagataaatcaaaaataataattcgctcaacgatctatttcaaatctaagcgtttagatcacttgattgattccaactgtaataatcaaggcgttgcttgctcggagagggcaatgatgtgggtcagaaacatcgctagctggtaattaactcgcccatttaattaacagaaatgtgacatctctgaaaccaaggttcactgattggtctgcacatagcattatatggctagagatatttgcaggagcaacattaatttgtgacttattatttcacttaggcccgtttgagttcacgacggacaaacattaaatgcgaacatgaaaaacaaaaaatattaacgcttgattaggtgagtttgaattattttaaatcttaagaaaatatatttatttgatattttaaaacaatttttggatagaaatttttcgtacgagatgtaccgtttaactgtttgaaaatcacgctaataaaattcgagtaaaatatgtattttaatcagaacagaaccagaccttatcacttatctgagcttgataaatttccgataaattagagtgttctaatcagttataattcgtttcatgatttagggcggaattattggcggcaacacgactatcagttggtacgactcatagtacagcggtttgtggtgggggctatggctgtggatggatggaggggaatctcttttaatttctctgtgtgacacgtcggtcggcccaataatgccaagggatgaagttgacacctctggatgaacgcttggccgccacgtttccgtctccttggtcatcacggattccagggccaattagctggctggttcacacgtagtcttccgtcgttcatgttggtcatattttaattacgtttaattacacgctctgtggagtatacatatatgccacgtctcctgtgaaacattgattaaatttcacaaaactatatatttaagataatatattacaaaactacagatttaacactgaatttctcataaaattatagatttaaggtagaatattataaaactacagatttagtaacaaaattatcgtggaactatatgtttagcatcaatttaattacaaaacttagatatttataactcaatcataacatattagtgctaagaatttaaaccccaaaacctatatctttgtgataattttattattaaatttgtagttttgtgatacttaatcttaaatctgtagttctgtaataatttcatggttaaatatgtagttttgtaatacatcacattaaatctgtagttttataataatttgatcaaagtacctgcagttttgtgaaatttactctgaaacattttttggtagaagcacactgtatacgcagactctcgtagcacacgtatactcactcatatgaacgtacacacgcacatcttactcatatgagcacctccgaaagactgtgcgagcatatcttgagattaacgaagtcatgataggcgtctagcacgaaaaaaaaattaacaataaatacaagcatcggcgtaagtctaggacttcaacttaggtagactgattccataaaaaaacataaccagttgagttacactcacttcacactttatgaaacattttgacgtgcctcaagccatcaaccagaattattcttgtaaattgtttaagcatgttcatataatttttgtaattatagcatcttttaaaatctacagctccataaaccgtagttatcaaacctagaaaataaaaataaactagaaactgggaaactaatacttcttgattctcaccaattacgtcttaaaatctcaggctcttcaaacaacacgtacgagctcatctctataaacgtgcacatgcatacaacgtacactataattgtcgatgagtgatactcgtaaaccggatgagttgggtattgatgtacattgtaacgaggatctatgtaatacgacatcaagcaaacagaagataaggattatactggttcaggccccttatcaggtaatagccctagtccagattatatgggactcatgatggaaaaacacagaatacaatggaagtagacgaattcgatgataccgacgagatcgtagtcgatgtattcgacaagatctcccgatgacttggctccgcgtactccggctttgtaaaccgtggtgggtgtgttggcgatgatattcgatgccttgtatccctctctgggggtcccttttataccatatatcatcttgatctccaagtaagactcagagacatcaaatcccgtacgagacaatagaaactctatcccctcctagtaggactttggaaatcacttaactcgtagggatattttctataatttgtagcggattcctacaacacatacggaaataacccgtgtacatgaaggtataccatatccatatattccataagtcgtagaataggaggtatgccttattcgtaatcatgacaataataaccatctctgaaaactgaaccagaatatctctagattgatgaagtcaccataacgccttgttatccatgtgtacattaccttaagaaaatagtcgtaaatatgaacactcgtcaaatatagaacttgaatattttaccataagaaatcacaccaattaagcgtgcacctccaaacaaagactctagttagtatattatgcaagaggagtgacacacgtcacacgcgtacagtttattaactcgaccggatggaagacaaaaatggttggaacgtacagtactagcatatactcgtgtaacggcattgaatatcgattgatctgtcacatatcattgttagtaacttttttgacaagtcgataagcacgatcacaacatctaaacgtcttgtggtgatatagagtcgccaaccacctcaatctagccgaacggccaaatcaagatgggttttaagggaaaacaactaaaccggctagcgaaactgaattagagatcaaaatcagcctctaggccgatttagatcgatacgaggataactacccgtctcgtgggcaaaacggaaggttttcaggacaaacctataaagaggtgtcgcactctcgcagcggcagcggacggtttatggcgcaaaccgacaaagatggactaaactagggtaaaatataaaacatagtaaaagaacgattcaaatagattgtattcgggggttttacaatgaaccggccttgtcccttaaatagggattggtcttgccctctacaggcccttctctatgcccaactcaggatagaaaccaaaggaaacacgaaacatgccttcccgagcaaggaaacccgagacccgacaaaaacagacttggactcggaccctgcccgtctgaccgctacatacctgcggtcagaccggccctacta

SEQ ID NO: 80762 - DNA, 2030 bp, Oryza sativa
agaccggccctactagccggtcagaccgcccacatgcctgcggtctgaccggccctgtgaaggaaacccgatactttccaaactttggcaattttcccctatttcgtccataggtgccaaatttgggtgtaaacacatgccccccctacctttttggtgaacatacgtgaacctaaaagtatagaacatgttatctcagggcgataatccaattaccagccataggacttcctaagtatcttgccaaatgctcgggaagtatttcttcaagtatttcccattaatcgctctctgaaaacaccgtcttgaagtatcttcatctcctttaaagtcttcaaacgcttgtcgatgacgtcttcaaaattgcttcccatcaaggtcttgtaatcttcaactgacaagtcgtcttacttgaaataccgaagagagccaagatttacctcaactggcaaaacggcaatttcaacaatgtttctttactcgactcggcttatccattagcctgagtgtagtaaagagaagaacttaacaacttaatatcataagattcagcaaaacttctttggacataaaagaagctcctttaacgtttgaggaataccgaatctatgaacaatatgcttcaaaataaagtcaattacctccgtacaagtaatattctcgagcggcacggcttcggcccacttagtgaagtaatccattgcaactagcacgaaccaatgcccttttgatgacgaagaataaatttgaccaatgaaatctaaaacccaacctcggaacggccatagtttaatgataggattcaacacagcggtaggcgctaattgaacattgccgatccgttaacaagcttcactccctctataacatttgaaacaatcatcaattattttcggccaatgaaaccctactctcctaagcagccaatttatcttacgggccgattgatgaatttcacaaatcccttcatgtagtactctcctagaaactttagattgatcattatctaagtaatactccatctatttttcggcgatataatatttgagcgcttgccgctgaatcttccaattaaccttaagtgtaggatctttcaaatatctaatcaaaggaattccccaagctatttctaactcatgggcacaaatgtccgaattcacaattaattcggccttttaatcaattgtaacgtgccccccagcctcctgtctgagatcggtcagaccggccacgcaatgccggtcagacctccctgtctgctcggtcagaccagccatgcagagccggtcagaccgccggtaccactggtcagaccggccatgcaatgccggtcagaccacccctggtctatgactttgccaatttcgtctaaacttttgaaatcaagcatcggcctttagtatataatttttcttcacataatagccagatgcttggtgtatcaaattattagaccaaaattccttctctctagacatatgaaaaactataacatccaactaacatgtctagatgaatactaattcaaatggcttttaaaacaataatcaccatggcatcaaaacacttagccaattgaaatatgatcaataatgaatcaccaaagtcatatgcctcacacacatgaattccaataaactacaaatgtaagtaatcggcttgagcatgtatgtaaaatattagcaatgccaatgtttctaaagaaaacaattgtagaataaatcatcacattgaccattgacattagccgaattactaaataagcaaaactttcatggtgtaataattataaaatctatatcttatatggtgatccataaaaacacatccaatttggctttaaataaatatcgaagactcatgagccaaatcatacttcaaacaaattatatgccaacctaccaattccactacttagaactggcatttacagcatgtatgtataatatcaattcgataagcaaaaacacacatgtgctagatagtaagcaatgttctaacatggcataggcatataatataaataatgg

SEQ ID NO: 80763 - DNA, 16711 bp, Oryza sativa
ggggtcctacatgtcattgaaataccgatggcatatctcaaactttgaaaaattataatggtatggttacaattttcccaataatataatgatgaacacaataaactcataccttgccttagaatctaacaaacggcggctcgaagatgtggtattgtatccatcgccgttcatcttctcttggttcccttatgagcatattaatgtcttgccccctaagcaaaatcggccttcttgatttcacgatttcgaaggcaagatgaataccgcactaacatccatagcatcatgtgaagaagacttatctttaatgaccgatgattcttctctcatcaaattgaatccatcactactccgtgaaatcaccgatcttttaacttttacttctttaggtctccacactcgcttaagtgtcgttcaaggctctaaattgatacatgttttgttctccacatcttcggcctccttttctttttgacctatggctcgaagacgctgtagcctcctcttttgagagcgagataagccagaaggtatccacttcagctgtggttgttttccaggagctaagcaatgattcttcatatttttggtcgaagtggaagctcctatgttgctctcaattttccctctcacctttaatgccccccagtctaatcggcctctgggcccggtcagaccggctgcaagccatcagtcagaccggccagtaaggtcggtcagaccggccgtagactggcggttagaccggccagctgtcttggttagaccaccaatgttgacagtcacggcggcggcttcgatcttctttgcttgcgtggtttccaccgcatctccagtaggtacatgaacatattgagactcctccttgacagtgacgacctccgaagctttggcttctttcctcacccacaccttcttcacctttttcacctttgatccaccggaccgattcttttgtgggaaacggtcttgtcttgagttagaatgacttggtattgtcctaggtgattgcttccatccttgatgacacggcatatgtggttgaggcatccatggaatgtaatacataaaaggataaccaaatgatgacattggatgtggataccatggcatcacaaccggaggtttatatggagttggtatagttgatggctccgattgctttgatgtttgaccaaatctcttcctacgagatgatcttggtcttttcgaatcactagtttggttatcaaatcgttgaccagctaatcctttcttgtacttagccataagcatctcaaaagtgagcttcggctttttagtcttttgggaactagatgacttatcttttgtaactttatgatcttcagccttcgcatttttgatcctattcttgggccgaggatccccaataataacacttttccctttctttttgccaacaccaatagaactaacagggagaggatcactaataattccggtcttaggcatagatgtaaccgaaatagtttcacaagtgaccgatgaagtatcaatcggtctttgctccatcaagcttgcatctttgaaataaccatgaaactcatgctccatttgtgaccatgtagaaattgaattaggagcaaataaactataccatgtagatgcaaagtttgacaaagaaagaggaaacaattttaacttaagcaaatcatcattaccggccttaccacattgatcaataaattggtcgatatgctccattgttgttctagcatcctcacctgtgaatttcgtgaagttgggcacctcaaatccttgcgggtatgggaccgaatctacgtactcaggatacggcctttgatatgtatgcatagctactttggattctatttcaccactatcccgcaagacattgtcatcatcttttccaacatccacatgaccgatttttgattcggtcttaggtgacaatgctatttcattttcgcttgtaatataatccgaaccatcacttagttcggctatattttcaatgatgctattctctaaactagcaatgcaatccgaaccattgcttggttcggctattccattattgtctaaattagtaacacaatacaaaccaacacttggttcgactataatggttgttgcattatcatccaagctagtaagacaatccgaaccaacacttggttcggatataatcgttatgacatcattgcacaaattattaacacaatccgaatcatcgcttggttcggctatacatgatattgcactataatctaagctagcatttaagctattgtcatccactcggctttcctgagccagagcttcatgcaacacatgatcaatatcaagaaatatttggccattcaatttctctttaatagaatcaagaaatccatcatatgcaatgttggccaaatctttgtcagttattttcaaactaaaacatcggcttttaatatatctaaaccttttaatataatcagcaacagattcattgtatttgtgcctaaccgatgttaaattagacaacctaagctcagtttcactagtgtggaaataatcatgaaatttttgttctaattgagcctaggaaaaaatagaatttgccagtaaaaaagtaaaccatgtaaaagcagtaccggacaaagataaagaaaacaagcgcaatttacatgtatcccaattatcctcaccatattgcgctaaaaattgatctacatgctcccttgtggtcctactatcctcaccactaaacttggtaaattcaggaattttataaccacgaggatatgggataatatcataaaaatcaggatacggcttttggtactctctagcacgattccttagctttgcgatattctccctgatagtatttctaaaccaatcctccacagtttcaggctttggtggatctggtggtgtatttggtggcctaagaggtggttattgtggcgcaatataattatattggccatacctagtatcggaaggatatcccctattagtatcattgtaggcattaggaatatgtggaatagcatgtctaacagtattaacaggtgatgaataataattaaaattagtactgctaatcgtggtatgaaaacctggaaaaactcccagggaaccggtctaaccggcccatggcccggtctgaccggtggtcagtggtgcggtcagaccggccacaggaggcgcgatctggccaggatagggcacagtctgaccggctatggtaggcacggtctgaccggcataggatgcggttagaccggtgtcatgaccgatcataccgttagctaggttttgcatatagccgattcctatgtaatcggctgtataatcacacattgacccccatagcattataagcatattgtataggagcaaaactagaagtagcatatgcatctatacaatgatcattaaccttttgaatagcaaagtatgggttgggcgaatcggaggttacctttggtgaaactacaacttgaggtagcgggacatttcctctcacgacgccttgagtaatattgttgaacccgttcccactcgtcatagttgatgaagaaattccttgattaatttcggccatatagctcatagtcgaaatttttgaccgaatagattaatatacggtctcgtaattttcgttgcatactactgtgtgtttgtagcaaaaatttacaaaaactgaaacttcccagtgatagccgatgcaaattgaatcggctttaattttttcttttttaataattcactcggtttctgtgcacagcaaaaaatatacagaaatcaatactactgctgctggctctagatagatcggctttgtacagcctgatcgttttcttttcagcacacgttaaacagcaaactataaataggattggatttctgatttttcagaccgtgtacagcgaggacactaccggtcgcttgttgctgtttccacgcgagaataaaaatcgattccggctgtatagccgaaacactcgattagatgggaaatcgatgaatcgatggcagcaatcagcttgatgaccgaacagtatcgctgccaaatagattgatccaatcaaaaatacgtggcagcagtgacgaattttgggtagattgatttcggccgtttggccgaaattcttgactcgccgaaacgaaaaagtgactagattaaacgaaattcggccgtgatatggtcgattagatcgtttcccagcggagtcgccaaaaatcatgttggcaacttttttgacaagtcgacaagcacgatcacaacacctaaacaccttgcggtgatatggagtcgccaaccacctcaatctagccaaacggccaaatcaagatgggttttgaggaaaaacaactaaaccggctagcggagccgatttagagatcaaaatcagcctctaggccgatttagatcgatacgaggataactactcatctcgtgggcaaaacggaaggttttcaggacaaacctacaaagaggtgtcgcactctcgcagcggcggcggacggtttacggcgtaaaccgataaagatggactaaactagggtaaaatagaaaacatagtaaaagaacgattcaaatagattgtatttgagggttttacaatgaaccggccttgtcccttaaataggggttggtcttgccctctacaggcccttctccatgcccaactcaggatagaaaccaaaggaaacacgaaacatgccttcccgagtaaggaaactcgagacctgacgaaaacagacttggactcagaccctgccggtctgaccgcctacatacctgcggtcagaccggccctattagccggtcagaccgcccacatacctgcggtctgaccggccctgtgaagaaaacccgatactttccaaactttggcaattttctcctatttcatccatagatgccaaatttagatgtaaacaaccatattacatcattgccgggactaacatgaggcatggagaatcgcacaaacatgcaactacgacctacggatcgatggcgcacgcatgtgttgttgtttgggatcgtgtcgcgtggtgctgtaaatattaattattgatcgaattcgttcgttagagaaacagctcgggatgggaattcccttctgtactactcatgaatctggatatttatattcaaatttatcattagaattagatttttatgagacgaagaaagtatgctactattagagagtccgatatggtgttcgcatgacctgcttctctgaatgctaggagatctagtgcgtgtatatgttgtaatggaactatatgaaggaattacatattattatcatttcaaatattaatataagaattcatgttcctcgatatattccacttaatagcatatgggcggttggttctttaaagataatggaataatacatcatgcctttattttagaaaaaagctaatatataatcacttattacaaacatagctcgcttaacatagagatgctaaaaaaatccaaacatgacgaggcaataagtctaaaaactccaacacagaggagaaattaatacatcttatttaattttatttgtaaatatctatccaaagttggtgaagatatgtgtgaccgttgactctaagttccagtatgtaatatgtattagttcattatcctcgtcatattttatattttttagttgtgcggtgctaatatattgccttggaaagtacatcatccatataagatttagttaaagatttatcaaaaccatattatttatactcaaccataaagtccaacagaaaaacatatggttctactaagttttttggtttttgagcatatcattctaaaaaaaaagcaggcacaccaacacgtgcgctgattttgattttatagtatgattaataacaaaccacccattctattagagaaagaaaaggtcaaacggggcaccgcaaagctacagctacagattacacgcaggccaattcctatttgatttaaggcaggaaatgcgtgtattcgatctgtttcgtctatctgacgcataagagctggatgagcaccgatcatcaagacatcaacgtgtgacagaagatcgatgaacagttgtacactactacaattctgcttgcctgtatttaggaacaaaagtataataaatatttgaaaaaaacattgcacgctatctacgtactgactaatattttttcttcttcttattttgcaggcatgcgtgccaaatgagaagtcgttatattagcttggatcaacgggtgggcatgtactggtacgtgcaaaagcccaattcatatttttgtactcgtgatttgtcatcctgatcagtaactactaactagaggcagcagcactacgtggaatccggagacgtgcagtgccagggcatgcatgtgaaaaaaaaaaaatgaagtgcacgccaaattgagcaaccttagccacgtgcacacgtggatggataacgcacgcctgcaagtagtatagtggcaaaattatgtaaaccatctcaattatcactcttgttttgtgatttaatccattacttattttgtttcaaaaacctactcacccaacactaacataggttgaaattgccttatcaaccctcccccaccaccccaacccgcgcacgcgcagtccaaattttttctaacttaaatgtgcgccaagccatatatagcatccagtctcgttcaatattattaatgtaatgaattcaactcgaactcattctatgaaaaaaaaaacagtgttacttgtaggggtggaaaaaaaatttgggctcgtgagcagctcgggcttggctcgagctcgcttagcctggctcggcttgaatgccaaacgagcaagcccaagcttcctttttagcttggttctgaaacgagccgagcctgagctggcttgcgagccgcttgatttggctcatgagcctagcctaggccatcatgtatttatatggatgattttttttctagtgaagttattatttgtcaatatgtaatttatcatctatattttaatgaatttaatatataaagttattttaattttacatgttgatgatttgttattgcttttcttaatgattacaaattatatagcttcaatggaaggctcgcaagtcagctcgagctagctcgagccagaaaacgagctgagccgagctcatgttttagctcgtttccttaatcgggtcgagccaagccaaacctagcttattacaagccattgcaagccgagcctagctcggctcgtttccacccctagttacttctagcttacaaactcttcgttggaccttgagtggagaaatagcctaaggacaaatccgagccagctgatacaaatccgcgtcaaaataaaatgggtcgaatgtgctactcacatgcgtgtacatggcaatttcaacatgtgagtgttgaggtggatgagtttttggaataaaacaggttgtgacgtagaatataaaaaataagggtaacaattagagtggtttacgcaattttgcatagtgcattccatgcttgcttgaatggacttcgacttttgatgcaattacttttctttctctttgattgagatggcatatatgcgtttgggccttgagtagctgtcggcctaatttgtacaggccatttaagagcaatattatccggcccataaaccgattggtgggtccgagctgggcatcgccatccgcaatagggccgtggtaagccagattgggcctgatgagttggatcgaaaggcaaactttttttcttttgccgtcggatggataggatgggagtgggaccatcgacaacgcatgccaccaacgagtgagacctaaccgctgctggcttcctgccaactgtttttttcccaggttctttttttcccggcatttatatctaatcggatatatgcggccatttaaattaggaacttagcctcataaacaactcaatctataattcgcttctatgaagatgtgaactcacgaccttagggtactactcaggtcactgtaaccattaggctacatgcttcctgccaactagacgacctaatcgcttactacgtgattcgtgtataaaaataaatttattttaagatgaagggtataaagaaaacaaataaatggtactgataaatgttatgtgtcatgatatgcttaaaaaaccaccatgggtcaagaaaaggaggaactttgctcccttcaatcacatatttgattttccttcaaaaaaaatatgtatagagatgtaggcactcatattcacacgagcacacttatctatataaagttttaaaatttttagcaatcaatatcttctttaaatatgcaaatcagtcgaaaatcacatacaacatataaaagatttatgttaataattacgtcatatcgctattttagcactatgttatatgcctactccttatgtttttgtattttaaaacctaaacccttctaaaacttttttccataatctgaaccttttaatcacaccagcacacctgatgtggtaaaacaatactgacacgccacactcatcgggcgtgacaggtttgtccggccaaataacattaccacgtcagccggatcagcgtggtagtgttgttttgccacactagtctagctgacgtggccaactagttcagatattgaaaataatttttgaaatgatttatttttaaaattaaaaaatttaaaagttcaaaaaacaaaaaaaggatcactccttattgatatatttgactaactacatcgatgtttaatatagtaggtggctctcatcttttctctatggtttatagtttataaaccatggtcaaattttaaatttaaaacttgattataaagttttttttatcgtagtttattttttagcattagcttttaatatcgcttaggacattgttaaggtaggatattaaaccaactctatgtgcatattaaactttttcatagtaaaaaaaatattgtggtacctctcctttttcaaaccagcattaactcaacaaaacttacctacctcccttagagcaaggataataatatagcccacttcctaatattagcccattctaaagtcaacacatataatagattagctataattttcttctcctatctctatctctcacttatacatttaatgtatttgtcttgaaacttgtgttaagctagcttttgcatgagagccaacaccattctcttttgtttacctctctcctccacatgagcttatagtatgcttatagctcactattatacttgctcttatctcaaaatcaagcaacccataatgtgaattttatccttaagcttcgttcccctcttgcttttccctccctaatcaactggaccgcacagctaatacccttgtcggatcccgactccaccccacccgaacccgctacccgcacccgcacccgcaccaacccatctccttctcctcctaactcaactcgactccaaccgccgctcaccggaatgcggcggtgacaagacgaccaaccacctcctgcgactgctcggatcccgcgacgcggcggcggcggcgaaatacggagatccggcagctggaggcaagagagagagaaagccatggcgagcgacgtgcccatgagccccgacctggaacaggtggacggcgagatccaggacatcttccgcgcgctccagtgagtcaaatctccccctcccccaccgccgcctcctcctcctcctcccccctccagcattccgcccctccctccaccggtttagtgggctgagaagcttctcgaggcttctgcggaagcggcggcggcggtggctcagatcttccccactcgcccaatctgcgctcgaaattgttcgcgggttccgctgctgggtccactgcttttcgtttgccggaatgggttccacaagatggcaagatcaaggacctcaacaggcatctccacggcgctggaacatctcaccgggaaaaagacggactgcacggggggggcctcccttgcctgcctgaacactactgggtgctctggtgatgcacaggctcacgcctgaacccatggtttagtttagcttctccatctgtgcgccattgatgttcctggcttgaacaagcaatttaaatctttttgcatgtggcgcatgagttctgcaactgctctgcctgttagatggagcactaatgtcttgatagatttgtgtaaatgtgatgatttggtgttttctcgcagcttaatcaaagaatttgatcgtattctcaaagaggatgagaaaaagaactcggctgatgtcaacaagcagctaaatgataagaagcagctgatggttggtagtactagttttcttcactagtgtttgtgttacccttactggacaatttagctcacaagtgtaatttgtttcttgtgtgttaaaacagatcaaagaattgaattcctatgtcacattgaggaaaacgtaagtagattttcccctttcgttatgcatgtgttattttttttccttatgttgaattcagcgtttcatttgcatatgtgatcctgttacattgtacatcacttgtggtaatagacatgcaactctcatggtgtttcaggtaccaaagcagcctgggtaataagaggattgaactatttgatactggtaatgatcaggtggccgaggacaacactgttcaaatggcatcaggtggttgtagtttcttatatcattgttaacctgcccctgagaggtaatgtgttcttattctaaccaaagcactttggtaattcttcagaaatgtcaaatcaacaactcatggatgccggaaggaaacagatggaccaaacagatcaagttattgagcgttcgaaaaaggtgcgctagtagattttgctttcatttctttacacacttcaagagcaaattttacaagaatcctttcttgtaggttgttgcacaaaccgttgaagttggatctcaaactgctgcagctctatcacaacaagtaagttttttgggatgataaaattcaacagaatattccttggacgtttcttgttagaaaggtcagtcctgataagtttaatccagcaccctaaaattctctttacatccttttagacagaacaaatgaagagaattggcaatgagctagactcggttcacttttcactgaagaaggctagccaaatggtgaaagagattggtcgccaggttctctctctctctctccccccctgcacacacgtatgttactcgtttcgtcccaaaataagtgcagccctctagttcaaatttgaactagaaggctgcactcattttgggacagatggagtatatttgaagtggctgtgcctagacttacaagattcattgctgcaggttgcaactgacaaatgcatcatggcattcctatttctgatagtctgtggtgtgattgcaatcattgttgttaaggtatgttttaattgcttttgcaaatgtacccatgttgtttaccttaggtgacatcacttgttgagataaaaactgatcctatatcctccgtatgtgcaagttcaactaaaagcccatgacctatggtgaaaatttctgtccagttaattgtagagccagttagtgcacctagctagtttctcgttaactctacgtgttctattatatgttggagataagaatgacgaataaaaggagcaggaatacatcatttggataataactagagctagtgatcagtcccacatttggtgtgttacgtcatgcaatgctatacttaactgattcagttccagaatgtcatagattgtttcatttgtcacattttacattacaagctagtcttacattactatgcaatgaatgaccggtctgccgttcttccagattgtcaaccctcacaacaagaacatcagagacatcccaggactggcaccacctgcgcagaacaggaagctcttgtccatagaatctttcggaagcctctgagcattgcgagtgggaggcaaccgagatgtttgggagaagatactatgcacgtcgtgacaattcttttgcgcttgtatatcatctcatgtcgttattcccttccactgatctattcttttcttgctgtaattggtcattagtgttggatttacgtttgatggttgcagtgcggcttcctgttggctttatgaatgtgtgtatatgtggtagtgatgaggatacaaagatatttgttgttctttttattctgcaagtaatcacgtgaaggcttcagtttgcagttgttccagttttcatatctttgtgaattgtgatttgcttcagtctcgtcagaataaaaaggtaacatattcgtacaaaatctaacgcccaacttggcagggtcagacaaaagcatctgggcaaaacaacgtcgttcaggccaaaacgtaaaataaagatgatagaaatgcaaggatcctagatggatcactggacttatgttacagtgcttgcaaaaggttaccgggcaacaagttatcttagctcttgtacgtcccaggaagaggagcttgtgttaactgattaattaacaagtaacattaaccctcccatggagaggaaggctatgtcatctctcggatcgaactaaagaagaggcagttcaggctgtagagggctgtgcatcctcgtcggacaataataggtcactgaagaaagaatcagtgagacaatctttagcggaatcatacttggctaggcgtttcttgaacgctcggagctccctgtcgtctttggaagtaaatgtctagcaacagttactgaggttagcaatggtggcaaatttgatttgtaggcaataacaaaatcagcgcaaattcaaacgttgtcaggaaagatgaactcacggagtatctcttctgcagtacgatatcgacaagataaattagccatacgacgtttgtctttggaaagctgcaatgacaattaaacagacctcaaatgtttccgattttgaaagtatttttctatcaatttctgattaaaaaaagtttactgtagttttaaatccatgcaaaagtaacttcagctagtgaatagccatacacatagtttgtgagtcggctagaataattagtactttgctattgcaagctaacaaagttggtctgaaactacgaatcctgcaacaatgtcaatgacacgcgtatgtaaatggctcaagaattgttctgtcttatgtagtggagtacttacctgccctcccagtaatcattggtaatctgtttcatttttcggtatgtttctgcctgcatattataagaaacatatattacactagcccaaaatgatttaacatgctactttcaaagtgatcatctgaaaacctgcttatctcgttttggtccttcaaataaggcagggtccgttgacaggtctaaaaagaggatagcatcacctggagagtatcattacaaacacaaaaattgtcaaatggacaaaacataacacgtaaaaggctaacaaataagaaatgaccgtatcactttgctcttgaggaaaaaagaacaagaaccacaaaggtgttacatacatgcgtagcacttgagatgcaaacttgaaatattttatggagctaactgaattgatcatatagtaataccagaagttaacgtacatggactagccagaagatgggcatattcagctaggatctatcagatccaatatgaacttggaggtgcaaatgtaattattactcactccgtcccaaaataagtgcagttttgcactgttcatgtccaacgattgactgttcgtcttatttgaattttttttaagactagaaaaaatgcccgtgcgttgcaacgggtgaaggctattttaatcttattattattatatacggtttagttaaggtgaaatttactgtgggaattcgcttggatatatatatatatatttagaaaatcataagctgcaattaggagttcgattgtctcaagttagcacacgagttttttaaagagattttttatacgactcctactgtatttccaaaagcgaacaaacttaaaaacagactcaaatacggatatgtattttcaaaagcgaacaatcgtaaaaaccgtctcatacacgaatggcataccaaaataccggtaaaaacatctttaatttttataatagtagagatagagaagaaaatatatttttggaaaaaatttgaattgggaatttattttttaaaatacttataaataaatattaaaaattctcagtaatagcgcttgtgctgggtccacccatatatataaacacgagaatggcttggtcaacatgcatgcacgggctgacatgaggacaacggcagattggcccaagaggtagatttgcatatgcacgtgggatgtgttgtgtggactgcaaacttgtgcctgacaggagcagttcatgggctgcccagttagaagcttggcccaggcagggctatttcatacgcgagcgcagttacagacatggaaattaatcgtaatcggatagcaagttgattcgagggaaacgtaaaacacaaggaaaaatacccaagaacgttcaccgactcacaattggtcgacgtacgaaaagctaggcaaaaatatcttgaatttttataatagtagagattagtatttttattgttattagataataaaacatgaatagtactttatgtgtgactgattctttttatttttttcataaatttttcaaataagacggacggtcaaacgttggacacagatacccatggctccacttattttgggacggtagtattcctctgcaaatgttttttgtggctaaaaattttgcttatgatcacaacacaaaagcatacaaaaaatcaccagttttagtaattctagaaattgtaggccacatcaaaatttaaaactacaaatgggtgcagcataatgtaatgaaaaaaaatattaggttcatggagtacctgtattgatccgagaaagcgtaaaatcaattattgagacgttcaaaccaaaagttctagtacacatgtttttcccttgaagagtgaaacccattgtatgattcttgtcttgtgtttcatctcgatccaatagaatgttacccctgcgaaatgagccgcttgtaagcaataatagacaactaaaactgagaagaaagaatatcaacaattggtctgagcagttggggttcccaataggaaccttaaaaacaactcaactctgtccacccattgtcaccacctatattttgacccactttaagtattgttaggattttcccagctacctggtatattaaatccacgtgtacttataaaaatatcaaaatttcacattctaaatattggcccttgttttgcatcctgtacaaacacttaacaaaactaaaaagaataaactacctcatcaatgttacatcatttcgttggagaacactaaactaaggatgtgaatggaaatcatttttgaaagtacaaaccaatgcaaatctcgatgttcaaattcgcacgcgctttcagcaacagctaaagcagcagtgacctgcatcaataagatgatttatagtttatccaaagactttgtagttgaggtaaagttcataaaagcttaggatacaccaggtttatacttgaaccaataaactgcaagcctcattgtagtcaagcaaagcaaatttttcaaggtctctcccaccatcagcttgcacaaagacaatatagcactgcaagaaagttacaaaaagatgtgataaccagaagaaatggtcacgcatgcttcaccacaataactgaacgatgtgtggtttgaacgatcagaatcctacttgttcattcgaaaaatcatttggatgatcattctcagaacaacatttggcatcccaatcttcccaagcacaaataagtgaagggtcatatggaccttgacaaacccaaaaactgcaaaaacagacaaatatcagaagaatttaggccacttggttgttgggtaaagctggcttagtcatttcatacaatttctacaaagataactacaagataatgaaaatcgcatactcttttgtctcaatgaaaccatggcatgaattttctttcacattatcaccccggtctgctcttagattatttagtgttagacaaagcaaaacttcctcaagaacttcttctgctttctgcaaaacagaaccatccaatgactaatgagtacctgaaaatttcagagtggacagcacaaatgaatgaaataaaccttttgggtctctccattaactagtgatgttccatcaaagggaaccactttacagacagtactaccagccctgaaggcctcaccgaatgttccttcaccaagcttcacaatgctgcctggtgtactatttccatgaacatcttcgttaaatgacgaataaagactgcatagtagttaataaacatgtaaggttgaaccacctaccagtaagtggaaaacgcttcagctagggttataggtgcagattgattgcaaaccaaaaggagttgagcaaaggcagtcatagcttcagcactcaatgatggaatgctgctatcatcaggttcttccttaatcttaagctcactaaaggatgtaaaaatgctggttttgtcactgagccctgaagggattgttcttttcataggatttgttttagaccccctatccttttcaggggttctacaactgtcgtgaagactgcaatcactacggactgatggtacaactggggtctccatgatatcaaacaag

SEQ ID NO: 80764 - DNA, 10131 bp, Oryza sativa
ccttttctgctttatttaaatttggatttgaccatgcattgatcctacccctttgtcttctttaaatggctgagcacccccccaaccaccacggaaaaggcatggatgattttgtgacaaaattggctcccatgacactggtggtgggctaccccaacgcgccagaatactcgactgttccaccgctcattggcgagtttcctcaccgtgttcgcttagaggtccatggctatgtgggtacctgcctcgctaacatggtggttgaggcatccggaggcaccgcagaccacgcctcgctaacatggtggttgaggcatccggaggcaccgcagaccacgcctgtcaggaggcagcatatctgatgatggccaggcttcgtgatcggcacagctacaccttctgcaacacggcgtaccgcttccaccctcgtcgagcaagtggctatgatatcagcaccttccgcccgatagccggcgagaacgacaccaccttcggccacatgtgcgccatgatgaggggaatggacaggatgtactcggatctgcacaaggcatccaaggccttgaatgatgggaatctcgtgaggatcatagctctgaaggatgagatagcgcgcctgaagaagaagaatgctcagttgaagggtctcctagcgccaggaggagtccggatccgcaccacgccccgcaagtcaacaacggcacccgtgcgcattcaacttgcgcccaggaacccacctccgcctgcagctcccgcagctcctccagctccgcccgcagttcccgcagctccagcgccagttccagctcctgttccagtgtcagctcccgcgtccgctctctccttcactccagcatcagccgtcaggggcccagccagtggcaacggaggttggttgcctgctactcccagtggcagccgtgaccacagcagcagcagttccagtggcaccgagccaggcagatgcgagacgtatctgccagattccaggagccgctcagagggacctggtgacgagcaggaggacgccttcgactccaccgaccgcaggagccgttccgagcattaggctcgctttccattagtttatcgactatttagcatttgcctgttagtttgtgtgtttaggtctgctcgcttgtgggtcagttgacggtcgatatcatgtgcctataatatggctgtcttaataaagatttttgcttgctgttttaagtgttttaatttagatcagaacaattgcagtttaaattcctatataataaagcttagttcttgagcatctgtttttcttcttttcccccccgtctgcttttcctccagatggtctacaccaggaatggtagccgcacaacaggcgagggcagcaatggcgaagaacgcactgacggggtgcatcccaacagcgattccggcaatggtccgccaccactccccgagaatccgactctggcccaagtaatggctcatcagactcagatgatggcagccatgatgcagcagcagcaccagcagatgcaccaaaggatgcagcagcaagccgagcagcatcagcagcagtttggtccccctccccctcagtccaaactgccggagtttctacgcgttaggccacccaccttctccagcaccaccaaccccatggaggcgaatgactggctaaatgccatagagaagaagctaaatctcctgcagtgcaatgatcaggagaaggtcgccttcgccacacaccagctccaaggtcccgcgtcagcttggtgggacaatctcatggccacccgcccgccaggcactgaagtcacttgggcagagttctgtcgcagttttaggaaggcgcaggtgccagacggggtcgtggcacaaaagaagagagaattccgggcactccaccagggcaacaggacagtgactgagtatctccatgagttcaatcgcttagcgcgatatgcaccggaggatgtccacactaacgcggagaagcaggagaagttcctagcaggcctggatgacgagctaaccaaccagttaatctctggggactacgccgactttgagaggctggttgacaaggcaatccgtcaggaggatcagcgcaccaaaatggacaggaagagaaaggcggcgcagttccggtccaaccaaggaagccaccagcgaccgcgcttcactccaggacagcagggtggacctaccaccatgatcgtccgccagcaccgccctttcaactcaagcagcttccaccagggcgccagtggcagccagaaccaccatggaggtcagcccaaccacagtgcagctccgcgcccaccaatggcaccagtacagtcagctccgtccgcgcaagccaagaaggagactggaacaaagccagggtcctgcttcaactgtggcgagcttggccacttcgctgacaaatgtccgaagcctaggcgtgccgggccaaggttcatccaggctcgtgtcaaccacgcgtccgcagaggaggcgcaagcagcaccagaggtcgtactgggtacgttttgtgtcaactcagtccctgctatagtactttttgattctggtgcaacgcattctttcatttcaaagaaatttgtgggaatacatatgggttaagaaaagaagagcttagtacaccaatgagggttcataccccgggaaatagttcaacctcggtcagttatagcccttcagtgctaataggaattcaaggatcaccatttctagccaacctcatccttcttgaatctaaagacctagatgtcattcttgggatggattggctaaccaagttcaagggagtcattgatttgcaaattgcacagtcaccttgaccaacaagaagggagaaacggtagtgtacaaatcactagtctcaccaaagcaaggggtctccttgaatcagattgaggtggaaatcccagtggtcaccgaggggaagagttcgaggaaattggaagatatccccatagtctgcgagtacccaaaagtgtttcccgaagacctcactaccatgccacccaagagagagattgaattccggattgatttggcaccgggaaccgctccaatttacaagacaccgtataggatggcagccaacgagctagcagaggtcaagaagcaggttgatgagcagctgcagaaagggtacattcgaccaagtacttcaccttggggtgctccggtcatttttgtggagaagaaggacaagacgaagagaatgtgtgtcgactatcgcgcactcaatgaggtcacaatcaagaacaaatatcctttaccgcggatcgatgatttgtttgatcagctgaaaggagctaaagtgttttctaagatagacctgcgatcaggctaccaccagttgagaattcaggaagaggatattccaaagacagccttcaccactcggtatgggttgtatgagtgcacggttatgtctttcggacttaccaacgcacccgcattcttcatgaatctgatgaacaaagtgttcatggaatttctggacaagtttgttgtggtattcatcgatgacatacctatctattcaaagtccgaagaagaacatgagcaacatctccgtctggtactcaagaagttgaaggagcaccagttatacgccaagttcagcaagtgtgacttctggttgtctgaagtcaaatttctgggtcacgttattacagctcaagacgtggcagttgatccatcgaatgtggaatcagttaccaagtggacaccacctaacaccgtgtcgcaaattcggagttttcttggacttgcaggttattaccgccgattcattgaaaacttctccaggatcgcccgacccatgactcagttgcttaagaaagatgagaagtttaaatggacagctgagtgtgacaagagttttgaggagctcaagaagaaattagtatccgccccagttctgattctgcccgaccagatgaaagacttccaagtctattgcaacgcatcccgccacgggtttggatgtgttctaatgcaagagggcagagtggtcgcgtatgcctcgcggcagttgcgtccacatgaagggaattatccaactcatgacctggaattggcagcagtggttcatgccttgaagatctggaggcactatctgattggcaaccgctgcgaagtgtatacggaccacaagagtctgaaatacatctttacccaaccggatctaaatctccaacagcgaagatggttggagctaatcaaagattatgacatgagcattcattaccatccaggaaaagccaatgtggtggcagatgcattaagcaggaaaagctactgcaatgctttatgcaccgaaggcatgtgtaaggaattgcagcagaagcttgaacacctcaacttggggcttgtggaatatgggtacatggctgccctagaggcacgacctacgctcgtggatcaagtcagagcagctcaagtaaatgatcctgaaataacagagctgaaaaagaacatgagggtcggaaaagcccgggatttccacgaagatgaacatggcacaatctggttggaagaaagattgtgtgtacctgacgacaaggaactgaaggatatgatactcaccgaggctcatcagactcagtactccattcatccaggcagcaccaaaatgtatcaagacctcaaagaaaagttttggtgggtcagcatgagaagggaaatagctgaattcgtcacactctgcgacgtttgccaacgagtgaaggcagagcaccaaaggccagcagatttactccaacctcttcaaatcctggaatggaaatgggaagaaattggaatggatttcataacaggtctgcccaggacatcatctggccacgattcgatatgggtagttgtggatcggcttaccaaaaccgctcatttcatcccagtgcacactacttatacgggcaaaaggttggcaaagctctacctctcgcgaatcatgtgtctacatggagtacccaaaaagatagtatctgatcaagggagccaattcacttcaaagttctggcagaaattgcaagaggaattgggaacccggttgaatttcagtacagcctaccatccgcagaccgatggtcagaccgagcgagtcaatcaaatattggaggacatgttaagggcttgtgcacttgattttggtggagcttgggacaaaagcttgccgtatgcggagttctcttacaaccacagttaccaggctagtcttcaaatggcaccgttcgaagcattatacggctggaagtgccgcacacctctcttctgggatcagacaggcgaacgtcaactgttcggaacagaggtgttaacggaagcagaagagaaagtcagaaccatcagagaaaggttgagaattgcccagtctcgacagaagagctacgcggacaaccgccgaagggagctcacttttgaagcaggggataacgtgtaccttcgtgttactccgctccggggagtacaccgttttcaaaccaaaggcaagttggcaccacgcttcgtgggaccataaaaaatcttggaacgaagaggagaagttgcttatcagctagagcttccatccaatatgatcggtatccaagacgtgttccacgtgtcccaattaaagaagtgcttgagggtacccgaagaacaggccgattcggagcacatcgatatccaggaggatctgacctacatggagaagccagttcgcatccttgagaccagcgaaaggaggactagaaacaaggtcaccaggttttgccgggttcagtggagccaccattcagaggaggaagcaacctgggaaagggaagatgagttgaaggccgcccatacgcacctcttcgccagctcttccgaatctcggggtcgagattccgtttaaggggggtaggtttgtcacaccctgaagttctttcccaagcctaaattgaagttataaatggtctcaagaaaataccagtgcaaagcaagactaaaccttaataaattaatgcaaataataatcagaattggcatgtggaatttttcttgagttctacatgtcgaaattcgctaacaagatttttagtggaattttcagagctctcgaaataattttaaccaattaaaattgagcacatgcaattttaaatcaaagggaaaatcttttcctccttttctttttcttttccctccttttcctcttcttgggccgtcggcccagtccaccccgccgccgcgcgcgccctcctccttgtgggccggcccaagccgcccctccctctccccccaggacgccgataggtgggccccacctgttgaggtcgtccccttcctccggccgcccgccccacgtcggcaaccgccgccgaaaccgccgcgcccacctccgccgctcctcccgcgcccacgcggcgtcgcccacgcgtcctccccacatcgccgccctctccccgcgtctcccggcccgcgcgtgcgctcgaaaggggcgggattcgcattttgaatccccccattttctctctctctcctccccacgtcgccggcggaatcggaggccctcccggccacatccgcctccccctccgcctataaaatgttccccgtgcccttctctctcgttttccgctctcgccgctccctcccatgcttcttaccgagctcgcgccgctcgccgcccgcgccgccgcttgccaccgcactccggccgcgtgccgccgccacgctaagccgccgccaccactagcttcgccgccgcaagatctttcccggccgccgccttgcgtcgccagaatccaaccgagaccccttttccctcgcgtcgccggtgagttccctctcccctccgactccggccggcatggatggccgccgtggggtatttcctccgccctaattcctctcctctccttccataggtgtcgccgtcgcgcgtccgcacctcggcatcgccagtcttcgccgcctccctcgttttccgccgccggtcgtcgccgccccctccggtgaggactccctcccccttcctttccttccccatcccgcgtgcaccgtcggttttggccgcgccgctgctccgtctgtgcgcctccgccttcgtgccgtccgccgccgcctctagccatggccggccggccggctttgaagctgagccgagcccggcggctactccctgcgccgtccgatcggcccgaggccgatccggaccgtcggtcctgtggaccggcggtggaccacccgcgtggtcccggtccacggtggaccggccgctttgtgccgctgacccatggggcccacgtgccggcgccccctccctctccccttgcgcaactgacatgcgggccccgcatgtcggcgccgcccgctccctttgatgacgtcagccctaggcatttattgcgcaataattcaattaaggattttttctgtttatagtaaaaacacagtgaatcttctaaaattcataactaattcatccgagctccgtttaagcccattcaagtctcagtaaatcaagaaaaatgtgtagaatccattaaaaatggttttgttctctgtttcaatagtcttatagcctgtttgtattgtttgctttgtatatcgcttagattccggttcttccgacgctccggtgtacttcgagatagtcgccgaggttcctccagcagcagagcaaggcaagtcatgcctgttacttgaacatgttgatcctatattacaaatgttctaatgttttccttcaaatactgcattgttttacaataatacaatgggatgtttacctactgttacagccatgctattttggtaccatgctcctttgttagcttgggttataacatgactagacattggactggggattgcttagccatgcttagttcaactagcacacaatggggaaaatcctattaatgtatagactgtaggttctaatggtaatgttggattagtgccaccgcttcggtgttggttaattaaaataaatcacatggtgggctgtgggtgcatggttttgttggtcgcgcccatggtagttaaggaccggttcgcgggatgccctggaagaacttatcgtacttatcacaagccagcgtgggcaacggctgggcttgtagtgtagctttcctctagctgacgcatccaggcgagggtgagcgtgatggagtttggatgggccctgcgatggcctatgcggcttccagattcacctaggcacgagaagggactgcccgctgccttgcgaggagtgggggggaaacctgaggtgtggtgtgcttggttagagggggttatgcgaagggtcctgtcacggcctctttccggtatgtcgtggtggcatgccggcgcacggaaacgtgtcgtggggctgtgtcttgtgggtacagttgtacatctctgatcagagtaaaactattcgaatagccgtgcccgcggttatgggtggtcaaccagattcaccgtgattagtctcaccctagtttagtctaatgaaattggatagtataggtggatggttgggcctgttgcaacgtggtatagcgttggacagtggatgattaatattgattaattgttacaactgttttactcttctcaacttctgtttataaatgcccgttttatgcaaataaaccattatagctaccccttgataattccctgcatcatacccctattccagtatgacttgctgagtacagtgggtagtactcagtcttactctgttttccccaaaaccccagaatttgagtatgcgtcagatggcggtttctccgaggagtaggcttcgtccgtgccgtcgaggatgcctgtggagtggtgtttccgctgcagatcaagtcaaggcttagctccagttatcttttatttttccgctgcatttatgtaaggctttgataatgtttgtaagacgtggatctgtatgtcaactttgtcgtttgtgtaccccggccggtcctggacggggattttaatggacattctacttggaattctattcagaaatttctgggcgtgacattcctcaaatagctttaattgctcattgtgaaaaagagaataaaaatataaaaaaattaataccgaatccttggaaacagtcttgacgttaaggacgtattcgatgtgagcaaaataatggatgcggaatccctggaaacagtcttgacgacagggacgtacccggaataaaagagaaaaatataagaaaaaaggctcaagaaaagaaaaggttcaaaaaaattctcttagttattttgtgctaaagtttatttgggaaagagttataaatgcaataggtatatgtatttagtgtttattcttcaacatatgtgcttgttaagatattgcattataaatcgtatgaaatcatgaattttgattcttgattcaaggttaattgtaaaatctttggttcatggttatactttaatgcatgcttgttatcttatagatgggtttatcttctttttattgcaacacatgacttgatatgctatatgtatgctaagctcttgaacattactgcacataattcatatgcttgaagaaatcattgtaaaaagggggagaagtaatgtgaaaatttttggatttttgggagaagcaaggtgattttttggagagttgttgagaagagcatgtttttggttcgattgggaatttctttctttcaaaaagggggagaagttttcttttggattttcgagcacgatgtgtacgtttgtgcgaagtgtgcttttttccacttttgtttttatttttccaaacaccaaaacatttttattggtttgccaatgtgttcatcaagggggagattgtaaaatcaaaggtgtttttgattattattctgtgatgaacaatcgggcattggagattattggttttgttatttggaatttattcacaaagtggttttgaagatgattggatttcacaagtgatcgcaggatttgttatttcatgtgaccggtcagaccgggcagtgtgtgccggtcagaccagcggtgatcgagcggtcggaccggctagcccgcggtctgaccggccgacgctgtgtcggtttcggtttcgggttgtttgtttggatatccgtgattatttcatgattatgacttctatatggatactatatgtatgtaatactgttgt

SEQ ID NO: 80765 - DNA, 642 bp, Oryza sativa
tttcacatgcgggcctcctaatctaaccgcataggaaaatagcacttccctcccatcctattcaaaaaaaatggacttttcttctctctccccccgcccacctctctcctctctccctcccccttatcttctcagtttcctcttctctcattttcctctctctctctcaccttctcctcctctcctccgggcggctctcggcggaggggtcgacggtggctagcgggcgcagagggctcgcggcgggctcacggcagcggcgggcggacgtggggaggcggctgggagcagcgtgcgcgcggccgacgacgacgacaatggcgaggtagcggccgggagcagcgtgcacacggccgacgacgatgacgacgacggcgaggcggcggctcggagcagcgtgcacgcggccgacgacgacgacgaggtggtggcctgaattggcgtgcgcgcgacgacaccggcggcaaggcggcggccgggagcgggccgacgacgtgtgccgggagcgggaggaggcggtggccggcagggctgggagcagcgccgccctccccgcgcccagatccggtggcggcgactgcccccgcccggatctggcggcggcggcagtcccccgcccggatccggcggcggtggtggccg

SEQ ID NO: 80766 - DNA, 3460 bp, Oryza sativa
ccattattacttggaattctgctgtctagtacttaggcaattcacagtgcacacgacaatgttggggccacgtcaaaaaaataaatatagacgggatgtatcacaacaaatctaaataatacatccaatactaaattcggtttttatgggacaaagagagtagacaaatagcttgcctggaggagagaagggattggggactggaccgtgatttcaccgggttcgcgtcaccaaagttggtaacgagagcctcgcggcagtttcgtcataaaaaggaatcacatccgctcgagacaagaaagctagagagagagagagggaagaacagtgtccgagctagatttgcgctggagaatctctccggagaggggtgtggaggtggtgacgtgatggtgagcctgaccccgatgacggtgcccttgccggggacctcaccggcccacacctcctaatacatgccggaggaggggagaggagtaggggcgctgacgccgctagatccgcccctagctcaggtggtggtggccggagcgagggagggagccagggaggggcggccgttggctcaatctgcggggagcccgtcgtgtcacatcctgattttcgtttcaggatttagaaattatttaataaattattgttagaatttatattaaatgttcattaattttcaagtgaagttaaatgtgggaaataaaatttcctaaatataaagcatggatggatttaatttttattaaattctccatggttaattatactctctggaattttcttggatttttcggagctcaattcccaattttaatcatacaaagaacatttcagtaattacccacatatttaattaatcattaaatggtctgttttaatattgttaagtactttgagtgtccaattagttccaggatttttcttgaaattatttgagcattgaaagtatttttaacaattcaaagatcattttggtgattaatttaattggaaaagtaattaagcttgcagccctctccctctcttttccgaagtccatttcatgtccctccttcaatcgggccaaggaaaaggaagcccagccaaagtctactttacctcccactgttcatcttccagctccagacacagcccgagctgccgtcctgtgcctgtagccgacgccgcttcctccaccaaatccggcgcattcgttgatccccttccaaaattgattgcaaaaacggattcctctctatctccactacctaatcccgaagaaacccccatcaaattcgttatctatctcacgaattttggccgtttttattcgggtgaactcggataaatcctaacttccttcaccaaatccatccgttcctgagccgatctcctccaccatgcctatataaagcatcccctagtcgtcctcttccgtttgccccaagtcccgagctctaccgttgcccgtagcgccgccaccgcgtagccctagccgccgccgtcgttgttgtcgttccagccacgccgcgccggggttgtggtcgccgccgccgcttggcgtcgtcgctgtcgggtttgcgcggaggaggagcacctcggccgcccctttgcagctgccgaagaccgtcggagagccgtcgtcgccgtcaagtcaagccgagccgccgttggagttcgtcgccggccgtcgtttgtcgtcgttcgtcgttgttctttgcacctgtgagtttgcgtcgtcgtcctcttcgtgttggtgtctttggatagcccaaccgagctctctatcgccggcggagttgtggtccagtgccatggctgcgatgatgtcgtgatgacatcataaatcatttatttaattcgtaataattatctggattagatgaaaatcgattaaacttcagaaattcataactaaatcatcgtaactcggattcgagtggttcaagttgctaaattcatctaaaatcgagatctacatgttaaaaatgtccacatgtactgtttatgcttgttttttactgttttattgattttgtttatttgctttagtttccgacgttccggaggagagcgtttacattgaagaaggttcaaaagcgtttacggaagctcaaggaaagtcacacagatcccaaacaaccctttgagcatgttgaacccgtttaaagctaatgttttattttaacttatgcattattttcgaatgtcatcgggtggtaagcctttcccaattaattaatggccgaaaatgatgttatttttcctatgggttataatttgattagctagaaccttatatattggtttagttcagctaaatgctatatgtataattgcttagccatgcttagaaacattagctcattaatgggatgaatcatatatactacattattatttatgattatatttaatgatagctcacgatggttaatcgtgttatgataattaattgatatttaaaacttgtcaatggtgggttgtgagcacatggttttgaaggtcgtgctcatggcaattaaggaccggttcgcgagctactgttgtgagacattaaccgtgccaaccacaagccagcgtgggcaacggctttaccttttgtatagcatgattcattacggggtgccagactgagaagcggcgagaagtctgtgggggtcgctggggagtccatgcctctggtaatatttatagagggggtgattatgatccaggaatggtgcactgtggtgagttgtgttgtgcagggggtactgtcacagcctctattcgggtactttccagtatcgcgacgcatggtagacatgatgttgaggctgtgtcttgtggatacagcggtacacctctggccagagtaaaactattcgaatagccgtgcccgcggtcatgggcgggttgagcaatgtttttcgttattagtctcacacctctcacaataattattgatgctataactggtaataatttgtttagctcctggtttggagttagatctgtgcagccgggtatggttgttcagggtggttgggcctgtgcagcatgggtgtgctgtgcagtgttgattaaaattgatgattaattactctactatttcactactcttaaatgtttgctaaatactgcttttgcaaatgagcctatgttatgccatcctttggtatccttgtgcacttgcatatttgttgtgtggcttgttgagtatatcatatgctcaccttgcaataatcaatcaacctcagttgaagaaaaaggatccagaaggaaaagatgtttggcttataccccagttgagctgcctgtgggagtggagctgaagccatcgctagaccgttaattccgctgttgtttttcttttcttttgtaagtatgtaacgttattattatgatggatttgtatattaaattgtcagtttgtgtacctcggctgatttctggacgagggtattatgcacaaataagttcggaaattactagtgaatttccg

SEQ ID NO: 80767 - DNA, 587 bp, Oryza sativa
ccggactttgttggaatcgtaaaccctggccacaatacgagcagtattgctttgcttctgcataataggtacgatctaccatgcccacactaataataaaggcaaattttgtctacaggacactgtaatttcgtggttttagccgtaggacactgcccgaactcacttttggaggaaaacactctataaacatggtaatttggcaatagacatcgtgctgattaaaataataatttttggttgaagaggagagagaaatggcatgaaagttctaaaatacccttgggcccatatgtcatatcttccatctcttatctctatccccgctgcgccgccgcctcgatcgaggacctcagcgctgacgtcttccaggaacagcttgggcatcaccgcgctgcccaccctgaacgacgacgacccatcctccttcctgacgtcggcaaagctcaccatgaccatgagcttggtcgcccggccatggccgagcaggagcagcacggggtagaggctgtacagcagcagcagcagaagtccgcggaagagtcccccgacctccagcgcgacgagtatgaagtacgggaaggtcg

SEQ ID NO: 80768 - DNA, 3208 bp, Oryza sativa
gttgagagaccgacaggggggaagaccgacaaaaagaggacatttaacttttgccagttttaaaagttggtctttaagaatttgtcactcgctgcctataacatgtgtgctcttatgtgtacatatggattagtgctaaattctttatcaccacttgtaaaagtggcaaatacttattctttaaaaagggataattttattttcatggagcaacttaaggttacaggctcagggttcacaattacgacgaaaaccggtcgaattccacgaaatttcgaggtttcgacaaggctcgaaagtagaagccgtctaagatttcgatgagtttcattcaaattcaaatttgaattgataaaaaaggaaacaatcaaataaaatcttataaatggtatgatattcatagaacctattgggatataaattttcaaaagaattaatgtatttcgtgtatttactgaaatttacagtaggaaagaaaagaataacgaattaaaaaaaaggaaaaaattcagtttccctccttttctaattactgattgaaattttgatgatttcgctcggaatttcgccaaagccgaccggttttcgcaagcttatcggtaaattcagggaatttgtattcaaattttgatttatcaaatgtgttcagaatctaccggctttctagcggatttcgcaaaaaccgtcattccgccagagcccgaaacggaaggccatctcggaattgtaaaccctgttacagcactgaaacttgtgtctaacatggtaattcaacctatgtggcatgtgaggttcaagaattatatgtgccgcactactgctgcccttacagtttcatggtgttatctttgttgaaaacaactccatcaatcctaattactcagctgatttatacattttaaaatttatcttgaaataaattaaaatttttgctttttttcctagggagttgctaaaaaaaattggcacaagattttatagctaaaaaactttcaaatataattatagtacaattacacagtttaactataaatgtaactattattataattataattatagtgtaacaacattgcaacttctctatataacttatgtataaagttacatgcacatttttaatacttaagttatataaaatttataatatagttgtcaaaaataattaattatattatagttacatttgaaagtttttcctagacaagttttttatagtccatttacctagtatcatccataagatgttcttttaatacacttacctatccatccattaatatttttctattaataagaggcactttggttttttatactcatcgttaatatttttctcgatattttaagaatttatttttctctactactgtaaatgtaaaagtgaagtcttctcctccaccaccctcgtacctccctcgtcacatagaagattcaccccatgtacaaaaatacagtgtttctattaaaaaaatcaacccaacataaaaagattctgtaaaatcaaaggtgttttttattattattctgtgatgatcaattgggcattggagattattggttttgttatttagaatttattcacgaaatgattttggagatgattggatttcacaggtgatcgtaggattctatcattttatgtgaccggtcggaccgggcagtgtgtgccggtcagaccagcggtgatcgagcggtcggaccggccagcccgcggtctgaccggccaacgctgtgtcggtttcggtttcgggttgttcgtttggatatccgtgattatttcatgattatgacttctagatggatactatacgtatgtaatactgttgtttgctactaatgagtcaagttggagatagcttggtctcggaatatggtttctttgtttatttcatgtgtaggtgactcgatgtctcgggatagtatttgcggtgatggatcgggagtcggcttggggataagacgacgtccgtggtggtcagagattatgcgggatactaaggctagagttgatgcacgtggttgatggagattccatatggtatacgatggaggtattgtgtgcgtatgagatgcggagtcgaatttggaaggagtccaaatttggtatgattggttatgtaaagtttgtgtcttgtactagagggtttcctaaggtgtttaggacttctagtatgagtttggtccgtgactttaggttgcctacctcatgtataaatagagggggagcgtgaggcttcccggtatcgcttttgagagcaattgagttgagttttgagttagggtttccagtttagtcgaaatttttgtaaggagtgttgttggtgcactttgtaaacacagagagaatcaataaagtcgtcatccactttaagagttcttcgatttttgtttaccgggttttagcggtctaaccagcaactcaccagcggttagaccggcgagtacatggcggtcagaccggcggcgacagcaagcgcggcaggcgacttcggcggttcgaccgatcgatctacatcggtcagaccgacgttcatcaggcggtcagaccgcgatccgtcgaatttgagggtaacttttatttccactaaaagttttcggtttttggatataccaaccattcacccccccctctggttggcttagttcctgtgattcgatcctacagattctccttaaaaaactatagagaaaatccatgaattgccatcgacaagcaccctaattccagaaatgccatcaacaaaagcaaacttcccagaaatgccattgcacaagtctctttcttcccaaaaatgccatcacagtcaaactgctattaacatatctccattaagttgtatgaaaagacaatcttacctctatgcaactatttgctcacacagcatcattttgcagtgtgtgctcacacaacattattcatatttctgttagcacgtaaattcacagacattattattttgctatcaatcaaatcatttcagaattaaattcacagaaatcagattcaaaaaaaatttcacacattcgccgcttccggactcactgcacatgcagcaactcagcatttctgcatcgtaagagaaatccaaaagaaacttcacctaccactggtcgtcggcgaggagcgtcgatgcggtggggaagtgagcacagcgagaaagaaaaaaccccgaggccaatgtccactgctcccggttcgcgaggc

SEQ ID NO: 80769 - DNA, 629 bp, Oryza sativa
ggctgaggaaagagcccaggtgggaggataagacaacggagttgctatgtccgacaatggcaccaagccgtcgactttgttccattcctcgtgctacttccactcgtcgcacttctcataccccgagctccgggacatgaaggcagcggggagcaatggcatgtcaccatcgccatccggtcggtcaagatgtcggagcttcgccgctgctccagctctccctgcaaaaggcgaaaggggagagaaatagaaagagagagaagggagagagagagggaggaggaagaagggaaggagaaagagaggatgacgtgtgggtcccacaatatttcttttgtgaatgacaaatgggtctcacatattttttttaattctaatactccattcgttcaaaaatataacaatttttagcattcaaagtttgtccaaaagtatataactttttcacctacattcattctcaaccaatcataacctttcaccattcaaattcttcacatactttctcttctcaactaatcacaaccctcttccatttaatcaaacctacttttttaatgctcgtgcccaagcctaaaacttcttatattttaggacggaggtagtatcacataagcgtcacgtcaacg

SEQ ID NO: 80770 - DNA, 1399 bp, Oryza sativa
cggctacctcgtttgcaaaataaacaattggcaggagatactttgtttgcccccaaagaagacgacgatttcgttgtacgtataacaaattacaaatttaactagcatctgcttattattactatcctaactaactaattatgtttgtttcttatggcaatccaaggaggtgcgcattcactttatggatcgacaatgtcgatccaacatatgatggccaaaagataactgagtctgaaacacaagtagagtaccagcgagagaaggagcatcaaaaatgcaatacatgttgaacgacgcggaaggagtcggtagataagctcaagcttgatttgtcaggaccgacaaatttgtattttttatccatgctatcttgccattataatgtttcattattatggtgtgtgttgttgtatgcgtcacgaattataaattaatgtgattgtatcgttctgaattccaaagtttctttgacgccacgatacgttgtatccttataaatttataagtatctgcttatatttttataacttccactttcaattgtgtacatgattcaacatacgcgagaattatacgtaacttacaatttataggtaacaaaccccctcatcgtactttgttcgtttcaaaacgatactttacctaattttaagtgctaaaaaatcaggttcatgtaaaatacctatttcgtaaaattttaagtgcaaaatagttagatttatgtaatgaataatttgaaactattcctccttccatttctaaacgatgatttacgtagtttttaaagtcacaattaaatatttcgatataaaaacaccccttgttgggctagaaaccgccaaaacaacgtgccattcaattctaataatgtttttcttatttcacaattttaaagtgatgatttactaaattttctaaatgaacggagctaaatgcctgggggctgcccttaaagctggcggcccccaacacaatacataatcgccctccctaagggcggtaatggggccgcctgcaaaagggtctggaattttgcaggcggccccattaccgcccttagggagggcgattatgtattgtgttgggggccgccagctttaagggcagcccccaggcatttagctccgttcatttagaaaatttagtaaatcatcactttaaaattgtgaaataagaaaaacattattagaattgaatggcacgttgttttggcggtttctagcccaacaaggggtgtttttatatcgaaatatttaattgtgactttaaaaactacgtaaatcatcgtttagaaatggaaggaggaataggttcaaattattcattacataaatctaactattttgcccttaaaaattttacgaaataggttattttacatgaacctgaattttta

SEQ ID NO: 80771 - DNA, 19470 bp, Oryza sativa
tgtaagatgatattcttgaagtaaatctggctttgaatttatcatgtggatttggtttgttattcatttgatacctccaccattctcaaatagatgacattttggaacttgtgcagtcaaaccttgaaattttagctcactaatatatgtaaaaatatcaggatttgatatgtgaaaataacactaacaggtctgccatgaaaaataatttcatgtagttatattttttattaatatacaattagtgtaatggtcaaacatgtacattggagactgtgttattgtcttaaactacaaataaaaaagaagggaggagtaattttgtagccctatacccctatattatgtataatgtctcgcaatctgattgcacctaactattttattatgataatgtgctaggccaatgttttagcttcttcactgaatgacttgcacaatttttctgaaaacttggctaactatcctataccctgttgacttatatgacgttttgatacttaccttcccatttcttctcatcattcaggtattgcgaatgccagccacagcacttcttgttgatgaggtacatcaatttaatctccatacctgatgtattcgtgccactatttgtgtctgacctagtcaattgtaccacagatccattctgatatcttgcttctcttatgtatctttatcattgttagtttttgcttctatgttcaaatgtgttgggcttttcgcaaacgtgttagactttcagctgctcaatcaattatcattcactaattcaccaacctcacaaatcactgatgattttccttgcccactttacccatgggcatgctgcatgcttcacttgtacaattgcactacagatcatacaattagttcttcatgaatatcatccataaccatcactttcttgaccaggaaaaaaagcgttatgtaggtatcagattggcatctggtcaggatattttgtgccaacagttgatactcgatccatcatatgaaattccttccttggatatgccaagtgatgcaccagtatcaaatttgccaagaaaagttgctaggggaatatgcataatcagcagctctgtgagacaagatacatcaaatgttctggttgttttccccccaaagtgtaagtacagccatttctccctgtgtctctgattagatcttggtgcacctgaaggtgatattttgcttctcttctttgacatcatctgtttccttcattttagcactagaagaggagcaaattactgctgttcgggtgcttcagttgagcagcaatttagcagtatgccctcctggaatgtaagttttttttcaaggatgtaagttatttgtcctattattaacattgcaatgttagggtatttttactacgatcaccaaggaaccactcatttaaaactaatactgtataatgttggtgagcacttcgcttggacccttacaagctaatctcacttgcaggttcatggcatatctctctactccctgtactgatgccttcactggaaagaaatgcatcagcaaagcaatagatgctcttttctcaactaaggtttctaatgatttggaagatcatttggagaaaaacagtgaagaaaataaggagagtgtgaagccaaccctactctggagctgtgtgtatgtacaagagattatacaggtgcgtatatttcattcatggtagtttcaacattgttaaaaacatttgctgttcagatgtgcatatttatagttttataccttatataacttattttttattttgtcagggaacatctggtactgcattgtcatgccccatacctgatgaaaatatggactacaggagtatacttgaatcaacaaaaatggtacgctttcttctcaattttgtactaagtactaaccacatcagaaactaagccagagagtttggttaatcgtggatgttatgaaactgttcctggcttcctgccaaaatgggaagatttatttctaggttacattaaaaaaaaaaaacttagatggagtaacatatgcatctgtgcagccctggtgcagaatcattaatctttcgtaagctaaactgtgtttgagataactttagaggttgactgttcatttcaattattaccctaaaccatatgaaaaacaacatgcacctgtgttctttactatggacaacaacatgcatctgttcgtacctgatgttgcattgttctttttgcagctgttcactgatatttgtcctaatgaagagttcctgcctagaaattcagctcccaaatatgcttctgataatgactctgattctgcagagtaaatccaaacttgcaaaggtaaatattttcatgtggagcttacactgtttacacatgtttaattcattagtattggaattgaaaataaaacattctttgcacatgagttgcagtactcatagtaccttattgcatatgaaagtacgaaacatatcaaaacctttgcaagtgaaactttgtgcaatttaattataaatactgttacatataaaccctgtaatcaactatgagtttgtgccaaggaaattttttggtacaattttctccttaccaccggttaattgattaatattaacgtgtgatggacaagataaataccaagaaagctatgaagatttttgaacaaaatgccaggagacgcatagctatttcaacattacagcactaccaacagaacctttgatactttgatttcatctgctgctttttgattttattaattacaattccaggacaaaatgaccattacaaataagaaagtttgggcggctaaatatatatcaataaatagaatgcatatattcttttaaaagatcatattattaggtacttgaggtttgactttctggttttattaaatgtcgtacatgtttgattcatcctgcttttggaactttagttgtattttttttcctttgtccacatagatgccatatacagtacatccttactagtgataggtaattccagctactagtggtgcgaactcctgccttgaaccctggcttgggcctcagtctttttattagtattattttgaaatcttataatgcaaaagactaatgatggtgacgatagcaaatagataataaagtaaagcacactctttcttgtgatattcttgtgccataggcctatcgtgttctctcattaattggcttgcatactatactatactggttcacacggctgtcctttagaaaagtctgagataaagaaaaaccaggctgcatatattttacagtgatctttttgttggtaacagatgtttgcttgtgctgaatagatgttcttgttatttttggcagggctttgtattctacatgacagggttatcgttgaagatatctgttccatattacagtgttccccaaagtcacggtaagaaatattgcagcaagggggagccctttacgttggtgagatttgccaggtttctctttgactagattgcagatgcctacattgttccatcattggtacgacatattatgatactggtaaaacactcaagagagagcgatgcagatgtccttggcattttgacatttggagaacatcataccacatgaaccgcttagtgtgattactacatccatatggttctctgaattctatgctgaatttgttggcacataggagtactgtactacataggaaggatactgctgagttctatgctaaatctgtgtatttttggtgggctgcctgaatcattgtacaagcgaacgacagaaatggatatcaaatgaggtccctccgagagggagttgcattacatgcatccttatcgatctgcgcggtcaatttctgttgcaatgactgcaacaaacctacagagaatcctgatccgcatttgtttgtttgggagagaacgaggcactgcgatgaattttggcaaaaaaaaaaaggggggggggggggggggcggcttgtctatatgagattcgcatgattttttaggcttctatcatgcagtgtttcaccaagtagattaaaaatgtttcagtcttttaaaaaagccagaacacaactaaatcacatcatgaaacattttggtacaacgtatgaaacaacggttctaaatatattgaaatatgaaacaaatcctgagtatatctaggaaacgtctatatgagattctcatgattttttaggtttccatcatgcaaattttgaagctaatcggacgctgtttcaccaagtagatcgaaaatattttaattttttaaaaggctgatatataatcaaatcaccttgtgaaacattttactacaacgtataaaacaacggttctgaatatattgaaacataaatgatttagctatcaaaaaatcattcgataaccatttagtcttcctgaaaaagaaaagttgatgtaattctgtgttggttcttacattctgtcttctttgaaatatcttgccttaattctcaaatatgtgaaaaccaactcttttgaaaacaaaccatgcccaaataacattacttacacgtatcacgtatgcatggattgaagtattttgctagaggggttcaaattattcgtgtacgattatgcacgcgagagcgtttccaacaagttttcttttagtcaaaataaggaattatagttggttttcgtctctcgtacactttactaatacaatggataaatatattatctcatcaactcaactagtatttgaattttatatgagtttaaagattgatttagatttagattccacgtaatcgcgagagagagagagaagagaagagaagcgcgcagtgtccagacgcaaccgatcagtctcgcttctcgcctcgtctcgtctccttcctccgacgcgcggaaccttctagaagcttctccctccggtcgggggatgccgcgctgaccccctaccgtggttatgctggcgtcaaagctctggtcgaggctcgcgtcgccgtcttcccccgcctcgccgcgcgccctttcttcttcttcatcggcggcggcggcggcgaggtacctactgccgagctctgggatgccggcccaagaaaggtcgccgggtcaccccagtggcggcgacgcgcggcccggtgcggggctcgggctcgccgagactgggtgtggcgcggccggtgcgccgcgaccgctgccgctgccgtgctcttcttcgtcggacaatcccgcgtgagtctgcctcggcgttctgaatcttctgattctcttgtgctcaagcgcttgcaccttatctggatcactgaataggtttacgcatttagtaaatctttagtaaaatgtttgccccaaaaaatgataatgaaattgtagattcaaaattgccctattcttttgtaatctgttggcttgagctaaatttcgtgtttgcggtagggaagagaatccttgcacaagacagatataccaaagacagctaatgccgcatcggttcaagttatttttgggggagaaacgtcattttacatatgcaaatggtgcttcactgaatccgcagaactacagatatttttcatcttcttctggccaacagagtataggaattggtaacaaggtgggcagccatatgttaatgagcttctatgacagagcttgatatgttcagcctttagctttattaaaggaaaattgctgccatttttgttatagaagaattatttccttctgaatttattgactggaggcaacatgtttccagattatacatgaccttccaagaagtgtgaaaattgtggaagttgggccacgagatgggctacagaatgagaagaacatagttccaacacatgtaaagattgaactcatacagagactggcaacctctggattatcggttgttgaggcaactagttttgtctctccaaaatgggtaccacaggtaattttggtttagcaattagcatgcattagatacttgcttcttacacatatacggtttgatattttaaagatcaccatccacccatttttttctataatatttatttgacttccatgattttttggaaggatttttctacttgataattttaagaaaagtttggtgctagctctgttacaaatacagagcactgtatgttatggaacagccattacatgtggttatcgatcgttaacatgatcctcttattcccaatgatgcaattgcttcttgcattataatagccaatgtcatgtttcttccaaagtattaaattgttgcttctcttattaaaagccaaagaaatgtccttattatagaggacacgtgtacttttcaagtaactaaataaaatagatgagatgtagcaaacatgacacacgaacaagtataatctagaaataagcatatgcttgtggcttgtggcatacttatcattgacctgagcaaattatttcaccgcaccaagttccagttaacttgtaatggagtattggagtgagaagaaaaattgaaaaatgtaggagtatctcaataatactttgctgaacttgaatcattgtccatccattgtttccagattttatggttttgtatgtatattacttccattatctaacaaaaaaatgtatattacttgcttgctgctttatgtacttgaccattattttattataatctattttttatcctgtttgttcattggtttatttacccatcacatctttaccgttgagtttctcaataatttcttgtttctaattgtagctagctgatgctaaggatgtgatggatgtagtccggaatattgaaggtgtaagccttcctgtattgacaccaaaccttaaggtaatataatttgattcagataacttttgagtacatatgtctgtttacctcgtttcacatttattctgttcgttggtaatcagggatttgaggcagctgttgcagcaggtgcaaaagaagttgcagtatttgcgtcagcttctgaagcattttccaagtcaaacataaactgtaccattaaagagagccttgctcgctataaagatgttgctcttgcagcaaaagagctaaaaatccccatgcgagggtgagttatgtcacacagtagcctgatgttgcatcaagtttaatttctacatttgcaaatatcgggtgtatttgtatgaaatagtaatgagcaagtaaagtaatctggatttgatttattctgttgaataaccaaccagtctacctgttgcctctggcatcagctcactagctagtctagtgtatgatttatctttctctggatggtagttcagtttaccagagttttattccagggtagacttgtataaatagcttatacaaaatagtgtgtgttaatagtcgctcattgcataaattggtagtagatgctgacacaaagataaactggaaagtcttcacatacatggtttggcataatggtgtgggcaaatctgatttatagaactaccatttggttagaacttagaagagatatgtgagcataatcagttactgaacttaacattctcttcattttgtactggttcttggtgcaacatgttgatatctagttcctttacttgacaagaatataggtatgtttcttgtgtggttggatgcccagtagaaggatatgtgccaccgtcaaatgtagctcatgtggctaaagagctttatgacatgggctgctacgaggtttcacttggtgatacaataggcgttggtaccccaggtgatttcatattacctattttccatctcctgttttttgtgcgctatattatctatagcttcattcaactgctgcaaggccttagttcattacatttgttaaacaaaaaatatttcttgctgcggggggcagttttgcgctaaacagctcaccgctacaatcttctggagattgtgtgtagtttttctttaggagattgtatgtatagttattaacaggatatttgtttttcagtgcatcatgataaaaaaaattcctgttcttattaatacttaccagaaaacaagaaaacatcacataaaaggaaaaacaccatcgcgaaccatgtaattcatgtgaatgccagtagcctcttgcccttttatacacatagaagtttaagtttttgtctactagctttggtttattacccttcttctccagcttcatgatcccattactagccaggttttaaacagtttacttcctccatctatccaggcaccgttgttccaatgcttgaggctgttatgttctttgttccaaaggagaagcttgctgtccatttccacgatacctacggccaatcgctttcaaatatcctcatctctctccaggtaatcatccaccagatactaaacaaatcatcacacagagccaaatggttgtgaacttgtaacaacaaagaatcatatgtaatttccccaccaaaaaaaaaagaatcatatgtaattgatcatgtcctctgctctctttttattgtctcacctccgagtgcagtggccaggatatttattccattttgttctactggaaaatgctgcaagctttcttaccaacgattactgcatttgcctttgaatcagatgggtgtgagcgttgtggactcttccgtagcgggcctcggagggtgcccatacgcgaaaggtgcatcgggcaatgtggcgacggaggacgtggtgtacatgctgaacgggctggggatcagcaccaatgtcgacctgggcaaggtgatggccgccggcgagttcatctgcaaccatctggggcgccagtctgggtccaaggcagctatcgctttgggaagcaaggttgctactgccaacgcatccaaactgtgaggttcactaacattcactgatgcagtctttcggaggatgcgtttcagacatacaaatgtatacgataaataaaggcgaaattggttccatgctattcaagtgacctgggatttgtcggtgctagaaaactaaaatcgggatcgttgggtgatgtaagatcaattttgccagaaataaatggactgatgggattgttgattgatatatatggtcagcttttcctgaagaacttaagctgatgtttccgttggttcatgaaactcaatgtgtgtatagagccagaagcgggttgctcaatattgcatttgaacagctgcacatttaaaaagagaaggaacgggtggtatatttgtatggaataatcgacgatgacataactagaatgaaatggatgaagaggatagtagctttgagcccatttaacaaaaagacaccttataattaaaagtttagaacgaatgctacaatctcgctcacccaaaaaaaaaaaagaatcatcggttcatttccaacttcaaatcaaacgttcaaacagcaataatatcatttacagtagcttgttaaacacaatggtacactgctaatgtgttcctgaaaattgaacggactagtgcacgcaccctccgggcttacttcaattatatacttgatggcgcccatgaggaaataccaaaatgtttgcaccagtccactcaaaatgatcagtcagtcaagcctccctataaaagtcggattgtcataatgttttgctgaactcccctgatggcagcacaagaccttttccgtaggccgctaacaaaagggcctctgctcgccctgcatgagtgtaaaaaaaacattattgagctatagaaggaacatgtgtcatctattctcatggaacgcttgaattaaatggattgaagctaaatatgttacataaaaaacttatttaactcatccatgtaggtcgtgaattttaacacatatacaacctacagattcaatggacaatactagtagcaaatatgcacagtgcacactgtgaatgtgaagcatatcaggggtcgtttgattttgatttgatgcgcacctggaaagacagacaatggttctttgtattgtctttgacatactccctccgtcccaaaaaaaggcaaaccctgggtttccgtgtccaactttgactgtccgtcttatatgaaatttttttataattcgtattttcattgttgttagatgataaaacatgattaatattttatgcgtgacttgtctttttaatttttttcataattttttcgaataagacggacggtcaaacgttggacacggaaaccagtgtttgcctttttttgggacggagggagtatatcgcttgtttattcatgtgtatcagtcaagtttacttcaaatgttcagatgaactagcagaaacaaaaacatggcgagataatgaactattcgctaaaaataagatataatgaacagaaaatgatcttgttgcagtgaaaaaatcatttatattagcaggtatgctcaaggccaaaactgcgtgacataggcagtaaaagtttcacagtatgtaccatgatgtttcttcctattcagggacagggccttgtccgggaacaagattgaagcagcttgcctgctatagtcctgttatagatcataaagacaaccataagagggctatagaacagcaatgagttgatattctacttcaacactaaccatattgagttattgacattgaaatcatgttaggacaagatcaaaagctaacaacagagatcttgagatatgaaggtaatatttttcagatatttaattcatgaactttgtatataggaagtatttcagtgctctcccggaaatgaagaagagtgaaactgtgaattgaatgcctaatttgtgaccacactactgcactaccaacaactctataggacttcccttatttacactaccacactactgcactaccaacaactctataggacttcccttatttacactacagacaaaaataagcaacaaaaactccaggcccgggcacttctactttgttttttctttgtggtgtgtttttgtattgttttttcttccccttaatgaaatgaaatgcagctctcctgcgttttcgagaaaaaaaaaactccaggcccgccatatagaaacaagaagaatacagacagacacatgttatcttcatagccctggtaatgaagtgagacctcaatcccatcccatcttgttaaactccaatagtccattatacccaacctataatgtacttcaaccctaagccagctcccacgcacattttggcctcattatgttcatgttgtacagtgtgttcattttagttgacaccttcgtttaactaatttggatggcttgttatatattctgcaaaatctctccaatacctccaggttaacaaacaactctactagagattgtagaaacaaagagtcataaagcaactttatgttgcatacttccatatgacaagagtaacaaaccttaggtgatccgcttcgtgttagcccaaaataagccttccaggtctgtgatgcaactggaacaactgaaaaaccagatgcaactagagcagcaatccacaggccatacgaaaaacctgtactccaccatccctatatgaccccccaaaaaaaatcaccaacagaacagaaatttattgctgaaattcacattgcaccacatggtgtgattattcaagttatgaataatttcaaattggaattcattgttttagtgtaactctaaacttcagattatgtgagaaacatcctcaggaacatgatatctcaaactgtcgcaaaaattagttctattgttttccaccattgcaatcgtgcatacatcgtcaataaaaagacataggagagcactgctatccaattgcatacattctccaataatcaatgcaggggacattagtctgatactgttgacacaaggacttctacaaaatggctaaatggaaggaaggaaaagaaaataccagctttccatcagttggaaatgggcttgacttctcaatatatgccgtagttcctgcaagagagcgaaacaaacaatgatatcatgattagaaacaatgcagttcttcacatagcgcatatctaaaagaagaatgtgataactatgaatgaccataatgagtaatcataatggccatgtcccttgtgctgattgctgaacacaacacgaagcaaaccagcaccacccacaaaagaatgcagtaagcagtacaagttgcacccatctgttcataccaggaggcgcatcgaggccacggagcagctcgatgatggatttggtgtccaagcgcttccggatgaactccgagaccactatgtgcacgaacgggttatcaaacacctgcaagacatgaacgcctttgctcaagcacacaagttgtacacacagaatgcgcgagttccatcggagcaaagaaacccagccatacctgcgaggacccgtcgggcgagaggacggcgattgcgccgcccgtatcgggatccaccccaatcgcccagccggtggaggccgcggcggcggcggcggcggcctcgccgtcgtcgaccgggagcagcgagagggaggccagccaggggtccctcgtatcggcgtccgccagtagcttcgcccgcgccctggccctagccctagagggggacctggtgggcctcgtctcggcggcggcggcaggagcaggcacgcggcggcggcggcagcttcgggagcggaagggcggggcgaagaaggccgcggcggcgtcccagtgcagggtggagcggcggagtgcggtggagcggagcgcgttcatgtggtcctggctgccggcggggagggcggcggcggcggcggcggcggcggccgctgccataattaattaattaactcgaaatgagggaggaggggttttggggggataaggcgtcagaggaggacgcaggcgtgcgtgatgcctgcttgcttgctcacgaatctcctctccttgtttattttgcttcgtttttcttggttttttcttaattgcaaaagtttttttgtgtgtgtcgaattaggcatttctctttaaaaagaaaaataaaaaagtttcaatgtcacatcctcttcggaggtttagttgaagtgattttgtgtatttgatgtagtgaaaaatgaaattgcgcatgacaaatgtagtgcaggtgtagggtacataaatccaagaacgcatttgtcacttgcgacagaaacaatgccatttttatttagaaaagagatggtacatgtgtttttaatagaaatttagtaatgttaatgattaaccactagcttttatctcttgtcgatacacttttcgtatgaatttatcgagatttttatgttctctcgatattattgttagtctccgtctattggagcgtgtcatggtacataggcgtccttcacgtaatgaaaaatagcattggataaaatcataaaaatgaagaaactaagcaggaacaaggttttctttaccgccagatgcaaacagttagcacccagtaacccaaaccaagcataaaatttttgaacaaaaatttagttatttttgttcaattttatccggtttcagttttcctgaccgaaacatgattagagtacttatccatgaatcgatgctagaactgatcacgaggcacaaatttctaaagaattttacactatgattccaatgtttatatatcatctatcctacaagctgaatttggaattatacatcatctgtaaggtgagagaaatttaaatattgacatagataacccgttaactacggcaaatgtttgctgacttcctaagcagacgcctgacagctagcaagagccgagtggaacttctcatcaaatcatggtaccagtggcaagtgaataaaattagcagcgcaccatttcgtcgccaatctgctgcctaatggacctcagcatgttgcctcatcttagaaatatcaccaattctgcccgcaatgtttccagggaagtcgcattaagttagctcaacgagtctgcgcttcaaggaggatgttcgtggccgtgttgatgtcatttctggctcgcattagcgcctgtcttgcagcatttccatcaaagcccatcgaaaccagcatagcgattgaagattctgggggctccacgacaggagcgaatccagatggctgattgttctatattaaatagacagaatcaagatgtaagcatatagtcattggttttctttcaggcaatgcttaggaactcagagatgataaaggtttcgtgccttgtatgttagaaactataaaaattaatgggctatgcttgtatcagtagaaaaataattgaataacagtaacagatatgaaacatcaaaacccatcaagatgagacctgtaacttaagtatgaactttaagaacattgtggaccaagaccaaggaacaacaattttgtgctagtaactggagtcatcttaatcttgttgatgattacatatatggatgagtatttgatctatctatgttcacttcagttacaatggatcttcatcacatatgatggaagacatcacaaaacaatcataattgtccagttgaatcattgaaacatgcatacatggcagctaagtatatgaccaattactcaccagctaagaatccagatgaaaagatttatttatcaaaggatcaacatacacataaatcaaaacccaaacttagcttatcaaaaactaacctgcacagcacggcttgtacgagaactcatgtttccgaccagactcctggagggcctagatgaacctcccgaagaaggtgcgaaaattcttgcgaaaaatgatgcaataacctgtggcatctgtacaacgagcataaatagttagaactgcagacagaaaaataggcatgttttgagcctttggtcaaactctaaagacaaggaaatataataataaataaaagctctcctgccccacccacccccaacccccaccccaaaacaataaacttgaaaagaacagacaccagatcgtactactcaaaaccaagctagcaaatatccaacaaaaaaggggaaaccaggaataaacaacaaaatgcaatagcaaaaaagatctgactagatgtactttcacttaattctgcctgcagccatatgtatgtcaacatggaccatacaggcggtccgtgctgttcttttcttcgaaatgattatctgatatttaacaactgtaggtggagcaggtaatgactagctccagcctgatattacttggtccagttgattccatatcatattgcacacagtgagattttattaaaaaataacttctgatgccatgactcatgacttgtgactacaatagttctagtatatggaattaaatattattccaagtaaccaggcgactaacagaaaaacaacagaatataattttagtggtactgacataacaagaaaaattaatatagtatgaataagggagaacttaccttcatcctgcggatgccaagcacgttcagacgatagagagaaccagcaatcagaccacaaataccaggaataagagaacgcttcccagaagataaaagcagctgccaagagtaacagggaagttgtggcaatgaaatacttaagcgtaaatgacagataagtatccatttctgtccaaaaaaaaaaactaacctgcaggccagctaggtatatgaatgatttatcactgaagttaacaccaaaaatacgaaatcgtgatgtgacaggaatgtcaagaaagaatggaatgaatgaggcaaatataaggccataaggtccacatgcaagagtgctgaggtagttggtgtctgcaaaaataaataagaatatcaaaagaagctcaataatgacaaataaaaaagtcaacatttgccacaaaattatgacaaaaactgcactctcaataaatttcaaaaactcagagaaaataatgctcataattcaacagctaagctcatgaaaaataatcgtgaaaaagagggaaggaaactaacatcagcatggagcttaatgtctcgaaagaccactataaaatggtgaagaacaataaatcaagagccctatagcataatatggccagaaacaatgtcttggaacaactggatctagtatgtcacatataatgaatctctctaggtagcaactacctgacttgaattcataacatattgaatcaataaatttgtatttgcttgcaagttgcaccaaatgatgcattgcttgctagttcattggttgggtgctgatatttatcacaattcagcctacaaactactcagctaggttctcaactatattgttttttaagatgtataccttgacattttcttatctagacaacagccaatcagtttccagaacatccaaattataacagttgcagaaagcaggaaaatgaaaacaatgttagtatgtaagcatcattcataactactcaaggaaaaggaatttaaaagtatgttcttttcttaaaatttaccagacaatgctagtcagaaatttgtctcattgtcatacctttcaggagaaccaaagataggatctcaagaagcaatgatactgagatagtgaataaactaaaaacctgcaaaatacaattaaaaagcaattatatcatgatctcttactagcaaatttgtttgaacaactatttcttcttacaatggaagttaaaacaaactaaatatactgtttattccttcatgcattatatatggccctaaaactgagttgattccacacttaggctcatgacttgatagagtatttccaattgcacattaggtttttacacttcagaagcatttcactaaagtctgcggcatataaatttacagtgcgttatatgaagcagctaagagcaactttaaagttcaaggtactagacggtaaagttctcgagttccactgtacaggttcagatgcaatatactcctgcttctagttctaccaatataatgtaagttgtttatcaatctccatttcccagaaaagaattgatctcactctttctaccatactattactgttgtttatcaattcatttcacagcagagagaagtacaaaactgaggcacttaccgagtatttgttagagcctatctgcctctcgaaaacacggaagtaatagagcaggtagactccaaacaatagctccggtgttgactgaaaggcaaacccagatgcaaacaacttccatagacggaagtttttgacaatcccctgaaataacaaaaatgattgctttacacatacaaattacaaaagatccgtcataccacggatgcagcccaccttaagttttgcattaaagaagcagaaggtgaagtacagataataacaagaataatttaacggtgctgcagcagtgcaagctaacaggcacatgagaaatactgtttcagagctactattgggagttaactatcattataactataaggtacacacatggttaaacatatataagtggcatggtgcaactgaaatgtcatgtttgccaacttatcaacataaaatcatgtcctactcattattaacatgattagtttccatgtaagtttatatgataagtaaaactttaactcgtagtctactgtccaaaaagaacatatgatatattcaattacaacggtgatgaaacatctatatgtgctagttggtctgaagatggttctttttcttcttttcgggttgtgtacagatatttcccagactaactgaatcctaagttgatgtacacattttgcttctgttctatttgcccagagatgcactgcgtgaccgcacacccctaacagttcaatccatgtcttcccacagatacagtccatcaataagcaccagctactgagcactcctcaaatttccagaacggaccaaaatctgcaatctaacatcaccttggaacaacattccactagcaaatttcacccactgattcgccaacaccatagactattaaaaacaaagtaatcaggcacatcaaaacctatgattcagcgatcgtgcattcatgaatcttaatcaattagtaacccatgaatcaggcacttaatcaaagcaacacaacacaacgctcgtgacctaaccacggaacagctgcctgaaaaaccaatcgagattcggcgcccggctatccagggagggagggagggaggatgacctggtgggagaggacgagggcgcgggcgcggcgctgggcgctgaagacgacggagaggaggccgctggcgaggacgacggcccgcgtcaccggcgcgttctctgcaaccaaccaaagcgaaaaaacaaacaaacaaacgccggggaggcggtcaggcacggagtaaacggggcggaattccggtctcgattccggcgaaatctgagtggggggagggaggcggcgcttacggaatccggacacgccgccctgcatcgctcctctcgtccggaaccgatcgaccaccgccggggtcgggacgcggccccccacctctccgcggtcttccgcggcgagggttcccgtcaacttggacgggaggcaggctcgcggtcgcgggcggtccgacgaggaaggaagcgcggggtgggggccgtgcgagaggtgcggcgaactcgacggcggcggcggcgggcgggcgggcggagctcgggagggaggaagggggaagaagagtcagatgaggcgtggcgtgttttatgaggcggaagagacgaagagtcgttgacggtggagggggggtggttggctggaactcggctttggactctcctcctcctccgacctccggtgtggagctttctagaaatcacacaagtttgctctcttcgcatcagttccctacacaaacttgagaagcctttcttaaggtctatttggattgttatcataccaattttttaaaaaaaacttagataaattttggtactaccaatttttttttgttagggtaagattgtatttggtttgctacaaatataaagccagcacatgaattctagtgaagattgttctaaattgatgccaaatctagcatgggcattaccaataaattggtctcaatcaaaacaagcacatgtactatttaaactaccaaaatattggtagggctaagttttggtagcaatccaaaacagcccttaatttgatttctggggcggggcagattgtagccaaaatattactcaatattaccaaaaattttggcaggatttcttacgtatttactaaagtttggaaaaaaaaactaaatatatgcacatctttggtaaatttactagaaaataatatggttaacatcaatatgaatagcccctctattaagtcaaccgcaatgccaaattttaataacgtagctaaggttaagatgtgtgaatcgtgtaaaaaaaagtaggttaaggtgtgtgaattgtatctggtttgttactttatttatatcgaagaaaattttagaactatcaaatctttgtagaggctattttgggtactactacctccgtttcaggttataagactttctagcattgcccacatttatatagatgttaatgaatctaaacatatatgtctagattcattaacatctatataaatgtaggcaatactagaaagtcttataatatgaaactgaggaagtatctaatgggg

SEQ ID NO: 80772 - DNA, 3481 bp, Oryza sativa
gcgcagggaaaggaaagccctgtagacagagggcgaggcgaggagggactccatcgcacgaggagcacgaggtgggtgggtgggtgggagggttggtgggatacggatacgacgacggggaagagccggcggcgatggggtgtctctcctcgtcgcaggagaatggggttttgattttataagccaaggcgggggaggtggcgacggcggttagcacaattcgcagaggcagcgacggtccgaggccggagctgaccgacgtgacggggcagtgatgaaagcgatgcccacaagacacggacccgttcccaacttggcctcccctgggcctgcctcgtgttctctcgctcttttcgttcctttttttcatattatttcataaacaaacaaaatactagtaaattatttttaaaaggtcctacatctatcctaaaatatacagtccgtattaaattttaaaatgaaggtaattttgtcttttactcagtccatccatcaagttagaaatattgtatcctcaagttacaatattttgaaatgttgatcataaataacttatgagatgctttctctaaaattaaataaaatgcatgtatagatttatcttaaaaaaattatactatcatagtatgattcacttatttaattttataaactcgttttaatatcaaattattggtcaaattttaaatgttttcataaaattttatcctaaataataaacatttatgggaagtatactatatttttctgcagcataaatattaactaggaaagctagattttttgtgtaggtttcatccctatatatagtcatagcttattcatcaggttattaaaatgaattatttgctatatgcatcgaaaaatatgttttctaacaaaataaagcataacaataatagtcgtgaaacggattattcatgtttgcattataatatgctaaaagtggatgttgtaatatgctacgtactccaagccaaccctaggatgcaaatcaacatattggtttattgaaccaacgtggtacctaagaacatggccaataaagactatcagcggtctcaacatgtcatatactagataatatcccgcgctttgctgcgggatttatgaatgagtatatgttaaatactattgaaatgataaaagctaaaaagttgagaaaataatgtgagaaagatgattaacacatacttgtttatctctataatataatattgtagatgatatgctatgcttgtatgggatttaaaatatactagaataatagtaattgctagtgagtgaagatgtggcatacttgcatgggattttaaatgggctagaatagtaattgctagtgggtgatgatgtgacatgtttgcatgttgagctttagcttctaataattgttaatgggtaccaactatatagaatgtatagataggataaagccacaataaagaccacttaaaggtatattttgcgttttagtccttaattattttttgtcaaaccttatagtactatttttattaccaaatcaactaaaacttttatattttagaccttacaacaataaaaatatatatatatatatatatactcctaacctctatatggacccagcgcaaacctctccccccatcttctttttctctcccttatcccactctctttctattccgccaccatccatggatcctcttctcttgacagtaacatcttctcagccactaatgtcaccttctcttccaccgttgtaatgccgcctctcccccatctccttatctatgagcgatggcaaatgatcctcacagcgacggcggatctggccgcaagctcactagcctttcccccctccccttctctacgagtggtggcggaggatccccacggcagcgacagacttggtcgcgagctcacaggacctgcagtggcgaggagcaacgactatctcgctgagagccctcaacagtagtggtgagcggtgacaacctcggttacagcaagcagctacaaccacaacaagtccggttctgtttctcttttctcccgaaagcgtgtcgcggggctccggacttgcccaaatacgtggcccgaagtaggggtggaaagaagccgaacctagccaggcttggctcggctgctggaagctcgcgaaagccaggctcggcttggctcggctcggttctccaaccgagctatacattaggctcggctcggctcgtgggctggctcgagccggctcgagctggctcgtgagctttgcaatagcagcagttgtattgccagcagcagttgtgttgctttgcaatgacttggttattcagataataactctcaagtccctacaaagataattaggtatattgtatgcagccaacatataacaaattgatggggttttttggttttcggccagaagtctttctattcaaaccgagcctactaagctcgtgagctgctcgcgagctggctcgggctcggctcggttcacaaacgagctaaaacccaggctcgggctcggctcgtttaggattcgagccgagccgagccaggcgagcccgagccgagcttgagccgagttcacgagcccgagctatttgtccagccctagccccgagctgtgtctttgtagctcccgacccgaggcacgacaaggcaaccagaacctctgtaggtcgtgcatggtgtcgtgagaccttggtccctaccgccacgagcgtttaggtccgacatggaggctcgagaccactttatacagtggtgcattgagtatggccttaagcatggaggatcagaggagctcagcagtaagatgagtactagcacatgattgatcagcagtaagatgagtccttctagcacatgattgatcacagtgcttggtgagaacctgcggttgtgcaacacatataaaagagtaaagtacatgttcgacagaaatcactcgtatcctcgtactcataaaatgcagaataagcaaactagtgtttttctgttcagcactagtccaaattagtagtcctaacccattctgtgagctgaaatggcattgcgtaatttggtgattgatgaaacatgttcttgcaccatagtccataaatattggtacttggtaaagaggagttcccagccattcaccatgtggttttttcaggtaatctcagatcatgtgtccatgctttaatttgtttgttcgtgggcaaacaagggatgaggcggccaggctgcgtttgcaacccctttccaaaccgctctcccacgttttcaaactgttaaacaatacgttttttaaaaaaaaaaattttatacgaaaattgtttaaaaaatcaaattaatccatttttttaaaaaaattagttaatacttaattaatcacgcgctaatgaatcgctccgttttccgtgcaaggtgttggtgttgggagtcaggggtggtgaacacacctggcagtgatcgaaagagtgaattcccaacactcccctctcgtttt

SEQ ID NO: 80773 - DNA, 16697 bp, Oryza sativa
cggtgagtttaatttcttgtttgtaagcttcaaatgattttctcataaatcattttgtaattaaatccgattaacactgttttattcattatagttaaatcatcttcggtgattatattttactgaaaaaaatttaaatcatcttcggtgacaagtgagccgcataaaattttagcttatctcaaccatgttacatctctccaatgaatataatctactctggataacttcattgacaatgttctagcttatgcaatttagtatctctttccactggtagacgactagacgtcatcaatataatctcgatatgaagttgtcaaactatcccaaagcagtaacatgtatataagcattttacagtgtgtaactgtggccattacgcactacggacaagtttagcttagatccatggcttcgccacctagttcgaccttgtactccaatccgcaacggcattttactgcatcagaaactccctacaggacaaggagatgatcagctaatcaccactgctcaaagtagcttcaccactccctatcggcagcatagtatggataaggtaaccaaactagatagcatcagcgtaccttcatttcatttatacgttcttcaagagactgaaagtactcaatttctccagctttatcagcttgtagagctttgtgttcctcctctaaggatttcatatccatctgttgtagtggagcctgcaagcaccagagttatacaacatcacaaatgagaattaaaaacaatgttagaatggtagaagagcgtgcctaaacatacaagaaagccagaaattgcatttttctcttgctctatgacctgcttactctgaaaagtaaagacataatcctttcagtttcacccaaaaataggcataatacaacttgcagatgtcatagatctaaggatgggtgtcagaattggagtacttcgctgatttccgtaagaagtgctgattgtttttctttgatctcgtcgatcttatgtttagttgactccagttgaatcctgagttctccttgcttgcttccaatgtcatttccctgtttattagttagtgacactctggatcatttttaagaggatgggatgagatattaatcaccttatctaggctcccacatgagttaagtattccatggctttgtcctgcatacaaacaacacaaccaagtcaatgtaaagttgtaaaaattgttcatcattataacttaacacaagatttctctatgtcatccaatgtttagacacgctacaaggcagagactgctaatctaacacaatgaaaaaaaattctcaattttagtgatgcagcccaatcagttctaaccatatcaattggtgcttttagattaacaaaggttggcactgtactgagactctgggagggagggtggtgaggaagactgtccagaaaagaagattgcagaaacttctactccatgctcaccagttaatcaaaaaggaggaattagttagatatgtaaataaacattatatgattttgttatagcctttgtaaagagagcatatgatgcaaaaatgagtgggggaggacctcatcaatcaatgatttctagaataaacagtggtttggccagaaaagggcaggtgcatatgcctgagctgaatacataggagaatggacttcgctattccttcttgatcaacacttaacctgatccctctttatacaaggtcggcttcctaataatctaagctacgtatagtaatcaaatattaatttaggtatctaaatttcatgccaacttttagatagaaatgctatgcaatttatagaagtctccagaatccagatatcttcttatcaattggtgccacttccacacaaagcctgaactggtgcagctgcacatcggctcctcctttgatactaccaaagtcaaagtataacagcttttagttctaatccacatgtgcataataaatctacaagtctgaaatttcacagattgagccaggaagtgtaactcatgcccccaacttccaagaattgcaatcagtgcaaatgcatttgtcatatgtcatatgtgtacttgtgtagggcatgcacatattaaaagcatgcagtctgctttgcttcatggccttcctcagcacctttcatggtagctaactcagaaacacagattgatgcaattagaactgactggactgcacaataacatgtttcaactatataatgaaaaaaaaaaactgcacaatcaacataccacatattgacgcttaccaacatggatacagaaaacccatgaaaggacttaagtaagataggaaaaaatagcattggagccactatttatttcacttcatattcagaagagctgtaccttgaaggttttgcttgctctgagactcttcaacctgaaagtgtattataacacactaattaaacagtagttgcttcattgtaacagggcattgaaatgaggagcagaggttacaagatgatatcattgaaaaacaagtgatcctatctgctcgaaatacttgcagactacatgttgaatatcaagcggaagctccctgattttaataagcatggttgagataagggcccttaggcctgattgaggtgtatctggacagctggacccaagtagcgacagcactaagggcaggggagaagagggagagatcaaagacttgtctgttgttttggttaatatatagacacgagcctacacttaccaatataaatgagatcagttgatccttgacaacttacctgtaattcaactccaatctgaacaggctttgtgaacagtaaccacacgtgaacagtaccatgggtactgatcatgtacacattgttgcgggccctagagagattgattacctcttaaatatgggcctaatgggtgacacatggcactgataaaattaagatgacttgataatttgtccaaatattccagaattattttccttttacacaagacttgggttgtcattaataaacacaatggttatgatgctcaaattaacttttactttggtaagtggttgccttatggtacagagaatttttagttactggtgttcctggtggggcatatatactatatacctcatgcaacttattagtagcataattggtgaagtgaatttataaatagtccacccaagtattaaacaacatttgttgcttctgttctctgaagttctattggaaatttggattttgggtaggataccagtactggaataaactggctaatatatttttgaatttgaatttaaaattcaaatttgaaatttataaaattgctatagcctcatgtgtcacctttatgccatcacatatgcaatagccaaaagaaaatttattatgtcttcagctcatgctaattgtgcaatgacctctagacatatatatatgtgtgaaaatgtgttatatttgcgctatggactctagtgatatatgtatctatgtgctatatcatgtataatgttcatctctaattggctcatgtattatgttgatctataatttgttatggattcatgcatcatgttcatttggaactataagattgcactaattactatacacaattttccagatggatactgttttcaaattaaatgtttggacctgaatttttctccgagtaaatctggtaaatggacagttctggcgaataccagtatttcataccttgtcattactagctggctcaaaacaagtactagtgtaccacagtattaaacaaaagggcaataagcaataacagaacttatctccctccgtcccaaaatgtaagcatttttagctatgaatctgggcaactgtgtgtccaaattcatagccaaaagttgctatattttgggacggaggtagtagtaacttgcagtaacagtatacatataagtttctttacttacataaaaataatcacaagaaaggaaaacaatttcttcaaattacagtaacatatgcgtaaggcttacagatggttcaattgtaatcaccttaagcttaaatgcaccaagccattcctgtgaaagaatggaaagtgttacagcaatggaatgataaatctggtatacttcctcatggaacataaaactgactagaaaagataaacataggactaaaaaaatatgttaacctgttgctcttgtaatttgaccgtcaggctttctattgtctttgtgtagaacaatctgtcatgagagcagaattagcgtaactacgatttacagtacatccttttgagagcacaggctacaccttttctcaatgagttttgaagaagtacttgcgatttcctgatggaggagctccaaggtctgcaagtacaatggaggaatgaagacagaagtctgactgagaatttatgaagttagatagacaaaaacaaaaacagcaaacaaaaaatgtccagatgataagaaagatgcacggcatacagaattttggattatactactgttacaaaagtctaatatcagagggccttctggggccttcctgctatatgaaattttcatgtgttgtgggactgggctagggtaagagtctaggctgttacgcccttttgatgagctataaagaccctaaggctgcgttcgtttgggtgatagggagtgagaatgcacattgttttccgcggacacgcttcccaaactattaaacggtgtgttttttgcaaaaattttctatatgaaagttgctttaaaaaatcatattaatccatttttgaaatttaaaatagttaatactcaattaatcatgagctaatggttcacctcgttttgcgtatcttcccaatctcctcaatccccttttcctcaaacacaccctaagacttattgggcgtttggagttttggactatccgtagagattgattgattaatggaagtagatatatatccatccttatatggcatatctttaatattacggaaaagatgattctaaccgatctaatcttatcaaaactaattcgtggcatagtaattacataaacaatatgtggtgcaccgatgttacactacacatgtgaacaatacccgagcccataccttaggcctcttcttttataagctcatcacaacacgaaaatcaatgggaaattttacataggatacaataaataccagtgttctaaaagacagcactaggcgccagatagctgccactattaggcaatagatggtgcattaggtcactgaactaccttgggaggtaaacatgtttgaactggtagcagtaacagttggttttacaacttatccctcctctcatatcctgttctcatatcctgtcaaacaaaacaaatcgcgctgataggttggctcttcatcctctccatggatataaaatactcgtccagttaaaatggcataaaaactcatgcatgatcagaaaagttattcaatatgctccaatatatagaaaatcagaaaagttatttctggggaaagtaatgctgtagagttagaaagagattttcagtatattttttcagattagaagcaaaatatagagaaacgtggtttgagttttcaaaacacaatctcagtacacaaaatacttgtcaaaccaaagaaaataaatacttatcatcattgtcatttccatatgccacaaactttttgtaacttctaaagaaatatgcctcataacggtttatggtaagctcactaatgtagtagtgggtattgtgaaaggttgtagaagtattagcatatgtgagaagtgtgccaaagttagtgacaacaaaatttttcccttgtctctaacaattggcacattttgttcagattaaactgacaactgttcacagacagatctaactagtaaatgtagctctctattggttaggaacgaatagtcatatgacgaacagagcatgcaagtatggtggagctccaatgcatctgtttatgtatgaactttaaaagtgtcatttagaacattaagcacaacaatgtttaccacattcaattgaaaaggcaataacataaatacttgatgaccagtttcagaatcaccaaacatcaaattatcttgcttgtcattcattctacacggctaaaaatttgggcattacaagaactatagttttgtaacctccaggaaagtgatgcaccaaatggaatcaaatattaaattagaaaagcaggaaattcgtcccaaatgggataaaatttcgactctacagcaggcaggtgaataaaactttcagctctctaatgttaaacagcatttaattgtatagacctaaaatggtttatggacgtttcatccacgatagacgaaaattggtactacatccaaggcaccaaaaaaactcattgaatgtgaaacgactggcaccaagcagagcactagaattagaatgatcagtaccgggactaatcacctgcttcagcgtggcgcactcaatctccagcgtggcaatcctgccctgcttctcggatatctctacgcagagctccgccctcgccttcgaaagctgctcggactcctcgctagcctgcttcgtctgcgccctcactacccaaccaaaaaccccatagcacgagaaggcgttaccggaggaaagaggcagaagcagggccaaaggggctgggcgccctaggggtggggggaccttgggcgaggtcggcgccgtgggcgtcgatggcagtgcgctgccgctgctcctccgccgaccgcttcgtcgcttcctcctccagatctgcaagaccaacaaaacgaaacaggcggaattcagggagggatgtggattttgggggatcgcagcgcaggacgcaccgctcatgtaggagcggagggtcttcatgttagccaggtactcctccatggctggtccgccggagtggtggagcggaacggaggagaatacgacggcggcggcggcgaggagaggatggagacgcggcggaggagagtatgggcgagcgagagagcgctctcgaggtttccgttggaagtgaggtttatgcttttatccaaccctcgagaaaagaatttaagatcatgtacttacctccgtttatgatgtatagcttcatcaggagatcgctaagtatttttttccaccacttttttttcacgatatagtttttattttcggataagattatatacctaaagtatatgcctataaagtttatacatattttataggttaaaattttatatacccgatcaaatttaaatttggatttaaatattcttatatagaatatttctatacataaagttatattataaatcaaagtctatacacatgaatatatttttaagggtattagattttatttactcttttttatatatatttttaatattttaaatttatgatataataggaagggaagaaggagaagtagcgtacgcaccaagaggagggacgggggatgattgtacgtaccaggaggagggacgggggatgattgttctgggttatcacccacccattagccctccccgcttcatcatcttttttctcaaactatccttaaactttgattaacacatcgtcctattgagtacaattttacatttgactatttatattttttttaagagaaaccatttattgatgagctcgatgttttatattttattattgagactagcaattatgtcagagtgttagaacgggaagaaaaatcgataaagttagacagggaaagagagagaattgttgacaaaaagccgagtataataagttgatataatacaaattaccaaagactagtcatttaagaattaacatatgcatgtctttagcatgatagtaacaatgctaacaatgtggggggataatgcaaactactaccaccttttttaataaatgacaccgttgactttttgtcacacgtttgaccatttgttttattcaaaacatttacgtaattattttttgtgagttgttttatcacttaaaatacttttagcatgatttatatcttatagatttgcataaattttttaaataagataaatagtcaaacatgtgacaaaaggttaacgaccgtaatctattaaaaaatatattaaaaaatagagggagtacttgtctttttacttacaattcagtggcttaaaaataacaagtttggtaactggtaagtagaattacccctgagtcttttcataaactaagggtgtgttcggcaccacatgttctcaactcttctccctcgtgttccgcacgcacgctttttaaactgttaaacgatgtgttttttgtaaaaagtttctatacgaaagttgtttaaaaaaatcatattgatccattttatttttaaaaaatagctaatacttaattaattacgcgctaattaaaaaaagaaaatgcaaactgggagagagagagagtgaagagaggaaggggaggtatgacaagtgggtcccatatttttaaaaagaaaatacttactagattgccacgcgtacgccacgtaggacaaaaccgctctggattaggtcgaggggagtgattcgtccggtattgaaagttcagggtgagcaatgtctgtttttcaagtttagggggtaattcggtcgaccgcgatagtttagtgggtaattcatacttttttaaaaaaaaacacatgatagataactctcgtactcgtattattctggttgttcacagagtacaaaactatctatagacagcaaagctatatatagcttttgaccgttagaaatatgtggggtcgtacgagattctcaagcaaggcgagcagaatttcagaagctgacgaggaaaacagaacaaaacaggggagaaacaagcctacagatgatggctcggtctatcccgccggagtccggtgacgagaacgtctcggcttctgccgatggtgtgtatgcctccttgttcattctctgcatgaattgcctttcctacactgggaatgcaaatgaaattctctcgtggtagaagatcgaaattaagctactagctagtttctcttggagaatgaaatcaacaacagttttcttccacttcccatttgttcgtgcaaaattgctgctaaaatatttaacgattttactcatgtttctttttttttccccaatggaatctgaacggctcagtgttgctttgctaaaaacatgagggtttgagaacttctctcgcaaagacatgcaggcggcctattttagggacagaagatgacaaaagaacatcaaggaagagggcgtacgtgtagagaaagacggtgaaatattttgccagccagccggccggccggagtccgacgatcgagcacattccgatggacactgcaggcggtacaacaaaccacgcctaaaacctcctttacttgtaagtcatcgtcgcaaagttctaccacaaacaagtgaaacgcattgatcgtcaatttcgtaaaaacacttcaaatgcatagatcataagctttcaaatctcggttgcatatcgtttgctggttagtttgttagccatagtcaagatttgaattttgaaactttacttgggagttctttttcatcgtaatctatttttagcattagcttttaaactgcaaacaaatagatataaaaagttgtgattagttcattttggaatttgggattatttcattcaattttgggtcattagaggaaacacttttaatcatttagatggacatccacccatttgttgcctgtcaaattaaatgattatgatttttttttaaaaaaatggataagatatattaatacttcctctatttcacaatgataagatatattagggtgccatcatttggcatattggtggaataagctaaacggtatatttgcaaatgaaaagtaatttgtgaataaaatttttatatatgtgttattagcgatctaaaagcaaaggctgaaaaataaccttcaatgaaaaaaccctaaaatcagcttcaaatttaatattgaaaattcaaattttggctgataagcatatgaatatgccaaacgatggagacctaatacgttccgttccacaatgaatctagacatatagcattgcctacattcatatagatataaagaatctagacacatatttgtctagattcattagagtatctatatgaatgtgaacagtgctagaaaagtcttacaatatgaaatagggggagtacataatatgtcacttcataaacatacaagtttaaatttgacttctatgagttctaacaaaaacataaaaaattaactctaattagtatacgtatatactcacagttaaatttgtttttcttacaactcgtaaaagttaaatttgaacttgtttgtttaagtgaatattcatattaatctatcttatcttgtcaattgttttgatttattattttgtaattatctagttgacatgtaataaatatatgaacatatccaaccgaatgattaaaagccctctccgggttatcagccataatcactatcagagttttgtgtgtgtgtgtgtgcgcactgcagaggagggcatggaggaggaggtgaacgaccacccgatcgaggaggtccggaacacggtgccggtgaccgacgacccgtcggagccgtgcctgacgttccgggtgtgggtgctggggctctcgtcgtgcgtgttcctcgccttcgtcaacgagttcttcatgtaccggaccacgcagctgagcatcggcacggtggtggtgcaaatcatcacgctgcccatcggccgcctcatggcgtcgacgctgccggcgaggcgcctccgcgtcggcggctggtccttctccctcaacccggggcccttcagcctcaaggagcattgcctcatcatcatcttcgccggcgccggcgccagcggcgtctatgccatgaacatcatcgccatcgtcaaggtgttctacaagcgccagatcagcccctacgccgccatgctgctcgcccagaccacccaggttgccactcatgcattggttgattagtaacaaatcgaagacctgatcaaacacacattgattaatccaaaaatggccttttatttgatttcatacagttgcttgggtatggatgggccggattgttcaggaagtacctggttgactcagcctacatgtggtggccgtcaaacctcgtccaagtcaccctcttcaggtaatggtactaattaccagcagttattttgtcgaaatatttgtttctgaaaaatatatgatgcaaatggggaatgggcaaacacaaactttattttgagcattttttttttttgcggggaaacttataagcaaaatttggaatgtttgtcacgcagggcgatgcacgaggaggagaagaggaacaaggggcagctgacgcggctgcagttcttcatcatggtgatgacgtgcagcttcgcctactatatcgtacccagctacctgttcccggcgatcagcaccatctcggtgctgtgctggctgtacagggactcggtgacggcgcagcagatcggctccggcgcctcgggcctcggcgtcggctccttcggcctcgactggaacaccgtggtgggcttcctcggcaacccgctggcgtcgccggcgttcgccatcttcaacgtcatggccggcttcgcgctcagcacctacgtcgccgtgccgatcctctactggaccgacacctacaacgccaagcgcttcccgctcgtgtcgtcgcacgtcttcaacgccgccggcggccgctacgacaccgcccgcatcctcgacccggccaccttcacgctcaacctcagggagtacgacgcctacggccgcatcaacctcagcatcctcttcgccatcaactacggcatcggcttcgcgggcctcatgtccacgctctcccacgtcgcgctctaccacggcaagcaagttttcccgcacaagctcttgctaacttagtactcccgtcagtcataaatatttgatatgtttatgacaagattcagctaaccagcttgcaaaacttttgacttcaatttgttcgagcagggacatttggggcttgtggcggaaggcaacggcggagcaggcgaacggcggcggcaaggagcgccaagacgtgcacacgagaatcatgaagaggaactacaaggccgtgccacagtggtggtttcacttgatgctggccatcgtgatggcattgtcgctgtacacctgtgaggggtttggccggcagcttcagctgccatactggggtctcctccttgcctgtgccatcgccttcaccttcacgttgcccatcggcgtcatctctgccacgaccaacatggtcagcacaagtagaattactttctctttcagccttgaattaacgttaactaagctagtatagtagtaaattgcattattgttggttggttgtttctttcagcaaccagggttaaacatcatcacagagctcatcatcgggtacctgtacccggggaagccattggcgaatgtggtgttcaagacctacggctacataagcatgactcaggcgctgacgtttgtgtcggatttcaagctggggcactacatgaagataccgcccaggtccatgttcatggtgcagctggcagggacggtggtggcgtcgacggtgcacttcgcgacggcgtggtggctgctgacgacggtgaggaacatctgcgacgtggacagcctgccgctggggagcccgtggacgtgccccggcgaggacgtcttctacaacgcctccatcatctggggcgtcgtcggaccgctccggatgtttggccgtctcggcaactactggcagatgaactacttcttcctcgtcggcgtcctcgcgccggtgcccgtctggctgctgtcgcgccggtacccgcgcagcgcgttgctccgggacatcaacctgccgctcgtcctcgccggcgccagcgggctgctcccggcgaggtccgtcaacttcgtcatgtgggggctcgtcgggttcgtgttcaaccacgtcgtgtaccgccggtgcagggcgtggtggatgcggcataactacgtgctcgccgcggggctcgacgccggcgtcgccttcatgggcgtgctcaccttcgtctcgctaggatacttcgacatatacggggtgcagtggtggggtggcgccgccgatgatcactgccccttggcgtcgtgccccacagcacctggggtgtttgccaggggatgcccgcctgtaccttcttgattgatcaggacaccgcatctacatgtatatactccatatgacagatggttactcaaatgtatatattatatcctcttgtcttcctctcttttgccccctcctcttcatacactgtagatccaatggtcgccactcgccagccggcagtggtcacggcctcaccggtgcattacacctgcaatgcaaagtggctatgagcctatgaaggtgtcagtttcttagacagcgagccatgctcgcatgtgcctctttccgcctgcctgcttggatcctaatctggtcggtctttgtgctgtcctctggtctctggttgctattggcacaaattgaggacttttggttgtgtgttgcaaggcttcatgtgaaaatatagctcaaagccagtagggatgacctcgagaggcatcggttccttatgggatggttaataaggttctctttgatcttgccccattatgtctcattgggtgaaaaacaatgattcagcttatcagaccgaatgacaacgctgagtattggccttacatcatgttggttttcgccttagaatccattaaaacctatatctctggacaactgttaaaactcaaaaattctcggtttgtgattacgcttatccactgaacaaaattttaagctccggtccaacaaaaatacctcgaggtatcagtacctcacggtaccaaattgtttccgtgggtgagggctggatcgacagaggcggcggtgtgcggagagaggggaagagaaaaaggaaggaggaggtggctaccttgtgacggcgcgggaatttggatcggcggcgatggcagtgggagaggggaagacagagagaaagagaaaagggggcatcgacggatgaggatttgggagcggggaggtgagcttggggtggtgtagcgaacagcgaagctcgccggcctttttataggcaagcgtcggcgctatagacgcgggagaggcggttgcgcagctcccagtgcggcatggatgtgttggccgtggcagcgacgtagtgaacacttggtgcaggtggcagcaccatgatgttgcggggcaacgcggggaagatgggacacagggaggctgcgatgcgacgtgacgaggatgggttgaatttaacggcgcccttttcgccgcccaattggtcaccaccagctatttaagtgacgcgcctccagtggcgtcactgtccttctcccgtcctcccccctcccccacacaaaatccaagccgttcacatgactcctatcctccactctttgctctagtgtcttccgttcacatcgccggaatgcgctcgcctgcctccacgtcgcgtggcgtcggtaggagttggtcgccaaccgccacgccgcgctcgacatggggctaatcatggggggaaacctcctccaggccgacctcgaggccaccaaatagcgcgcatcatcgccaaccccgatgaaggcagcgacgcggaggctatcgatgagtagacccggtcatcgtttctctcccgcaacagcacggccctccgccgtcgctcggctcctgctcctgtccctctgcaaacgaagagaaaggagagggaaagagagatagaagggagagagagaggaggaagaaggaaatgatagaggatggcatgtagggtcccaacatgacagtgtgtcccacaattatttgtgtgaacaacaaatgggtcttacatattcttttaattttaataccacataagtgccacgtcagcgtcacgttggatgaatactaggtcaacaccgccacgtaagcgctacataagcaaaaccgccctctaaaaccgtcaagggggtcaaattgcaccggttttaatagttgaatgatctgagatatccagtattgtagttcagggagcgccatgcgaagttacaactggacatgcaagacaacatagatcaatggaaagctgacgaatatagctatagtaggggaagtagtctatcttctccaccaagctgatattctagggttttgctggctatagcaattgattacgcaactacgtacaaatacttaattaatcacatgctaatggaccgctccgttttccgtgcgtactgtttaggcggggaaccgactagagcgaacacaacctaagagcaagtagtaattagatgagtagtgaaggtcagtagaaaaaagtgaacggtcgagggttatgattagttggacagagaatgttagtggagaagttatattttagaacaaatactataggctaaaagttattatattttaggatggagtaactactatatgagttggttgagaggttatcagattgtataactgcagacaccttataagatatttcctccatttcatattataagactttctagcattgtccgcattcatatagatattaatgatctagacatatatgtgaatagattcattaacattactcttcgtttcacaatgtaaatcattctagcatttcgtagattcattaacatcaatatgaatgtgcgaaatactagaatgatttacattgtgaaacgaaggaagtatatgaacgtgaacaatactagaaaatcttataatatgaaacgaagggaataatctatacttgggtcctatagtgtatagcttggttcaattggtacacgtgcagtgtgaacatctttggaataatagtgtattctgcatctcaccatgtctccagttaatatagtgcaatttaaatcaaaccagatactaatgaactacaccggctgaaaatgcaattataccaaactagtttatccgaagactactgagccctgcaaggaaaatatgcaacgatatatggtagccatatagcacccaagaagtcagcattcattagcctatagcacccaaccaacctacaaaattgccagcgcagaaaattgatacgcatacaaattaagatgcaagctgacctcaatggacactaatgattacgaaatttttaactaagaacagaagaaaaacgatgatatactactatgaattcaagatacttcatcgccatcatatcaagcctatgataggaaagatccacagaaaatatgctccagttgcatctcaaatcgactaaatacgagctaaactaacagccatagtgactttgctatctaatcaaagcatatgtgcgatctcttgaattctaaacactgaaaaagtgattttaaattctacaagccaatctaacaggagtcaggagtggtacagcaaccttagcagagccaatctaacaggcgtacataaaccttagcagagccaaatctagcaggagaggtacataaccttagcagattaaacttcaactcttcttttctagctgcagataatttatcttgccttgtctagtaccgaccttctgcaagcttatctaacacacacatggcagcatctgaagctgtctaccttgcatatggatgataacgaccagaagcaccagcaccactgctaccatagcctcctctagcaccatagagtccacccgtgccaaagccaacaccagcaccaggacct

SEQ ID NO: 80774 - DNA, 6636 bp, Oryza sativa
cccccccccccaattgaaagtccatccaacactctaaaacttaaaacgagaatactgttcatataacaccctaagatgattttatcaagtggtttttatctaacttgcatatatgttgaatgagtttgaccatgtgacacatgcattgcacatatatatgttaaaatccttgcctaaacattttgcttttaccttttttttctctcacttacaaaccaatgttgatataatactagtatgacatcactatagagggatcgatgaatgacgatatataaacatactatgttaattattattcaaaaccacttatttaagctccaaatatgcaaaattactatccaaaactatcttatggtgtaatataaatgatattgtaaaatttgaaaggttgaatgtttggtttcaaagtttggtgtgcttcatggaagtacagggagtacacagacttttccctttcggcaaccatgtgaatttaagtttgtattgaaacttttaaacaagtactcgaaattctatataaatttgctttagaagttctaaaattggctccatgttctataagggccagactgctctgaatgtggcaatgtttgggtgtattagatggacgactattatccaggtccttaacaatcctatggcaaaaaatgggacaactaaaacagtaagtccaataaccaacatatattctgcaaaaattatctatgtcttaaaaaaaactatgcaaaaaagttcactctgctgttgtacaaaggaaaatactcttttactctcataaaaaggttgaaactaaattgaaaatggtactagctgtaaatacagagaaaatttgtcacaatgatacaaatatagcagtactattttgttttgtaagaaaaaaacactcgctccatctcaaaatataacaacacagtattagattatatgcaaatagttcatagtattagattatacaccatgttcacttggagaggagaggagagatggctatctcagcggccgtgcgtacagtggaactttctgttatcttttgaattgatcaaatcgttctatagttaaattaatttgctcaagctctaaattattttagtcttaatttcctcttctcatcgtcttcagtttttcagttaatttttcatgttccatctttatcaatattagtgttcaacaattttccatctttgagtgcccatgtcatcctcaagggtgactcaggcgacgaccacccgcggcagtggcccaccacccttccccttccttccccctcgccgtcaccgatgctagccgccggtctacgtgcggtgacaaggaaggcgacggtggggccgcttttcctctccagatctagtcgaggctcctcgcggatctaaggcgttgtagtttggagttcgcaaggtcagtagcaacacttgcagcagaggaggcggcaacccgcgtagaaggaggagacagagtcgacgacgacggagttggcggtgacaaagtttgggggtcgagctgttggtggccccatggacagatctggtaccccatggccggatctggagaggctggcgccttcaacggtaggagagcaattccaaggtgggcagggctgcagcagccacaggcttcgcagtggccgataggtcacggcggtggtgtgctggagttgctacggttgcaggggtagagttgaagccgccagagcacctagaaagggtggagttggagttggagccgtcgacggatttgtctggattggcgtatgttgagggtgtccgcatttgcaggaattgctcgtgcatagccgcagggcaacaacatcatggtgggcatcggctttcttggtggcttcaaggacggcttgtggtttccccctcgactgaccaatctccttttcccacccggagctcctccccttctttgtatcgctctgcttctagatcccggtgcagggagccccatggtagtaatgaggtttccgtatggtcaagcagggttcccacaatatgctaaagtttgagcaaccttcggcgtcatcgtcattttctcgaggtctgcgacatctaggtgacatgtgggggggtgtacctagggattttggtggttttggttggttccacccacggctgagctttcgcaagctgaggtgaagtcggagctacttggtgtgacgagcttggcaatgataacccctcaggaagtgtagttcaacgtggatggaggagcagtgttgtatgcccctgaagtgcagtgtcatcttgtgttgtggtggaatcggagctgttgtgccgggtggcaagctaggcaatgataactcagaacacccttgtcttgttctttagggtactccctctgtcccaaaatataaggaattttggtgggatgtgatatatcctacctgtccagattcgtagtactaggatgtgtcacatccctccaaaatccttaatattatgggacggagggagtaatcaacaatcgagagagcccaactgcccaaggcggaagcctttcgtagtctttttggtgatggtgatgttgacgcctttgggtgccgtgttcttcttgggtgcatcattcatgtgactctctcttctttaggtgaacacctagtttggtgctacagtcaggcgtcaaaagcattcttgatgttgtttccttgttggaggcttcgattaatagttcctgctcctgtggtgggtttgtttgaaggttgtggctcttcttaagaagtcggggcgcttctcgtctcttgatgagtttgacaacgatgacttgagtcgtaccttagtagtcttgtagtcgttggttgtttctcttttttctctatgtgtaggttttgacggttttccttataaactgggctaaatctccttcttaatatatctagcagaactcctgccgtcggtgtttttttaaaaaagtttttatgttcctaggtgacatcaaaaccaataccttgacggcctcctcgtttcatgcaaggccatcagttggcgccaacgcacgccggtgtggtttcctctccaaaattaaggcgtcccctctcccaaccgcacgtcgcgcgttccctctcctcgccaccgccgtcgccgccgccgccgccgcgccgttccccgccccgaccagacgaccgccgccgccgccgccgccgccgccgcgctgccccggcggcagcgccgccgaccgccacatgacacagcctccccggcgacccgacgccaccgagacgacgaccgccttcctcggcgccgcgtccacaccgagcccgcggcccgcgccggccaccccgctcccggacgccccgtcgttcctgctcggcccgtccacgccgctccccccgccgctcccgccgccgacgtcaactgcggcggcggcggcggcggcgaaggcgaagcaccagaagcagcagcagcagcagacctccaagcactggtcgcggccggcacggttcgtgcggtcggtgcgcgccgcgttccggtcgttcccgatcctcccggcgccgtcgtgccgggggctgccgtcgctgccccacctcccgggcctccaccacggcggcgcgggcggcgccgtcaggaaccacttccacggctccacccgcaccacggggacgctctacggccaccgccgcgcgcgcatcaccatcgccttccacgacagcccgggcagcccgccggcgctgctgctcgacatcgccgtccccaccgccaagttcatccaggacgtcagcgccgccggcatggtgcgcgtcacgctcgagtgcgacaagcagcagcatcagccgccgccgcacgcgcacccgccgggggatcccctcccgccgcggcggctgctggacgagccggtgtggtcggcggaggtgaacggcgagagcgtcgggtacgcggcgcggcgggaggcgacggaggcggacgagcgggtgatgcggctgctgcacgccatgtccatgggcgccggcgtgctccccgccgtcgccgccgacgcgccgacgtcggcggcggacggcgaggtgacgtacatgcgcgcgcacttcgaccgcgtggtggggtccaaggacgccgagacgtactacatgcacaacccggagggatgcgccaccggcccggagctcaccatcttcttcattaggacatgatcgacgatgatcactctaatttatttaggtttttctttcttcttcttcttcttctttttttatcttggatcatattgttcttgtttgataagtgtgcctcatcccaaccttgtgtgttttcctctatgattgtttgtgtagattattacatatcaatggtttagtctagattgcatataaagaaaccatgtagagaatgaaatactagattgaaatgttcagatggaataagcttgattagttgatcatgtgttcaattggtgcatatatgcttacattgtattgggaagtcgaataagttacatggtgatagagctctacgcctccatgcctaacgccaaaagtttttgttaagcaaaaggtatatgaagagggcaaatctattattctcctttcaaaaattgatcgattgtcacacattaccattcgtgttgtgattcgtaacgcaaaggctaaattttggcaaataatgctctgctccaatgaagtaatcttgtcaagtttctaggggtagaaacatatcgaactaatggaggcctcccatatcaatgttcatatgttaatgataatgaatacacatcgaattaagatattcatgtactccaatgttgtgagtaggaatcaatgttgtgaagaatacaaatccaataaatgcttcatatggttggatcaaattaatatccaatccaacaacataataaaggagttcagtgaaagaagtttttaaggagttcaagagttgcaaacttctcccaaaaaaaaaacacattgtcttcctcactctttgaaacccaaattaaatttcctttcttttcgttgtataaacaattggttatgaaatcataatactttgagatccctcaaatttcttacaaacctttctccaacggtcgacccaactctcacaaacacagccgggaagccaatccgggcctcaacctcggcctcagacccatgcgacatcccctctcctacaccccctctactcgtacgaccaccgaactcatcgccggtccaaacgtgcttccataagccgccatctgacatgggaaagtaggcggtcaccgtgctcctccccttgtccaagaccggcaccaccagcatctctgtcccaaccaggaattgttggtatgtcatcttctgcacacgctgatcctccgggtagtggaggaagaggtgccgcgccacgggaaggcccttctccgccgcctcctgagaagaaaccagttgtcaggataaacaactaggtagtacaatacaatactgtgtaaacatgatacaatatatgggcaatcacttctaaatgggcaagtgatttcatcccttgaggggatatcctctcgtttcgtgtatgccacctaaatagtctttaaaaattttgacaaaatttggtaagatagattaatatgatatagtatatcactccacaaacatgcaggttaaaattcaactcctacaaattgtaacaaaaataacaaatataactgcgaatgtacgataactatttttagtttattttgttctttttgttgcaacttgtagaagttgaatttggtttgtatgcttgtggagtgatatacttcatattaatctatgttgtcaatttttttaaaagatttttataactatttagatgacatacaaatataataatatttgcatgagagatgtccactcgttatttatgtcctgtaacgtgcaccgtgtaaactttttttttccaggcacgtgcaaaagctttgcaatgacataagagcgagaaggaatagagagtggcgtgtcacgtgtcagttcagtacctcgacgagctggatccggtagaactcccaggctttgtagatctttgcgcagcgcgcgaaatgcgcgagcgtgcggttattggagtagaactggcagttggatcctggcttgttaccctgcacatccaaactcagaattaattggatcaatggatcatcttgctagctagctagctcgatcgaattaatcagctcattgtttgatcagcaatggcgtcagctgatcagctgatggatgtatatatatgtatgtacctcgtgggtgcggaagacgacggtgaaggcgctgagctccagccatcggaggaggagctcctcgctgcggcggtagcggaggagcggcaggtcgacggtgcagtagccgccggcgtcgccgtggttgagcgggaagccggacatgccgccggtgaggaggccgacgacgctgctcttgatgccgtcgttcgcctgccagctcaccatctggtccccttcccagaacagcatcgcccacctcgagctctccctgaaccccgcccgcacgaagaacaccagctcgccgtcgccgtcgccgtcgtcggcgtcgtccgcgacgcggcggtgctcgccggagcgccactcgtcggcgaactcgcggttgacgcgcgcccacagctccgggtaccggttgtgcgccgcgacggggccgtcgtcgccggagccggaggagtgcagccgcgcgttcagcgggaggcc

SEQ ID NO: 80775 - DNA, 2819 bp, Oryza sativa
ctcgcggagcgcgaacgagccgcggcactcgtcggcctcggggtccacggaccccgccgaaacaaacgcgacgccggggacggtctcccacatcgtcgcgccaccgccaccacggcgaggagccagcgacaccgcgccgccgagggacgggtcccagcggaggaggaagtgggggccgacagggaagtcgtgggcgccgtgggcgagcttggaggacggcgagaaggagagcggcggcgcggcgtcccggtgccggagggaggacgacggcacggccctcgggaacgggttgttgaggcggacgtggtccttctttctggtcttcggctgcgccggcgatggcgtcggcggcggcggcggcgccatgtctccggcggcggtggcgagagaaggcgcggcgcgggtgctctgcttggcgaggcgagaagcagagagccgattggctgaaatagattctggaatgaagggggagtgggggcccaggtggtggtgggcctggagagcacgcgctcgttttgactgaagtggattcgtgtgaatttaggtagtgtttggttggtgggatgggatgggacgaatctacttttagaggtgtttggttgaggggcgagtgggatgggttggtccctagagaggaatattcctcctagatccgggacaaacacatccggcaaaatcggccagacgagctcgtcccacttggacgaagcacacggcgtctcctcggcgaccgccggcgctcgtccgcgcccgcgcccgccgcctcctctgtgaccgccggcgctccgccacgaccgcctgccaccacctccacgaccgccgacgctcctccatgaccccctgcctcaacaccggtcgccgccacgagcgagatgctctgcgccatcctgccgctcatcgcgatgctcgacgagagcggctgcggtgatgtcgacgtggcgggctcgagtggcggcgaagcttggaggtagggagggcggcggcggtggatccagaggagggggactcggcggcggcgaaacttggaggtagggagagcggcggcggcggatctggcgcaggggatctcccgatccagccgcggcgacgatggtgggccagcgggttgggtgctccgacggtggtggccgtcctgctgctgccactgtgcttgattgtggcgcagtcaacggtcgttgacggtgatggcaaacaatgtccatcccatctcccccttatcccttcaaccaaacaaaaaattaggattgtcacatcctacaaaccaaacacgtgagtggaatcatcctaacccaaaatcagatatggtttcatcccatcccatctagctggatcatggatggagtagcaattttggtcacttccaactttgccatgtgtttatttggattaatagcattttttaccctgtcaattttttttggcagcttcaatagtaacgtataaaggcccacagtatttgtattataagttgtttgacttattttctagttaaacttttaaagtttgatcaagtttatagaaaaatatagtagtattttttttaaaaaaataaatatattataaaaatatattcaatgttagatttaatggtactaatttaatattttagatattgctaaatttttctataaacttaatcaaactttatgaagttttattagagaaaaatcagacaatttataatatgaaatggagggcatatgaaatttggtagtgccaaaagttatcaaggttttagcactagcaaaatattggtacgacaaaaattggtaataatccaaacaagcctaatatctattagtattaccacatttttacaaggtaaaaaaaataatcttactattgctactttaccaaagatcgataaggcttcaacccaaacacaaaaatactatcaaaattcggtagcataaaaatgtgccacaatttagtacttcttaaaatttgataacgttaacaacaaacaggacctaaatgcgctcaccaatgttcaggccacaagattctctccttgcgtaaacagtccacgtggaatggcatactggcgaggtaaataatttaagaatatcctaattaccttgtaagattgacagatgatacggttttgtatttggcgccaaacttgattttgaaaagtttgacccaaatatattctaaatattaaatatttatgtacggatggagtataatagatctacaatcccaacaatgttataatgcgaggtggagcagaacgacgcaagagcggtggagagtgtgtcgtgggcagccttggatgcgcgccgagcagcggcagcagcgaccgcttctccagtagttgggtcaacgtcggatccggaggagggtgtgaaggaattgcgtacggcgtcggcgacggctttgacagcctcatcgatcgcggcgttagctgcatcaggaaacaacgctggcttcgacgtggtgtcgggcgccatggagaagaaggaatagggtttaggtgttgtcgacgtttgatgtcacgattccggtatttgcacagtatggggatcgttggtactaggatatatgcgagatttaagtaaaagagacggagacgaggattttttataggttcgggcccctgaaatgtcaggtaataaccctatatcatgttggccaaagccggtattgcttttattcaccataatcataccagtataatatttggggtagtctatctaactattgtcgacttggcagtctgtagtactgactcgtagtcgataacagggtagtcttcctcctcgaatccacatccagtgagatcagagacaacgctagattcctctctttggttcccg

SEQ ID NO: 80776 - DNA, 1568 bp, Oryza sativa
gatgattctccacgatatcctcctaatgctccaccataagcaccatagccactaccatagtcaccagggccataagaactactgtaaccaccaggcctagtgccaaaacttccaggtgatctataggggccaaagctaccaccataattataagagttgcccaatccatcataaccatccgcatgtggacggcccctaggttcactatcaaatgaacgatgaggtgggttagagggtttctttggttcggccttcttgatctccacctacagcaaagcaagaaagtcaacctatattctcttaagacctttctacttccacgaaaatggagtgctaataacctgcagcctatataagacaacgaataaagcaacagaaacataacagcaaatcagcaagggttctcccagaggtaactggaagaacacagtttattaacatgtgcaggcatagttgtaccaaactagtagaattacaaacttcaaaaagcaatacaccgagtctcacctgagaaccatttagatcaatcatattgcctttcttagctaataattcatctacagttttttctgcatcaaagactacaaatccaaatcctcgtgaccggttagttgaatggtcacgaatgatttcatgttccaccacctttccaaatttcgaaaagaactccttgaattcatctgtcaaattatcgcatcaacatgttcagtatacttataaaataataatatgagctagtccatggttaggcaaacaatatatacatgtaataccttctttcaaagcagatggtaatccaccaacaaatattttcttcgtcttgaaatcttttaggggggcagcaccctttggaatagttctcttaatttcaacctgcatgtttcacgttgaatcatgttacgatataaacagagtgagagaagcaataggcaatgcctattttttgctaaaggaagttggactagtatattaacttataaacttatgacatactctggtaaccgacattcatacaaccaagctcaaaggatcaaaagaagtcaggtagcaacaggaatcaaacaatttacctcctttcattaataacatggttgtcctcaatcactctgtcaacaacagcaggatctgcaaaggtaataaatccaaatcctctgggtttctgggtaaagcggtccttcattatgacggcatcaactatctccccatacttcccaaagtattctttgaaagtacctgcatgttcaagagcataacgaagaaattaacagacagctagagtaaatctgaataaaacaagcaataaaaaaatagcctcagattttttacttcttatataaatcttagaatacaagatacagaccaatgaaaaaataatttccgagggccacacgaagatcagtacaaaaaaatttgaccttttgtatgataggtaacaagtgcacatgaaacccaattaaataattcacaacatgaaaaaggcaaagcatatttggtagaatagaagtatcagacatctattatcaacaaatacatcagctattgctttactaaaagtttaagctatgatg

SEQ ID NO: 80777 - DNA, 1662 bp, Oryza sativa
atgtaggttcaaaaatattgtttggtccaaccacagtgccagtaccctatatcacacatatattagtttttatttggtgcagcatgaattgttaacggaacaactgtatttgtcgctacgtagtgcatcccagaatatgccaaagcatgccaccaaagctaaggtcgcaaaattgccatgctcttaatcaagagaagagctattctccaccgggccaactagaccagatcaaggaaattattacctccagaactaggtcaatcgcaacatataaaagctaaaaacatgaagatctgaacaagaaccgaaccataaataactaatcaagcatacgccaaaacagccagtaaacacgagggagaaagtgaatctatagcagatctggacttacccatggtggtgtccttaggcagcccgccgatgaagattttgctgcaggaagagcaaaccaaagacaaaaccacacgaaaaaatacatcagaaaaataatgccgaaagatttcggaaccgagccaccgtaaggagcgaggtggggatctgggggaggggagaaaggcgagaggactgacgctgggctgcgccgtcgtgctccttcatcttgccgccggccatggcgatagagagagatcaaacgggctagggtttcgcgtttcgttgaaaaaggcgggtggaaggggaggacgcgtgagattggggatttttatctgccagtggaattgggatccggaagcggctaatttatgtcggtttcgactttggactttggacgatgatggccactgaccaccacgcgaacgttcgcgccgaacgttcgcgcggaacgtggtcgcacgaacgcagggctaggctgagttcgggagtaactcacctaccccacacgtaaaacggagcaatacattttctcatgattaattaagtatttactaattatatttaaaatatagattaatataattttttaaaacaactttcgtatatttttttttgcaaaaaccacaccgtttagcattttgaaaaaagtgagtgcggaaaatgagggtggtaaattggaaaagttggtaaaagaactcagccgaatacgtaaggagtgggcataaataaatctctagcaagactagcagattggaacagaattaaggcttcttgcaatcagttaactttaaatgataaaaaagatgtggttgtgtggaatctgacaaaaaatggattgttcagtgttaaatccttttatacagctctgaaacttcaggaaacatcctccatgacaggggtatacataagaaaatctggaaaatcaagattcctttaaaagttaggattttcatgtggttgatgttaaaagagagtattctaacaaaagacaatttgataaaaaggggtggaaaaaaggaaacaacttatgccagttctgtgaacaaaaagagacaatccaacatttatttttcgaatgtccaatagtaaggttcacctggaacgttgtgatttgcgcttttggaatgaaacagatcaaagacctgaaacacatgctgaactcttggattcgatcttgtgacaaaaccacaaaacagctaatgttggttggtgtggctgctataatttgggccacttggaaagctagaaacaaagcttgtttcaatcaaattttaccacataatccaacta

SEQ ID NO: 80778 - DNA, 16331 bp, Oryza sativa
ttttatatcgaaaattaaatggtaatatattctggtaggaagtttcctaggtgaattttattttaaaccattatatatatattagacatattgcgaaaggaacaaccatacacgtgaagctagaatgggactatagaatgattacatgtttatgatttatttggtactgcacatgtgatttggtaagtcaaatggagcaatggaaatgcttggaaatttagccccatcgttttgcttatacttaaaaatttagtcaaaatttaaaatttaaaactaaatctttcgagttgaatttgtggttcttttatcatcatttattttaaattatttacttttgaatggcaaaggacacacatatgaaaatcttaatcacaaattgtttttctttctaataagctgtacggataggaatagtataagcaaaatgatgtggctgactaaaaaatttaacctatttcaaatataggcttcacctgattttatacgattgtaaattcacaaatatttttggtttagtaagattataatcacgaaagtagcgataatatttaaatatgtaaattatgtgcacccttcaacatgcatgatggatagttattttctcaaccaatttggttattattccggggtgtacatatcaaatttactgtaagaatctaaactggtcaaacctcagaaatgtaaacggagatactccggaactccccataaattaccgaagtttatggtaggattgctttagtgtatattactccctccggtttcatgattcctgactttttaaataagtttaagattaaacttttgtaacttcaattatcgttaactttaaatatatttagtttaaagaaactagaacaacatatatatagatttatatttcaaaatactactctctccgtcccaatttcatcatcacataagaattttaaagtcttcccaaaatgatcaaacaagtgactatttgtttatttgtgcaaagagtaaataaacatcattgaatgcactgcatgttaccaaccaaattaatttctatcggtgcaaccgtgaaatatttaaaacatgaagcaattcatggaagacgatgcatcgtagcaccttaattgatgataattaattatagaatgaagatttttattgtccttggtctctgcgctttttctttaaaaaagtaaacatgtatttatttgttgtatatactccctccattccataatataaggcacaaccatttttttagatgttccataatataaggcatacatgcatgcatacaattaactatgacatcttctccattaaattattaattctttaaatcattcactcttacatcctctaattctattagatgcatgtattgtatttattaggatgatccaaactataagatgataataattatttcttggtctttgggttaagggtagttgtgccttatattttggaatggagggagtattataataaaaacaaagtcatatatatatatatatatatatatatatatatatatatatatatatatatatatatatatatatatatatatatatataggagactgtgtcattgtccaaacattaagaattatgaaaccggaataaatactgtaatatgctttgaattatgcagatttgctatataaaagttatattattagatctgccactgaaattgtttctatgatgttacactcttactgaaatatttttatatagatatataaaaagttaaaaattgaagacgcacaccttagttaaaaacatatatgatgttaattttttaggccttcgagatatgactgaccatatttttttgttagaataatatatataataagtttgattactaattcaaataaatctgcatatatcatttttatgtgttcatgctggatatttaaaagatattgatagattaattaagtttatccaaggcatgtatcacagtcatggtgcaaaatcattaggttaagtgaatgaatggcaggagtacagcccagagttcctttctttgtaaagtttgttgtcccgttgtgaataacaccgtgattgtggaaaggtgcatctcgtatacaaagttagccgtgtacgttcatgcttagtactcctagcaagtagctttggcaacaaccgagcagaagacaaagtaaggatgaggcttcttacaaggtacttctattaattaatggaatgaatgaatttagctagaggcatgtaacgtgccaaaggtggccagatgcaatgaacctagtagaggtttacatataggacaatggatatgtgggcgtaccgttgaagtgatttaattcggcaccaagtttttaggaacaaacaacttcttctaacaaaataaatgaattgatactctcttcatcccaaattatagcaacctagaaacagatatgactcaaacgaatctaaacagaaagcctatccaaattcgtaatagtattttgagtccatctaattctagattattctatcatgggacagacgtagtacaatttggaactccgtctctaaacaagatgcataggttccctctagtcattaatatatgactttttaacactagtttagtgttaaaactgttagatattaatgagtgttaaaaatttcatatatgaatattattggagtgagtatattataggacaagtgaaataacttacactcccgtctgatcatattaatatgttgataggggattgttgtgatcctattatcttactcaataaagaaagaaatcatatgactagatggtttcataccacatatcactatttggatattacctccgttctcaaaaagatgacatcaaatacatgcagccaaagctcgaacttttaaatcagtcctagattaaaaaatatattagaatttaatatgttcttttcatgtattttctcgtaacgagttttataaatatatatttagaaaacatgtgtatcggaaaggggcaatttcattcttacccctacttcgatgttcatattgattttgccccttcggaaattatgttgatgttcaaacaatgagtaaaaaaagaacggagcaagtatataactgctaggaaacgttgaacaagattagtagttattcaacgaatttcagttattcatgtgtgctttaactagatgggatattcgttaattgatagtagtactacttagtagaacgtaattcagcatgagcttcagtgatccatgtgaccatgtctatgttacagccttacaggcctatatacgtaagatcgagatggttcatccattggcgtgcatctggacgttttcgcagctgtgttcatccatgctaataagcttcagtatagcatgaagacacgtccaaacctctcgcttttatggagtaccttgcatctgctcgttgcttatgaatcttcccgccatcgtggaaatgttctcagtagaactgcatgcattacaagcgtacgacagtctgtttgtcatcatgcaaacgagatgtttcactgaagtactcccgacgtttcagattataagtcgttttgattttggtcggagtcaaattgcttcaaatttaatcaaattggtaaaaaaaatagtaacatttttaatccaagataaatatattatgaaaatatattcaattatagatttaataaaactaatttgatatcgtaaatattactatatttttctacaaactaatttagagcggtttaactttgaccaaaatcaaaacgacgacttacatcaacatcacaataaggagagatagttcatttaggttggactcttggaaaaggccgatgatcgaacaccatgaagaagaagagagaatcttaaagaaagagagaaccggcggtatacctatacaacttattacaaggattgagttcagaagttcagattccttagattgatagagaaagtgtttgtggtattatatagaaaatttatgtccttaattgtgggttgtgaatagaagatataaggtgaaaattaagacctgtagcaaatctaggggtgcatttttttttagagggggtgtgatgttgaacgtaataacgtttggaaattggaatatttgatctcgaaaataacatctagagccattcattaaaattgttcgaccaattaatttctaagaatggctttagttgagttttttttttataaaaaggacaaagggggaagttctcattattttttactatgatttgactgcttatacatagagtataactaaaaaatcagttgaatgtgacgtaagatttgcgcaggttcacaacgcagctattttacgtaagttttactagaaaattccacaagagttacaattttttttcatagtaatcagagttaattatcgtgttccaacatgaatcgatttgcgatttaggaattctacaggatacatgaatcgatttaactaggtgaaaccccacgcattgctgcggaaatttagtatgataacaataaaaaataatgtgtaaaatagctagataacatcagattaaataaattaatgtggtttatgataatttaaatttaaatagtacgtagaatggtgattcaaacgtaaaaagtaagctagtatgactttatggaagaataaaagtagggagatagtttggaccgtagattaatcatctaaaggctaaaaataattgatgatatgacttaattagaggaaaaaaggagaaatataatttggatcatagattaatcatttaagtactaactaagtgaggatgaactatataagtatataggatatcataaaacataataaagatatacattgaaacattatgtgaattatgttgcatgataatttaacatgtttgtatttaaaaagctcttaaattataaaaactataaagatataacatgtttgcatgatgtttaaatgtgatgattgttagtggatgatgatgtggcatcttgttaattagtgtatgatgatgtggtatcttgttagtggatgataatgtgacatctttgcatgtcaagcttaaggagttagtggaaataactttatactacctccgtcccaaaataattttatttctaggattgaaaattcgtcccaaaataattgtaattctagagtactaattgccccatcaatcatctctcatttaaatttctccctattttaacctcagccatctttccactctcacataaacaccatttaataagggacaccatagtctttcttttcaatttcaaaccttaatatatgctaaacaatatagaattacaatttattttgggatggaggtagtagtaagataggattcctacgtcaactagacgagatttccacgctccactttccaagtccagtctcactcacagtcccgactatgctaccgttcaaattcaactactacaaggacacgaccaacgaagccgtcttatggtgcacacgcggaaattcagaaaacgggggtagcacgagggtgcaaggaaggaccgagcgtttgacgcgaacaagagctggacgagatggaaataactgtccaaaaacttgctacaaaatctaaacaaaattacaggcgaaagaaacattaacaactactcctgaatacttactagtaatacttactactagcaggggattactctttgtaagtgtccgcctgtcaggggattacgtcttcccctagcaagggaagattacccccaatgtcataacgagttccaacttacaacgtgaccacaaccgaactgtctcccagatataccagttaattaggcagtaattgtgtaatgtagtaggggagttgacagctcccctggcaaggaattaaaccccatgaaatcatttctggtttcttccctagcctacatttactgctaaattagcaccaaaacaatgttggcaaggaattcaagtttgctacgcttggttcctgtgggaggggattgaaacagtggataatctcctgtaacatacacgactgtcagcattgccgaatgtgctcaaatatcaaggtgttctaggttgaccatgcttgcagcattctggatcagttgcttcctgacatcaacctgaaataaaataaaaagttctgatgctaaagcgagaatataatatgttaatcgttttttagaatttagtaaacttagctgcttacccgggtacccataagagatgagaacacaacgttggcctcagcagcatcttcaacctttagctgcttcaacatcctcctctcagggtccattgttgtctcccataattgtgccggcatcatctcaccaagacctatttagccacaagagaaaaggatgcaaggcaaaatgtctaccactgagataacagaaacggatgaatctttggatatgtaacataaaaaaggtgtatagtatacaagattgcacaaagcatatttagtaacaatttcatgtgcatgtatgcatgcatggtacaaagactgagcactaataacgttttgttatgaacttaaaagtcagcatttgagcataagagtaaatgtagcagtatatgcatgttttttggctcaagtgtacagttcaattacacgtcatatagagcgccataaagatagtttggtagatgagaaaggggcacattgcatgcgatacggtgctggaaggaactggggggaagattagaacggtagaagtggagatcaggcagagtacatgaacaaggagctctcaacagtaatggcatttgtgcattctctagaaacgtttgtgcacaaaggtgtgtgcatagggtagagggtggaattaaagttgacttggttgactggagctggaggtaggaaagattaatgtaaatattaacaaagtgttatgaatactgatcaaatatggataatgtgttaagttgggaaatcacagaaaatagattagataatcacattgaaaacttatcagttcataattgtcagaaaaatctacagtgtagctatttctacctaagcacggtgatgtattgtcacctagcaaatggtcttataggtagacgagttcttcactagatgattcaaaagaacaaaagataaacttggtacaatatcgtcaattgagatggctcagcacaatagcatataaaaccgcatcaacaaaataatattggggataacaaatagccaaatgtactgagaaatgactgtgatgtgttgacagattttctcaaagttcattgcactcattagttgattgattcaaatgtttgtacctttaaacctttggatatgataagaagcatttgttgggaaggtgttaactagctccttaaggtcagcatcatcatagcagtagtgcgcttgtttcccacgttcaacctaacaccaaagataaagatcaactacaaacttaagaccagctcttccgtcaaaatttgaaggactagtgttgcatccacaatcaaaccttgtaaagaggaggcacaccaacataaatgcaaccttcatcgaatagtgctttctgcatagacagtagtgttagaacggaaaacatgccttttatggttcatagtatcagcatctgccatcataatatggtatggacagttgccatttaaaacacatagcatactcttctaaaaaaatgttaacatgataaggctcaaaactaacctcatccagactgagattatcataaacagctaaactcccacccactgaaactgatcttatgcaaactacaaccctatccattgtcaagccttagttgtacaagagtcaaaatacacaggcaaaaccagagaacaatttatttgaagttgcaacacctaggatggcccctaacagatcagccataactccagtttgatcagtatcagaaagagggtagaagtacctgatatctaaagaagaaagtaaggagaagagtccggatatgtgcaccatctacatcagcatcagtgagtatgactatcttatgatatcgaagagcttccttgttaaaatcctcgccctgaaagaaaatattagagaagaaaacaataacagtagaagtttagatcaaaacagtatgcacctttactcctaatccaagagcgacaattagattttggatctcttcgtttttgtacaaggctgcctcgtctctcctttcaatgttaagaattttgcctcttagaggcaaaatagcctgcatccattttcgaaggtatacttagatctaagtaaatgacaaaacatggtgtgcaagtccaaacatgcttaatatagaacaatagattatgactccttatgagatctcatctcacattccacaataaaggtgtctacgtaacaaaaaatggacacgctgctcttgacaattatgcgccaacttgtgctggtcctgctcgacagttgcagagtgtttactgatattctttgtagcttaatttatgtgccaacaccagccggataattatgtttgctgagattgttggcaagttaacaaactgaaattgtatatagtattctgcagtttagaactacatggcagcagctttgaacgaagaagaatttttggaatactgatttacttattctcgaacaggaaggaatactgattttgatggactaataagagagcatccatttgacaaaaacatagatactctatttggccaagctccaatatgggccagggcctgagccagggttccccagccaaatgaataatgaactttggagaagctcaaattcaagcaggccaagtcccaaatatttgtggagtctagtttctccttaaaccagctactagagctaactggtgccagaggctcagctaaacatggccttagcaactaaggctgtgttcgggagggcaagttcccaaccttgcctcccaacacggaaaacaaagcacgcgattatagtgagattaattaagtattagcctaaaaaaattgaaaaatggattaatatgattttttgaagcaactttcatatataaaactttttgcaaaaaatataccgtttagcagtttgaaaaccgtgcacgcggaaaacgaggggaaaagaacacaacagacaggcatccatgttggacctagaaatggattgctttatatacaaaagaatgacaggagggcgagggcactcgtgctcttcctagtttcatgtacattatattagaaaagaaaagaacacacaaagattggcttacaaccagacagatttcaattatgtaaacagacaaattgaagcaatatgttctccatttttaagaattttcatggtcttcttaataacacgttgtccattccaacactaagcataactacttatgaacaaaaggatgaactaaccatctcaaaaaaaaaaaagggatgaactaacttaggtatatctatccttgatggtacgacaagtagaagacatggtctaacatttttagagttctaaagcataaattgatgcaatggaagtttttttttaagaaaaatacatatattcaaggaaactttgaaagggtgaacaaaaaccgccaatagatggaacaatgatcaacacatcagctgatcaggaatactaacagctatgcaaaatagaattagtcaaatcaaacttcttcctttagagaaggtaaaacgacagtagatagctataaacatctactcttggctgtatatcatgaatattgcaattcttctggtgtagaatcattgaatgcacattagcgtgactagactggcaaaaaaaatggtatacctgaaatttcctatcacgtccttgttttgcactacccccagctgaatcaccttcaactatgaagatttctgaattcatgtgtcataaccaaaggtcaaagtttagaaaaagtagaatacgcataaatcatagtttaaacaaaaatatacactacatttgtcaggcatatatttaaaagaagagttgaagaccagggagaagtcaaatcagaagggccaaccaaaatggtatcaataagatttgaacttgagccacttatgatgcaagggtttcatggtacaagcagcaacgcaccagattcttcaggatcactagatgcacagtcagctaatttcccaggaagtgaagaagatttcaatacactttttgtcctcactaactctctagctctcttagctgccaatgcagcctgcaagagaaacatatgccatgcattgaattagaattacagtttttgaactcctgggaagggctttttcatccactgagaatagaataggaaatgtcctttcctacactgtcaatcagattcatgtcaaagtgcatatggcagactgtatcttaaggaagcaggataaaccatttaagttatcgtttataacagattatgtaccttgagagcattaagggactttgacagaatcgaatctaaaacatctggatgtaactctaagtactcagttaaattttcttgaacagattgttcaactattcttcggacttctggatttcccaacctcgtctgtgaaaagagaaaagaaacaagatttagccaatcatcagcacttaaaagacaaaagttatcgaatcattcttctggcacatttgtctgtatcaggagcaagctgttacctttgtttgcccttcaaactctggattagggaccttcactgcaataatgcaggtcattccctctcttacatgctccccactcaagctaatatctttatcctataaaaagcattatatgttaagataaatcccactaaaaaaattaccaatacagttaattaaaaataccatttgatcagatgaataagtatgctaaaaacatagtaataaatagaattttccaaaatatggatccaaattccttactttaaacatttcaacattgtggtcttttagtgggaaggacagaacaaaattaatatgtaacttatcaccttaagagtcttcgacttctttgcgaagttattgattgttcttgtcaatgaagtcttcagcccatcaatatgagtaccaccatcaatagtacggatactgttagcatatcctagcaccgtatcagagtatgaatcagagcacctgtaaatagcaaacattttctgtttcagaataaggcacaaaacttctatctagctgctattcagtaagacctagaaggaggaaaatgaagagatagtgaaaaaggaacagaacataacaacatcacatgacctttgaatctggactgtgggccatcatttatgaaatttacaaagtttcttgacttcttgtatggttatgactaaaggtactgcacaggcagaaatcatttgtaaaatgatcaataccatttaattccctttgccaactgatggataaaatttcaacagtttgaacagtgtgaaacttccacacataataattcgaagggcgtcaattaacttataaagtacatattgattttgatcacaaaaaaggactatttatgtaccactgcatttatagcccttcaatactttgaagttattctaagcacattttttttcaaaagtttaggctaatttctaaaaaatatagcaatccagtagtttgtcataagctgtgatttttttttatcatccagaaattgaccattttgatgctacctaagatcattcattttagaacatgtagtggtactttggtagaaaacacaatcaaaaactttgaaatcaaggatctgatttataaaatagacaagacagccaacaaaagtatcaacatgttcaaccaaatcaagataaactgccactaccagctagcagatgaccaaacagaccatggaggacatgatattaggactttttatttctttttctttcaaaaattcaagccaaggaagtacattttaccattgaagggaaacatccactgttattccatccatttcttttctgaatgcgattggatcatgaagggatttctaggaaagaaaacatgaccaagcaaagtattagggttgctgctggataacattataaatgcatcatgtattgctatgtgcagaagtaggactcatcactcatatagtcatatctggtggcatattaataatagtatacgttacattattactctaaaatttaaggtagattaatgtaagtttcttcaaaggaataataaagaaattcacatgacaggaaaatataaccaaaataaatatagatccttcaacattttaaaatatcgtaaacataaggcaagtgtagattcagcctataagcatactgtctaattcaactctgtgaattttgtccaaagaataaagcaaacatagcatatatttcttcatttcattaccgtattagcatcagtatgacaggagttggttaggtatgcaagtttgctcacttgtgtgcccattaacccacatggtcacaccattcaactaaaagtgttttttatattgcatataaaattataaaccaaatagaatagcatggacgggtacccgactacccgtgggtcaatccacttgcatccttagcgttgattggtttatgtaaaattttagctcggatccaaggattaccatcagtaaatgttaactacaatgtgtatttctctttttagttggttgtcgaaacaaagatagaaagaagtaaagctagccctgatatttttaatgagtcatttgaaaggatcaaataagtcaattcgtaacaacaggtactactatgttaggagccattcaagtagcagatatgaaccattttctatgttgaaaaagtgccgaaatggagctgcatgaacatgtttccaatggtacaggtcaaaccttgtcagtattcaaccatttaacatactcaaccagaccaccagcataacagtattcattgtgttgaacctgtaagtcatcttcttcctttgtcaatgctattgtcagctggcattgagagaataatatgaaattagacattggcctactttaagaatatcaaatattactggtgaggtaagttgtgcatacaaattaacattaaaaaagaggcataaggatgttcaaacaaaactgccaaagtggcaactttccagaattttgaatgaacatatagggatttcacggaggaaaaagttccaagtaaaacttgacctaagttaaaggtgaccgtaacagcaccaataaatgaatgtgacaattcaggtttccatcatagcatttttttcaagtacattgattcctaaacttggttttgttacttttatcatcaatatctatgggtgctctccacaaatataaacaatcatagctgttgtggactcccatattacatatatcagataaataagcgttggcattaaattagagtacatggagagaagaacaaactatatataacatgatttgtcttgattgtgaataagtatacaaaatgaattgcatccttcaatgatgaaaagataataacttgtatgttttttctactgattgaaaaaaaacaggattaaacatattcccatggtgtgtcactaggaatcctagctcccaagtgtgtggcctggttttaagccatgggtagagcaatggttaaaagtaacttcttagaatatcaaataatccaacagagcaatcatgattcaagcattagctgaccgataaacaaataaaggaaataatgattgttcaatgatatcttcgagaactagcaacaggaaatataaaacaatacaatttatacctcaggatttagaaaggcaagttcccggatgcgaccagctatcgtattgaagtcaaagtccattgtggtggtaaaaactacatcaagaacaataattacacattggggaacataagtagtaatggtacagctaaaaaaatatgtaaagacagaagcatactatgtttatcaggccaaaatctgatccgtgtgccttgacgagaacttgattcatcagacaatgtcctactagttagcatcgtgatagcttttccacgtgagtaattttgtcggtattcttttccatcacgccaaacagtaacttctagtgcctgtcattataatatcacaacaaaacaaattatcaatgtaagctcatgagtaatatgtattgtttttgtcttgagactggaaggttggaaggttcttaaacttagtgcagagtagccagtatacgtaaagataaagccacatgaccagatttgtattttaaaccaaaacctgacaaaaatgacttcgtgtagagactagaaagagtttttctgtctgaatcatgattgttgaacttttatcaagagatgctttcattttcttaagaaatcttagaataataagtaaataaaggtgaaagcaagaacctctgacaaagcattaacaactgataggccaacaccatgcagccctccagaaacagtgtagccactctttgaacctccaaatttgccaccagcgtgcattaactgcatggttaaaaaattagattgattggcatccaacatgttgaacactgggtatgccaaatggataaacaatgtcgcacatatttgttttttagaaggtaatgaattaacaggtctgcacagaaaatgaacatcacaacacatgtattgaagtctggatatgcacatagcaacagcacacaaacaggccttaggattaaggtgtggactctgacacctaaatataaccatgagatagcatgtcatatttcatgctccctccctagaaaatgaaatgccccatgggtttacttatttgggaaaaagacggttgaaaaatagaaaaaaataatacagttgattgaatctaaaaggagtataacaaaaaagaaattaacagtaccgttaagacggtttccacgcaagatttcttcgtctgagggtgtatatctgtagggatctgcagtatgcgtaggtttaaacagtaattaaataaacaattgacagatgatccacaaagagttacaagtgaaagatgctgcaagtaaatagtcaaaaagtgtgataagcaaattataaaaacttccaggaagcaaatgtaaaactacaaaatttcaaacaaacgatgacattaatagtctagcatagttattcaatcaacaaactatgcaaaatggactcgaactgcatagtatcaagaaacatgttctgcttcccaccaagtcatccctccatccacaaatataagggattctgtatctttgtttacgtatctggacaagtatttgtccagatatatagccaaaatcccttatatttgtgaatggagggagtacttggtacatcagaatgtgttagcagcataaatttaacctttcgtgtaactatgatatatagtaatgtagaaaagcttcctccatgtttgttcacttcttcttaatgtgggattactcaatacaacagtaactaaatactgtagctgaaacatgagtgttcatcattaacacaaggtcgtcaaaatttccccaaaaaatgcattggccatacaggaagtacatcttgataaggttttaggaactacataccccacgaccattgtctgttacactaactgaattgtcgccatgaaggataacatcaaccttagtggcgtagcctgcttgagcttcatccacggcattatccaatatttcataaacctgtgatacaccattcagacgaatgatcagaaaagaacaatatggaatactttgtaccacagaaaaaaaacagtagcctaatctgcattcaatataccagatgatgcaaccctcgtgatcctgtgcttccaatgtacataccaggccttgtgcgaactccatccaatgcttctaagacctacaaaattagcagttcagcatgcaaccaaaataaagctaaaaagtacagcttgtgtttgaaaagatgatggtgtcagataggagaaatcttgaacaaagctgtgaaggtatacaatgttatatttatttgctttcaaaaaagataattgaattttaatactaagctgagttcataagtccaatgactacgctgttgagctaatgactaatttattgttggcttctgacgtctggatacagtgtataataaagtcctttggaaaatgaattagatgtaaagagcattttctagacaaattttcaaggacataaatactaactttaggttgtaacaaacttaaacagtaacaatcttatcccctcttacgctccatgaaccaccatcgaagtatggaatccacagtatgtgaccatggaagtatggaatccacaatatgtgctaaagaagatagaacatttgcatggcatataaaattgtatatattgcatgttatttgggtaaacagctcacaaagtcagataatctagtatcataagagttaaatatcaacgaaataagaatactccatgagaaaaaaaaacagctaatcgtcatgttaacagaaatcgtaagatgaggaaatcttccccttaaacaatgagcatga

SEQ ID NO: 80779 - DNA, 6891 bp, Oryza sativa
tgtttcgggcatttcatgctgttttttttctttcttctttgtttgctccatgtgagcccctggggagagttttctcctcgggtctaagaccttaaatttccacatttctttaatggaaatggagggctttttgccctttgcttaaaaaaataaatctctagcaagaagatttggtatttggtaatactttgatttttttataataataaatttgtttggtttgtaaccttgccaaataatgacaagtaattttgagaaccactatagcactttgtttaataaacgatgtatggcatatgacatttccttttcttaatccggaaaatgggaaaatattgagaggataattttttttattatttttacttcctatcttagttatgcagtacaacggtttctaaaatgaatcatcattacattctctttctccacgagggcggtgacctcccaactccactactcattgtcgatggattgacacctctgggtagatctgcaccatgcgactgaggtagccccttcccccctcccccggcatatgtaagtgtgatgcaccccctacatctctttctccctccttttcttacacaacgtcctcccatttattccatctccttccccttttcttgcactacatcctcccatttattccatctccttccccttttcttacactacgtcctcacatttattccatctccttctgtagcaacctgattctcgttctggagactaaactctccaagacaatgagaaagaagaggaagatgctagacaaggtgagaaaggacaccttccctggatcgcagtcgaagtgtgagattttgatagccgattcacggctcccgtccttattagatccaactcttgcatccttagaactgactgaacatagggatgccaagacaggaaagaatttgtcgaagacatcacaagacgataaagcaagccgatgacgatgaggaggttagttgtttttctttttgtcttttatgtgttatgctctaataacaatgtcaccttgcgatagaaatttatacctgatgaggctcacgccaaatagggaatatactctctgacaagtgaacattctatgcttttctttgcctactatctttgttgggttggtccccaacatatcacatggatgcattcgtggatgaaatctgagttcaaaatgcaagacttgtgcaaaactaagtattgcttaagcttgtagcttgagcatatccctgaaggggtcttagtgcaccagtcaacctacacatagaaagtgttggaacaattttgctttaaaaaaaaatccttcgaaaaccctcatggtagaccaagagaagaggaggaggaagtccttggatcagaatttccatacttgagtgtaataggagcgctcatgtaccttgcaaattgcacaagactggacatagcatttgtcggcaacttacttggaagggcatcaaggatatcctttgttatcttcaaggaagcaaggacatgggactattctacagaaataaccaagatctcaccttggtaggatatgcagatgttgggtacctattacacccacatatagccaagtcacagactggttatgttttcctatgtggaggaacaacaatttcctgaaaatcatcaaaacaaaatattgtagcaattgcgttgaaccactcgaaaaatcttcgcactatacgaagcctcttgcaaatgtgcatggctttgtaggatgattcaccacattcaacaatcatgtgaattgaacaccatccagacccctacaattatttatgaagataatgcagcgtgtgtcacacaagtggaaatgggttacgtgaaaagtaatctcaccaagcatatcaaccccaagttcttctatgctcacgaactgcataagacgaatgaattaaagtattgcataccaagtcctgtgaaaatcttgcagatttattcactaagtcattaccgacatcccttttgaaagatgcatccaagggattgggatgatgagacttagagaagtgcaaaaggagaattttgctaactcacttgctaaacttaatccaaattccagaatgacaaagtacccaataagaataatggtgtgggttgtactctttctcttatataagttttctcgcagtttcttattaaggtttttaatgagacaatatatccgtgcaacacacaaaatgtatgctatgtactctttcttcaattatttcccactaggtttttaagaagttttaatgatgcataagcaatacgtggtgaagatccaaggaagaatgtgagaaatttggactttggcccatgaaggccagtctaaatgtccaatacatcaattgtccctcaccctattttctatatataataattgactatatataaagggagggggacaccctattttttatatataataattgactatataaaggaagaagagctgaggcttcgtgtgcatacgcaatccttttaaactgctgtacgtagtagagcagttgcgtaataaagggatggcctagttatgcgtacttattttctaagtataacaaaagttgctaagtttatctaggagtctaagaacaagtctaatcgtagttcacaaccaatttgggggctgctagctggcgcactaatgacggccagcggcgagcacttccctcctataactactctatattagttaacacttaacactaatgacgggtaattagagaatattctcaagatttttctttctttttgggagatttttttactaacagattgaaaatttataagtcaaatttgaaaactttcgatttaagatttaaattttaaagtcaaattttgaaaactttcagctcgagatttgaaaacttttaactcagattcgaaaactttcacgtccagatttgaaaaatttgaaaactttcaacttgagatttgaaaattttcaactcgagatatgaaaactttaaactcgagattcgaaaacttataagtctagatttgaaatatttgaaaactttcaacttgagatttgaaaatttttcaactcgagatttgaaaactttcaaatccaaatttgaaaattttaaagttaagatttaaaaattactagtaaactaatcactaacttaatctaaactaattactattttttcccctgtccatagggcaggaatggcaaaaacagcaaaaaaaaaaaaaaaaaaaggaaaaaaaaagaagaaagagcggcgtcccaaaaaaaaagaagaaagagagaagaagtgtgcgcgcgtgcgtgaaccttgtgggccaaaggtacgtgccggcagccttatgggccggaagtacgcattggcaacacatgcgcgccaactagcattcacgccaatttgaaatcccaaccaatcaacaaaaaacatgttttactttttttttcccattatgcctccatacataggttcctttttttagcctgaaaataggtcgcttccccctcgtagttgatatgttttacggttcacaggataaacacagaaaaatgggaacagataaaaaataagatactaggaagcagccatatgggtgattcacaagtctacaaagataggagtaccacataccagctatgattcccacgtaaacagcgtttcaccagttcttttcacaaggttaagatcacagtggttgcgtagaacgtctggaataaaatcaaatgcatttccaccatatgtttgcactttgcactcgacttttgtcttgtcaaatctataacattaaggtgatcatgaacattcattgcaccatactgataaaacgagattgggtatctgacaactaataatctaaacaaagtttgtgcagtaccatgcaatggttgctctgcaactcagtacataaaaaaacaaaaacaaaaaaatggcaaacaaaattcctccattaaatattaggttcatatggttccaaagtagccatagaaaatatccaggtagatcaataggacaaagatgcttgaactagtttcctccttagttggttactctgtacttctgcaaatgggaaaagttcaaattagaccttagcaattgatccatgtatgcaataattattgtcaacagctgaatcaaacagagtaaatggaagttcaaccagattatcttaagagcaactgaaataaaattgcaaattcaagtcaacagagatgtttcccattatcttgtggtaaatgaaattcagcggagttacacccgctgagtcaaagcgccacttacaaaactcctaagacatgaaaatgcaataatgcataatttaagctatatcaatactgaacagatcataaattgcctttaaactcgatttgtgacaatgcattgcacagtgcaagcaaaaggcatggatggaagtggttactacagtatcttacagtgtgaagaaagaccataaaagtttaaccacaacagtcagagatggataataaaaaaatataccttaacagtgttaagcagaatctttgcttcactgttgttattgaagtggtcacgaataggctgaaaatagaaaggataacattattaagacaagataagctattggaaccataccgtgcaaggtcttgataataaacaccacatcattatccaatgaaaacaggtcaatacaaaatacactagtgcgaaattgataccacatcaataaaaataatccatcaaaactagagaaaatgacaatagtcaaatgaagcaaacaacaaataggcaccatattattgaacagaaagccaaatgtgggaaactttacctgcaatatttggtttattgcttttgctagagctggcttaacatcagcaggatgcaaagcaccagtcttataatcatcgatgagttcatccatgtttgtaaatgtcctgtttaacatcaatatgcaaaaaagtttaacatcgatgctttgccttgtcatgtcagaagatcaataatagactaacttaatgtgctctgattaacagactggtggcataggcaactaacttaatgattgagccaattgatggtaaataggaaaaattccaagttatgtagctcagaacagaacatttacttgttaccgccatttgcttccttccgaaccacctcaaacatttcaaaccaagggaaaacaatatacttgatgtactccaagcatgggttcccatcaaccacgttgggagggcaaaatgcttgttttatcttcaaatttacctgagcctgcaataaattaagccatgaataaatttagaactagtttgggtagtgatgaatacatgctctgattacaagtacataacagaagctgctatagaagaccaaaaagaaaagaattagcaaattgtagaaacatactcccatcttcctaaattgatcatcatatatgtttatacaccaagaccaaggataatttaaatcacatcaatcaggacatcatgcacacattctcccacaatacatgcatcgattaaaacaccatgccaattacacattagcatgctcacattctcccatgctgcactaattgtattatgatgaaatccgtgtccatgcggttatatgatgatcaatttgagaaattttgagttccactatatgatgatcaatttgggaaggagggagtaaatgagaattttatttatccactagaataagcaaaaggaaaagaaaaactgcaaatcagcatgtaaggttgccatagtagccattcaaaacaacataggtgtctatcaacccgcatcaggaaactaaaaccaaagtaaaatcaccagaaaaaacataaaattatagcacttagatgatgacctctcctaggtaaatacccttaaaacattccactatttcttaggaagggtctagcttgcccaaagattgggatggtcccgagtaaaggcacagttttttttttttcacaaagcatagtcaatggggtcacctttagttgttcctatctcacttatcagttagtactttctttcatccaagttagtgaactttcagcagttatccaacactgaaaacagaaggatacactactattggacagcccttgctgcctaaacttgtgttatgaaaggcataccgcgtaataaatatgttcttttatattacaatagtgggtgtcacaaggttcagaagttatagaaattgatacttgaataacaggaaaacctcgtcatcttccataaaaatggctgaggatggatcactctttgacatcttttcctggccctccttaaaaccagggagcatgtctgcaattcacgttaagggagtaatacaatttttgacaatgttttttttttttcagaaagaaggcttagcatcccaattaatttgacagaccaaaagaaaagtgtcccgcgctgtttaattacagaagataaaggtttaatcaacatgcaagggcagattaggatacgatgtgacaaaataatcggtttgtttttccttttgatgtcggtacagtactccctggctagcacattgaccttcctttggtccatgcccaactggcaaatgtctgcctacaaaaggaagggataattagaataagcttcatgcctatatgaaattctggattacagattcatgtacacacgctctctttacactgtgactcaaggtacttctcaaaaggcatggtgtgcaatagcataaatttactaaccttcaagaaaaatatatcagcacactgcatacaaggatagaatatttgggcagctgtcaactcatccgaatcatttcgacccataatctgacaacatctgtgagccaaaaatatatactcacttgcaagttataaaattgcagttacacttcaggctttggaagtgaagaagccattagacgaacatatgcaatccaaatgtggttacctcattattcttttgacatt

SEQ ID NO: 80780 - DNA, 19642 bp, Oryza sativa
ccccttaaacaatgagcatttgattgcaccagattgatttgtaaaaataaactacatgttgaattaataaaagttatgaaaaaaatgcatatgtttgcaaggctaattggacaataaatttaactaccacttacatataactacagaatgagacggatgcttgcactagcaagtccttgcctccttcccacccaatctcatctctttgaatgctatgtacatccatttaaaatcccgggaaaatacactgattcgttggccccctaaatatcaaccttagctcttagccacagaagcccccatcgtgcaagagaagcgcacgagagcgaatcacctggacgttcgcagcggtgtactccccggccacccgcttctcctgcatcgcctcggaagccgccgtggatgccatgaaagccctcaccgcgaccccattccgccgcagaggagcacccgccgcagcagccgcaaccgcaaccctagagagagagaaaaccccaacgttaccaaaattaacagcccagaataatacccccattgaagagagagaaccccccaacccgaaaggcgcgcacgtctggattcccttacctgggcctgacgaggaggcgggcggaggaggaggcggggagcgggaggaggcgggagggccgaccggcggcggtggagaggaggcggcggaggaggaggcgcaggtggcgcggtggcggcgacgaccggaggaggggccccatcggcggcgggcggcgcgcttcgacgtgcgtgcgtgcgtggccggcctctcgctgccgctcgcttttgctgccgctgttgtggtgagggtgaaacgggagggggaggggaggggacgctggggtttaggcggagccgcgtcgcggaggcaggcaaagagtggatgaggcgaggaggtcgagggttttagacgagcgggccgggcttccggatttccgtcggggcgggcagtgcggggaaattggaaaaaagtccacatggactccctccaatatacgccgtgtttattccaaagttgttcctcaaacctccaacttttccatcacatcaaaactttcctacacacacaaactttcaacttttccatcacatcattccaatttcaacctaacttccaattttggtgtgaactaaacacagccatagtcaaatctaatttataagaaggacctgactacacagctagtggtagctggtttgtctaaaccagctaccactccatatatgatagacactatccaactatacttcaaatataattttctctaaaactgcttatccgatctacgatctgattacaccgttgtgttcgtaacaattaaatctttataacaagatatcacatgattatattttgatgaaaaaatataaattaattttataatatatctaaattacttttagatttcactaagttactttttagacatataaaagtaattcaataaagcctaaaagtaatttacatatactatagaagtaacttataacaaaaagaaagtaacttctataatatatgttaattactttaaaactttcttgaatttacttttatatgtttaagaagtaacttagtgaaatctaaaagtaatttagatatattataaaagtaatttgtgattttttatcaaaatataatcatgtgagatcttgttgtaaagatttaattgttatgaacacagcggtgtaatcggatcgtagatcggatgagtaatttaagagaaaattgtatttgaagcatagatggtaggaatattttttctacttgcttgatcaattagtactatagtaaagtaagattcttcaacacacatatgacaatggctgattgtatctggacaatggctagcgttgctcgttatgactaaattgagagcgctctcgatttagattttacgttataagaagtatctctcaacctaaaaccagatataatatctcttccaactattaaaacggcgcaaataaacttccttgactgctttgaaggtggttttcgctgtcgtggcgtccacgtagtattccaatcatcacataaattaaaaaatagacgtacctgaaaatggtctaaagaagcccattattgcttattattgtaggcctgttaaagactgaaaaaatgtttgtgcacctcttgtgaggtaaatcagcggtaaatagtttgttcgggggtttgtgatggcataccattttggttgtaggttaaaccacatctgcgaagagacatctcactcgagagcctaaaaagaaatatggccatatgggtgtattatataattatggcgcttatgttttttttccatgctcttttctaaatttactcctgaattgatgtgcaagttgttaaagggccaatttgcctagtaccatcacaaaaaacacggagttagaaaataccatcgtatgtgtaattgacatgtgggtctaggcctcacatgtcattatcacgtatgattatattttacaactcacatacctttgcgatggtacttcccaaattttcccattgttatctcagcaaccattgtcgtggaagttcatccattagatcttaccaccaacatgtacagacgcatctcaacgtgtgtccttttctatcataaaggcatctgatttcaagattcaggatttagtattgacctaccaaatgaggaggtaaaaaaaaagaattgctactccatcttatattactttacttaaacaccgtgggattgctgaagaattagcgcgccacgtcaacgacgtttttgcaaaatggtcctcgaatttccagttaattacgcgccagtctctgctaccccaccgtccgatctcacgttgcgattgatctggccatacacgtgtcccgccatggcggccctttcacaccagtgggatcgtcgaatcgcgaacagacggtagagatttcgctagcccacaccaaaccatagccctcttgctcgctcgcttgcagcctctcacgcgcgccgcctctcccttctcctcccctcgcgtgcgccgccgctgccggtgtagcccgcgctcttctagccatcgtcgccgcgtggacgagagggacgcaagccgccactgccctcttctcccttttcatcccagctatccccgccaggtcgacgaactctctcttcgacgggttcacattacactattataggcgctaacatgtgtgacaataaaaagaatgggacccacataccaatgactataataataatggtattatggtagagggtcatcatccgtctttgacacccgcaagcaatgtccatgcgaaatcacatccttgcttacaaatcaccaactacgtgccaaccataacgcgtcacacggataccataacgcgtcacacggattacaaaactgtgaatatacacatcatcagaacaaatgaaatcgaagaaattccatgcgtgcgaaccaggtaaacttggttttttgactcaaacctatcatgcttgcatggatagtgcaggttgtggtttgtgtgctcacgcaaaacatttacggttttacctgtcaatacggttcggctcatggaatgtgtgtgcccaatcgaccaaccgtatttggtgacatgagcaagtgggagcgaccaactgaacgtgtcaccagctcgatcataacttgtaacctgcccagcgcatttgatcatttccaaggacgactggggcccaaccaaaggcacatgagagtaggtacaatagcagactattacctctgctattagccagttataaacatattttaataagataacgataagagataaaagcagcggactttaagggcaagtactatgagccctttatcactaattctaagatgccatgtagagtcatatgatgatgtggaggagagaaaagaagagagaggagagcagccacccctcatgcaagaggcaacctccacaccaatttcaagaaataagagagaaagagagaagttgtttggtagtaaatgtattgggtgtagtataggtagatgcaatctattgtatgtattacctctaaattaatatgtagatgatttggataaaattagatgtgaccactacctctatcataaaacttgccctaaatctattgacagctgcagcacagactctaagaacgcaatgtgtgtataacaggtgggaccatatattaatagtatagtaagcaactactgtatgaattggctattagattggttatatgtaaattagagctagtagtgggctataccattaaacttgctctaataacttgcattcaagactccaacgaaaaaatggtagccaacaaactgttttttccttccaaaatttagtgtcgtgtagcatataaatctgcaaatatataactagattttttttgaggagcttcttatcaatggtatctatatatatcatgtaaaaactttatattcaattaatatatttaccatttcttttgctaacatagagtaatcgaggaaaaaaagcagtggcgggcaaaatcaactccaaaataaactttgatgaccgctgcgggattgatggcggcgcgaagagaggagatcggcgaggcaatggcgggtgatggggaggagaaggacatgaaggcggtggggagaaggaggacacgacggtgtttggtgaggaggaggacaacgcggaggcggtggggaggaggcgatgcagcagcggtgagtgcgaaggaggacgacgcggaagcgatggggaggaggcaatgcagtagcgttgggtgggaggaggagaacgcggcagcggtggcaggtcaaggagattcggcggcgcggggagtggcgggaaggggatcgagagcggtagtagtgagtagcacgggcgaagtcttcgcgcggtgatgggagcgaaaatcacggtggagataggatggagttgctgtgcgagggtgaatcgcagtgtacggtagggatgagagcgatgcggatgagatgcagatggatggtaggatcaacatgttgatttagcctgtatgattgcaaagagataactcttttttttattagtaaatatttaaatggttatttagtaattaattatcattcttaggcatcagcggagccatatgtgttggaaatttggtcataattcggcatattttaatccaaaataacaagataataaacatgatatttacaataggatttgatccagtgatagtgttgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcaacaacagctttggaaaatggatgaaagtgtgtcttctttttctcgcgggagatcaaatccattcccattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaaatgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaattttcaaggctcatgagaatgctctctattccatagcagcttttatataccagtgtttcggtgaagactgttaagttgaactttcacctagaaaaggagctacacctgaccacaactgaacaatggactatgccttgaattgtcagtcttgtgcagttaggtttcactcaattccataactgatactaggcaaccattagtattccctcgggttggagcttataagtcatactccaggcctttcatgagtatctagagatcacccaaatctcatagaagcagtcgaactcatataggtgtgttccttctaagatgttctgcaggtcaacatttctgcttggaaaagccactcggatcacattaagacataagccatcctaccatgcaggaaagaagaaaagcacatcatgaaaatgagcccttttcaagggtctcttctctcagtcacacaatagtttgtttcaccatccaaattcacgggatctccgatcataatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtaccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatctttcatttcaaaactcttggacagatagtctttgacctcctcaatcacattaaggctggtcccaaagatcagtatgtcatcgacatataagcacaagatcaccccttctcccccaccatagcgatagtatacacatttgtcagcttcgttcacaacaaagcctgcagatgtaagcgtggtgtcaaacttcttatgccattgcttaggtgcttgcttgaggccatacaaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtggtcaagcgagcaactggtgagtatgtgtcgaagaagtcctcgccttccttttgggtataacccttggccacaagccttgccttgtacttttcgattgtaccatcaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcattgtgttctatcggtgcaaagtactcatggggcatgacagtttctttactagaagtgctaggtgtatatttcataggaaattcattctcaaagaatgtagcatctctggactcaagaattgtaccaacatgcatgtcgggtactccagagtttactattaagaatctataacccacactgtggatagcataaccaagaaacacacaatcaacagtttttggtccaagtttccgctttttggctataggtacatttaccttggccaaacagccccatgttcgtaggtatgagagatttaatttcttcctttcccattcctcgaatggtgttacttccttatgcttcattggaattttattcaggacatgacacgcagtcaaaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattggaaaaatactccccacctctatcagacctcaaccgtttgattttcctttcaagttggttttctacctcagctttatagattttaaagaaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattccttgcctcagatgccttgtgaggcttgcgaggttgtttcgattgaacacaagtatggcacttggaaccttttaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtctcatatttagatacgacacatttattggactcaaacacaagtctaaaatcttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaatagagaaatgtcagcacatacatgaatattagcaccagtgtccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccatttgcctttcccttgcttttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaagaacactgaactcttgtctcttgtgctttagagaagtggcaaagtccgaccaagaaggtggtagtttggcaataatgccacctgccacaaacttgtccggcaactcacagttgttgttctcaagttccttagccagcatctgaatctcatgagcttgttcaactacagaacggtcatcgaccatcttgtagtcatagaactgctccataacatacagctcactgccggcgtcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaactacaatagtgcacgtgctttccatctcttatagtttgaaccatcaaaggcatgtggtttcagtgcagcagcaaagccaactaccgaaaatgacttatcaggtttttggattgttggaaatttggtcataattcggcatattttaatccaaaataacaagataataaacatgatatttacaataggatttgatccagtgatagtgttgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcaacaacagctttggaaaatggatgaaagtgtgtcttctttttctcgcgggagatcaaatccattcccattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaaatgtcatcaactagccatgaaccatcctccactacacaaccatcaaccatccatcaattaggactaattgacataagttaccaattccttaatcaaatggattaattctcaaaactcttcatcccattgatatcccatagaagaatgaattcacatgaattcctagcataatgagccttgaaatttatttgatttaattgatttaaatggattaattacccaattaaatctaacaatatgcacatatgcatgtggtcagaggagtaggtgacagtagcagcagcagcgtacagtaatattaacgaacatgcttaagggcaactctaagagagtaagcagccatctacttacatgttattttcatatcattaaaggtgatataaaaattaatccggttgtgtttaggcacttgatcaaatttttttaagtatactgacacatatttaaagtattaaacgtaaactaataataaaataaattatagattccgcctgtaaactacgagacgaatttattacacctaattaatccgttattagcaaatgtttactgtagcatcacattgtcaaatcatgacgtaattaggctcaaaaaattcatcccgcaatttacatacaaactgtacaattgattttttcgtccatatttcgatgtgatgtttttagaaaaaaaataaatctaaacacggccctagtcattatttttttctcaatgtgggcaagccttggttctctctcctaggctatctaccaaccacttatgctctttcgatgtgggcccaccttaattatctctcaccaaatcttttaaccaatcacagcttccatcgcaggtacattgtgtccaggcacccgtccgaagctgtcatcaatttagagcgagtacgatagcaaggctacgagtcagctgcgagttcacgcggagaagataatagaagatagagaagggaagcaaagtataaatttatagctagctgtagtatacactctaatatattatgtgtataaaagatgagactatatattagtgatgtagtatatatttatagataactattatgtgaatgaactattatattagctatagatgaattggagataatagttagctatactattaaacttgcttttagtcgaccgcttctctctccactccctcttccttccagcaatgaaaaagagctgatattagcagctaatagtaggtataatttccttattacacttgccctgcttaaccaaaattagcaaaccaaagtgacatactaactcttagtgccatcattttttttctttgcatgatagtacaagcactataatttcgtgtactgtttttcctcaacctaaattagaacatgccgtttgttaattttactcgagtttatggtaagtgatatacggatttatacaaatatatgtgtacttctatttgttgttagctttgtccaggctcaagaaaaaatttggatctgccgctgaggttgttctattttaggacagaaagtattaatgcagataataaacagtactgcgtaccaggggtactgcgttcaatcaataattgaaggatcagatcgtgcgctaccgtaaatctaggccttgtttagatccgcatgataataattagccctccgaaatcttgttatttaggaatatttaataaagtctatgtaaaaactatttgcagaacccttgggctaattcacaaggtgaatgtagcaaggtgtattaatccacgattagcggatgattattgtagtatcaatgaagtgaaacatagattaattaggtttattagattcatcaagcaaattagactagaggttatggaatgagttttatcagtaatctacgtttaatactactaaatagcaatattttggagagctaattattagagcatcaccaacggtctacctatatgattcccaaaactaattttgagcgattttagtccaaaaatcagctccaacagatcccctactctcctacccgagttttggagttcccttcccccggttcctcactccatttatatgcgggcacgaaagtcgctcccaatccgcaatcctgcctctctcctttgttcccgcgcgtgggagatagcgatatttctacgcgtgaaagaaaaaaacggaattttctcttggtagttttacagacgggcccacttttaagtttgggggattgaatttaggctatctgttggagggaggaattttttcacttcctattttcagtttaggaaacccaaaaataaatttttaggagaaaattatagataatctgttgatgatgctattagccctctggatgcaaacaagaccctggtacaatactaaaacagtacactacattagtccgaccctgtagctacagtacggtactgtttatgcatgcattcacagaagatcgatcctgtgcatcagtactccctccgtcccataaaaaactaagctagtaacatattttagtactacgaatctggacatatctctgtttagatttactccatccgttctaaaaaacactacgaatttagacatacctctgtttagatttactccctccgttccaaaatatagggcatacctactttttaaagtggtttcataatataaggtgtgcatgcatacatgtaattaattagcacattctctcccctaaatattattattttaaatcctatactcacatgatcattaattctattggttgcatgtattgtattaattggggtgattcatgacaacgatgagatattaattatttattggtttttattgtattaattggggtgattcatgacaacgatgagatattaattatttattggtttttagattaaaagtggttgtggcttatattttagaatggatgaagtagtgtactcggaaatgttatatccggtcgtagcttctttttttttttatatggagggagtagtaaaaatttaggcaaccgtgaaccgttcccgacttttccgttgcgcgagacgatgcaaaggagaacacggcagctagcagcatctcaacaagaagaaggaaaaaacgcgcggctcgcgccgcggggcatgagggtgcggatgcgaattaagccgcacttgaccacgacgccacgaccactctccatcgatcgcgtcctccttacattactccgcccgctgcggcgaggattccctcgatccagggggggggggtggtgaagagctagagctggcggcgggttgttgaggagcggctgactgaggggagaccagaccaatggttggcggcggggcgggcgagccgctgaggagggcgtgggggtaccaccccgagtgccccggatgcagggtggacaggaggaaggaggagagggaggggatcccctacacggagctctccctcatctggctcgtcaccgtctcctccagtgagtgttcatcggcctcgcgccgcctctcttccctgaccttgatcgacctgtagtagtgcttcgtcttttccgccgtctgtttctttttttttcttttttttttggaaattagtggaggataacgccgttctttccttcttcttcttctttgttttgaaattagtggatgatggtatcgctgtcgccaattcaatactttgaactttttctaagtcgaactaacattttcaatacaaaacaaatatattatcaaatatatttaatgttaaatttaataaaactaattttgatatcataaatattgctaattttttctataaaaaagctttaattaagaaaaaaagtcaaataaattataatataaaacggagggagtagtactatcgtagtgttatcattgtttcggttcgtactttgtagtacaagtagtacacatgcatgtgtatatcatggtgtaatggggattcaattagtatgggtttgtaggagcatctcgttgccccgagctttggcatgccacgatcatgctcaacgcagtagatttgctcggtgctctcgcgggtattctcagaatctccactgtcaaatgccactgcccactggggattggtgcaaaaccgcaaactttgaagagcaagtttaatagtatagctaactactggctacaaatcatctatagccaatctaatagtccattcatacaatagcatatactacactattaatgtatagccctaccttcatacgcacataacgtactgagtccgtgctagttggctacaaatctgtagcccgttttccttctctctcttcttccctctcctacacatatgcttacagttgctattctactcgctctaaattcaaaatcgaccaagcgaacttctattcgcacatcccgaattcgaaagacttttgacagaaggatagtgcacgtatggtacctgcacgtacacttaggaaatgtacttctcgttttctctaatcaaacactgaggcttactaaaatgttttctccatttgcctaatttgctcatcttgttaggccaggaaactgatttaaagaagattaactgcacatctgtgtcctatatcttgcgatctatatctttattgtttatcaggacctgatattatttgtccctttctttcttaatttgtctttctctgttgctctttgcagccctgccgatacaatccctgtttcccttcttgtattttatggtgagcaattttacttgcttttttttagaggtgcaatatgatgacattttgtttcatgagaagagaagagttactagcgtcactatcgattttacatttggacttaacagctgtgctggatctgtagtatgtaaaaggtaaaaataaaaattaatatgcactgtcacattgtaattatttcatatattgagccaaggaagaaccaaatagtaaatactataagagcaatgctacacgtactaaatttttcttactaaacttttactaacaatcatctcaaccgtttgatttaagtagatggaagttacaaaaattctaggtgcactcatagcatgacacatcagtgttagtaagaaaaagttagtacgtatagccttttccatactataaacctggacacatatcaccttcattgttgtagtaccaaaagagccataatctgacatcctctattacaatgatcggttaaatatttctccttaaatatgcgtcttagatattctatcgacattttgtttccttatttggtatagatttgtcggaaacataacttttgaacgtaaaacagctttgcaaatgctgaactgtgttctaaattaattctcttttatcaacattggagtttctgtttgcagataagggacctgcatattgctaaacaagaagaagatattggattttatgctggttttgtcggtgagttttctctgaaacatatttcctcttttgcgtcaatctgagtaagcacttaaaagtagcttctaaggatgtattatgaaagtgatagcctcagcaaggcagccttatctaacagggtgaacttgtgatatgtgaaggcgcttcatatatgtttggaagagcactctcctctgtgatatggggcatcgtggctgataagtacgggaggaagccgattattataattacccttatttcaatgtaaggatcttcgttgaatgaaacgtagaatccaatactctcatctataagcttttcgttggatctaatttgttaatgcacagagaatttgagcacattttctaatctattgcagaattattttcaatacactctttggactcagctcaagttattggatggcattaacctcaagaggtttgcttggtctgatgtgtggtatacttggcccaattaaggtacctgtgtccacatgagaatgcttcacttttgtctattaaaaccttcgaccatgttcttgcagcattattttctaatttctgtgttccaggcctatgctacagaagtgtgccgaaaagaacacggtcaccttggactatcccttgtaagatcttggaccattactatttcaaaattttcgttgtctcccaactttgttaggcccccaatgtaatgttcactggttgatattgctggctaatctgtcaggtttcttcctcacgtggcataggccttattgtgggaccagctattggtggttatcttgcacaggtaatattttattttaatatttgaagaaatcatgatgtaattaacttgtaactatgtcaagattattggcccttgtattccaatcatgactcttgctaaccatagtcgcaaatttcacaaattataatactttaatgcggtgtatctaaagtttggagttctcttgtcatatacattaataattatactcgtcatgcctcaaaaatttgtgaagaacatgaaaacacacatgttgattatattgctgcatcgaggataaagtgcgatagtttcatttttcttttattggcatgcaactctacttattttgcttgtgcctttctgttataccagcctgcagataaatatccaagcatattctctgagaagtctatatttgggaggtagcatctgctttctagatccatcttgtattggttgtttcttacactactaatttttaacgtgcaatgttttaggtttccgtattttctcccctgcttatgtatatccctccttgccattgttgctctacttgcttccttctggctcccggtgagcatttttcttatatccctatgatacaacatttcttttagcaaacatcattataataactgctttcattaaatatttgataattgataactctggtgaaatcccattttgacactggaatcatagttcttcatgatgatccataaattcatttagaatctgctgctcagttgcaattgcaacattagtattgatgtgtaccctgagaactttgcacaaaaaccttaatgtcactgcacaaaatttgacatttacgtcatgttacaggaaactttgcataagcacactcaggatatggttttagaggattcaatttctgtagaagaaggtctttctggtccaactgctgaagaaaatagtgctggatgtctaaatttattcacaaactggccactgatgtctgctatcattgcatactgcatattctctcttcaggatgtggcttatgctgaggtaatattctacagtgtcattggagttgccttttgttattatttagaatttcatgcatcttttttttaatgtcatatttgatttttgcaccacccctcctttttctgttattactggatttcatttgggaaaacacaaattgcaggtattttctctatgggctgtcagcgacaggaagtatggtggattaagcttttcttcccaagatgtgggtagtgtccttgcattctcaggtacagtaagcacaacaggaaacctcccactaatatggagttttgaatttacaggcagacttataagattgttcatcgagatttgaaattttgaacaccgtggacatgtggatgtgatagggatctaaagaaagcactagccccatgaccccacatgctatggctaatgcatatgataatgtaaaattgtaaattaccataataaatatataatatggatatagatcttttcttattgttaggtctagtttgatgtgatcaattgcactttctcaatttgaagtattaattcttgctaaaaccaaatcttaatctgaagtatggtatgaacttgcttaaaactcaattattcgtattccatgcaatgtctggtatattgagtactgacttaacttattatcaggtctcttcctcctggtattccaaattttggtttacccgtcagtggcaaaatcagtagagcccatcacgcttgtccgtatagtggcagtaagactatctctctttttttgggtcagaatttagatcagctcagttctactgtaacggttcaactcatatgatacttctgaattgcagatattgactataccacttctttctagctatccatttatggccggattgtcagggtccattcttcaattgatagttaactgtgcatcttttctgaagaatgcttttgcagtgagtgcaaacgtcttgtgttgtttagaatggatactcgtttggacaagcgactcgttgtttattcatttttttgaaacaattacttcaagtgtggtcctgtttattgtatatcactcttttatatttcacctctcgacacatccatattagttttgacaaaattcaactcatgctcttctaaaattttttcaggttactaccatcactgtattcaacatcttaatgaatgatgctgtggtaagttcttcaagttccaaataatgtgtaccgggtagttatataaaaaatatattctatttttcggttattatacgtggtaatttatagtttctaattttgtttttctaaccatgaaaatacaaataacaggctcaggacgtta

SEQ ID NO: 80781 - DNA, 7595 bp, Oryza sativa
  unsure (1)..(7595): unsure at all n locations
tgacatgtgggtccaagtcctagcctatatgttagtgggacgtcaataacaaataatggaccattgaaccacgtgaaattttcagtgtgaaataaggaatttccctagttttcttggacaaacaacagtgtccttacaatttcttagatagttatatttccttttggttaatcagtttaattacaatgacaatgaaacacaattttagttttttgtttgttgtgatcaactcccaatatttttgttttgccacatattattagtagtattaattcatcaagatatacagccaggattcacactttgcaaactgtgggtaccagctttttattatacatatatgttttttcaggagaaataccgcatcgtaatgctaattactcttttcccttatagatttgcatgggctcaaaggcgtcagacagcttcatttctcccaggtattacatgcatggtatattactagtgaattaacacgaagatacaactttgctatatcctatccctgttaataccaatgcaattagcactttatcagaattttcttaaaataatatatgggagagccaccttatcatgtcaataagttggaaagttatgataccagaatagaaagaatgcagttctgaatgttggcaatgaactcgccagatatcaacacctttagaacagataataactatgaatgtggtacatatataagaataagttatctaccattagttcttttaattatttttgcccctctcaatgccatgaatatctgaattgaatgatcaaactagagaaatttaagcttgcgtgtctgttttaagaataactagatattgtttgtctaaaactaatgggatagagtctcttaatgttaggtaccagcgaagttcatatcttcatttttgaagtaagatcgtaaatacagtaggttcttagttaaaaatttagagtaagatgtctcatctctgtcttttgcgatgttcatttgatatttaaaataggcaacatcgtagactaaaaaaagagtaaatttcacaaaactacaagtactttggctaaattattacaaaactacatatttaaggtgaaatatcgaaaaactacagatttagtaacagagttatcacaaaactacaggattaagataaatttaatcacaaaactttaacatcataactcaaacatagcattagtgcttaaggatttaaactctaaaatctgtagttttgtgatagttttattattaaatttgtagtttgcgatatttagccttaaacctgtagttttgtgatacattaacttaaatttgtagttttgtaataatttaatcaaagtatctatagttttatgaaatttactcagaaaaaaaatccagaaatatgctgatttcaggatcactattcactattaagcccgaccttaggatctcttctgataccccccttaatttcaactaagcttatgtatgcgtttgaaaagattaagccaggtgggttggcttgttgaaatgcaactacgaagaggatttcctaagcattgaaacgttgttgtatcccattgattcgttgtaaagctctaattctgttggcacctgctctctgtttttgcaggcgaccacctggtattcttcatgctgaacgtcttcacagtcatcggtcttgtgagcactttcaggccgttttacgctagaagaagcacgaagcacgatcccattactacttagcactaaccattctactcaggacctgaggtctgatgtagacccccatttttataacaggaatcactcgtgttaatagtaccatttccctggatcaagtagtctggtactcacgattacattgccgaaatatcaagtgcgcatacaaagatggtctagcgcgaattattacatcataggcccgcaggcagtcttagaacataggaccaaacggtctacaatacatgatgtaacagaaatagattaggcagcggaatataggcagcggcgacactattgccataggcaacgaccgtaaataagacctacgaagcgtcgttatcctccgcatcctcctgaagataagcatagggatcctcctcgacttcattgccatccactgattaaattttgcaatagcaagagtgagtaccaaccgtactcagcaagtcaccataacaacaatgcatatgatagtggtattcaaagtatggccattggtttatttgcataaagctagtttaaccattcttttcacaagcctattatctagcatagactagtccagttttaattccagtatttattacacagcagcggttatgttcactatccattgtcttcccaaagatggcttcccgttactggccgtaatggttttctggggtttactccttctcgtctctcgagaagttgatccgccagtacaaaatcatcatgcatatcccatcccaatcaatttaagaatttagagtctagccaagtgtaatacatgtcccggtgctcattatccgtgagcacggctattcgaatatatttggtttactcacactgcagtggatgtacactttaccctactccgcgacttgcccaacacatgagcctacgtcccaacgaatgagacttgccacggcaaagcctttcaataacctcacgttggcagtactcgctccatgaatttacatcttcatgcactctaggcatcataagtttctagtagtgagaggagttctggcgctcccgggaagggaagactcacacatgcattaagttttagttaagttaagtttacacatggtagtcctaccgatggcgacaccactgtaagcactcgcccctcgcggtcccatcaatggctgccccaccgtaggccctgcccccacacacatcaagaataaccactatgcagggatactgcctccgctcggctatgtactccgctaggtctatacacatgcgagaagtacggttgtatgagggtcgtttcatgcttaacttcatggctcagtccttaactgaccagggacggcactagccttttccggacaccacccaagtaccccagccgccctagtcgaaaacagtgtttaattttatttctcctttcacaattcatgtcatccttgtcatggcaatgtggcgctcatgtctccacatgccgcatctcaactaccttccctaaggtagttgcccaagcatgtagcacttgataaatatgagaatgcatgattctaattagcaggactaagcatttgtcaatattgactaagtacacacgataacagggtttacaagggtcatacagataatcaatatcaaggcatggcatatataacaagtggggcattcatattcgtatatatagcatgcaattttatttaaatcaacataattttcgcaatagtttcaacatgctcaaagattagtgatgacttgccttgatcgtagtcttgctgtccctgctcctcaatcgactcaacaattccctcggaatctaaatttacgtgcgaaagatcggatttgaattcaattaggattcaaataaattcaccaaaattcaaacagtacaaagcatattgagaaaatggtatcattagatagaccttgattttagatgaatttaggttcaagtttcattcaattccgagttaaaatgagtgagttatgagggtttaaagattcaaacttgaattaattcggaaaattgtgaaaaactactgttcctaatgatttatttttttgtccgaaacattatccaacacccacagtggctgacatgtgggccatcctcctatttcatttctggtttttttattttttttaaaggaaatcctgctgtgtcattgacaggtgggtccggccccctgttggtgaggtcaagccggacctttaacctttggtgggaccctcatgtcattgagacatttacttaaaaaccaatttaattagatttctaagcatccgggcctacatgtcataggttcacaataatatcattagtttgaggattactgtacactaatgaagtggggtccacatgtcataatctctccctctctcgttcttttctttctccccgtcgtcttcttccttccgctcgcgacggagcagaggagcggcgcgtgatgatgcgacggcccgagccggaacggctcggcgcacggtggggcgagcggtggcgcatcaccagagacccgccgccggcggcggcgaagcgcggcgatcgtccggcgcgcggcgcgacggcggtcgacggcgccgagatcccaaaatcggcggcggcacaatgaggaccaatgtgagcgtaaccaacgacgattcaaccatctagggtccacatggagcatatagaagcaaaaatctagcctaggttgtattggaacgaggtccctccatgatgagctcggccatggcgcggtggcggccggagtcggcacggttacggcggcgcacaccccaaatcgagggggccgctggcttctaggtgtccaggcaatactacaggcgcgagggcttacgacgaagtggcggaacggcggagtttgacggcgcgcggcgtggtgcaaccgaaacaggggcagacgacggtcggcgacgtttgcaggtgtttgacgctcgtcctccctcgcgtagcggctcctggctccttccaacagtagcaacagcaacgcgggcacctcctcaacacaccctgccacccacaccggccgagaggccctgcggcggcggcgcggcccccgcccaccaggtgttcgacacccggcggcggcgtgttttctttcctctgagatggagcaagagctttggggaagagagaaacagatgaggggttgatcttggataaagtcgagctaaaggcgagcttataacagcgagaggaagggcgatttcttaatggataaggataatcaatgactcggctttggttcgatctcacccaggttcggttcaatgtgcaggcgtggcatgattgcctacgcggtagtatgcaggagaggtatcgctagctggacaaaggggcaccgcattacccagcggtctcaaccgggggcgacaagatggcgacgcgacggcgacaagagcgacgacgacggatagagataacggcttggataggggcgcagggctatgccctagggtgacgcggggtcgtcgtggcggccgttatcactccatcccgagggcgacgcgcgaggggatgggatgacgcgggcacccgtggcggcgcagctttggcgcgggcttttggcggctcggtcggctgcgggcccacgcgacgtggcgcggcgcggtgcggcgcacgggcacgcctaatgcggcgcacgggtcgggacagcgggcgcgcggcaaggcagcggttggagggggcggcgtcgagcgttcagacgggttaggcacagatcgaacacctggcgcgcaatgaacagtagcaacccgagaaaaatcacaattagggttttctaatgacaatttttatggaatttttgtttagcccactacccctatttccattatagatctacccacatcatatacttctaatttcatgatttattgaacccaagaattaaggattaatattattacccttgacctatattcctttattctcaactttatagcttctaacctttgtttttctataacctcatatttgatttattacaccctatgtcaataactaatattctatttgtattatgtttttcttatttcgccatattctggattttattatttgacttccatctcaacttacttatcttatattatttaatttaaacaatatatttgcaatagagaaacgaataacaccaacatgatgcaaaagttttaaaaagttcgaaattttagtgatttttattgcctatacctccgtagtaaagtgtatatttttctgtttgccacacaaccattctgatgtactgcaaaatatgcctcgatttttttttagatcagtacttcgatttggtacgatgatcttgtgctgttgtacacatcaaacttagcctgaaggcttgtcttgtatctgtatcttgtatttggacgctacggctcaaactgccatgtgccatgactgtccattcagctctgaaattccatcgactgtgagagtttttacactgtccttaacactgtaatccatcaatttgtttggtggtccttaatctgtaacggcttttgcttggcgcgatcttttgtgggctatgtgcatcttgtacagtgctaaatgtatctagcgttgcacttcctctggttacaaaatattcactactccccccgtttcacaatgtaagactttatagcattgtccacatacatctagatgttagatgttagtgaatgtaaacacgtacatatgtctagattcattaacatctaaatgaatgtgggcaatgctagaaagtcttatattatgaaacggaggaagtagtaatattttgaacgagatttagcaaaactcttgaaacttttagaaagacctattttaaagtgaagggtgttatttggatttttgtgatagtttggagtgtaaaatggagttactgtacatgttagattttataaacttattattcaaatataaaattgatggtcatttttaaaagcttaatcgaatttcatcctaataaacattaaatattaacaaccaaggaagtagcagcatcttcgtgacccctgaggatgttttcagacaggatggttttaatgaaatccatggatttcattttaagaagaaaatatcgggcagggcgtccgtattcaattttctttttactgcaataaccattacaaattcaaaccattttgtaatcatcaaaaaacaaaaattacttatagatgtaaaaaaatagtcatgaaaacaacccattcggattaagcccaatattacacctgtgctcgtatttatagctaattatttttttagtggtaggcaacatatatgtacacagcgagacgtctacagtgacttcgttgatctcaagataagcatgcctagtattttggagatgttcatagactcatagggtaggatatatttgcgcgttcatagaatgagtgtgcgcgttacgagcatatgcatttatatcgtgttctgttttttttacatgaaaacaggggtagagagtacgcatagcagtttgctctcaatgtcgtccggtcttacccttgcggtcgttttttccataaattttcctcccccgcttcccttctcttcccttttttcgctcctcctccactcgcgctccgcctctctctctctctccatcgatccaagcccccccccccccccccccagatccccctcgccgcctcgccaccgcgtcggccatggcggaccagctcaccgacgaccagatcgccgagttcaaggaggccttcagcctcttcgacaaggacggcgacggtatctcctgctccctccttccctctctctctgtaccttctgtttttgaactctgttatgctctgcgtgatccggtagcgcgtgcgtgtgcgctgatgcgatggcggtggagtggagtcggtttcgcggcctcgcgggtgcgcgagaaggtggggatccggtcgccgggggggggggggggggggcctnttccggcggggggggggggggggg

SEQ ID NO: 80782 - DNA, 6172 bp, Oryza sativa
tgctgcagtcaaagccacatctcaggacacttgatcaaccgcaggcaaacttttcacctgaaaattcatcttcagtatttaaatcttcaatccagctgcctatttctgttggcgtggggcatcggcagcctgaagaagtatctctgtctagtgattccactcttatgagctcagatcatttaagtgctagcagtttgttggctggccttataaagagtggattcaaaccgaatgaccccaacgatcttgccagtttgagggcacaacctcctcttccaagtgggccacctcctcatgtttcgacatctttttcagctgcttcctcatccctgcaccttccagctagtgatactctgaagtctcaggcgccaaactctctgcgcccacctttgccccctgggttgccactttcgtcgccgtttgtgtgcccgacaacacagacctcggagaaagctgcaccactctctagtcttctcagttccctggttgcaaagggattgatttcttcgccttctgcagattcaactgtagcgatcccacaacagccctgtaaatcagaactgaacacaccagatgacactgcttcagctccatctctgccttttgtccagccttcagttaaaaaggaaacatccaatcaaaactcatctgccccatctaaggtgctggtgcatcaacctgttgaaatcaagaaggaacctgcagaaatcaagatggtagaccttattggctttgacttcaagcctgagatgctccgcaagtaccatgcacatgtgatcagcaccctctttgatgaccaaagtcatcaatgtaatacatgtggtctaagattcagtcttgaagaagagctctctgtgcacactgcgtgccatggatcgaagcaaagtgagactagaaagactggtatcgcacctgaaaaatggtaccctagcaaaaataattgggtcgatagatcacatgaagtgcagaacagcgccctggagtctgcttcttctgttgcagatttgagctctgaagaggaagtttgtgaattcatggttcctgcagatgagagtcagattatctgtgcactctgtggagagtcatttgatgacatttattccattgagaaggataactggatgtacaaggatgcggtctattttgattcttcgaagacagaaggcagcagtggcgacagtgctgagagtaaagagcgtgtacccatagtgcatgcaagatgtatgtcgataagctcaaatgatggcatggaggttgattagcatttgtgccaaacacaggggcagaagcagtagcaacagaaacagctcgaatgatgagattgaggtggattagctggaaatctggtgcttaacagaagctcaaatgaaatgatgccacaaaagtgggtcagcgtgaggggtgatccgcagcagcaactgcaatgatgctgtcgcggccatgacatgtaggtggattagtgtgaagttgacaacctgacgcgctgcacaagtaaattttggtcaaatgtttgtgttcatccctcagtcaccattaatcgtggataaggtgcttacacagaataaattccaagtccagctctggccttgtcaaccgatcatcctcgcaatcgagatcttcgggggtctgatatttgtatttttggttcaatcgaagggaaatgatctttctgttcatagaaggccagcttgtatgttaaaaaggagtgtattgtttcattacgagggaaagcaataggtgacgctgccattgagttactgttgttttttggcaaacttgtttcatcttccgaggactagagattttgtacctaaaaagaactgataatagaacatcatggaggcagaattaaactagttacttatggcttgcttgcttgatgtgggagttcttcattgtagttcgatgttccttcctccttgccattgtgatgcgtaaaattgttttgtcgtcggaagttgttaattcggcagatgatagatctgagtattatataattctgtaattaattgtgaaactgtaggcatcagtaataagcgattccattcccacctgatagatcctggtgaatagctcaatgatttgcctctcatggattcctggtacaagtcaatgttacgaaagaggccatttggattaataaatgtcccttcagtcatgacttatgttactaatcacttgatgaaacaatgcggtcaagtcgagttgcttgttaatgtggtagcttgatgcacgttactccattgtaatactagtacattttagcatgtctgatgcttccgttttgcgtaacagcaatggttgggcttaactaagctaatgcccagtgggagaagacagcagccgaccgccccaccctggtctagagtattagcggaatactaacttgattatataaataaattcaatttctttttcaaaaaataaacacaataaatggcttaaaacaagtaatgcaatggtcaatggaaaagaacacttcttaatagaacttttttttaaagagtgaagtaaataagctgtttcaacaagccgataaataacctgaaaagaaaatggctcatttcaacagtcgaacgccacctaccgcttatggagtttgtggttgcagatggttccccttgctacctctgtcggtcagccccaaccaccaaaccaaccacagccatattcccatcctatcaacatcaaccttacggagtacgtgctgccatggatgcatgtttgtttctcccagtactcaccaaactgtcttctatgttctatctgtaccatctacagtactatgtgtgtactcaaagtaatggcatgccatatcgatcagtgaattcattcattttttttttctcagcaacaagagagccaaacatttgtgagcagacaagatcacaggacagcagaaatgtggtggttgttttgattgttttaggcagctcttccattccaagatgtaaaattcgacttactgagaacatcatcatgatgtaaatccgcacccgcgaccgcaatcaaacattaggaggtcttcctcccctctctccaattttggtcacaaaaatttcaaaggaaaacaagaagaagaaagaagcaaattaaccaacaaaaatttgagcatttcttgagataactgtattcaactaccaataacagcagcagcatcagtcttgttgatcaatcagctgctgctggtgtcgccggcggtttggccggaggaggaatactcccagggcgtcatgtccatggggtagctgccgagcacccggaggaaggaggtgaactcctgtatctccgacagcgcgttctgcgccctgacctccgccatggacgcctggaagtcgatgtagaacatgtactcgaagtgcttggccgtgcccacgttggcgtcgtcgacgagccggatggggcggtggcggtgtgggcggctctcgatcttggtgaggctgatgtcccggaacgcgaaggccgacagcaccttgaagagcaccgacgtgccctccctgtcgtgcgcgaacacgatgctcgtcttgaatggccggtccgttcgcgggatgatgggctcccgcgccagcatcacgaaccgcgtcacgttcccggcgtcgtcctggatgccgtccgcgagcacctggagcccgtacagctcggcggcgcgggaggacgcgatggcggcggtgtcgcggagccccgcggcggcgacgtgctcggcggcggccgcggtgtcgtcgaaggcctcgcgggcgacgttgaggcccatggcgttgagggtgagctcgcactgggcgagcgcctgcgggtgggagatgacgcgggtgaggaggtccctgcggacgcccgggagcgcgaggaggcagtggtggacggggagctggacctcgccgacgatgtggaggcggtggcggaggaggaggtcgtagttgcggtggatgctgccgccgagggagttctcgacggggaggacggcgcggtcggcgatccagagctcgacggcctggaaggccacctcgaactggtcgcaggggatggcgtcgcaggaggggtaggccttggcggcggcggcctcgctgtatgcccccgggacaccctggtaagcgacgcgcagctggctgccgtgcatgggcgcgggggagaggtcggtgatggtgagcgggcgagggaggttggagacggggagcagatccaggtcgagcggcggcgcggcgtggtcggagagggcgggcttgatgctgtcgccgttcacccgcggggcgccataggctttggcgttggtggtagtggtggtggcgaggatggcggcgcaggtggtctgccagtgggcgcgggagaagggggtggcgcacggcgggcggatggccgtggatctggggatctgggtggggcgcggcgcgggcagagtttccatcatccggcggacggcgacggcgaggggtgggtggcgggaaagggcggcctccctccctccctgtagctgcaagggaagggaagctaaagctttgtgtctctcggtggtgttgcgtttgtcgagaagatggagtgagggactgcctccacctcaacgagacgccgcgggaccaactatttgtttttcttaataatcacgattcttaaatattatttatatttttttaatacattgctattccattttggtaagcgcaccaactccatttgtcagcatgagtgtgaatgcctattttaccatattacgaaccctacatgttcatcctccttcctatctccatctctcaaatcactctcctctcattgacgcatgcctcattttttactcctccaagcctcctgaccttcccttgatgtttccccttctaccaacatctagctatccacgcccccttcctctcttcctccttattgcgctagctcttgagcccttgcgtgatgagcctatagatcaccgaggtctcacattctctctcgacctccttgtctcgttagttttccctactttttttcgtcattggtagtcatgctcgttgctcccaccgttgacaagcctagatctagcgagatcccactgtcgagctccaccattccttgttgcggttggttctatcacactaaagagcccttctcgtcacacgagacccatcggtggcagtgatggaggaggagatgcgtagcaatggagtgagaggaaggtgatgcgctgacctactttctcatcatcgatgccgcctcactttcatcaaccatcgtatatttttaaagtaattttcgtatatttttttttaaaaaataacacattgttttagcatttcgaaaagcgtgcacgtaaaatattgagaaaagtgagtttggacctaaggaaacgaactcatgctcggcgctgcatgaatttatatttatgtattctatgtattcagcggtagatgtacacatcaaagtcaatttttgttttgcaatccacgccgctcaggatgcttccttcgaacacagaaagaaagaaagaaatgcgaggcattgagtcgttatgttaactaggagcagctgtctagatgctggactttttacacatggccctttctgcagaacttattttacgaattaaactttttagaaaactaattctagaaacaaatccctatgctcagcgcaaaaaagaatggcgttaagctttaaatagacacgcaagagatattggtattgattttgaccctagcatgcgctcgcggcagctgaaccacactggtgaagcggctcggcgcatgctttaagagagagagcttggagacagtgcgagcaatgtctaaggatcgcgcttgcaaaggccaagtcaagctcagggacggcatgcggcgagctaggccgaggctgttattgggctggtggggtataggaaggtaaaatggacatggtgaccggcctgtgagggggattgggccgccgggaagaaggagaataagtgggccggtctatgaaggggaggaagatggaaaaagtacaccgaaggtccctcaacttgtcatcgggataaaaaacgctctcaaaccacaaaaccagatatgtggatcccttaactatacatcatcaccctctgccctcctttccctttccctttctcctctctttctcactcttctcttaccttccctgggcgactgggcaagccggcagaaggcgacggcgcagggcgggggggagggggaggggggggggg

SEQ ID NO: 80783 - DNA, 11139 bp, Oryza sativa
aaaaaaaaataataattactaccgcatagtaatcaaatatgaaaggtaaaatgaaccagattagtaaagaaaagaaaagttatcaaagctcttactgataattagcaaaacaagagttatatgctagccaaatatttcagttgactgcagacactaacctgaaagcataggtcatttaggtataattaactaaagagattgcagctaggatcagggcatctgcagtcacacagcttgggcatcattatctacatcaagcaaatctccaagcaaattcaggtaaggccgtgtttagttcacccccaactaccccaaactttcaactttccatcacatcacatcacatcaaaaactttcttacacatataaacttccaagtttttttctaaacttataactttctccaaacttttaacttttttcaggaactaaacacaccctaaaggagaacaactttacacaaaatggacatcaaaatcatactaaacaggcaggggccgggtgtctgttcgaagttactgatgtccccctcatgcagaaagctgaaaaataaatctttgcttggtaacaaaccggctaccactggcattctagtaacatctaatctaacatgattaaagtacgaagtcatgataatactataatcagtatttcttattggaaaccaacccacaaacaacgagtaattcatacatgaagcaagaaccaaacataccaggttagtcgagatggaggcggcctgtcaccgggatggtcttgacaaggacgaggtggtggccagagtcagagtaggcagtagaggtccagccgacgagcgtcgtcgtatccaggagttttctcaaagccgacgaaacagagccggtgatgcaatatgtatgttgagctacacagatttagcatgttacagcacaccttgctatttccagtatttcatatgatctaaggtttgttcacataacataaaaatattttccatctttacattcttacatacaaatgaaagcacggttatatcttattttgcgctaaactaaactacagtatcatggttaaatcagcaaaaatctatgtgttgatagctcgttccaaaaagacaccatcctgaatacgaaaaaaagcagcaccatcagaacaatccacatgaaacaattgcatttttttttaattcattagcccttgtgtacgctgtgcatgacaaagaaatatgtggtcatgcactcatgcgttcgtaggttagtcaatgcatttatgtaacattagattctattgttgactttctagatcttttatatttccttctaaaatgaaatgtaaatgcatctttcatataatattgattatttagaaacccaactattacaaagtattagttttgcttgaagaagcttacattagtaagcatgttgaagttctccaaagcttgaacctacaaaacctggcctcgaacattcgtatactcagagttccactttctgtggaaaagatgtcagttaacgaccatataaatcataacggtcctagttataccctcaatacaaaatcaatgcttagtgaggttgaataacgaggttgttactacaagataatacacctgaagtgctgtcagatagttatggattgaaaacatttagatagtgcatgaaccgagttacctgaataattgacaaagcaattaaggacatatcacataagatttgttctacaatgatttctcttaattccaaatagcacatgcacataatgtagagttagcttgatccattcaagaagatctaaataacccaatttcacataaatcatataagcaacagcactgactatttgtgttcatatgaaaaaactataattgatttgaagacatggaccagctgctggtcataggatgatcactctgtatccttgcctaacatgtgctgaaaatgattaggatagcaaaatctgcataataaaaaaattacttaaggggaaattagtatgttgtgtagccagaagcaaagattatctattaaacaacgctaaaattcaagctagctagagtggcgtgccttgagaaaccattgcatcaataacgataacaatggcatgcaagaaatggttagattgcatcagaataggcagatgtaccataattagaccgataaatttgagaaaataattccgtagatgataactatagatgggagaaaccatggtaacgtgcaggctaaaatatattgagtaggaaatctagcatccatatacaaataatattggcatatcggatagaacctattgcaaataccggaattgcgacatcaaacgtcgacagagctgataaagcaccagaaccagatggcttcactggggcattctttaaagtttgttgggaaatcatcaaggaggacatcccactggtgttcaactccatcttcaatcttaggtgtgcgcacctcaacctaatcaactcagcgaacattgtcctaatcccaaaaaaggatggggccgagagtgtttcgaactacagaccgattagcctgatccatagcattgccaagatcttctcaaagttgcttgcgttgcgtcttaggccccacatgcatgccttgatctcggtcaaccaaagtgctttcataaaagggagaagtatccatgacaacttccttttcgtgcggaacatggccagaagatatcatcgcttgagacgggcaatgttgcttttcaagcttgacataacgaaggctttcgactcggtgtgttgggattacctcctggccttgctgcagcaaaggggcttcccgacgaggtgggtggattggctaggggctctgctatccacttccacctcccaagtcctcctcaatggctcgccggggcaacgaatcaagcatggaagaggacttcggcaaggggaccccctctcgccgcttctcttcattttggctctacagcgtattctctccaaggcaatagagctaggctcaatctcaaaacttcggggaagaacgactcgagtgcggatctcgatgtatgcagatgatgctgtcatcttcattaatcccacctgaggcgatgtcacggctttcgcggacatcctacatcgtttcggcacagccactggacttgtcaccaaccttcaaaaatcacaggtcgtggccatcagatgtgacagcatagacctgaccgaggtcctccagggcatcccagtaatgagggcaaattttcccctaaaatacttgcgcctccccctagttctgggaaggatgcggaaaacggacttacaaccggtcttcgacaagatatcaaggagggttgcaagctggaggggcaagaacatgggagctgccgggagtaccacactcgtcaaatctgtgctctcagcgcagccaatttacctcctgactgccttgaaggtgacaaaggagtctttggagcaactagacaagcagcgacgacgattcctctgggcaggcacgggtgatatcaccaggggaaaatgtaaagtcaattggataaagacgtgtttgccgaccagccaggggggcttgggagtcctaaatctggacaagttcacaagggccttgagattgcgatggctttggcatgaatggaaggatcctaccaagccgtgggtgggactggacacgccttgtgacggtttagacaaggacctttttgccgccgcgacaaaggtaacagtcggagatgggaatacggcacgcttctgggacgctgcatggatagatgggcagagaccaaaagacctcatgccacttttctatgctatctccaaaaatagaagaaagtccctgcgccaaggaaaagagggtgacgcctaggtgaatgatctgaccttcaatgcggcctcgcctatcacaatcagccttgtcgagcaactggttcgcttgtgggaagcggttcggaatgtgcacctaaacagtgaagagccggaccagattgcttggaaattcacagctaatgggcactacacagcctcctcggcctatcatgcgcagtgcttaggggcgccaaactcaaatctaaactccctgatttggaaagtctgggcaccggggaaatgcaaattccattcttgccttatcatccaaaatagagtttggacatctgaccgccttgcgacaagaggctggcaaaataatggacattgccctctctgtcgttctgaacttgagacaggaatacaccttgtcggcaggtgcagatacacgaagagaatctggagcctagttgcttcttggacgggttatcagcaattggagcccactgagtgggaggaagcacggtcagtccaacattggtgggggagtttagcaaatacacccggcgtcccaaaaaagggccttcgatccctcattctgctagtcgtttgggaaatctggaaggagaggaacagatagatcttcgaccacaaagagatggcaaaaggcttcctcctatcaagaatcaaggatgaggctagtctttgggctctagcgggagctaaaagattgtgcgatctagtcccacattttgtatagtgtatagctcatagttctctttctttacccttaggggttgtattttctcctgctctattcaatgaaaaggcacacctgtgctgttttctgttaaaaaaaacaaatataataatgcaaagacccatggtatattaatataacttgctcaaaatgcaataaacaacacataaaattcttctagtgtcgtcgatctaactaacgagcttaagaagcatggtatatcagtatatatagttctttgtgcaaatgatccatgaattttaaagactaaacaagagcaaattggtttaagagtataaatatcaaaggtcaaaatcactatacaacatgctttagtggactttggctttggaggagagggaagcaaacagagaaagacagacacaaccttacctcacgtcatagaattttatgtctcatgcgaactacccgatgatctactgcaccctcataagtaatgccttgggtcctccctgtttgcctctttggaggatccatagatatagaaaacatttactcagtggataaaggcaaattgtgagtttcatagtagaagacttacttctataagctgaccgtggatggtaagacagagttagtgcacccaaaggtacatatctgatagcagctgaaatgtagcaccataaccatcctgaggtgtcctgctcagaggatatctgacatgttcatcctggttccgatggatttcaggtggtaacaaatactccaaacaatagaatatatgcctaatacagagaccattcaaagataatatactattggatgcagccgtcagtggcaattgtttttttaggggaaaacggcaggagctctgcctattcattaagaggaggaaaaagagtttgatacagattctgggcacctccaagagatgtcacaacaaaacatgaaaagcaagacagaaaaatacagaatttttaggaagtgcatcgccaccagcatcagacgtcttcgtgttatcatctatccattttgagcatcaacaaaagccttgcacatatttatcacggaagcaattgtattttggagcaaagttacctttggagttgcgcggttaacaactattattgtgccatcaagttcatgtgaatctttcatgttattgtctacagattctgtaataacatcacagtgcattagaataaggtaattacaaaatgcatatcaagcttattgatcaaactggggaaaagcaatcatgcattaaaaatacagacatgaagtaaaaagattgaggacacaatgccatttttatataaataaagattcatttatgttaagattgttcttcgccgacaacaaagtaaaattaaagcctaaagaatgatgcaggatttctgcaaatgtacatccactctgaaaagcgatgaacacaatatcacgggtccagatcccctagagttagactacaactctaccaggtggagttgtcatgatccatgacattccgtatacttcaagggttgggattaagccgccttaatttttactacataaaaatcagtaactaaacattcaataaatagacttgcatcaacattgtcaccagataatttctgtagaattatagaattaatacataaatttcatgcttcatctattgtataaaaatcatacattggtatcgttcacttttgcatgtatgggaaagcactatattggcatacaatgccgcataggattgatcgactgtatgtgttgcttaaaaacaaaaagttgttgtgttaatttgtttagaacttaatcaaatcactattacaaaggaaaaccttaaaaataaaattctccgaacacttaaccattaatttaaggataatttattaagtgaaattgacgaggcatgatctcaaccgtatagaaataacggatggcatagatttagccaactccactcgatacatttgtacccaactctaggggatccagaccccaatatcacgatgacccctttgaatcatgttctacacattgtagttccatttactgctgattgcgacaaataagcagaatcctatattttaaatacttcttctgtgctaacttagattcaatatgcaccttccatatcaagtctcttataagatgcatatgcctaagttagaaaaggccaaaggagtccagagaatcctagctagcgttaggattagtttagacaactgtccttatcagaaccaaatgtaattaactacacaagaagagtgtctatacttgtattggtacttaattttgatatcacagagaatacataaatactgttttcagctaatcaaacatcatgtacctgtcaataaaataattccaaatttggtcacctttggcatgtaaagatgagtgatttctcctaagacttcaaaatacctgtgaataaattactctagccgttggttttggagaagccgtcgtctacgtacgtctgctcctgctcgtatgccgccaccgacgtggggggcgaggcgagcgccagcggcggtgccgacttgggtgacctgggaggggagttgtgactgctgcggattcacggaggattgcaaggccccatatatcgctggcatgcgggcgccgtacgagaggatcgaggtgggtctgcgggctctgcacggacgccatcgacgacgagcttggctgcacctcttcgcccatttcgccggcggaggcgctcgaccgcgcgccgcgccttcatctgcggcgtcggatgagtctccaccgcgccactgttggcggccaagagcgcggacgggattgatattcgtcgtctttcttctcttgctccgccgtaggctcgctggccccgttaccgggaggcgtcgagaagggatcgattggaaggggaagatatgaggcatgaggtcaaccctttgggatccataccgccaaccatcgctctacgtcgcgccttccccatcacctcgtcaatcggtgacccccgtccccttcgcgctctccccgtcgcccattcagatcccactcgcgcgcttcgccatcgatcgctgaatcctccccggcccgacgacaggaagcatcgccgcgtctagcccgaagaccggccgtcgaccactcaacagccggcccgtgtctgcatgcagccgtgcaccgagcccacgcagttcccaattgccaccaccacatctcaggccacttggacaacaacatcgagcgccacctcctcggttcacggtaaaatccattttccccatcctcctttctattcctcctatctaatgatattttgaggtttttttttctcctcatctccattatgggtacatctctgtgaagctataaaatacagagagattagcaacactaatatgcatgcctttgtcttttgtaaactgtcaggattaataaatagtatatgtcttagtatagttctgaatttatacctgagactgtcaaaaacagggcacggctatgccctatgtggttaacttatatggatcagtccatgtatgtgcccaattgtataacatatagcttgttatatttgtcagttgataaatatatgaatatatgtatcatatataccatttaatgtcatttttcacttaaatccattgttaactatcaacaccagtattttcttttaatcctctacatgcctatgattttccatctaattccttctccatatgtaacaacagtcattatatagaatatactcatgaatgatttgttgcactctgttgatgtaggaaactgtaataatgatacctggaatcatggttattgacaatataaatctcacttaacttaaatttgaagtcccataaaatacacattaagatttagacaaaatttgcattgtaccgaatgagtctattaaaaatcgcaacataccagaaatgtctacttgaatgttgtgcagaatatgtggttcagattgaaaaatggatgtttctttggtaggccatacagcatccatgatgagcaattgggtggtacctgggtaattcaaatgtcagttctatcctaactttttttcgcacaaagataaattgctatacaagcttgttgacaatcaatattgctacatctcaccattagggcagatattcataatttctgcagcgcagaactggtgacaatttggttattagttatctttatctcgcatttcagttttccatagaattacaaaactggtgatttctcattggtgctttaaaagttgcggcactggtttatcacagagaaggtgtgattgttgctctcaagaggagtaagttcgctgggttgatggttcttttttttgttgttttgagtttccctagtctttatacgagtgtacattccagttttcaatgctgaggtgggctatccctagagtttggtttattagaatatccgtgagctgtctcggtttactctcttgttttgaagcggagattgaaacctttcgttatcaaaactgagatatgtgttgtctatagaacatcagggctatatagtacaagttttctaactatggatgcactaaaatgttggatcaactgattatttttgtttctgttcatccataagtcccatagaaactgacattgtttcactttatattttcaaatgtgctttgtaaaagttttgacccatgtgcagcaaaattcagggacattacctccgcaacgctagacaagcccctgtggttgctcatgaagatggtctcctcgttcggtgtttcccgtcactccatcccccgtctctcctaggctccaacgtgcggtgaagcaccctgtgcccctgtcctacctcacgacatagaaacaacgggtgctccaccccaccgctcatcccttcctccatgaatggcagcggattacaaggatacagtacagaggatggagttgccatggacagcgaccaacacgggagagatggtagtgacaatggctggtggtaagtaattgttgtttcaatttgggattttaatttgttattcaggctttgcaaatctattcacgtcttgacagcccttgcgcaccagcgcacgcctgtgcagttgctgctgtttgtctgccaaaacgagttgaatgctcctgttgcgctaggtagagaacgatcggatacagggcatccagagcagtggacagtggaggtaaacacaatatcttggtcagggccggctctacaattttgagggccctagggcaaacttgacaacatgatccttaacgctctctcccctatagagagacgtgttatatgtatattcatattttttgggttgttcagattaatgtcattttaaaccatatcaatttttgataaagttgttaaagatgtgcatccatttagtttttttaccaaactttagtaaatacataagaaatcctgctaaaactaggcaatatcactaaattgtaaaaattttggtattgccaaaatttggtaagatttattttggctacgatatgaacagccccttcattttcaaagtgtgttttcaaatctaatcatagagagaaatgaacattgataatatttcatatatatgtttttagaaatagaaaaatatcaacacttaaactgatcttgtttatttttcccatttacttagcaccataaaaatgcttcttgagtaaaattacaacttatcagcacctaaaattataaaggaaatatatattatcaacaagaatctatctatacatacaattttgattttgattgttgaatatagaatctttattaatttactaatcagtattatgtagatactagtagataaccaggagtggtagatagtatgtaattattcactaatcttaaaataatactttggctatcatacaattttaggcatgggcccctagctaggacgggccctaggccgtcgccctcgttgccatgccccagagccgggcctgatcttggttcactaacgtactcttgttgcatgtatcaaatgttttcagtgtgcttttgaacttttagaagtaaaaattaaaggttcagaacaaatgaagttgggctattggcttaagaagtacaatctgaattctgaactttcaaacctatcctttgttcaattaatctgttttttagacaaaaacttctttctttagatatttttttgtgaaacataattctacacacagtatcttcaatcatcgcacaattgaaatgatatttattttctatgggcctaggtggttaatccattgtagttgatagtggtaaacacaacagtgatttctctgtctcacccaagaggtaatcacaggggtaatctgaacttagcggtcaccaggtaacctaagtaaaatgatttgaaacacaaagctccaggttaacaaaacatcaactgcctccgtcccattacgatttctcttgtgcgtggaaatgttttgattttttttttctagaaaatctgatggccaagaaggggacattaaaatatgcaacaagagtgaagagtgcaagactattcttatatgactcacttagagatcgattacatgaaaaatctcaacttcatgccagagttggaaaatgggattagtgatgtatttatttaaatacgtctgaacatatttcagttacaaatcctattaaaccatgcaattggcttcttagtctgttagtcatgcaacctaactttgttgagtca

SEQ ID NO: 80784 - DNA, 12229 bp, Oryza sativa
taccatagataggattcaaaacctctctctctctctgtagagcaaaaaagaaaaagctagcacagagctgctcacttctcagtatagaggcagaggcagagacgacagaggcagcgcgattctttctttttggcctcctctcctcttgtctcgctcttcttcttctccctcttcttcttctatgagacctcgctctactctctctggcggcgcggccacactgctcttcttcctctgatcgagacctctctcggcggcgcgcacactggtagcgtggtgagcggagcggtacactccctactccccagtgcttcttgttctgtatacgcatcatgttcttgcatctcacatcttgcaatgtttttcatgttctatccgcctccctcttctttacaatctgtttctcgatctattgtgtgctagcttcttttcttaaagaaaataatttggataaagagatgtcgctttttctacatctcgctcatgctgcatgcttatatatgtttttccattgagatcgattggacagccatggttccaaaataactagtttttaaaatgtttcaataaaaagagcatcttttttcttgtcttgtgggcttgtggttagtacaaattttcggtccgatgccaaccggggttttggtgcacatacgaatgccagctcctctatatagtttttggatggtgtgagaggccaccatattcatcatcaaaaggagctgatagatcgatgttgcctgtgtccatggctagggaaatggcgcgcgcggcgagattccatcggctaggtagctgcatctcatcgatccagaccaacagtatgcgagccagcgagttggctttgacgtgtgcatgcgttggggttcattgggccttcaatatatttctcttgtgaaaaaaaaggtgtcttttaattaatttaatttcgtcgtcgaccctgtcgaatgggacagtatattgggagagcaatgcaaacgatctggagtatctatcactcgatctgagcgcatatttttatctcacattctcactcctaggcgccctagctaggatctcgatcggtaattaattagtgtatcatcctaagatgaacatatactgtataaactaatcggccggtcctcctttccttgcaaatatgcaaattttgattctttatatatacgtccttataaatactggtcctcatcatttcaatcttagtatagattcggaaagagctagctagatacagcaatcaagaaatttgcgcatttatttaaatatataatgtgtgtttttctcttgaaattatcgtaccgtatttgattgtttctttgcttgccgtttcgtttgcacaggtatgggtccaaggagcacaagaggccgtgttctcatgttccttttgctggtcctgatgatggccgtcggagccaatcgcgattcaacagtacgtcttctcattcccttccctatcaatcggagagatctagctagtccttaattataaattgttcgtcccacgcttgctaattaactcacacattgctaattaattaactcgtagtgttgtgtatatatattcaggcggctggatttgcaaggacggtgtccaaggctgaagtgttggcatcacctcctccaatttcaccagctgtcaatgctgtcatcattataagaaatcgggtggttctgtcaattggtaaaatcaatgttttgaatgattagatgcacttttttatataaaaaatagatgataatgtggctttatatataatttctattattacaatacaattcatgtttttttatacgtcgttgtgtattgttatgatatatgaaagttttttcatgtacaatctagatattgtcacaattagatagtgtagcatttctctgcttcatctcaagcatgtttcaaaaataagtttgaattaatgacacctaattattatacgttatctaattgtttataacaaaacaaaactcacatcttatgtaataattggagttgtatttagaaaaataaagattagtattatctttgaggatttagatgtgtagaatggataacaatatcacacgtgattatgaactaaagggaggtgaatggatgagcaatgattaaattagatagatgaatagctagcttcttgatccaacggctgataactctatacaaatgcgatccaatggcttaaaattgttgataatgtggctttttgcatatcttgatttttatgagtaaatgcttcttagtgggtatcaactatataggaagatatgatatgcattcatttctcttctgctctatttgattgttttcaaattaagtcatgtctagtctcgtgtactagttattgcttttatggcgattaatatgcatgcttacaatattattaaccggtctcccttttattttttttctctgcatctatttaatttattttattttatcttattgtagctaatatttttagcgtagcagtctcattatggccgttttttgttcgatggagatacggttcttggtttattacacgccagattttttcagcaaaagtcgtggcgtgtaatcttgtggcatctgtcacttggactatctatatgatggttcaaatgtatgccggcggtaattacgctggagacgacgttttactgatcaattcagtaagcagcacgagtagtatgtttattttgctggtgtatttcttgcatgggagagaggatattaaggtaaatggaacaaagtcgatatgtttttaattagttgttttcttttaagttgatctaatagtaattttatttattttacatttatatagtactggatcctcatgatcctctttgctttggtggtatgctgcggaatgggatggttagtttggcaccctaacataatcatgtccgagagaacacaagacattttaaagaagtccaccaaatcagctgggattactggaatagtactattcggattggtgaattttctcccattttttgatctggtatggttgcttgtctgaaacacatacgcattctactgttgtgtccattaattgttagtttagtctaaaaccttttggttagttagagaacaaatcatgttcagtatcagtttcacactgaaattaactttggaaatgtatcattgcttaataagaggaacatgtatttattttggtaacatagtttttttcagtagtaaatagtaggtatatacctatgcaggcacaaaataagttcaggacaaccaagctaggtttcataggatatttgtgtccttgaggctaagtagcgatccaattttgaattgctgcacccaccccttgtagtatcatatttcatcatgtgcatcattatccacttcactgttcgttcctaccaagggaaatcactcagtaatgtaattagtgtggctactgtagtgatttttttttgtgtccattgtacataaaaaatgatttaagtatatgcaattttttttttactttactaacgccccatttgttttttaatttcagtggaccataaccaagagcaacagtacagacttcagtttaacaacgccaattgttataaatacgatgttggcaggtgtattgagtgcattctgggctttgtatgcctggatatttgacccaaaatcacccaattactttatggtaagtaatacattgcttgtttttgtttttactaattattaatagtttatattttctttttaatgtacgtcattacagatagcaaattcattggcggctggcatgagctcaatacaatttgtatggctgttggttctgcgcaattctcacagagaagtaaacggacagattgtagaagttgagagtctgcggtgtgtgttacttagtgtcgcaaagtcgttggagaggttgggagcagcagctcctaccgaggagttcttgcaacaaaccaagtatctgctgaggttacaagaaggtctgtccattgggctgcagtcgttggatttgatggagagtgcattccttcggctggaacaggagctagtgaagaacgttgctcgcactgctaatcatgttttagaaatgcaggataaacaagatgcagcggctaatttcgtggcaaggtctgatgacaacaatgcaaatgatgtgctaagagcctgtagaattttacgtgaaggatgcacaacgaacaagaatgcttttgatagcatgcaagaggctatacaacacaagattgcaaatgccgaaggaggagaaaacaacttgaaagacagaatcaatgccgcagcagcagccataagaggcttggccatttccatgggatacaatatgcaaaccatcaacggtcgagggattccacccacggtgaagatcgccttcaatttttgctgtgagcagattttgtcagttaaaacttgcgccgacgccccgtttgtgtggttggggtttggtggattttctctacgaaggcgtctgaacttacggtttgataacgtgaactggcctgatgtacccttgtagtacgaattgggctacgtactgtacgtgaaacttgctctaatagcttcagcgagcaagcactgtgcaacttctggattgctagctaggatacttcgtgtccctaagtagtcatatgcttgttagctctgttagtttcttctgctgcttttgtgcccgattgttgtggagtgtgatgcttctactggtgccagacagctctatatatctttccagcaaattaatttctaaaactagctagatgggatcgatgatgtgtcttgtgttgtagagattaaaactctgctctttaggcagtgattgtgtctttaagtttgctgtgttgacgattatgcactgtgattaattatttagctggtcgtggatgggcagcagacggccgggttttcgctctggctctttcaccgtcaggctactgtggtgcgagggctctgcaccgttgcccgtatttgccgctcattttcgcgcgtgacgtacgcacacggcacatcgcattgacatgagagagacaattgtgtcgatcagtttgggatttgccccaaaaaaaaaatcatcaaatcaaatatgccttctgatttgccattggaattaaactcaccaggatcctagccaatatattattttcagttcttttggagattattagtagttctttacaatgttttgtcttcttataatgctagaaaatacaagcacctgttaggacttgttgcctaccaccaattataatgctacaaaatacaagcaccgaggtgatgaggtcttcctatatatactgcaatctactactcatgttctggcctatgaaggttgtgcaggatgtacaggggagccgaatccgatgacaagaaacgctcctagttggtggatggtcttcagcagcattggccaacctcactatttcccaatgaacagaacaatcattcctccccatggtgacatcggctagcctaaaaggcgaggttttgacaccatcgtcatcttggcagcctggtcaatctgaaaggattggaacaatcggatgttcaacggcaagagcaagaccatgcgggaagtgacggagcttgcggacatggaagccgcgctctgacgcgaggcaggaggagtgcccatttaagtggcggtcatctatgaagttgcgagagattggccttaggaaaccaagctcttttttccttttctttgcatgtacatagttgttgaacctatgtggaacatctaaatcctgatattaatacaaaagacacgcattttgtgtattcatgaaaataaatgagagaaacacgtaccgatgaacatagattttgagttttgtgtcacttaaactagggattggcccgtccagctttgtgcggagctagataattcacgttgttaatataaaaatatgtttttttttgagaaatcacaggaggggagagcttccccacctgaatcttccattgagaagagtgaacatgggagtacatcattacaagggccgatcacagccagcgttgtgccactaagaatggtgagaagaaagggggcgggagagagtagctttccaagcttggattacaattcaatcgccgcgcttaagtcttttagcccacaaatatgaaatttaatttttattagtattattacatgtagaagtatatttggatttcatatataactcttagcttctatttctataaggtatggatttcatatacaactcttggattctatgtctacatgcttagatttcatataaaaatattaacttttatttctactagcaaaatacccgtgcattgcaacgggttaagaaagaaaaaagagaaaatttaccattgtcaagcactttgccatgcattttttctaatgaaaaaaaaatctagattacccctaaactatcatggtcagccccctgaacacgaataccagacatttttcaccctcaactatttaaaacggacaaataacccatccttgtccatattcaatatccggaataattttggccctatgtggcattgcagtcagcattttttttctaaaagataggtgggccccacctatcatacttttccctttcccctttctctatctttttctctctctccccctccctgccatagctgaagcttgcgacgacgttagtggctggccctatcaggcctcgtcctcctcacagcaaacacactgccgcggtgctgcttgcccacacagaaggagccccgatagcatcctacgtaccgtctcgtcgaggtgtaggccgaggaagagaagcgtgacagcggctgcctccttgagtttgagatctgcaggctccttgcggcggaggccgaggaggagatgagatttgcggctttctcaagagcgagatgccagcacgagtgcgagatgcgacaacgacagtctaggctgagaaggtggtggcggcttcttcgcagctgttgtccgtgtgtcatgctaggagacgacgacgagctcatcaccgccttcatgcaagctccagctccgccaccattgccccctccttcgtgcgagctccggctccgtcaccactgtcgtcaccttcacgtgagatctagctctctcgcctccacgctccctgaggcaagagacaatgtggtgttacactaaatatttgctaataacggattaataaggcttaataaattcgtctcgcagtttacagacatattttgtaattagttttttaatagactatatttaatactttaaatgtgtttctgtatatccgatgtgacatgacaagaaaatttcacccctagatttaaatgcagccaaaatacatcctttttaagctgaactagatattttgcgtgtgccatcacccatggtcctccgtactatcttttttgtccttttcttttggtacggcggttataaatgaatattgcacctttcttatccacactcatactatatcggcatgttttatatacgattccttatatcaggatggcttagctattggtatttgtaaaatagtgaaatatgatttaaataagccggcatgatgtgaaattgttgtattattttttacccgctgcaacacactggcacctaactattatttttaaacacaaaaaactatttatatttgtagagcgatgaactataagataatgccagcgagcaattaacaagaacaagacagaaatcaactaacaagtagcaacttctcattggttgtaataactagcgtggcatacaaagagtttcagatgcctcttcagagtgaaggcaacgcttcccacgcatcccagtcatagaaagtttcagacgcctccgaagattgaagttgaaggcaccgcatcgcagccatagaaagtttgagccgcctccgaagactgaaggcaccgcatcccagcaagagaaacggagtgtcagcacaagttttaattgaccacatatgctcacggcaaaaactaaaagcgattctcattgtgggtggaatgccttctgcaccgttgatcctttggatccagggtcccaaaaaaatagctaatatcctcgtcatcccagatgcaagtctgatgttggcctgcagcttttccccggctcctgcgacatctaatagcctgtcatttacagatatctgaatgtcattaaaaacaatcatgtttgccctgcatatttcaagaaaactcctgtaagctgacagggcaccatatgcagctctctcattagagacggctaagaagacaaccacgctatgtacacaagccttatcagcagccttgtccacttgtttagattcaagacgatctctatttgcggcgtcaattgcggcagcagcaattgcagcaagcgatgcaaccttgtccgcttgtttggtttcaagacgatggaaggtacgctccattagagagagcgattgccatgcaatgtcaaggttattttgtaacttgaggagatagttcctggtccagaatgatttggtaggaggggcagcacccaatctctccaaggattttgagacgctgcgaaacacggatgccaggcgctggacaaagggaatttgcccctggatagccattgtaggtaatttccaagatgtaattaaattgcaatccggcggctctgacacgaagaagaggacgggcagatcgacctgaaaacaactatcctatctctgcagatcgatttgttgcgatgagctgagattgacggttgggacttgggagttatatggagccaggcggccggcggaagtagaattgaatccgactacgagtccgagtcaggtacgctaatagtggagtaatacggagactaaaccggggtcggccagagtaatggactgtttgtaaaccaaatttgaaaaatcaagtttccttcttatgtctggctggaagatcaaagaacagcaaatcatcaattgattcatttgccagctagtactccagttgaaccatcagttatcctaattcattcccttttttctaatgttcagagtacaaaaattcatttctggtaatgagatgggatcgctgtctcccctctccgctatggcatctcatctactccgatcctcaccgagcataactttgactaattaatcagagtatcatccgcaaccgaaagtaaacatgaggaagagagtcttcctcccctttctctaatttgacagaaaaaaaaagaagagaaagaagcaattagtcactaacagaatttgagcatcagtcttgtcgatcgatcagcattatctgctggtgtcgccgccgggcgccggtgatggtgacgatgaggaggaatactcccatggcgtcatgtccatggggtagctgccgagcacccggaggaaggaggtgaactcctgtatctccgacagcgcgttctgcgccctgacctccgccatggacgcctggaagtcgatgtagaacatgtactcgaagtgcttggccgtgcccacgttggcgtcgtcgacgagccggatggggcggtggcggtgtgggcggctctcgatcttggtgaggctgatgtcccggaacgcgaaggccgacagcaccttgaagagcaccgacgtgccctccctgtcgtgcgcgaacacgatgctcgtcttgaatggccggtccgttcgcgggatgatgggctcccgcgccagcatcacgaaccgcgtcacgttcccggcgtcgtcctggatgccgtccgcgagcacctggagcccgtacagctcggcggcgcgggaggacgcgatggcggcggtgtcgcggagccccgcggcggcgacgtgctcggcggcggccgcggtgtcgtcgaaggcctcgcgggcgacgttgaggcccatggcgttgagggtgagctcgcactgggcgagcgcctgcgggtgggagatgacgcgggtgaggaggtccctgcggacgcccgggagcgcgaggaggcagtggtggacggggagctggacctcgccgacgatgtggaggcggtggcggaggaggaggtcgtagttgcggtggatgctgccgccgagggagttctcgacggggaggacggcgcggtcggcgatccagagctcgacggcctggaaggccacctcgaactggtcgcaggggatggcgtcgcaggaggggtaggccttcgccgccgccgcctcgctgtatgcccccgggacaccctggtaggcgacgcgcagctggctgccgtgcatgggcgcgggggagaggtcggtgatggtgagcgggcgagggaggttggagacggggagcagatccaggtcgagcggcggcgcggcgtggtcggcgagggcgggcttgatgctactgttgctgtcgccgttcacccgcgggactcggcggatggcggcgcaggtggcgtgccagtgggcgcgggagaaaggggtggcgcacggcgggcggacggccgtggatctggggatgtgggcggggcgcagcgcgggcgaggtttccatcctccggcggtctccggaggcgaggcgggcgcggcgaggggttggtggcgggaaagggccgcgtcgcgcggcgaggcgcggcgaggggtagtgtaagtgaaagctaagcaaaagaagaaaggttgcggtgggaggagacgagacgccgcggcgccggcgtgagaagagaatgaggtgttcccggtggttgggtaggtgggcactaaactatgaactatcccattcccaacgatgaagatgatgacgttgcatcttttactagtcttgctacacgccacggagattttttatgtttttccagtttactttcagtggtacaccgaccaaagtcaaatttgtttttgcaagtgcaatcctacgtttcttttctttcctctttcacagtttcaacacacacaaaatatagtacagatgtacacaaatcacctcttgtaactacaaccttctcttttcgtcttaaaaaaaataaattaacctatattgaaatgagacgtaccataaaacaataaatttggatagttctccctttagatttgtctttagatttggtgtcctacattttattctatctaaatctaggttgtgttttctttttacggatgaagtactactcacttagaacctaatcctttaaaatatctcaatttacatcagaaagatgttttggcatcgttggctcgtccattccacattaaatggaaccgaacaatcgcaacggccaaacgagcttgccattagatcacacacccttagatcatgtataataaatttccattagatcacacacctttagagagaacagccggtgtgatctccattggcctccggcgtcatggtatcaagggccagctaccgacgcgataggaggaggtacagctagcggtggtgagtggcatgaaactataataataataataaaaagaaaatcctacaacctacatgaaactaatttttttcctcttcctctccttaatcctagaaattaatcattttaaattgctaactaagatgctacatggcaccacatcatctcagaaaacatcttagtttgacatcaaggatcaaaattaacgactttaagagttggggaaaaaataaatggtttcataatcaacggaccaaagttggactagagctatagtcaattaagggttcttatatatgatacgcagtactcccttcgtctctaaatataagtgaagagaggataaaacaaacggcagagctgctgcctctgtcttttcccagcaataaaaaaactctctaagaacacaaaagctctgaattctatgatgctattaacttttcataaacgtttgatcatttattttattaaaaaaatatataaatataaaaaatatatttaaataaaactttaatgataaattaaatctcagtaaaattaataataactatataagtatattttgaataacagaatgatcaaccggagatttctgaatccgtcgtacggttccggagatgtaaaaaacaagcacttttttccaaaccaacgtgaatattacagtcgccgccattgcctcagctctttgcaggttcactcaccgccctcaatgcggtcagtattcaccagctagactggtagggaaaaagaaagatcaaactagctagcaagacatagttcctttctttttcaacaaaatctatgttaattgatattcaacacggatgtcagctacaaataaacaacaggaatcttggtgaattttacatgttcaaatagcacaacaacgctcttggttctacaacgatgcaactgctaggcaaaatatttggatttaatacacgtaaggaaagatcctccaaggca

SEQ ID NO: 80785 - DNA, 2206 bp, Oryza sativa
  unsure (1)..(2206): unsure at all n locations
ttattgctgatattaatcagagtttccaacgggaggagagatttgtttttgtttcaaaagctaactgcagatcttatgattgagtaccaggtcgaaagtgtgagtttgccctttattatcctctcttttcccccgttcttgccttttactttttgaaaggttcatcgatagcaattttatttgtcttgtcaatttagtacgatcatgtacctgttgcagcctttgaaatataaaactccatcatctgtattaaattcaaaaaggagaggcaacttaagaaatccattattattgggatgtctagttttgtgagaacatatgggggaaaacgacagttaaagatttttctctgatctttcaaaattggattatatggatttttgtttgtccagaagagggggagaaatctaaaaaagaggattattcaacgaggaattcgtcaaaaattgcagttctgtcctgtcgactggatctttctgtgtggttctgagcctattgctttttcaacaaaacagataacttttcaatggtcaaacgtttctgattcctttaatcttaaacaaatcagaggaaataaatgccagattattattcaaatcaggtaagattattattcacgcaaaggtctggcttccaccgtgccaaacttcttttttgacaaaacaaaagagccaaaaaagttactatattagtttgtttacagtaagtggttcatacttcatactacatttatattacccatttttctctaattcacttacgcgctaaaaacagttctctcttttagtttgtaataatgtagtgtttatttccacacacaaacaccaaaatcgaccctcgntctattgagaatccgcgagtacaatttgctttcttgcaccaaattttgtcaattttgggtacacatttttgtcaattttgagccttcactaaatacaaattcgactagtggatttttttccaaccgattattcctttgaatgattatgcctaatgggcatttatcctcccctctctgcagaaggaaaagggaacaagaggaagagagcatcttagcagcaaaagtagatgcccattaggccattagcatatcatttcatgatgaccctttcagagaaaaaaaaattacacaattgatcaaacttttacagctttgacactgccagcacatccacctagctagattaagttcagacatctccatctttttctttccctctctctttgtgccactctatatcagaagatggacagagattcagatcaagaactgcatcaacctgtgcagcttttacacagtgtgcatgatgaattcagctccagggttccagcataatggtcatctcatggctaaagcaaagaatcccatctactactgttcaactgtagctcccatgctgcatgtgccagccttcgttaattttacctgaattccatgagctacccgtgccacaatctctcaactcggcttcctatctaacctgccctagttggcttctactagtctacaagataccatatcatatagccctactttgttaaatttcattaggatttttcagacttacgtggaagatagatacttactacaaagacaatggaatggatcaccatgagttagaagtcaaaatcctgaggcaatgagacctgaaaaattcagacattaggtattttctcccccttttacaccccatccctcgaaagcgacccatatttgcttgaggaagaagagatatgcacacaacaaaattggcacggattaatcttacaattgttgtgacaatagcattcatgttatgtagggaactaaaaataaataaacactagctaagctaaaacagtgaacccaccgaatcaatctttttcggaggaatgtcactttttgaacggtccagatcgagaaatcctgatcgtttcctcaagagttatatgatcattctctacaattggcatgcctctaaaatcagtaacaagaaacaaatcatgatttgaaaaatatcagtttatgtcaaaaatgtttttatttgaatttgatagacgaggatttgaacccgggtagttgggttgtgcttgtgcaccgctcccctctgacccggagtgctccgtgcactcgatcttgctcgtccgcaccctcctcctcctcacgtgcaggcgcgacgcggcccacgacacgacgcgcctgtacagcgtcccggcgaggccgtgc

SEQ ID NO: 80786 - DNA, 16387 bp, Oryza sativa
gccaccgccatcgccgccgcacacaagcctggccacgtagacgttgccatggctgcccttcccgacgaggttcttggctgcgaatccccccgtcgccgcctccacctcctcgaacgagaactccctcatggccgccgccgccgccgccgccgccggcgagcaagctctactctacacctcgatctcctcttggtgcaatgcaaatggtgtggtgcaatggcgaaatggaaggaggagagaagagcttggagcttaggagaaatggagagcaatgtaaagcagcagcagcagcaagtaggcaaaggaataaagagcaaaaaaggaggaggccaagaagaaaggcaaatgcatggatggatcatcaaaggtaaagttggtggctgcaattttcagagagagaaaggtaaaagaaactccaaactctagctagagagagagagttaaagaagaaactccaaattctagagagagaaaggtaggcagataaaatttaaaaaaaaagaaatttggataggtatatatagagagagaaacaaagaggtagtagtactagtagtatatagtattatgattatgtttttgcttggtctcctaaaagaagaaaatttgtcttctcaaggagaaagaaaggtactgtagaaaaacaaagttaaatcaacagaagcaaaaaatggcttacctgctgtctctttctttcttcctcaatctctattagtattatataattataattactgttgtttatactcttaagcagagaaaaaggcggcatatgcacacacacggtgcattggggttcggatcgatcgttggagtggttggagagagagagagagagagagagagagagagagagagagatgcaagatactcacggcaagcgaacaaatcggcaacagagaatgtcgatttgtcaggaggggaatgtggagtggtggactggttggggctggggtttcatccgttcctgtggacgcgtccgtcgtccttgcctgcttggacgccaacacctggccggactggggtaggattagttcttttttttttttcgttcggtagtactagttcccaactcatcctccccattttctacgcgcacgcttttcaaactgctaaattgtgtgttttttgcaaaaaatttctatacgaaagatgcttaaaaaatcatattaatttattttttttaaaaaaaatagctaaaacttaattaatcacgcactaaaacgttgcttcgttttatgtgccaaggagtgagggttgccccgaacagagttgtgtacaatgtggttgctgtgatatgctgggttttcaatagtggaaatttaaaatgagacttaataaattgtcacaaaatttctttaaaaagtttaaatataactacggtatatttatagcgtaattatactgtagctataatgtagttacaattaatcccttcacatgcgtagatccctcatgcacaaatctcgatacgatttgatggttacaattctttttttttttgggagggggattgggggaaaatcgtcgttttctttagcaattctcatataaatttgggctacaaagattgtaatgtgaaggtatttgcctatttgagataatgatagagaccaacggcaaatctctacccttgttgagttctatcgaaagttactgcaacaaaatatgtgggtaacattcgtggccacaagcattttgatcctcgtggatgaaatcatgccccttgaacataagctacgggtatatggtagcagtgttgtaattggtttcagagcatgcatgtgtgtgtgaaggttaaaaaaagaagtaaaagtcaatttatatgagaaacaaggccgatgtatcgctcttttgtttccaaagacatgttattaaatttaaaacttgcttgagaattcaaggcaacattttagatttagttttgggccaactacaaaaatgtaaatgtaaagagtataaggatttcattcatgttgtatgctgacagttggagacaacaattatgtacattttcatcaattttggatgaagatttagcaataggattactatttgaaaataaattgtacatccaaccttattgttggtgccttttttatataacgtggcgtctctttattttttgctagataatattatattttggttttaagctaagaatctcttctttatataaagctaatgctcactaaatatctaaagctcaacatgccagcatagtatttattagaactcctaaaacctacatgcaagcatattacatcaacccattaagcacacaaagctcgaatgcaaacatatactccctctgttttaggttataagacgttttgattttggttaaagttaaactgctttaaatttaaccaaatttaaccaagtatgtagaaaaaagtaataacattttcaaccaagacaaatttattatgaaaatatatttaattattgatttgattaaactaatttagtattataaatattaatatatttgcctataaacttagtcaaacttgaaacaatttgactttgaccaaagtgacaatgtcttataatctgaaacagagaaaatagtaattataattacaatttatttcattctgaaactaagtatacacatactaaatcatcattctcaaatcattttcataatatttcattctaaatcatttcatcatttctccaatatctaacatatattccgcagcaaagcgcgaagcatcatctagttttataataaatggctgtagtttctattaaagtgaaggactagatcgattcaatctattataaaagaaacttgcttgagaattgttttgtcgccataattagtctcttgctcctgcatatataccccctatctatgttcttggctttcatgctgtcatgcaccatgcatgtcggtgctctcatttgttcgtcgtcaaatcatcaaaccggttgaacatctcgatcatggcggcagtcgcgttgaagacgaccggccaaaagtttctctcctgccattgattttaattttcatcaccagcaagcaagaattaatgaaccctagctaataacacgcgtgcagaatatatatattgaccattaacgaatgagactatccattttagtggcccctgccatggcggcaaggaattacgaaatgatcaatcacctgattattatatttatcatatactacagatcatgtacctaacctaccttgaaaatagaacacttgtacatgcacttttcaccagatgacctataggtattaatttgttagtatagtatacagtatacaatgtgctacttaaactaagttgccagattaaactaattaaataccggtcgccggagaacgctgacacgagcaactcaaattattccgcggcatgtcttattgcgtgatgcgtagcagtacgtacagctggatatggatatgtacagtttgcttgttcagactgacgatcgatcgactagttatttgaattgccatagtgaagaaggttgttctccatatcaaaagggttttaatttgcactcgattgtgtgatgatcaggtttaccaaaccgtgtgtggttatcatgtacggtaacctttatgtttttgaaaccacggtatatctcgttatatgcgccaaaccggagcggtaatcccatatcaaacggtttggtaaacaccgatgatgctttgccttctcttcattgcttccacactccatccatcagcgagctgtagtagcatagaggaattgaccctcgaccattcgtatagttactccaaaacgtatatacgaattcgttgatactccaaaacgcatataatttttcatttgtgggtatatatatatatatatatatatatatatatatatatatatatatatatatatatggtgtttaggaaggagggactaaactttagtcgctctcataaaaattttagtccctatgggagggacttaatatttttgtgagagggactaagtctctcttttccaaacaccaccataattactcgcattctgttgacaatcaaatttggcactcgaaaaggtgccaacacgttcaacttttaatgtgcaaaagcacaactatatatacatgtgcgtgtgcttctaatgaaaattctttacaagtgtcaagagtgtaaatgtggtgtacgtgtagtacggtgtatttttttacaatgaaaataacatctggcctctgcatcaactaataatataataatgattagtttcatgtgtccgatgaatagtttaggagaaaaaaacatttacaatttgctaataaaactgttacatgcatgtaaagagagcagcaagagaaaaaaacgagagggcgcatgtgaatatagtaggcgaatgcaacataatgtgcgtggagcgtccaattatatgtgaaatcatgtgatgattaatttttaaagatgagtgtttgttgaaaataccatgtatagtgttttcggtcggtgaacaatgcggtcggcactgggagaccactcgttagaccgggttgaccgacgatcataccgacagactctaagggcacccgcaatggttatctataggctctctacaagagatccatgtcagcatattttcctacttggaagagattaaatgaagagagagagcaaagctatctactaacctggagatagtctatagagaaatacgaggcaatggattagagagctatagatacccatgtagacataccattgaagtggtttactattaatctagtctattgctgagatgtacatgttttacagatatcaccttactttaccattacgggtgctctaagagggagtcggtttcgggttgtttcgtgtaaattatagattgcttcattatataacttttagacggttttctattcatatgtgatactattgtatgctgatatgagtcaagttggtgcgaacttgcacttggatgtagagtttctttgttgttcatgtgcatgcgttgcttgaggcaatgagagtatagccaatgatggatcgagactaagcttgggaaaagttgaagttcagacgatcaaggatatcatgcaaggatgctcaggatagagaataatgtacgtggaagtgaatgttttcatatggaaagtggagtcaaattttaattggagtccaagtttgggaagattagagtatagagttgtatggggatgttatttccctagttattttgttggggtcctatatgattaggagtcctagttctagttggattcgtggctagggacaaccatgttttgagtataaatagtacaggggttgaggctagaagtatacatctatatcaactttttgggagagaaaaaaaataggtttcgcttcgacgcttgaattctagttcgtgagtttagagatgaatgctttagatgcactttatgagatgcaataaagttgatccatcttcaagagcatctttggtgtgtttttctctgaaccccgacggtttaattaaccaacggcataggagcggtcagactagcgggaagaccgatgggtggtaggcggtctaaccgatggcatcactgcggtctaaccggcggctagggttcggcctaactagcttttatctggaagtttgactggtgcatctccattagattcgagggtaacctttatttgcactaaaagttcgatttttggtgttcctaccattcactctttctctagtagacttgattacttgtgtttaatcatacattatactcttcctaggtaagggcatgctcgatctgaagcattctccatataatttttgtgcatcttaattagtgcagagggaccagaacgatacatacttccattaccttaaaagatatccgctgttagctagcttgtccagcggtacactggacagtacacacatccattgtgtttgatgtactcctaatttgtacagagaccgaaagtgatacttggaggtacttccattatcaaaaaatatatatcattgttagcttgcttgaccagggggcatgcacaaagctcggggctcgcaagcctgctcgagcacgactcattttataggctcgagctctagacgagccaagcctaaatgtgccaattctcgtgagctttgttgagtcgagctagagcttatgtcgagcctaattaacagtacataatatttttttattatttattttttaaactagtagatcaaataccatttatataaatgtatccatgcaatgaaataggttgttttggtgttgtatatttatcttatttctttttctcctcattcattaatatgattaaataaaagttagttatttttattgatagaatatgtagcactacttatgacctaaactcaattgtcgagttttagcatgtctagaagctcgaacggttacacagactcagctcgaacttttgtctagctcaagcctagagagatgagctagttcgagtttaagcaggtgagctcgatcgttcgagctcggcttattgatagccctagctctcacattgatttttttataaaagaaatggatgatgagcactccctctcctagacctaaggtgtggcacactggcaatggggttatcatcattaggccaagctagtgtgtgtcgttgctgcccggttacgagtcgacggggccaatgattctgtcttccactgtacgccgcgcgctacgctagctaaccttacctttggagcgcacgcgaccgagaggattgcacgccactagcggtcatcgagagatggagaggaaaaatattccttgcatttggcgcgcgcgtgtttgttgcgtatagcatgcagtgcgtcgttgtcatggaccgcgagcatacgaggggagtgcgtctacgtctacgacgcgtgcgggggtagctgccaaattagacaagccaacataataattagccaaacaaaacaaattaggccgtgtttagttgcaaagttttttttttcaaacttccaactttttcatcacattaaaactttcttacacacaaactttcaacttttctgtcacatcgtttcaatttcttttaattttagtgtgaactaaacacagcctcagtgtgagtgtgtgttccggtgtttttgtttagtcttgtcttgctccgtcaggcaagctagctgaggtttatttatagggcaagcggattagctagcgtgcgagagatttgtcagtcaggtatccgctggtcgatctcgtgggcatcatcgtcagtggttagttgcagcaatgctggtgatgtgatcacacacgctatatatatatatatatatgtgtgtgtgtatgtatgtccgggttgtttgttttgttttgctgtgtgaatacgtacgtacgtgtctgtacgctttgttgtttaattcaattttatttgatctttccattttcttaaaaaaattaattgttttgatgaacgtgatggttaatgaatcgaccactcaatttaccacacctatccctcaaacttacaaaatgcagaaaaaaaatcacagcatgatcatgatctcacgttgaatcaattaattttcagttcctcgaaattagtagtatttgaatttacatatctataaagtgatatatcacatattaatctatcttgttaaaaaatttaatagctatttagatgacattaaaaaagacgagaggttatacatatcctctcaagattttattatcatttcccgattttcatggtgtgcagctgcatagtatgtttgacattatctatcttacatgcggaaaaacatgggatcatacagagtgtaatactagtactactatagtattattttctccgtttcacaatgtaagtcattctattattttacacattcataataatatgaatgtgtaaaatgctagaatgacttacattgtgaaacagagggagtagcatatatatgtactgtatgaaacaagatcaatcatgctatgtcatttgatattcaggtgagttattatccaagactttggcttcgatcagttgacagggttcttgccgagattgaaggtgatatatatcagatccgatgtatgcgatcggagatggtgatgtggatcatagatagagataaattagtacgggagaaaaaaactattcactattattgttcacttgttcagcctgttcattggttgacttcattcacacagccttcgctggcacgctttaattttcttctcttcttctttttcccgtttgcaagcttgggcttggcaggctggacttgggccaagaatctcgtaaccctgacaaaacacaaatggaagttcactttaggtaccttaatttgtcgcctgagtctgaaattcgtccctaaaccgaaataataggtgtagcacatcccccaactcacaatactgtgttaattttggtcctggcagtatggtggccggttttggctgacgtgacggctgagtcaatcatgaaacccaaatgtcaggacgccttacctaaataaaaaataaacaaaaacttgtggaccctacctttaagtgacaatctcctttctctatatgtatctctcaaccttttcttggcgacataggtgggagcaggggggcggcgcgccgactgggcattggtggcacggtggaaccacaaggcgcaactggcggtgtggaggagggcgtcggtagtgtgggagaggacgacgggcggcaagaaaggagcagggtggcagcgagcagtaggagaggagggcatcagcggcgtaagagagggagacgggcgacaagagaggagctgagcggcggcaggcgatgagagaagagatgggcggtggcggcgaccgatggaagagggcgacagacgacaagagaggagttgagtggctgtggcaagagaggagcagggtgcgggggagagaagcagtcgttggaaaattgttgttgacatcgccttctcaggggtcttctccggatggcggtagaaagacgctgccggtgccagtgcgatggcaggggagagaagcagttgtcggtcctcatccatgccgccgccaactttgccgcgacccatcgatcctcctcaagccttgccgccaccgccgccacctccactatgacagagagagaccccttcccatcgccttctcatcctatgctagagcggccgccaccactgtagtgccacccgtggcccctcctcctcatccttttcattgtcagtgggggctaagcgcacccttggggagtggtggggcggtggagaaggtgctaccttaacgctgctgtcatcattgacgatttgacatcacgctctgcagagttcgccccctccactcaatttccacggtgacagcattcaggcattggttggctaggacaaaggaagagagagaaagagagcggggaaggaagagaggggggaggggaagatgttgtttcaccgacattggggcctacaaaggttttttattttttttgtttttgctactatgccgcattagcgccacatcaaccgaaaccgtcatctaaatcacgttgggatcttatttgcactagttttaggagttgagggacatttcatattctgcggtgcaggaacgaatttcagactcggggacaaatggagggaccaaaatgaacttattaattacagattgacaaaacacaagatttgcctgtatctttcggaatacactgcgcaggattgggaattccagagaagttttagagaaaaggttgcttgttgtgcgacgcctcgaatcattcttctccctcgcctccaagccatcttaccatctcgacaactccgatccagggaaaagtgaatttcgtgaacaaatagcccaagatgttagtacaaccggaagcccagtatcgaagaaacttacgttgtatgggccaacatttcaagaaatataaacatataaattacaaattttgtcagtaaaatttggagggtcaaactttggtctcatgcaaaattttcacatcgtacactccttgacaaaaagaagaagaagaagacacccatatgaattctacgagaaaacaaattcgcataaattttaagatgtgtcagctcagtcttttggagatgtttttagatgtacgtagagaaaaaagtgagtgtgctttttagaaaaaaaattcgcggaaatttccttcacaaaattttgtcgaaaattcatcgaaaaaataatataaaatgattcgctgcaacttccatcttattctatgagaaaccgacttgatctaagccatgtgaatgcgatggcacattcatccggccccacatgtcagcgagccctagaagcgtccccccaacttcccatgcgtgtcccctcgtcttctcttctcctctctttcttccgcgccccgctccgttcgattcgattcgatttccgcccaaaatttcccaaattcccctccgattcgccgaaagcccaaccgcctctctctctctctctctctctctctctctctccattctctctcgccgccgcgccgcgccgcgccgctcgccgaccggatcccatccatggcgtccccctccctcgccgccgccgcggcctccccgctgacgtccctcgaccttgccaccagccccgccaccgcctcccgccccgccgccgccgccgcgtccgcgctccgcaagcgcccggtcctcctgctcgaccagcgccaccacccctccaccccgaatctcgactcctccgccgccgcggctgcggctgcggcggcggcgggggtggcgcaggcgcagccgccgcccccgcgacgcaagaaggcgggacacacgtcgtcgtcgacgcggccgaggtggcagaccgcgctcagcgtcgccgccaagaacgcggtgctcctcgccgtgctgctctacgtcggcgacctcgcctggcgcgcggcgcgcccggccccgccgcggccggtcgaccaggccgcgatggccggttacgacgcccgcgtcgcggacgtcgaggcgtccctcgcccgcgccttccggatgctgcaggtgcagctcgaggccgtcgaccgcaagatcgacggcgaggtcggcgccgtccgcggggagctcgccgcgctgctggaggagaagaggctggagctcgagggccagctcaagcgcctcgacgccagggccgacgacctgagcgacgcgctcggcgcgctcaagcggatggagttcctcaggaaggacgagttcgacaagttctggaacgaggtgaaagagagcctgggttcgggccccggcaccgaggttgacctcgatcaagttcgtgcattggccagagagatcaccatgggggagattgagaagcacgcggctgatgggattggtagggtagactacgctgtggcatcggctggggggaaagtcgtccgccattcggatgcttatgatgctgggaaacgtggtggtttcttttcttcattgcttagtggagatactgctgctagcccaaaaaagatccttcagccaagctttggagagcccgggcagtgctttccactgcaggggagcagcgggtttgtggagatcaagctgcggaaggggattgtccctgatgcaattacacttgaacatgtttcaaaggtaactttcttggtgattcgtttacggaattatatcatatttgcttccttgcgccttggttaattacttctctagcgcacaataaaattctgtgactatgtctgtctaaaaccaaatcatgtttgacctgaagggatgaccgatgagtagaggtgtgtcatttgttgggtaggtcttatgcataagcttgtagcattttagttcatagtagttagtgggggtgacaacaattttaagcaagacccttctttagcaaaccattatagagaatcacttacttttgtatcgctactagcattattgagcttgtatgttttgtctgcaactaattataattctatatgacatttgtttgtagttaccgaatcatcttaagcattacgtagtgtacccaccaaataggactcatatgacaacaatactgctgcttctatgaattctctctttgctgtatgttcagtggtaattggaaagacacacttttaactttaacttctatgtgatatgaagctgaatgcattctgatcccgcttgtgttatatgtctctctttttaatggtcaatggtaggcttcagttgctcatgaacaagcaatcttttttactaccttttgaatattattttagaacataaccttccgaattgtgagtcgacttttttctaatttggttgtaaaacattacaatacatctgatgattaagcaactgcaaagaaactcatatcttcccttgaattgctaagatggttgatcacttcttgtcatatgccggacttaaacctatgatgctgtcttttatttttcctgtttaatattttatgggcatcatttactttaattttttggttatctcaagttataacctgtagtttattattggaagcctgataacttgataagttataaccttgtaccgcctatttttatgtttgcgtagaacatgctccaattgaagtctcgttatacagttctgcagaatggatttcttactaaatacttgattttgcacactgagaggttttcctgtcacaaaaactattctcagatatttactgattaacttctgtcacatgacatgcaggatgtagcatatgatatgtcgactgcgccaaaggactgccgggtttctgggtggtatcaagaggcacataatgaggcgtattcaggtcatgctgcaagcgcaaagatgtatgtcttgactgaattcacatatgatctagacaagaagaatgtccagacattcgacattacagcaccagatgttggtatcatcaacatggtccgactggacttcacttcaaaccatggaagctccgcgctaacctgcattttccgcatccgggtccatggtcatgagccggtctcaccaggaatgtcagtttctcagtcctgatatgggaaaatgctttggttctgtctcttgttagtgttttggtttagggatctccttgtgcccttgctagttttcagcgtaggatgttatcatgtacactctgtaaaggtaatgattgttttgctgcaatcgtctagcccaatgacatcttttagatactaagagttagacattatgtttgttccatcaatggatggcaattgtggttagtaagatttatttgcgtatctgttgatggttgtttgggcttgatcattttgaaggtaaaacaaccaaagatttcttgcaattctacctggaattcttgtccactttcaaattgggaactgcctgatgctgggattgagtgaaatcatcctcaaatgttcttgttaacatgttcaccgaatctttgtctcacctctgagcttggaggggagtgaatcatctagttgggtgtagttaatagccgcattgttttcacagtccagtgttctcaaatctgaaatcgagacctgagatcgtaattttcatattccaataaatattaattactgtatttggtgatgatgtttgataatatttgattctattttcgcatccgggatttcttattttgattccaattccagaaaaatacatatataaacgaaaacagtaggctgtagtgcagtaggagtagtttccgtcctttttcgagctgttttcgcctctacttgcaaggatttgcagatgctgttgtttaaggtgccgtggaatggatttgccgacacaagggcgataccatacttttacttggaaccatttgaaatatttgacatcgaaaatcttctaaacaaggcttatatcttgtaagagaaaaatgatgggttctagtggtgatcggaaaactagcactttcaatcgcatatctcttctcttctctactacttaaaaaatacaaaaaatttacttcgtccgtcaaaacaaaaaaatagcaaaaaaaataaaataaaataaaagtccgactcccctaagatccaatccccccttaaaaacaaaaaaaaaagtccaactcccctgcataactgccctccggcatgaaaaacggagcgatccattagcacgtgattaattaagtactccctccgttttataatgtaagtcattctaacatttcccacattcatattgatgttaatgaatctatacatatatatctatttagattcaataacatcaaccctaacatcaaaacattgtgaaacggaggaagtatttgctatttttttttcaaaatggatccatatgattttcgtatataagctttttgcaaaaaaaagaagcgtttagtagtttaaaaagcgtgcgctacttaaaaaattgaaaaagtttccttcgtccgtcaaaacaaaaaaaagcgaaaaaaataacaaaaaaaagttcgactagatccgataccccttaaaaatggaaaaaaaaagttcgactcccctgcattcgtttccctaggctggccctccggcatagaaaacggaacgatctattagcgcgtgataaattaagcatttgctaattttttttttcaaaaatggatcaatacgatttttaagcaacttttgtatataaactttttgcaaaaacaaacaaaccatttagcagtttaaaaaacgtgcgcgtgaaaaacaagggagaggggtcgggaacaagcgaaaacgaacgcatcctaagtagatccgattcccccgtttagtagtttaaaaagtgtgcactacttaaaaaattgaagatgtttttgccggtactttggtaagtcatccgtgtatgagtcggtttttaagttcgattgcttttggaaatacatattgtatttaagtcggtttttaagtttgttcgcttttggaaacatagaaagagtcgtataagaattctcttttaaaaaaactcgcatggtaacttaagacgatcggacttctaattatagctcatgaatttctaataaaatatatatccaagtgaattcctacagtgaatttcaccttaactagaccgtataacaacaataaaattaaaatagcattcacccattgcaacgcacgggcatttttttctagtaaatataaaaattgaagatgtttttgacggtattttggtacgtcatccgtgtatgagtcggtttgtaagttcgtttgcttttagaaatacatattcatgtttaagtcggtttttaagatcgttcgcttttgataatacggaaggaataatataagaaatctgtttaaaaaaactcgcatgctaacttgagataatcggattcctaactacatctcattattttctaaaaaaatatatatccaagcgaactcctatagtgaattttatcttaactaaaccatataagattaaaatagatttcacccgttgcaactcacatgcatttttctataataaaataataaaaagaaaatcagaagctttatatttaaaaagtaaaaaaagagagaaaaaactaagaaaatagtcaatgacaaatacactcctttgtttctctccttccattgggagaaatttcagtatttaccatccaatacgatgacctttaaggagctgccacacaatacgctggcctttcaaaatttaccaccaggcacgcgaaattcttcatttggagccactccgtccgcctgcctcgccgtccatccgcgcgactgtctccgagctaggtggcgtcgtcgcccaggcacggtcgtcgtcacctcgcatcccgcccccgccgccgtccccatccccaagctcgttcagcaccgtcgccaccgccgtccccaacctccatcgccaccattcccatccccaagctcgttcagcgttgttgccatgctcgcgccccatcgccgccgtccctgagctcgtctgccactgtcgtcgagctcgcattccgttccgccattgctgccatgcccgagctcgcgtccggtcgccgccgtagtcacccccaagctcgcgttccgctgccgccgccgtcgccccagagctcacgttccgctgtcgccgccgtcacccccgagctttccgctgtcgccgccatgcccaagctctcatccgatcattgtcgccgtcgcccctgagttcgtgttctgctgttgaaccgccatgcccgcaaactccgtccccgtctaccatctagatgtcgacaaaaccatgtgctcctccgtccctatcgaaggtgcaacgtccctcgccggcaaccgcggccggagttagctcagggatgatggtcaagccttgagacgacggccgacaagctcggagacgaagacaaagacggacgacgcggacaagcagacgaaatggcaggaaatgaagaatttcgcgtgtctagtgatagatcttgaaaagccaacgtattgagtggcaatttcttaaaggtcatcgtattggatggttaatactgaaatttctcttccatcggtcccctccttttcctctccgtttccggcttccggc

SEQ ID NO: 80787 - DNA, 5709 bp, Oryza sativa
cccccccccccccccccccccccaacacacacacacacagcgcctcgcgcgcgcttttccgccgccggcgacctcgccggagccgcgcgggttctgtgtacgcccaccccctccctccgtctcccaccccccgccctagccatcttcccttgcgcggcgggcaacctcgcgcgcgcacggccagcagcgagcgagcaggtttggggggggagaggcgacgcggccgcgacctcgttccaccgcgccggcctccgtcttggctttgttcgaatcgaatcgaaggtatccgttcttctctctcgtagccctcctcctcctcctcgccacctcttgagccgggcgtgccgtagtggccgaggtggagatccaatacgaacttgatttcgtttcctccaattaacccttatccatttgtaatccatttgtttgaggatttctttgatgtgtagtgcggcgctcgcagcaatttcctccaattaaccgatgtattgtcatcaccaatgaacaaacacgctaggaaatttgatatacttttggaatgcttgtgttggttcttgcactagacctgacctatgccatgcggtatatctttattttgttgaagctgtgatgctttttgtatctgaacaaatcttccttctgcgtcgcagagatggccggaaaagggagctacgttccgcctcagtacattccattatatggcctggatactgaggaggatcgcgtttctgcggaggagaatgatgccgcgcgccacaagttaacccgggatcctacacaatggtcttcaggcatctgtgcttgttttgatgatccacagagctgtatgctactctctgacctgtgactccttgatttcagaaggaaagataaaaggtgctatttggttgcatgttaggatatggataagaaaataagcattgaacatagtttcctagttagtgttatcgctatgttattattgggtttatcattccacgaagcatgtcatgtgtgaagcactgaagccgtgaaggataagttggttgggtatgacatccaatattttgtactgtcaatttgccaaactggtatttatgccaatggaggcctgaaatgcaaagtagccaaccacctaatagttctgcttcattatacttaagtcttgagtggccattacagtattggtttaatttttagcacattcagggatattgcaagaagtataattaatccaataagcaagttttatcagcattctgatttctgaaaaggtcccttcactttgaagaaaacagaactatattcttatagcctcaaatttcctgatgatttttgtaggttttattggtgcaacttgtccttgcttcctttttggaaggaatgcacagttcttgggatctggaactcttgctggatcatgcactacacattgcatgctttggggccttctcacaagtctctgctgtgtgtttactgggggccttgtattggcagttccaggatctgctgttgcttgttatgcttgtggatatcgacaagcactaagagcaaaatacaatcttccggtacgagcttgaaacttactcttttctggtctttgacatttctcggatgttactggttacatgttttagatttagtagtcaatagaggcagttttttcacgacatattgatataaatggatgatatttccttactgcacaatttaatcaatagtgggatttatggtgaaaattcttcatagttgaactttagttgaaactgaaatctaccttacatatatgtaaggactgcatataaggcaatccttccactgttgctattagtctagcaatttgagctctgccatggtgtcttgcctaccaaagtatgtttcttttgcaagcagtacagtagtaagtgaatagaatctttaactgtcaattgaaacatgcatttggttgctggtttcagtgtcttgtgtgtaatttgattcagctacaaaggtcatgaccaaattgttaatctcaataggagccaatctaggcttccacatgactatgatttcttgatgtgttgtcgatgcattgttcataaatctacagtaaaacatagtaaatttatattttagttgcatgtatctggaactggatgctttgaaagcttacaagagcaagagctgggataaagggatctgtatgcaactggctatatttgataggatactggagtacatcactagggctgtatggttgttgagtcatggcaaatctagtttactgattctaacatgttcatttcaaatatattttcttttgcaggaagcaccatgtggcgatttaacaacgcacttattctgtcacctgtgtgctatatgtcaagagtacagggagatccgcgagaggacagacagcggctcctccgctccgaccgtcacgccacctgcaatacagacaatggatgagccttgaatggaaatatgaaatattgatgaacgcctctctatctgaattctgacgaatctttggttgttgctgcttgcgagtgtttgttatatcttctttgattgtgcttccacgggtactactacgaggctggttccgtagagttgttgtaaagatgatttttcgacaaatgagcaaatcacagtttgcaggtgtagctgtgtcattgaactgtagcacgattgttacatgtaacatttatcttttcacatattggaatatgatggcaaaggtaaagaacacacttgttgtccattgcctcagtttctttctcatattctgaggcttgtaatgtcttaatataatgatccgtagtctcctaatggctaatgttaaaccaacctgaggcccctgtggaacaaaagttcatattgtcttccgttttgaattatttccttagtgtgaaatccattcgtccaacaagggctaaaaactgaattgtacagatcatttgaaccatctatcgaatttaccaaatcactgattacaaacaaatagtacaaagtttgcatgagagttacaaactgaaattatttcggcaaatacagattcacaaatcacaactgggcaaataattttgttcctaaatcccttatttattcagcgagaggattgaccacatgcccaagaaacagtacggcgccggtgagctcctcgacgacggcgaacaagaacggccggtcggcgacgaagtccaccggcggcagtgagctccccttttgcatcataaccacggcggtggaggcggcggccacggtgccgagctcgtccacctcgatggtggcctgatgatacacttcggcgatgaagagaccgtccccgccggtcaccatgccggagaagtcgccgccggcgaaagctcgggtcacgcccagcttccgcatgtcggacttcgcctcgaacttgaacgagaacttgaacttggggaccatgagccgcctcaccggagcctccgccgccggcgtgtgcttcttgatgaactccggcgtggtcacggccatatcgtagagatcggcgagcttgagcgcgccgtcgccgtcggggaggagcaggagcatgtagaatgcggctcggggcacgccgtcgccaccgccgccgccgccgacgttcttgtaggggagcttgagcgccgtgaagccggggaaggcggcgacgtggcgctcgaaggggatctccgtcgtcatgaacggcgcgcgcacggcgccgccgtcgaggaggtggaacggcgcgtggaaggtcgccgacgggtggaacggcagcgaccacgtccccttgaagtggaccgcgttggcgaggacgaccaccgtggaggagtcgacggagttgggagggaggacgtcgcggatgagcccctccgtcgcgtcggacacgaaggcgttgactcgctcccgcgcctgctcgggctgggtggcgaagtcggcgggctcggcgacggcggcgtagcgcgacgcggcggcgtccgcgaactccggcgtgagcgcgcggccgcggtccacccacacgccgcaggcgaaggacgtgttcggcaggtggcggagcctcgcgacgagccgcgtcgtcggcgagcggtgaagctcggcgagcgacggcgagccgaggaagcccaggagctcgcgctgcgtctcgccccgcgcgccgtcggccaccagcgcgagcgccgcgtggaaggacagcggcgagacgatgaagttgcgcccctggccgccgcctgccgccgccgccctgcggccgacctccctcgcgagcggcaggcacgacaccttcgcctcctccgccatcgcaggaggagccatgacgtcgctccgcacaccaccatcgcctcccgtcgctcgaccagagaacggctcaccggcggcgagcgccgccatgggcacgcggtcccaggaggagaaaggacgaggaggaggcggtggcgcaaactctggcgcgtcgtggcgctgcaccacatgctcgtcccggttcgcccatgggtgcggcgccgcgaacgcgagcccgagccaaggccggccgccggaacggaagctcaggacctgaccggcgccctgctcgccgctgccgacgaggaggctcgccgcgcctgcgcgtgcggctccggcctccgcgccacggtaagggtggtggcgccggtcgtggccgtcacggcggtgagctgcggcgtcgtggcccatgagaaggcggcgatggaagtgaaacaagctttaagggaaactgttttaaacacttgggtagatgtccactcgtttcttgtatgtcatctaaatggttataaaaaattttcaaaaaaactaacatgataggttaatatgtaatatatcacttcacaaatatgcaaattcaaattcgacttctacaaattataacaaaaataataaatttgactgtgaatatacgtacactagttagagttttatttgttatttttgttacaacatgtagaaatcgaatttgaacttgtatatttgcaaagtgatatattacatattaatctatcttatatttttttaaaaaaattagtggtttcgtgagctagtgaacaaagcttggctctcaagtcaacgaccaggtcacgctttgacttggagagagttgactacaagttgactagctacgcgcagttgcttggaatcgcgactacaagattcatctacaggaagcacatgagctataaaagtgatactcgagctacaaaggcttaaattttgatttccacaacattacacgtccatctgtttgttcagacatctccttttaagttggctctttttgagacggagggaataagtgaatacatttttaatgacaacctgtgaagtagaagctcaccattaacttttgtttcttttggtccctccgtacttataaagaaagtcgtttaggacaatgtttaagtcaaacattggaaatataaatcatgaataactcttaagttgttaagtttaaaaatataaaaattatatgaatagatttgtcttgaaaaatattttcataaaagtatacatatatcactttttaataaatatttttatagaaacaagaagttaaagttgtgttttggagaccgtgtcgctgtcctaaacgactttctttatgagtacggagggagtacttcacgagactcgaatgattgacaacgtctatagcaattaatcggagtactgatagttaattaactatgtacacttttcatcctataatataaagcataattaaagttgacaatcttttaaaactaatttttaatt

SEQ ID NO: 80788 - DNA, 9566 bp, Oryza sativa
aggcggggcgatcctgctctacaaggccatcgcccgccgcatcttcccgcgcgagtcgagctaggagtacctcttcctctccgacgagcactacgcctaccgtgtctgcaactggctccggcgcaaggggctcatgccgctgctcaaggtcctcgagctcccggaggtgtacatgaccacgggcaaatgggagcagatgccctacacgcgcgtggtgtccgtggcgatgcggcagtacaagactacaagggggcgttcgagaagcacgacaagtcgggcgtcgccgaattcctagacgaggtgcgcaccgggaacgcgcgggtgcatgtcggcgcggccatgccgcacgagctggtggccgcggcactcaagcacgagcacgactaggccgcgagctccagtggcgctgggcggtggcggcgacagtgacaccaccagttcgaccgaccgtccccatcttctcgacgacggtgcacggggagaagggctgacaggctggggcgtgcgcggcagcatcaccaagcaggaagtggacaagcgacgacggcagcgatggggatgacacgacggagggggcggtggcgacggacgtcgtctgcgtgtggatttgcagcgcgatggctatcctcggtttcgccctggataggtgggcagcgagttggtggtggtggtgccgcccggactcgagttatatcgaaggtcgccgctcatctcttcccccgtcggcagccgccggcgcccacgcccgccgcacagacctgccatgcccagctgcttccccggcggccaacgtttcgatccaatccggcgagagagaaagggagaggatgttgctggggtcggcggcgcttcttttctttcttctattctcttctcttctggccgcctgcagcagatggggagaggtggccgtcgatgcctccgcgcctctcggccttgtcggcagcggcggcgttgtcctccaccgtcgttgctctccccacgaaggcctcggtggctgatgccgcggctgttgcccgccgccgctccaccgcccatcgccctttctccgcccggcctcgtgcacgtgtgtcgtcgtcatcatcgtcgggtgcggcgacgtaggtggaggcggaggctgacgctgcggctggtgcccgccgccccttctccggccaggctcgcacctgtgcgttgtcgtcatcgtcgggtgcggcggtggagctcggtcgtcgacatgccccgcctcacccacacagagaagacagagaggagtaaagagagaaaggggaaatagaggtgacgacgtgtcacctggcatgtgggtctcacgcttactcaactgccatgtcgaatgaaaccggggtaaaaaccgcccgaggaccaagagtgaacagctgccatatcgaacgaaaccagggtaaaaaccacccgaggaccaagagtgaatggtttttgtaagttggaggatgtcaaatatctagtttttgtggttagggacaattttataactcgatgataagctgaggaaccttaagtccttttaagtgtactttttccggaggaagataggacggaagaaggatgggctgggctgggctgggctgggctgggctggagaaagcatgagtcacactcacggcccggccccctctcccgtggctcgtcatcgtgctttcaccccgtgcatgagacgagctaacaacctttaattggatgtttctccggtagggaacataagacaatgaatgacttgtgcagtggtgaagatagtgataaacaaaatatatattttttaaacttcgttaaacatattatgaatgcaaaaaaaattaccattaataaatcatggtaaataatttgttgtcataaaaatatactccctccagtattttaatgtatgacaccgttgattttttcgaacaacgtttgaccattcattttatttaaaaattttatgcaaatataaaaatatttgtgccatgcttaaagaatatttgatgatagatcaagtcataataaaataaatgataattatataattttttgaataagacaaatggtcaaatgttggttaaaaagtcaacggaattaaaatatggaggtagtattaattattttcaatcattatacttgcattctaactatacgcttcttaatagtttcatgggccgattctagaatgaaaaaacgaaccccgtgctggccgggtttttgtttttgttttgcggaatgactttttactctgacagtgtgaatttgggtaaggggagcactattgcaatgaactatcctctctacgccgccgattctatagaatagaccgcaggagagtgaattatattcgcttttcagaaaattaactagctagtcaaagccgcccggtcagttgttctccatcttgtcagcctcagtcaaaaattaagatttacacattagcttttgagttaattttgatgtttttaactgtagtttgttttttagtgttgacttttagtgatcggctgtacaagtcatgtgcattgtgcaatatgtgcatcatcgcgatcttctaattaattcctgtaagggagggaggatccgagtaagtattcctatatgggggattcgggtcatatataatcagtactccacgaaacgatctactacttcacaatcagtgttgtcttggagaatggagtatctaaaagaaatactagcaggactgtacgtaggagtagtctgtactagtactccatagtgtactccgtttctttcttatagttcttcggaatctaactgctaacattgacctcttccgagtctaactgcattgaccagtgacacggcgaaaacaatcactgaccagtgatcgatacaacaatacgtttcccatctctacggtctacgcccacgtttcacatcttgtgctaatattagctccgtttctaaatatttaataccgttgattttttaagcacatatttaaccgtttatctattcaaaatattttatgacatatgtaaaactatatgtatatatataagtatatttaacaatgaattaaatgataaaaaaaattaataattacttaatttttttaataagacgaacaatcaaacatatttaaaaaagtcaacgacgtcgaatatttaagaaaacgaagggagtactagctagctttagagcaagtataatagtaggctataagctggctaaatgctgaggtgtaagagagaagagaggagaagcgagcttgacggagcgcggcgctcctcaccgggagaccgcacaggcccccctttgccggttcggccgggggctcagggtgagatctcaagctctccgtgtatgcgggaagatcgcgacctcccaaaagagcatgaaacacaagcgatgtatacaggttcaggccgctgagaagcgtaataccctactcctgtgttttggtggatctgtgtatgaaggagctacaaagtgtgagccaacctctccctcgttctaggttctgaatctggaaaagatcatcccctttctctatgggccaggtcctccttttatacttcaaggggataccacatgcacccctctctttccaaactggacttttcttctcttcataaatggacggagatttgcacggtcgtcctccgaacatcctcctgacgggacgacacacacctacctccacttctgcctgaggcgggcacgtcgtgggaaggcggctgtgtgctgacgacatgagcagtgtcagaccggtcacaaatcggtcattcttgtccaccacgcgtcggcttagcaacgtgcatgcttgcccttcttcaaacaacatcttgcttgtaatggttaggatgaagcctggcatatatcgatcggggctaacgtgtcatctctgggatgtaacacgctagctccagccggagacgagtgcctagaagctctcgtcttgacgggatggggcgaagcgtgcgtcagaccgcctgtcgccacctaacccgcgatttgaccggtctgtgactggtcacagaccggataatcgagtgcactgcactgcacttcgtgcggcgtgacacgcttaaccgaggcgcaataaatgcggttaggtgagccccgctgtgctcacctaacccatacacgtggagtagaaacgcgaggggtcggggcgcctcggccctcgggggcgaggcaagagtggtccaaccccccccctcggggagaccaagaggtgggcgcacacatcaccctcgggcccgacgtcccccgagggtgccaggccacgtgggcgatggtgtctgcctcaagcctctagtcatgatactcccggtcccatgtcaccgacagagctgtaaacttacagtcagcttggacacaataaccaagaaactctatgagagatacaagtaggcactgtattaactataaagagctaactattatatgggtaggctgagagaagactataaaaaaccttatagccaacctgttggctgtattattagccttgctcttattgcatgggctcttcctgcaccgtctccatcaccgtgaactactccttgctccgttcttcttcttcttccatttttttactttgggtagtgcaattcaaacattaagtgatgggtgtagtatatatgatcgatttaattcagtgggacgacacgtgtgtttgctttcttgcttttcgagttttcggtcaaacctagctaggagttacttcctccgttccaaaaaaaaaacaatctaagtgtggatagaacattacctagaacaacaaatctggacatcacaacgaatatggatattctgatgtccagatttgttatcctaggtggtgttctatcctcaccaatgtttttttttggacggagggagtaacccctacgtatggaattagtcttagcttttattgaggacaagaattagtctttgtgtttgaatctcctgaaaatgaagatgaagataaatattaagtgtttcacgtaaaatgaggtggtaataacatgtgattaattaagttttaattattacaaacttcaaaaatggattaatatgatattttagaacaactttcatatagaaagttttcgcacgaaacacatcgtttagcagtttaaaaagcgtgtcacgataatccaaattttatcctctcttagtaggagaaacgatcagggctacatgtcccctaaaattacttgtagcaaggtcctatttgattaaagcaatgtcagaggaattttaaggatttcattcctatgaaactatttttctagacaaccctttaaataaaggaatggacacaattaaatcctatgaaatttttatataatatgcctcatgccatataagtttaggagaaaatctaacatgaggtagaatgtcatggaaatttttctttaatgttttttatcctcctatagttctcacgtttttcccgcggtttaatcaaaatattatttctatgcttcgtaattatttattctaaacttgtatttatgttagtatcgtactttttcttattcataagtcttctcaatctcgtgtttaaagggggcctaagtagttatcgtgtatctaaattatattaccatggtaatcatgcattcatgcatgcatgatccatggctgctttattttgctttgcatctccacaatgtttgtttaatttgtgtgagatgtcatgaagaatggagctagccgaggcttgcaaatgaacatgcatgcatgcaacttttttttttaaggcatacatacatcatatagtactatatagtatagtagtaagccagcacagactgctcctactctatatatttacagcagctggatgcgacttccatattctggttgcggaagagcttttatttgcccttcacacaaacccatccttgggtgcatgccttcggcaaaattcaaaagtactagtattaacctagggcccaaacccaattacgtatgactaatactcaagctaaaattttcatgattattaatatagacctaattataaatgcttgaattttagcttttcaccaaaacttggtgagcattaataaccagcctatgccatatatctttctcgaacccttgaggagatgtatttcctacctcaaatgtgtgtgacattatattgaagatcctttgtcttttaaataatttgtacacgtgaaaggttaaaaatatatttacatgtaattatttttcattaaaaaaatctaattaacaatattttgatatgtcttgttttagaacgaatgatttcttttaatacttgattttacgcttatcgcttgcagccaaaaattggccttttaatttgacttgttttcgatgttttcaagtgtatttatttttcagcattagctttcatgtcataagaacacatatataaaaaatttacctataaatatttttcggtgaaaatgttactgctcataattaattaatgagccttcaaaagaaaacggtgtgcttacatttcatagaaacattttcttgtcaaatattgtcacaagtatagttagctttttaacaccacagaaactatggaaccatacttatggcatcgaagtttgacaagttcacggagccaaccaaacatgctccgttccggctgtaaaaccaagatagcgagaaaccgcgaggagcagacgagcagtctacacgctttgtcctctctgttttttttttttggcctggatcttctacgccctttcaggatctcgtgctccacttcttcttcctactgaactaactgctcttcttgtactctctctctctcgcctccaattcaccgacgtctctttggcttttgctgttgaactttatgcagcacatacatacatgcatactggtcgcctactagctagtatggttgcggagccacagtctctgccatgcctgcaaatttgtggtgttcaaagatcacaaagggatcaaaagattcaatacaattgtacccaaagaaggatcccgagacccctaccaacggaaaagctgcattaatctgcataccagtatgaaagtttaggtccattctttttcccctagctttgccggtgtacaaacagggagatgaacgtactgtccaaccatctttcatgttccaagcttaaggtgatatttgattcaggaactaacttttcacattggatgtttggacactaattagaaatattaaacgtagactaataataaaactaattacataaatgagagctaattcgcgagataaatttttaagcctaattttagcacatgtttactgtatcatcacataggctaataatggattaattaggcttaatagatttgtctcgtgaattagtctagggttatggatatgttttatcattagtatacatttaatatttccaattagtgtcaaactaaattacgagatgtatacatactttgagagaaaatataaaatatggagcgcccaactatgtgtgctttttgtacaaattttttttctttggtccataatatttgtttgttttagagttggacacaagaactaataaggtagataaaatggctgttttgttcagttaatcattccaaaaatgcgcatgtatacatggataaacaacttagttatgagttaattaaggaaggggtacggtacgtcagaccaaaaaaaagaccaaattaagctgtctatcgaaattgtaggtcaacaaatattttgaggactgtaaaataggttaaaagtaagtattttgaaccgaagagatcaaagtagaaaaaaaaaactctgacatgcatgtttcatgcaaatttcagtaggttccaaaatatacactccctctatcctctatcccctaatataagagattttgacattttatttgcactgcttgaccattcgtcttattcaaaaaaatttagaaattattatttatttttttgacttactttattatccaaagtattttaagcacaacttttcgtttttttatatatgcacaaattttttgaataaaatgagtggtcaaatagtgcaagcaaaatgtcaaaataccttatattatgggacagagggggtacttcacttatcgctcttttcaacatttcaaaattttaatgcaaagcaataaattaaacaaatcattaccaacacaaccataccaaatgttgtcacaccgaaaataactttgaaagatcactcaaatgtactatactctattgtttaattaataatatgtaaataaaattctctgagtcttaaaaagaaaactatgatagatcctttctagccaaacatagtttgccacatagttttggctccctggaacttaattgtcttagaacatgtatgcatgtttgaaaagttgttttgactttctttccaaacaacaagcaagctaggatacatgccgtaaactagctagctgcaagcctgcaaattactgaagaacaaaagcttttgctcagtgtgttgaggatcgatcgcctctccatttgtaagggacggttctttaatttgcccaacgggcagaacggatcatattgatcgatctactcctgcgcagcacgctgttcaatcaatctttgacctgaccgaacgtgttgattgtacatgtacataggagtatgtactccggtcagttacaacgggaaaacagctttgcttcatcagcacaactttggacctcgctcgctcacatgcatgtatcttctttttttttttttggttatatatagtactccaggtcgtagctgggggtaaccagctaagccagaaagggagacgcctggcctcgcacctctatccctcaatttatttttcttcattctccgatgtattgtaatctcctcatcaagctcgttgggttcgaatcatttgtgtgccacagtgttacattcgggtatacaagcagatatagcgaccgtctctaacaaaaggcttgtaaaaatcaggtgaatgccggtgaaaaatcattttttacatgtgagcttacaactccaaaattattacaagtggatattttatggcatgcctgtaaaaataaaacgctagcgaaaatgatttttttaagtagtgattttgaggttcaaaagtaaaaaaaaaaatcacatttgttagataagaaatggcaatttttatgtgcaattgaactacataacaattgtttcgtatgtctctagtgtgactattgcatgtacttgaattctcacaaataggattaactttgaagttgaattttttttgtgggctttgaaaatgtacatgacctcttttaactgatcatgacatttcttttattaacttttggacctgtaagtatgcattttctaatttgcacccgtataaaaaactagggtatatatatttgctctcgagatgtacgcactggtgaagaacacctggcttctgtagcagtggttgatcgttaaaaagaagaatattgtgctgcttgcaactctagctaggacggacggggggcaaaaatgctgtggtgcaccgtggtacgcaacgtaccggaagactacctaggtaggttcaagtgagtcgcaccaatgcaatgcagtaccatagataggattcaaaacctctctctctctctgtagagcaaaaaagaaaaagctagcacagagctgct

SEQ ID NO: 80789 - DNA, 29762 bp, Oryza sativa
gcgtcatacattaaaatatggaggtagtaataattatttaaatttttttaataagacgaacggtcaaatatatttaaaaaaatcaacggtattaaatatttagaaatggtgggagtattagatggggtctaatcgagtattagggtgagtatgttttatcagaactttttaactgaacaaacaggaaaatgtaaactgatgaggccacacctagcacagcaccatgactagactatgatcatcaattacaagctctaacacggaggaattacacctcatccaatcaagtgttcactgtgccttggtttgtccattttttaggacaattttttggtttgcgtttcttagaactggagtgtttttttttatttacaaaaccgaaccaataaactggaaaatctacttgttagttgttagatacacccttatatttgagtactgctacacatactaaaatttttttacaaaactcttactaacaaatttctcaaccgtttaatttaactagatggaagttgcaataaatctagatttactcacagcttgccacatcagagtttgtaaacattttgtaagaaaattttagtacgtatagacttttcccttatatttaatccctttgcatattttttattaaaatcctaaataaagattgtagtactaggctctcttttagcatagctctatagatccaagatctaatagagcgggggtatttttaactttacaaatcgacaaatctagatatatgattacatatataacatttgaagaaatcaatttattcatattttaggtgaaatttaactgtaatttaacatacaaatatcaatcttcttccagtttttttttaaaaaaaatcaatatgtttgcgctcatcttcttcctcactcgatcagttccccaaatcccccaccctatccaaactcttcctcccccgatccaattcgactccactccatctccctcctccggatccctaatgcacaaggtgtagaattaaattccggggaaatcgacggagtcggaggtaggcgtagcagcatggctggaggagatgactggtcgaagaggacgatcatggaggaatccctgcagccgccggcccacggcgctgcggcgactacaccttgggtcctcctcgacatccgtgctttcatggccaaccaccgcaacgccaccaccgccatgtccgagaccaggagcggccaccccatcgaggtatcctcgtggacggcgcctccgccgcgcgtctcctacatatgcgtccactgccctggattggactccaagaagttcgccaccgagcccaccatcatcgccgcggaggccgacctcctcctcatccgcgtcgccatggggcgccggaacatccgcttcaagagcagcttccatgactacttcgtctaccaggccaccaccccaaccccgaaactcaccttgctcccgccccctcccatcgacaggttcatcgaccacgagcttggcctcctgcgctgttgcgcctctcctgattacattgttgctgcactctgtaacaccttcgaatcaggatactttgagtatgacctccacatctactgctccggcgctgatgcttggacctgccatccaatctccctccatggcctggtcgacacatcatttacccatatcaataccaaggcaatcaccattggagggaaggcgggcaccatgggctgggtcgacctctaccgtggtattctcttctgtgaccttctccgcgacaccactaagctccgctacttccccctgccgccgccgctcagtcccaacaactcgttaacaggctctccaaggcctcatcgtgacattgcccttgtccaaggtcggatcaagttcatcgagacgcggcttcatgtcaagccaggttccatcatcaacggcaccttcatctctcaaggttggactgctgccacctggactgcaccggacaccaatccctggaaccaaggttggcgccaggactgcaaactcactgcttccgatatctctgttgatgacagcaagatgaattttgagttgctgcctaagcttttcgatgaccaaggcacacctcagccaaccttggagagacttcatgtgggtcatccaacgctcagcttgcactctgatgacattgtttgcttcatggccaaggccgaccaatgggacgacgatgcttgggtgcttgctgttgatatgaagaacaagaggctaaaagttgtggctgagtttggtgcagaaagaacccttggcattggctatgcctacatgagcagtaacatatcagggtatcttcgtacagctccaggtaactatttgttctgctgattcatccctaaccctgtgatccgttccaatgctaaccatcataaccttgcctgctttcacaaatagcaaacctgcatgttgtaatcgataagaatattaaacctattagatcgacgcatatgtatatatgtatgtgccctaatcaattggaaaacacatgtttttatctttcctaacaagaacaagggacatcgctgttgggagccctgtttctatggcattgggtgtacaagatactccagttcaggatgctaatatttgtctggtgttaacaagatacttgacacaatatttgtggggacacacttttggtgagctgataaaacatagtacatagatagatataggcaaataaatcattgaagggaatgagatttatgagcaatgcccagttaaaactgtaaaatggaagccttcttctataattacaatacattacctaacaaacagatggtggaaacaaaaactgcatcatggcttgtgctttcatggaaatagcacatcacctaggttgattgtttcgctatggaattctattagagggaaatgatagaaatgagagctactatttagttgtcattgagccaggattttttattttgctggctgcaggtatagagggtagcctaaagcgacaaggggtttgttgaccgcaccctcacacaagaagcagacccatatgatgcatatgtctcctccctcttggaaaggtggagatcaacagaattctgtgggaggtgaagttgattacatggattttggatgaggaggggcatggctaaggggagagcattttcatgtagtattgctgttgtgttagacttcttattgcttgattatctactgttttgtcagttctatttacgagggggtattgctggtactttgtaccgaggatgactatctaagcacaaaatcttaagagtgtagtttatgcctctgtttatttcttatcaatgtagcgaggttgtaaaccgtatggtcctctcgctggtgtcaaattgctcacaatgtgagcctcctggtagcattgggcgtcttaagtccgattaatctggaagctgattacatggattttggatgaggaggggcatggttaatggttagagcatgcatgatgcaaatgtctggaactctgggagcagtacaacccgatgaaaaagaatattaaacttgtctagctcttcaagtattgaggatttagtacttgttaatttcaggtacaagtagcagagtgtctctctctattgcactcattgatgaaaccttagttgacgcttacaggattgtttctgctgtaattctactagcactaatagtatatgcatgctttagtaaaatgaatgtcgattagaaaagaagatgtgccaaactgtgctacagtgatagcagtatatatttatcgaccggtccatggggagagagatatatacacatctctgcgttcatgtgcttgttcttttttgccgggcaccaaaccaatgcaagggagtgtagttgaaagcaagcaatttaattgcaatcagatgtcaaatatggagtactttctgcttatgcctcatccgccacccacggcgttctttcccgatggatgacgacgaggtgagaggttaaagaagaagaaaatgaagaggcaagagcagaggcaggcgtgagctcacctgatcgaagaaggagctgggctcgcccggagacgaagagggctgagagaagggtggcgggcggcaccactgcaatggaatggaggacggccagcgagcgcggcggcggcggcggagacagcatcacagcttgcctcgatctggtgcgtggaagtggctctaaccaacgggatagtgggctcccggctagtagcatatgtgggccttctttttagcaggccggccttttaacgggcaactgggctggctatccatcatcttcatcttctcttcttccccggccaattgaattccactccaccgtcgagagcacagcacggccaccgaggtcacactccgtttccctaaattcctcaatccgatccgatttcttcttctcacccaaaaccagaacggaaggtgtgtgtgtgtatatatatatatctactacttaataaaaaataaaaaataagaggtgcttccatcgtccgtcaaaaaaaccacgagaaaaaaaccgagcgaaaaaaaccggacgaaaaaagagtccgatcccaaaaaaaccgggagaaagaaaaaaacgtccgatccaacaaaaataaacggagcgaaaaaaaactggtgaaaaaaaaacgagggaaaaaaaccgggcggaaaaaagagtccgatccaaaaataataaaaaaaaagtccgactcgaccgattcctgtccgtcaaaaaaaaatagcgaaaaaaataaaaaaaaagtccgattgctataagaaaggaaaaaagaaagttcgactctagatctaaatcacccttaaaaacgaaaaataaaattgatgtgccggattaaagatctgtttgcaaaaacgaaacctaccggtcgagagcattccatttttatatgattttaatttttggatctatacttttgcatttgagtccctgtaatttttatatttacatttgagtccatataagtttgaaataaggtattaaggtcgtttttgattaaaaaataataaaaggggaagaataaagacagaaaggtgcataaaaagaaaaagaaaaaccgcacaataaaagaaaataaagaaaaagaaagaaaaacaacaacaacaacaaaagtccgtttctcctaagtggcaaaaaaaaaccgtagatccgattcctataaaaggcaaaaaaaaagtggtgaaaaaaatgctagatctaattcctttaaaaaggaaaaaaaaaggtctaattgctataaagatgaaaaaaatcccaaaaaacatctaaaaaagttcgtccgattctctaagaagaaaaaatggttcgtaaaaaataaaaagctggttcatataaaataaataatgcgcgcgagaaaaaaaatgaaaagggcgaaccaaattccgatttctaatcttcgttatgtctaatctaatctaactatttaaaaagagaaaatgcatgacaataaaaacagttcaaagaaacgtgtgagaaaagttagaaaaaagcgcaaaaaaaacacgctaaaaaggttttccatcttccgtaaaaaaaataaaaaaccgcgtgacaataattatttccatcgtcggtaaaaaaattacttaaaaaaaagggaggaaaaaactgtcagaaaaaacacgccatttctaaaaaatggtttaaaaaaaccgtgcaagaaaaaaacatcgtcgattaaaaaataaatcgctctgaaaaatctgtcagaaaaaaaagctaaattgatggacgcttgagccggataggatccatcgattttttgtcatctactacacggttttatttcatcagaaatttgttttaaaaaaaaacatgcgaggaaaaaacgcaccatttctaaaaaatggtttgaaaaaaccgtgcaagaaaaaaatcttctattaaaaacaaattgctctgaaaaatctgtcgaaaaaacgctaaattgatggacgcttgagccggataggatccatcggttttttttgtcatctattacacggtttttatttcgtcatatattctcctgtattggaaaaaaacaaaaaagaacattcgaaaaaaaagtaaaaaacgcacgagaaaataattgttagaaaaaacatgcaaaaaaacacacgagaaaagaaaagcaaaaaagggagaaaaatatggttttcgtcgtcagtaaaaaaacaaaaagaacatgctaggaaaaaactgttagaaagaaatgtgccatttttaaaaaatggtttgagaaaatcgcgcaagaaaaaaaatcgtttatagaaaaacaagtcgttcgttaaaatacaaacattgtcattgacatgattatgtatgaaaaaaatatattatcattagaatttttcacccgttgcaacgcacgggcatttttgctaatatatatatatatatatatatatatatatatatatatatatatatatacacacacacacacacacacacgtgtgttgttagatcagattagattagataggaaaagattgataaattcacattcacccagaggttaagtactccctccgtttcgttttatttgacaccgttgactttttagcacatgtttgaccggtcgtcttattcaaaaaaaaataaataattattaattctttttctatcatttgattcattgttaaatatatttttatgcatacatatagttttacatacttcacaaaagtttttgaataagacgagcggtcaaacatgtgctaaaaagttaacggtgtctgacggagcgcggcgctcctcaccgggagaccgcacaggccccccctttgccggttcggccgggggctcagggtgagatctcaagctctccgtgtatgcgggaagatcgcgacctcccaaaagagcatgaaacacaagcgatgtatacaggttcaggccgctgagaagcgtaataccctactcctgtgttttggtggatctgtgtatgaaggagctacaaagtgtgagccaacctctccctcgttctaggttctgaatctggaaaagatcatcccctttctctatgggccaggtcctccttttatacttcaaggggataccacatgcacccctctctttccaaactggacttttcttctcttcataaatggacggagatttgcacggtcgtcctccgaacatcctcctgacgggacgacacacacctacctccacttctgcctgaggcgggcacgtcgtgggaaggcggctgtgtgctgacgacatgagcagtgtcagaccggtcacaaatcggtcattcttgtccaccacgcgtcggcttagcaacgtgcatgcttgcccttcttcaaacaacatcttgcttgtaatggttaggatgaagcctggcatatatcgatcggggctaacgtgtcatctctgggatgtaacacgctagctccagccggggacgagtgcctagaagctctcgtcttgacgggatggggcgaagcgtgcgtcagaccgcctgtcgccacctaacccgcgatttgaccggtctgtgactggtcacagaccggataatcgagtgcactgcactgcacttcgtgcggcgtgacacgcttaaccgaggcgcaataaatgcggttaggtgagccccgctgtgctcacctaacccatacacgtggagtagaaacgcgaggggtcggggcgcctcggccctcgggggcgaggcaggagtggtccgaccccccccccctcggggagaccaagaggtgggcgcacacatcaccctcgggcccgacgtcccccgagggtgccaggccacgtgggcgatggcgtctgcctcaagcctctagtcatgatactcccggtcccatgttaccgacagagcccccggcgttatgccagggcgatcgcccttcttatgggaagcggccgggcgtgacgccactcctaaagcctggtgacaggtgggaccggtctccatggttgggcagaaacccaacggtctcaaaccatgcacaccggttatggtaatttggctgtcaataatgggcggtctcttcaagactgccacatcacctgagcggcgaatgaatctgggcgagccgatttgcttcgcctggagatacggtaatgtcgcttcggtcggcgagcgtaattaacgcgcgcacgatacgatctatctcgactgccgcaaccgcatatccacctcacgcgccgcaagcgggcgaatgggatcagtggaagcgtgggcgcgagaaacgagggggcgaaataatgggcgcgagaaacgaggagccgggcacagcgttggcaagggtataaaggcactgaggataggatttgtttccttcctttcgccatcattccccttgccttcgccgcttgcgccctaactccttcttccctgcgcccttctttcgccacacgcgctcgctctccatcttctcttcgtccggcgccatggcacggggctccgcactgcttgatggtagcgtgctgccgccttcccgcatcgtgagcgagaagcaggctgggttgccgcgccgctttatgccggaatctgccaccggccgtgagatagtcatgctgggcgagggacgcccggcgccagactacccggggaggtccgtcttctttctcccctttgcaatggcagggctggttccgccattttcttctttcttcatggatgtcctggagttctacgatctccagatggcgcaccttacccccaacgcagtgatgacattgggcatcttcgcacacctgtgcgagatgttcattggggtgcgcccatctcttcggctgttccggtggttcttcaccgtgcagtcggtatcgccaccgtcggtggtcggcggctgctatttcctgccgcgggggccggtgttgaaccgctacatcccctgcgtcctccgcaaaaagtgggatgactagaagagcgactggttctatacccccctcgccgacgaagcgcgcctccgacttccgagccagcccccggcgcaggcctccagctggcgggcgccggtagatctgggggatggctatgacgccgtcctcgaccgcctcgcgggcctgcgatcccaggggctcaccagggccatggtgtacggcgactacctccgtcgtcggattgcgccgctccagcggcgcgctcggggcgcctgggagtacaccgggtccgaagactacatgcggacccaccagggagtcagatgggattgggctcccgaggacttcaagatactggtccaacgggtgctaaatctcaactccgtggaggcgtccctcatcccccacggtatcctccccctctgcagcgatccagatcgcgcctccatcttgaccattatgacggcggtcggggcctcagaggagcaggctcctaagggccatgacgacgcaggcgggagccgccgaggggatcaatctacccccggagggggtcgtgcttctgggccccgcgtcgggggctcggggagcagccgccctaccgactcccgggggaagaggaagctgggaggaacacctcccccatctcctccccgagggggcggggcggtgcgcgccagcagcaggcgcccggagggggccgcgccagcatcgcagcccgagggggagcgcaagaagaagcggctgcgcaagatgggggagacagaaccatcccggggaaacctaatttcccctccaaggtggtcatttaaccgaccccctcgcaggttcgtcccacgctcattgcgaccgtcttttcttctatcccaaaagcaagttttctcttacccatcttgtttgccttctggtttttctttctgcttcagtgatatctcatcgcgttcctcccaccatcccaagtccggccagtccgaggccgaagatccggcggccgcagaggcacggaggcgggaatctgaccggcgagaggccgcagaccgcctacgggaagctgaagaggccgcccgggaggccgcccgggctcgccaggctgaggataccgctcgggaggaggccgcccgggctcgccaagccgaagaagccgctcgggaggaggccgcccgggttcgccaggctgaggcgatggcggcttccgaggcagttcgcgacgaggccgcgggcgcctcgcttgggtccaccccttcgggcgacgcccaggaccaaacaggtccgggggcggctcgcgacgaggccgcgggtgcgtcgcttgggcccactccttcgggcgacgcccaggaccaaacaggtccgggggtggcccgcgataaggccggcgcgtctattggcgggccgagccgcgcggcatcttctccaaggcagcccttccccacgccttccgtcgccccgctgagcgcagagccccttctgcaggccttagccgccgcaaataccgcggtgttggatgggttaaatgcccaggtggaggccctgcaggcggagcgtgcggagctcgacgccgcatgggcacgtgtcgaggaggggcggcactcggtggaggccatggttgaagcgggccgcaaggcacaccgccggcacgtctcagatcttgaggcccgcaaggcggcactggcggagatcgctcgagaggtggaggaggagcggggggctgccctcatcgccaccactgtgatgaacgaggcgcaggactccctccgccttcagcacgggaactgggaggcggagctgaagaaaaagctcgacgccgcccagggggtccttgatgccgccgctgcccgagagcagcgagcgacggagaccgaagcggcgctccggcggcgtgaagaggccctcgaggcgcgcgccatggcgctggaggagcgcgcctgcgtcgcggagaaggacctggcggaccacgaggccgccgtcgcctcccgggagacaacgctggcggcgcacgagtctgcctgcgccgaagaggagtccgcactccgcctccgcgaggacgcgcttaccgagcgggagcgagctctcggaaaggccgaggccgaggcgcaacggttggcggacagcctgtccctccgtgaggcagcgctgacggagtaggcccgccgcaatttggaatccgtccgcgccgagagagccgcactggagcagcgggctgccgacctcgaggcgcgggaaaaggagctggacgcgagggcgcgcatcggcggggcggctgcgggcgaaagcgacttagccgcccgcctcgcagatgccgaacacaccgtcgccgacatgcagcgcgcgctagactcatccgccggggaagccgaggccctccgtttggcgggcgagatagggcccggcatgctctgggatgcagtctcccgtctggatcgcgccggtcggcaggcgggcctctggaaagggcagacaataaagcctgccgccaacctgggaggccttgcccagcgcctctcgaagatggccggggctctccagcagctccctgaggagctcgagaagaccatcaagtcatcctcgagggacctcgcccaaggagcggtggagctcgtcctggcgagctaccaggccagggaccccaacttctctccgtggatggcgctggacgagttcccacctgggactgaagacagcgcgcgcgcgcaggtccgggatgccgccgaccacatcgtccacagcttcgagggctcggcccctcggcttgcgttcgcccccaactccgacgaggagggcgatgccagcggtgcagacgacgtggaagacgaggccggcgacccgggcgcatcggattgagcccccaggcccccgccaatcttcaatttctttctttttctttcttctaaggccttcaggcctgttttttgtatagatcaacttataatctgcaatcaaaaatgatgaaaaaattctttgtgttaattttattttgctatgcggatgagatgaggatgatctgtgccgtggtcctctttttgtgtcttagcttgatttaagggcccgtgtccaagtcccagtcctcgaaaagcgcgggtcggggctagtgcctggggagatccgcatgtcgagactggccaggccgggaacgtggtgaccgagggttatgggtgacccgattgtgggtttttgccgattccccccccggagttcaccacgccccggggcacggctcggttctgggccccgtttggcgattttagctgaccgaaccgagcccccgagggcaaggttgagcacgagtgacctcatttcaagtcaaaattcttcaaaaaggaaaaaacggcacagatacagcccttaggaaattgaaactgcttttattgaaatactgaaatgagagaaatgagaatgtgcatgtgtggcagcccccggccaaccctgcacacccgagggggggtgcggggttggcccgagcccgaaacctgacacccgacccccccctcaggggtagaagcgacgaaggtgctcgatgttccatgggttaggcaactctgtgccgtcgcccgtggccagccgtatggagcccggccgggggacgccgatcactcgatacggaccctcccacattggtgagagcttgctcaatccagcatgcgtttgaacgcggcgtaagacgaggtcgtcgacgcagagtgatcgggcccggacgtggcgctgatggtagcgccgcaggctctgctggtagcgtgcggctcggagggccgcacgccgccttcgttcttccaagtagtcgaggtcatctctacgaagctgatcttgatcaacctcgcagtacatggtgacccgaggagacctcagggtgagctcggatgggagaaccgcttctgcgccgtagacgaggaagaaaggcgtttccccggttgctcggcttggtgtggttcggttcgcccagagcaccgctggcaactcctcgatccatgaatcgccgtgctttttgagaatattgaaggtcttggttttaaggcctttgaggatttctgcattggcgcgctccacttgaccattgcttctggggtgggcaggtgaggcgaagcagagcttgatgcccatgtcttcgcagtagtcgccgaagagttcacaagtgaattgggtgccgttatccgtaataatacggttaggcactccaaaccgggccgtgatgcccttaatgaatttaagtgcggagtgcttatcgatcttgatgaccggataagcctcgggccacttggtgaacttgtcgatcgcgacatacaggtactcaaacccgcccggggcccgcctaaacggtcccaggatatcgagcccccagacagcaaatggccatgaaagtggtatgatctgcagggcctgggccggctgatggatttgcttggcgtggaactgacacgctctgcatcgccgaaccaggtcgaccgcgtcattgggggtagtcggccaatagaatccttgacgaaaggccttgccaaccagggtgcgcgaggcagaatgggctccgcactcgccttcatggatatcggcaagaagctcaacgccttgttcccgaggaatgcacttcaggaggattccgttagccgcgcgccgatagaggatcccttctaccagcacgtagcgtttggaaatgcgttggacgcgttcactcccttcgcggtcctcaggtagagtcttatctgtgaggtatgcttggatctcagagatccaagcaatcaatctaagggagcttggagcgctcccctcgggtcccgaggcctgggctccgacaggcctcggggaccgatcaggcgcgtccgtctcccctaaggggtcgggtcgcgccgacggctgggcaagcctttcttcaaagacgcccggtggggtctgggctcgcgaggacgcgagccgtgagagttcgtcggcaatcatgttatcccatctgggcacatgccgaagctctatcccgtcataatggcgctccatacgccgcacttggcgtacgtaagcgtccatctgcgggtcagagcaccggtactccttacagacttggttaacgactagctgggagtcgcctaacaccaagagacggcggatccccagtccggctgccactctgagtccggcaaggagtccctcgtactctgccatattattggtcgctcgaaagtcgaggcggaccaagtatttaaggacgtctccattcggagaggtcaacgtgacccccgcgccggcgccctgaagagacaaggagccgtcgaactgcatcacccagtgggcggcgtgaggcagctgcgaggggtccgagctggcttcagagactgaaacggtctctggagccggggtccactctgccacaaaatcggcgagggcctggctcttgatagcatggcgtggttcaaagtgtaaatcgaactcagaaagctcgattgcccattttaccacccgtcctgtaccctcccgattatgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcgctaacaaagtagacaggccgctgcacccttcggtggggccgatccccttcgctaagggccatatccccggggcgctcctcgtccaagtggcccctcggggcgcactcgtcttctgtgccgatgacctcggggtcggaggacgacaggggcggccttcccacagtggcctcggggccgttctgggggtcgtgggctcctggcgtcgtcggacaagcgggcaaagggccaactctggtcgtcaggggccttaggccaccgttcggctcgggggcctcttctccctgctccctcccgggtcgaatcggtacagggttagcctcggggtcagagggcgatagatgcagccttcccgcagtggcctcggggccttcctgagggtcgggggcgcccagcaccatctgacgagcgggcagagggccgactccggtcgtcaggggccttaggccaccgttcggctcgggggcctctcctccctgctcgctcccgggccaagtcagcacagggtgggggtgcacggaatgaggatcgtcctcatcgcgctccacaaccaacgctgcactaactacttggggggtcgccgctaagtagagtagcaggggctcatttggctccggggcgactagaaccggaggagagctgagatatgctttcaactgagtgagggcgcgttcagcttcctccgtccaagtaaacggcccaaagcgcttgaggagcttaaataagggtagcgccttctctcccagcctcgatatgaaccgacttagggcggccatgcaaccggtgacacattgcacatccctaagtttactgggggggcgcatccgctctatagctcgtatcttctcggggttggcctcgatgcctcgggcagagaccaagaacccgagaagcttgcccgcaggtacaccaaacacacacttatcggggttcagttttatgcgggcggagcggaggctctcaaaagtttccgctaaatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataagttcctatgggagtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatagatgacctcacggataaatccggcctccagaagtctcgcgacctcctcgcggatgaaggcttgacgttccggggcctggcgccgcactttctgccggaccggccttgcgcccgaccgcacggcgagacggtgctcaatcacctccctggggaccccgagcatatccgccggtctccatgcgaagacgtcagcgtttgcccgcaggaaggagacgagcgcgtcttcctatttgccgtccagaagaccaccgatccgtgtggtcttggacgggccgtcgcccagtgcaacctccttgaccgggacctcatcggacgtgactatccgctgcctcggggcggcgggggcggatgtgccaagcctctcgtcgccaccctcgggcttggacacgacggcgaggcggtccgcacgctgctccatacaagcgagcgcgactttgaggtcgccatggacagagatggggccgtcggggcccggcatcttcatctggaggtaggcgtagtggaccgccgccatgaacttcaccaacgcgggcctccccaggaccgcgttgtagggcagactgaggtccgccacatcgaagttcacccgctctgtgcggaaattggcgggtccaccgaaggtgaccgggaggtcgatatgacctagcggccaagtgtgccccggcgtcacgccgatgattggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctcccctggcaacgcacggcgggtggtcggtctggtcaaaagtgagggcaacttccgaccaccgcgcccggcgcgtcgcctcatgagtaggggccgcggccagaagctctcgcttcatagccttgaggctccggcgagaaacgtgagcacacgctcctccatcgacggtggcaatggtggccccaggctcttggaaacccaggtcatcatcgccatcatcgatgtcctcggcgggggccttctgcctggcctcacttcgccgacggccggaaggaaccgccggggacttgccttcccggcgctcctgcctcctctcctcctcccacttccttgtccgctctgccaagcttttgactgcgcgacagtccacaaggtcatggagggaggtgttgtggacggtgcaccacttgccggtagggcgctccctgctgggaacgctggcctccttctttttgtcgctcgcaggcctcccctttcgggtggcccgcgaagcgccctcgacggcgaggacatgaccctcgtcgtcggaacggactgacctcttcttcctcctcctgtcacgccgccctgcctgagcggcggatccgggggcggccgaagctgccacaccggaaccggaggggttccaagtccaggcctcctccttgcgagccactcggtccgcgagctgaaaaagctctgcggtagtctggggctctttggaggcgatcttttcgagcatgcggttgtgccgcacgccccccctgaacgcgtagattaccgcgtgtgcagggatgcatggtatggtattgcggacttgacagaaccgctgaatgtacgatcgaagcgactcatcgtcccttcgctgtacggcgtgcaagtccgcttcctcaccggggcgcggatacgtgccttggaagttcatggtgaactgctggcacaaatcctcccaggagtggacagacgcgggtggcaagttcattagccaaccccgcgcttgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccacgtccatgtcgaggtgacactctggacgaggaagcgccctccgttgcgtgggcagcacttcggtcattacgccggcgctcgatgctggcgcgggcgtcctgctccccatgcagatcttcccgggtcgaaggagtcgacgaaggagtggcagccgaacggcgaacagcggctgccgctcgtcgtgccctccgtcttgacaacgcggagccggtggtagcagcaccagaggccttggtggcggaggaccgcccaccagcatctaggcgctgccgtgccgtcatgaccaatttggccacatcgtccagccatcgttgggctggagactccgggtcagggacgacaggcgggtggcgtaagagcgcgcccgcagcttggagcgcgccctggggcgtgctgccgtcgccgtagacgaggaggcgacggtccccatctcgccgttctcctccatcgcccgcgatcggtgaagccgcggatctttcgaccctttcgagcgcctccccctgcttaggactttggcgtggagggggcggtggagtacgagctcgacggcgtgggttcggctccccgtcgtcgccactcacactgggagagaggtcggacgcctttgcttgctcagccatgaggctgatcaagaaaaacttgacgcacacggaaaagtgcgagagctcagaaaacacacgctgagccccctacctggcgcgccagatgacggagcgcggcgctcctcaccgggagaccgcacaggccccccctttgccggttcggccgggggctcagggtgagatctcaagctctccgtgtatgcgggaagatcgcgacctcccaaaagagcatgaaacacaagcgatgtatacaggttcaggccgctgagaagcgtaataccctactcctgtgttttggtggatctgtgtatgaaggagctacaaagtgtgagccaacctctccctcgttctaggttctgaatctggaaaagatcatcccctttctctatgggccaggtcctccttttatacttcaaggggataccacatgcacccctctctttccaaactggacttttcttctcttcataaatggacggagatttgcacggtcgtcctccgaacatcctcctgacgggacgacacacacctacctccacttctgcctgaggcgggcacgtcgtgggaaggcggctgtgtgctgacgacatgagcagtgtcagaccggtcacaaatcggtcattcttgtccaccacgcgtcggcttagcaacgtgcatgtttgcccttcttcaaacaacatcttgcttgtaatggttaggatgaagcctggcatatatcgatcggggctaacgtgtcatctctgggatgtaacacgctagctccagccggggacgagtgcctagaagctctcgtcttgacgggatggggcgaagcgtgcgtcagaccgcctgtcgccacctaacccgcgatttgaccggtctgtgactggtcacagaccggataatcgagtgcactgcactgcacttcgtgcggcgtgacacgcttaaccgaggcgcaataaatgcggttaggtgagccccgctgtgctcacctaacccatacacgtggagtagaaacgcgaggggtcggggcgcctcggccctcgggggcgaggcaggagtggtccgaccccccccccccctcggggagaccaagaggtgggcgcacacatcaccctcgggcccgacgtcccccgagggtgccaggccacgtgggcgatggcgtctgcctcaagcctctagtcatgatacttccggtcccatgttaccgacagtgtcaaataaaacgaaacggagggagtagatagtagctgcatatagagcatgggaggagatgagagtgatgggtggtctgattgggaggagaagaccatcatggatgagtccctccggccgccgacccacgtcgctactgcggcgatgacgacaccaccttgggtcctcctcgaatgcgatgcctacatcgccaccaaccacggcaacgccaccaccgccacgtccaggaccaggaccggccaccccatcgaggtatccttctgggcggcgcccccgccgcgcgtctcctacatgtgcgtccactgccctggattggatccccagccgagcccaccatcatcgccaccgaggctgacctcgtcctcctccgcctcgccttagggccccgggacgacagcttcaaaaccagccgccaagattacttcatctaccacgcttcttccaccgccccgaaactcgacaacaggttcatcgacaaacaggttggcatcctgcgctgccttgatgatggcacctacatcgtcgccgcgctctgtagcgccttcaaacgaggtgatcatctctaccgctctggtgcagatgcttggacctgccatccgctctccatccatggtttggtcttcgatccatcatttagccatgtcactagcaaggtcatcacggttggtggtgaagccggaaccatgggctgggtcgacatcaacgatggcattctcttctgcgaccttctccgcgacaccgctgagctccgctacctcccgctgccgccaccactcgagcacaaagacgacatgatagtaggctgtccagggccacttcgggactttgctcttgtccaaggtcggatcaagtacatcgagatgcaggttcatgtcaggccaggctccgctatcaacggcacctacgcctctcaaggctggattgctgccacttggagtgcaccacccaccaatccttggaagcaaggttggcgccaggactgccaaatctctgcctctcatcttgctgttgatcacaacaccatgaattttgagttgctgcctgagcttggcacacctcagcaaaccttggagagacttcacgtgggccttccaaagctcagcttgcactctgatgacattgtttgcttcatggctaaggtcgacctctgggatgaccagaatgcatgggtgcttgctgttgacatgaagaacaagaggctaaaagatgtggccgagtttggcgcaggaagaactcttggcattagctctgcctacataagcagtaggatatcagactatcttcctacggctccaggtaatttatgtgttctaccggcgcatccactaactaattctgtcatccgttgcattgctagccatcatgacctacaagttttaattgatactcctgcttgctttcagaaatattaaacctgtgagttataattgatagttatattaaatcaattagattgatgcatatgtatgtgctaatcaattggaaacatgtgcctttgtctttactaacaagaacaaggggacattactgtaggacatgatactcattgtttctatgccgctgatgataatcaagttcagaacgctacttgtctggtgttaacaaaatacttgacacagctgtcttggaacacttcagtgagctaataaacatattacatagatataacctatgtacaggcagggaatcatgaaacagaatggggtttatgaccaatgcccagttaaatggctgtgcatatatgactgtaaaatggatgcctttctctataatcgcaaaatgttacctaacaaacagatggtggaaacaaaaactgcatcatgaccatgtgctttcacagaaagtgcatgtcacctaggttgattgttttgctatggaattttagagggaaaggatatatatatatatatatatatatatatatatatatatatatatatatatatatatgatactgtttagttgtcattgagccggttttcacttaatattttgctggctgcaggtttaaagggtaacctgaaacgacaaggggttgtgttgaccgtgccttctcacaagaagcagacccgtgtggtgctgtctaatccctcttggaaaggtggagatcaacaaaattctggaacaagtatggatgataaagaggataacatggatttggacttggacatgttttttggatgaggggcatggataagtgtgatgcatcttcatgccttgctgttgtgttaacttatggctagattatctactgttttatctgtcctatgagtaacttatatgagggggctattgctagtattttgtagcaaggatgaatagttgtatctgtagcacaatcttaagagtgtgctcttgtttatgcccctgtttatttcttatcaatgtagcgaggttgtaaaccgtatggtcctctagctggtgtcaaattgctcacactttatggatgcgtgcctcctggtagagttgggcgtctcaagtcctattatttttcttctgcaatttggtttcctcgcagcttttcgttttctgagaatgtgaattgtgaatctgaaatcggctgactgcaatcaacatttgttatgccctggatggcctggcaatcaacaggtctgtccataattctagatggtgtttaattgagtactagagtattatattttgggacaggtggggtatgttttatcagaacttttgaatggaacaaacttgaagatgcaaactgatgaggacacctagcacaacaccttgactagagtaggatcatcaaccacaaaagctaacacccaggaattatcttagcagcttcactcgatcatatattgtattgtttacagcgataattatctgattagtatcttgcagcattcatggccttgctagtaaattgtatgttcgacctcatcagataataccatggctttggtttaattggaattattagattctcttcccgcaagttggagtcgtactttccgagtctttttcctttggttttttgtttttctcctctcttagaataagtcggtctggcttaatgcattgtgtaacgaatattcttatcttttaatatattgacgtgcaatccttttacgtcttcgagaaaaagaattattagattctctaacgaattgcacgcttacttgatactactactctactagtagagtacctgcttgtatgagacatatccatgaaccgatcagtttgtcagtcaattctggagccgtatcaagttgctagcccaataaaaacttcagacacttctgtcactaactacctatgcctggacctgcatctctgaaaccaccaaattcagacctgtttggatcgacggatggaattataccacctaggactgggaggagtgcctgagttgccttctggccatggtcttgcccatcaattaaatacttgtcgtatactccctccgtctcaaaaaaaaaagataaatcctgtgttttttttccaacatttgactatccgtcttatatgaattttttttataattagtattttaattgttgttagatgataaaacatgattaatactttatgcgtgacttgttttttcaatttttttcataatttttttaaataagacggacggtcaaacgttggacacggaacctaggatttgtttttttttggacggagtgagtagagattaagaaaaagaaatggagcaacgtgttttatcgatcatacattctcaagtaaagctgacactgatgaccttctgaagagttttgtcttcccttccactgctgattcggtaactgaactgaattctactactgatcgaggcaaaaattatctatcaatatctgttgttcagaatcaaggatgaggatttgtgaatagttctttgaaataagagttcatttacaaacaagacttttttttctgaatcaaggatgacgatttgtgccttggtgaactttttagatctttttatccttgttaatgtgagcaacccccaggattgcagctatcttccttctaatcttcctgtataatcttggatctgtgacgtcctttgggtggcaaagagtattgaatctgatggcttttgcttccggcagagatggtggtgcctgaggttaactaggacatgctggcggtactgtagtgctggtgcatgcaacaagataagttgtgagtgcaaaattagatatacattctacaatgatcggttattttaactgatggtttaattctgtgctgacgtatgaatgtaggtggtcactgatcttcatttttgtctactgcaatggacaatgctagaagctcctcaccagaaccatctgcaagaacaggtaaagacaccatattactcttcaaaggcaaagatgttctgcaattcagaataaatttacattgaattgtgattcattcacagagaaatgaactatccagtcaaaaatactctcctacttatccatgggatatttgttgggtggcatcttaaggaagcaattacatatatttagtggtcctgactgacacagcaaatgcctgatgaagtgcaaacccaaatggctgcattgttaatgtgtctgtttacctgatgcttatgcttgcatctcaatttcagcactatgtttgttaaaggcttcaactgcacctatatttcttcttcatgtacagaggccatctcattattggcgttctgttttttcttactacttgccattaggacgaatatgctatagaagaatttgataaatgctcgatccaacatgcaactgcctatttggattaaaggttgaattatcaagccgggcgactaatgatatttttcggtgatcgaaaaattgtaatatgtgtcgaccgttgtttatagtggagacaatatcagcgaagcccaagcggttgcccgatctacccaggaggtggctccgccactgtttatgagctgtgatgtggaccgaaatatataatatgacaagaaaaacaaatgcatatgctttgtgcatggaaaactgaacttgttgtccttttgggttgtcttaagtaaacataatgccaaatgtacgatatagcgcccatttaactttcctctaggtaatagcagtagtgaagccttgaaggtgtcattaactggcattctgagtcccgagaggattagcttgcctgtatttttttatcagattgtgtatatttaggcgccggcgtctgtgcatatcaaattatttggtgttgctgaatgatgctttccataaccaaattaaccgcacatacaaaaaggggaaatggaaagataaggcaaagaaagagatccaaatcaagaatattttttttcaaaatattaaatgttaattttgtcctaggtacatggaaatcgcttcatcaagagaagaaatggatggaggtagacatgccaacgtcttcacatgatggaagatcaaaaaggacagagggcttctttatttagctacggagtcgcggcttcatgtaatagtggtagggacgggatcttcacgcgagtatgacaataatgataggtcttcatggacgagcgatgggccttcatgcgacgatggtgacggcttcacggaactagagcgaaaataatgacttcataaaaagatagcgacaacttcacgcacactaagtggaattgttaattactatgtttggagctctggtgaccgatcgattttggtcacatgacttaagctaattggcatgctagttttatcggatcaggtgaaggaaaaaagttttaaggtggtataaaaatgataaaaatttaacaatcttattcttaagtcagtgaatagatggaagttgaggaattgaggcatatgcctgcctccttcctcctcatgtcatgtgttcctctcctcttcatgtggagtcttgagtcttgacaagcaaagaaggaaggaaacctcctcctcctcttcttcggctccaaatcaaccaaacaaacacagcttccgactctctccctccctccctccgcctccgcccatccaatttcttaccccgttcgactccactcgactcgacccgacccgcaggagagcgggcgtcgcaaaccctagctccacccacacccacacgctcatgccccccaaaccctagaccatgcgcgcctccgccgcccccatggagacctccgcctccgcccgcagatccgccgcccccgaccccaagaagcctcgcctcgcccagcaccccgcccccagggatcccagatcttaccccgctgccgccaatggcaacgcccccgccgtcgaccaggcgcaggtggacgagctcgtcgcgcagtaccggaccgccctcggggagctcaccttcaactccaagcccatcatcaccaacctcaccatcatcgccggcgagaacctccacgccgccaagcccatcgcctctctcatctgcgccaacatcctcgaggtgacccttctcctcttccgctattccattccctttctctccatgtaaaactattgaggcgcctcctgtcctacttactactttatcatgtacgtcttgtgctagatacagcaaacgtgctcccatgagcagccatcttttttgtattctactctacatacataataacatagctaatcgagatgagatccctgtgctgtgcttgttgcccaaacatcaccttctttactaatgaactgcgcactgacctaatttctaacaaaaggtttaaaccacccgcatttcgcctatgttgatgtatgcaaatatcagggtaatgagtgtttcgctatggactgaatttctctttgtctacgatcaaatccctttctatgtgtgcgtgctcatgcactactcttgtatgacgttaaggcacatggttatatacgctttaccgttgcggaatccatttcaagttaccgtgtgacgattttatgcccacgatatcattcactgtatgaatatcagacttactcgtcatggcaaaaggatatcaatggtagggttctatcaccctatgcaagtgttctatgatgctagaaaatatcataagtatcgacttatggttgcaaactgtaccaggcaggcttcagtttcattcctactcttccactatctgatccccagatttgtgctgcactgcatgttgaactgttctcatgctgataatgttctcaaattgtgtacctcatctccaccgttgcacacaagatggatccagatttcagaaatccatgtttatgattgatccccttagcgtgttcctgtaaaggtgaaaaaactgtataaattgtgatgagaggatgtggaaatactgcacctcataactggcctacgctggttggtgttgtcatgtagctgctggctacttaacttagatggttttcgcactgttcacttcttttgtagcctctgctcttcctaggtgatgatgcctactgataactcttgcatttcagctaggctcattatcttcacacgtttcgtgtgtttgaacaaaatgttgttggacttctcaacaagtagatgtaactcaactaaacaaaagatggaaaaacattgggccttctctatgtgagggtcataaagaaaatttgtattggtctgttgtgtagcagatttttctagtcttggagagtggagacacagctattatagcagtgacaccaggttttccattgttgtacttgtatcacattaacatttctgtgattctcttttttcattgtaaacctgtagtacctgcttatgtaattgtattcttataggtagaagggtatgctatttcatattattggctgcttgtgcttgtaggttccaagtgaacagaagctaccatctctgtatctacttgacagtattgtcaaaaatattggaaaagattatgttaaacatttttctgcaagattacccgaggttagtaaataatcgttcttgctcttctaacttttttttttgttgacctgatagttgagatgaccagcttcatggaaaaataatgaatcctggtttctttctgtatgagatcaaccttagttttcttgggcggttccttgttattgtaggtgttctgcaaagcatataaacaggttgattcttccatacacaatagcatgagacacttatttggaacatggaaaggagtgttttccccaacttcactccaagtgattgagaaggaacttggctttcaatcatctactaatggatcatcaggcgctgcaccatcaaagcctgattctcaatccaatcgtccatcccacagcattcatgtgaacccaaaatatttggaagcaaggcagcagctccagcaaccaaataaggcaagccaacttctttttttttttttttgtagatgtagctattcaatgctcttgtcatcctgagtatcgtatcaagactgatagatattgctcccattgaaaaaatatagatatgttcatagcattgtaactgctgctttatactatcacatcactcgtgagattttttcacctcattctattctcccctcgttctgtacagggacaggggatactgggagctggggccaagactactacaatttccgattctggtgatgatattgagaggactagcaggacagctgttgatagaggtgcagggcggcggctggatgctttgaaccctaggactgtaagttcatcatttgatcattgagtaacataagtgcttagatgtatttactttgttatatatataatgcatatgttattatttgactttgatatgcagaatgtacagcgggcacaaagggacccttttagcaatcctattcatgaaaagcaagatagagatatgagggtccttggattctccaacatttcgcagcaggctgttgtgggaactggtcttgttcgtgcaaaacctaaaggccaagatggaagtggcggaccatattatactgctggagttggttcttctgaagaacagtttgacaggcgcagcaatttttatgcaaacaaggatgttagaccatcaggatctgtacgtttagatggtgcacttttgccaactcctgttagtaattctgataggattggtaggccgtcatccaacaaaagctggaagaattctgaggaagaagagtacatgtgggatgatgtacgttctcaaggagcagattatggaggtaccagttcaacaagaaaaagagaatggatacctgatgatggaaatgttggaagctttcaaagggttaaatgggcagaggcgggaggacctttggaccctgaccaacacaaattagatagcttccaaagatttggaaatgcgacgggtcaagatagaagaattacaccatatatggtatgtgaaaagaagacagtactataaaatcatattcaatacttgatagatacagcaagttaatttcttgtacctaatgttgttagatagtttgaactgctggttcgctctcaaatttgcaatttataatattgcctcaaaatcttaggttttacctgtataccatgctaaattttgatgacatatatacacatattccatctttgcactacttttggacaagattataatctgattgttttttcaattgttcaggatcatgaagagtaccttcatggtaagcacgaagtggaaccaagaattgatagggaaatgctcccggaaggacagccgttctcgtcatctcgtggttcctctctctggttatcccatgaaaaacctctcccagacattgtgtcagatcctaggatatcagcgttttccaatcagccagcggacaggcctaccatttatgctggtaccttgtcaacaagtatcacttcatctgtacctgttgggttgtcagcagcctatgctggacgatcaagcctagaaagtgcagcaacaagatcaactgagactataggacagcaaaagaatagatattggtcaacttcctcaccacctgtacagtcaccttctgcatcatttgcacgccagagttcccctagtcctgtagagcttgattactcttccaaaccattctcacagttgggtcaaaattctctggaagactataaccaaagaactcatgccttggctcaaaaccttgcactttctcagggcagacctaatctgctgggtgctccttcacatgcctcccagcagattgaaaagcacccttccttgctgcagtcaaagccacatctcaggacacttgatcaaccgcaggcaaactt

SEQ ID NO: 80790 - DNA, 1697 bp, Oryza sativa
  unsure (1)..(1697): unsure at all n locations
tttgcaggcggccccccgcacagtgttaaactgcccttcctaagggcggcaagggggccgcctgcaaaatggtagtagccggccgttaggaatgagctaacggctgtttgccacatcacaaaaatcgccctttgggagggcgatttttcccaaagggcggcgggcgactaattttgtaaaattttgaaacacaaaattagttttgtaaatattttaataaaaaaataaaaataaaaaaaattctccaagatgcaacgcactggcctgcctagttatgtgcatgctgtgtgggccgtaactcactctctccggaaggcccaaaccgcagctcaacgcttctctcctctctctctctctgcagcgcttccacgctgcactgccgtctgcagctgtgctcaggaggataaaattgcggaggggatccacagttccagccgcgtgtgacagcggcgtgcggttgccgcggcgtgctgctcgagccgctttacgactgatccgagcagctttttccggcgatcatgtcggacgcgcccgccaccggcggtggatttcccgcgcaggaataccccaccatcgaccccacctcgttcgacgtggtcctctgcggcaccggcctcccggagtccgtcctcgccgccgcctgagcgcgcgcagggaagacggtcctccacgtcgaccccaaccctttntacggctccctcttctcctccctccctctcccttccctcccctccttcctctccccctccccctccgacgaccccgccccctccccttccccctcctccgccgccgccgtcgatctccgccgccgcagcccgtactcggaggtggagacctcgggggcggtgcccgagccgtccaggcgcttcaccgccgacctggtgggccccaggctgctctactgcgccgacgaggccgtcgacctcctcctcaggtcagggggaagccaccatgtggagttcaagagcgtggaggggggaaccctcctctactgggacggcgatctctacccggtgccggactcgaggcaggccatcttcaaggacaccaccctccagctcagggagaagaacctactcttcaggttcttcaagcttgtgcaggcccacattgccgcgtcggctgccggcgccgccgcggcgggggaaggcgaggcctccggtaggctgcccgatgaggacctggacctccccttcgtcgaattcctcaagaggcagaatctttcgcccaagatgagagcgtaaggaggccagcctgaagctggttttagtgtactctatttttagcattggtgtctaagattagctttatgtgccttgttttcagggttgtcttgtatgcaattgccatggcggattatgatcaggatggtgtggagtcttgtgagaggttgttaacaacgagagagggagtcaagacaattgctctttactcctcatctattgggaggtcacttagctgcttgaacctttttcttgtgtatactttggagagacatttcttttatgaattgagcaatccacattcatatagccttgaatgagacatatagtctatgagtggggtcttaagataagtttctcgctgtgtccctaacattttatatctgtttatttcaattttaacaggtttgctaatgcagagggggctttcatttatcgtatgtataggcatggtgagttgcctcaagcttt

SEQ ID NO: 80791 - DNA, 638 bp, Oryza sativa
  unsure (1)..(638): unsure at all n locations
ggcttcaaggaaaggctgttatttttgtaatttattttatttgaactcttttctaaaacgactaggtgagtgcttctcaaacgactcggatgagacagtgcgtctcgtccggtcggagtatgtgcaatgcatcaatctttagaattgaaacagaattggcacccggccaacagcttttcaaacggccacccgggccaacaacttttcaaacggccacccgggcctagctgatcccgtcagctgctgatttttcaaacatcgaaccccttttcacaacagcaatttcacaagcagtagtcaaacaaaactacgctaggaaacacctcacatccgcccatgaccatgggcacggctgttcgaacagtttgttaacctctgcagagggggtacactttacccacacgacattactaacccggatcacccagctcgtggggatcagccacgtcgggagacctccaagctttcatgacaaggcatttcgaaagccgatacaggtttaccatatgccgacgagaggtgtccccaaggaaacccccaannaacccaaaaaaccccaagggggttttttaaagggggttccccccccagaccatactgtgccaggaagcccaggggtcctccccgacaccaccccg

SEQ ID NO: 80792 - DNA, 1550 bp, Oryza sativa
aatttgaatgatatctgattcaaatttgaatttcaagtcaaatattttctatatatagtatttctatacatctaaagtttatagacctaaagtttatagatccaaagtttataagtcaaaagtttacacacccgattcaaatttgaatttgaattatatctgattcaaatttgaatttaaattatatctgattcaaatttgaatttgaattcaaatattttctatatatagtatttctatacatctaaagtttatacacctaaagtttataaacccaaagtttataagtcaaaagtttacatacccgattcaaatttgaatttgaattcaaatattttttatatatagtatttctatacataaatttttctaacttttgttttttaaaaaaatttgtgtggtgtactgtagtagaaagagaagaaagggaggagtatagaggaggcggggccaaccgatcgctgcgcgatcgcccattagcctcccccgctcgtgggggccaaaaccgaaattttgttccgaaattgcaatcactggtcccatctcccatgcttagaaaaaaaaaaaaaggttgttaatagacagagcaaggactaaacgagttattgatatgtcaggaagtaaatatatggccgtgagtcttgtgacatattttgcctgggaataaatgctgttgcgatgcctcctcttcattatgtttcaagattttgcatttcgattcaatgtcatacccttggttgaaaggaatgtgcactagtgtttcaacaattcagtttcaattgctcatgcgataattctttccctcacaatccacttatattaagaaacaaaacaatgacacaactactggcatgtcgtgatgatcatacacacagtacttcattatttctaacttgacttgactgctggagaacccgaatagccataatgttttcatgaaagaggtagcaagtaaatcgataatttgagatgtaggaggttcttgaatgatgaaagaggtagcaagataaatggtccgccattcatgcttgatgtgttgtgtgtggagtggatgttgcagaatgacagtgaggctggcctactacagctggattcattctgctaagtcgcagccgcctccggcctccgggctcgccgccgccctctcttcccgccgctgtgcttgcatcccgtgtcgaccaccgagcttgcatcttgccaccgccgggctcacctctcgcactggtcactgcattcgaccctcgcaccagccgcagcctcactcgcgtcgtcgttgtttttgcttggtaaggcgtggtgcgacccaccttggtcgcttgccctgctgatacggccggcaatagggcggctgcatcggggaaaatcatccggatgccaccatccggcatctaaggggaatattcttctccgggccgccgtatcccgaccctgcccaccaaccaaacacacatgaaaaacacaaggctggctctacaatttcaagggtcctagagcaaacttgatgctgtaggcccttaatatgtgttttctatttacatatttttaaacca

SEQ ID NO: 80793 - DNA, 1672 bp, Oryza sativa
ccaacaactacaacaagtcaaagggttctaaccaagggaggaagatggagaatcttaggaaggcttttcaacaagtttgcgccgctttcgagccactaagtgatgtagatggtgaaagtggagatgatgataagggaaagaacgtctccgatgtttgcttcatggcgcgtggtgaatctgacatagagtatgaagataatgaggtgagtgcttttgaggaagctattaatattttgagtgctaaaaataaaaagtgtgagaagatgtataaaaaacaggaatttatcattgaatctcttaagtctgaaattgataggttaaaatctcttattcctaatgatgattgtgaaaattgtgaggttttaatgaatgagatttcaaaaattagagatgttaatgctgcacatgatttgaaaaatagatcttctcttgcttgttgttttgctttgcacacacgcactttggatgagttgtttttaacaaaaaagttgttgcaaaaatatcaaattgcttttcatgctagtttgatgtttaacatgatttctgctaaaatgttaaaacaacatgatgttttggattgctcaacatgtaatttgaataagatgaaactaaaagatgctttaggtcgtgttgagtatatggaagatgttgtgaaaaaaaatgaagtgctttcttgccataaatgtcgtaaaagcaaaggtgtcatggtagattgtgaaaattgtgctaatttggaaaaagaggtttcttatttgaaaaattccttgctaaaattttctgatggtaaaaagaacctcaatatgattttggatcaatcaaaggttagcacaaataaccgtggtttagattttgatccttatgctcataactctagtcatcctcctgtcgtgttaggtgttagtgctagaagtggtgagattttgattaaacctgatacaaataaaactgtgtttaaatctgctggtatcatgtctactatgagtgcatcttcttcaaaatccaatgttgtgcatgcaaaacctcctgtttctgcctgtgttgctaaaagttctagttctaacaatgcgtctaaacaacgtgaaaaatatacttgttctttttgtgtcaaagatggacatattgttgatttttgtttcagattagctcataaacagaaaaaggagagagagattgcttttgcaaaatcaaagtggcaaaagtcgggttttccctcgaggaaaccggtcagaccgcagtgggttccgcggtcagaccggcgaccggtcagaccggctgcagagcctcggtcagaccggacaccagtcaaactggcagtacagaggcggtcagaccggcccccggtcagaccggccactgtacttcggttagaccggcctcggaggaatttttctgaaagttctaaaattgattttgcacgtggatatatgcctattggatcttctggtcgtgtgtctcagtactggattcctaaatttttattatctaaccccagtactgaggcttcgacttctgcttgtgtgtaggctttggtggcaaggaaggagaacgtgtggatcgtggattccggttgttcgcggcacatgaccggtgataaaaattggttctcctccctcaaaaaggcatccaagactgaatcaattgtctttgctgatgcttctactagtgccgttgt

SEQ ID NO: 80794 - DNA, 10979 bp, Oryza sativa
cacgcggcgcacgcgcgcgggcggggttgggacgcggtgcacgcgcgcggctcgcggtggacgcggatgcggcgggaccacgcgcagcctcacggctcgcggtggaacgcgcgcacggggagggaccgactggggtcggctcgacccggtctaggctgagctggcgcctacgtggctgccacgcgggccggcgggaggtagacgacgacccggtcgcgaatggacggcgggtggcggcggcgagcggcggagcgaaccacggtgatacaggcaaaagcgagcacaccgggcggttgcacgggacgaggggagacgagccaacggctcggattcgccggaggttgctcgacggcggcggattgcggcggcggcaaccggcggcgagggaagagggaaacggcgacgaggccacgaggggccgattcccggcggtgagaccatctacgcggcttcgggaactcgacgctagcgtcgggttgggcggaactacgccgagcgaggccggcgacgagcgggtgctacggagctagggcggcgacggcagcgagcacacggcgagcgacggcaatggtcggggcggcgccggctaactacggggaggctactcgagctactaccgaaatctaaggggaggagatggagcgaggaggaagaacggagggaggcactaccgtgcgggacggggcgctgtgacgagaggccgacggcgcgggagtaatctctccggcctcgggccggggaagaggaagaagaaggcgcggccaaagtcttcttccgcgtccttgctcgtgccggctcctccgacacgcgcgatgacgatcggcgacggcgaaacagagggcggcaatggcgcggaggcgaaaatgagagagtttggagggggagggcttgggcttaaatgggcggcaatgtcggtttgggagaggggaaccgacattgaacggtcaaggcgcgagcgggcgctcggcgcttgtagccaaagcggcggcaggaggatgacgcccgcgaggaggaaaaaggggaaaaggagggggagaaaggggcttgcccctttgccgattcgggaaaaaagggggaggggagcgggagcgtcgcggcagagggaggaggggcgcggctccgtcccttggcggcttgcgcgcggagtggcgggggccgggcgatgacgacggcgatgacggggggacggcttggagcggagcggcgacattggcgacaggcgcgtgcagaggctgacggcggcggcgaccgggcggtcggccactcggcacgcgcgcgcggcttgcaacgggcggcgtccgcgcgggcgcgcgcgaacacggcccgcgggaagcggcagcgagggagcggtgagggaggacttggctcgccgcgggcggcttacgcgtgctggctcacggggccgagcggaggggcacagggcgcggctctcgcgctcgcgcgcggcgcgcgagggaggggcgctcggcgcggcgacgcgcgctcgcgcgcgcggcgcggggcggagcggagggagagagggagagagcgggggcgcgccggggaaagcgaaagggagagggagatgggccgggggagaggggaagatgggccaagggaaaatcggcccatcgaccctgggggaggcagaatggacttttgcggaggaatttgatttggagggattggattcggaattgaactcgacgatagatcggggattgagatcttgagatggcacggacactagacaacaagcaaagaaacaaatttcgcaattagggtttttaagagataattttcccgctaggcgccacgacggaacgggcgctacagaccaaccccctaacaagaatctcgaccccgagattcagcacctaagggagcagctccgggaactcggcgcggagaagatcttctcgctcccaggttgcctcatcttcagaatgattgctccattggaccttgtagaacttgatggtcttccttcgagtatgacgttctgcctcttcaagaaccttgatcggtctttccttataggtcagattcttttccagctcgatattacctagggggacttgctcttctggaactcgaagacatttctttagctgggatacgtggaacacgttgtgcacatctgcgagaccttcaggtaactcaagctgataagccacttcgccacgtctggcggttatgaggtaggggccgatgtagcggggtgctaacttgccggacatcccaaacctcctcataccacggaggggtgatacccgcaggtatacatgatctcctttttcgaactcaaggtcacgcgttcgattgtcagcgtaattcttctgacggttctgtgctgtcttcaaacgttctcgtatcagcttaacttgttcttctgctgacttgagtatgtcaggaccgaataccagcgcttcgcccacctcattccagcacaagggagtgcggcactttcttccgaacattgcctcgttcggcgacatctgaatgctggcctgatagctgttgttgtatgagaactcagcatacggcaaacaacgatcccaagtgccttcgaaatccagggcacacgcacgtagcatgtcttctaggatttggtttaccctttctgtctgaccatcggtctgcggatggtaggccgtactaaaatttagatcagttccgagagcttcatgcaactgcttccagaaccttgaggtgaactgagtgcctcgatctgacacaattttcttgggacagccaaatctacatacgacatgggtcatgtagagttctgctagtttctttccatcataggtggttttcactggcacgaaatgagctgatttcgtgagtcggtccacgattacccagatggagtcatacccgctgggggttcttggcaaaccggtgatgaaatccattccgatctcttcccatttccactcgggaatcagtaggggttgcagcagaccagctagcctctaatgttctgccttgactctttggcaaatgtcacacaaggctacgtattctgcgacatctcgcttcattccagcccaccagaagtatgccttgatatcttggtacatcttcgtacttcctgggtgaatggagtaggcggactcatgagcttcctttaggatgagatctcttaactccttcttggccggtacacagatgcgtggaccgcaccaaactgtgccttgatcgtctatggagaaattggtgtctttcttctcctgtattctttttatcaactcttttatcccttcgtcgtctttctgagcttcccggatttgcgactctagggtaggatgtactgtcaagctggcagggacacctgactgtaccacggtcagccttaacttctctaattctctgcacaggtgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgtgtgaaaatatacttaagacttttgtgatcggtgtatacttcacatctgttcccgattaaataatgcctccagatcttaagagcatgaaccacggctgccaactcgagatcatgggtgggataattaacttcatgaggcctgagctgcctggatgcataggccacaacctttcgttcctgcattaggacacatcctaagccttgtcttgatgcatcacagaagatctcgaaatcttttcggatatctggcaaggtgagaactggggcagtggtcaaccttttcttcatttcttgaaagctgtcttcacaagctgcagaccattgaaatttcttttccttctttaacagctcggtcataggtctggctagcttagagaatccttcgatgaatcttcgataatatccagctaagccaaggaaactgcgaatctctgacacattcttgggcgggttccaagcaagtacagcttcaaccttgctgggatctactttgacaccgttggaggagatcacgtgtccaagaaatgctactcggtctaaccagaattcgcattttgagaattttgcgaatagttgatggtccctgagcttttccattatcaacctcaggtgttcagcatgttcttccccgttcttagagtatatcaggatgtcatcgatgaataccacgacaaactggtccaggtattccataaagattttgttcattaagttcatgaagaatgctggagcattggtgagtccgaaggacataactgtgaactcatatagaccataacacgttgagaaagcggtcttcgggatatctgcagatctaattttcagttggtggtaacctgacctcaagtcaatttttgagaaaactcttgctcctttaagttgatcgaataaatcgtcaatccgtggcaacgggtacttgttctttatagttacttcatttagggctctatagtcgattaccattctctcagagccatcctttttcttaaccagaagcactggggctccccaagtggatgagctaggtcgcacataacctttactttccagctcttcgatttgtctcttaacttctgctaactcattagctgccattcggtagggtctttttgcaattggtgcggtgcctggcgccagttctatggcgaattcaatctctcggtctggtggcattctcgttaattcttccggaaatacgtcgggatattcacagactacgggcaccgactccaaggaggtgacttgtaaactggttagaatagaccgatttgcggtaggagtgttaggggtaaagcggacttgctttcctccaggtccttgcaaggtgatggacttttcggcacaatctatctgtcctttatgcttagccaaccaatccatccctaggatgatgtccatgctttgcgagtctaggactatcggtttggctaggaagtcaacttcctcaattctaaggttaacttccgggcatatttgagttgcccttatattcctcccaggggaatgtactatcatcggtacacgcaaattttgggttttccaaccatttcgtttcacaaaagcttgcgatatgaaagaatgagaagctcctgaatcaaacagaactattgcgggtacggagttgacagagaacatacccatcacaacgtctggagcatcctgagcggtttcagcttgaatgtgattcacacgtcctcgaccaaagtggttggaagcacgtgaactttgtccacttgcctgagagctaggacgagacagagctgccgctggagtaggagttctagcagtgctgccattagcatgccctgagttggtgttggtaggattctgaggacactgtcttgcatagtgacccatctggttgcaccggaaacactgaactgctgacggtccttgcggtgacttgaaagaggtaacactgtttggcgcagtattgccactaggggcacgctgctgtggctgaggtgccggtcggttcatctgaggacgaggggcgtagcctggctggcggttagcctgagtgaccgactggtggtattgcatggattgaccgtagcgagggcgaggtgtgcctcgggaagaatttccctgatggttagacttgcgtttcttgtattcttcggtagcctcttttctggcatcctcaagcagaagtgccttgttgatcatatgttgaaaagtggggaagacatgagcaagtaactggagtctcattccaactgcgatccctttcaagaatttcctgatcttcttcttatctgtgtccacttcttcaggggcgtgctgagctaacttgttgaactgacttaggtactcattgacactactgttgccttgcttaagtctgttgaattcttctttcttcatgtcaatagtgctttcaggcacatgagctgcacggaaagccgtagcaaactcatcccaagcaatgttagtgggttcagggtgtgcattgcagtaattctcccaccaatctgcagcaggtcctcttagcttgtgagaggcgtagagcgtcttctcaaccggagtacactgcactaagttgagttttctatcaacatctttcaaccaatcgtcagcctcgacgggctcgacggtctgagagaactctggcggacgtgacctcagaaaatctgtcagcttggatcaattgttgcccacgtgaaggtggccatttccatgcgcattatgctgaaaactggctatggctgtggttagtccttgcaagatttgtgtctgaactgccattatgtgttgcatgttgttttccacatgaggtggggaagggaggcgttcttctccagaattgtgactggtagtgcggtgagagcagtgagactgtcccatctctgcatcacgggaaactgtgcgatgcgagcggttgctgcggcggggttgctcaacctctgcgttgcgggaaacagtacggtgcaaacggttgctgtggtgtgactgctcattagccgactcatgattttcttctggctcaactctaccatcttcaaaaccaaagcgggctggtgcacgggctgcatggcgggggcggctagccatctaaactcccagaagagggcgaggtaagagtcagacaagcacttaggagggcaaggagcaaagtaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaacacacgcacgcactacctcgccacgactccaatagagttggcggcggaacaaaaggggcctaacacacggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacgggccgctggcggtgggggagctgggtggcggaaacggaacatggtggaagaaccaacaacacgcttccgcgcagtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtggcagaggcggcctgagtcccaggagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactagctgagactcgctgtacggacaagggtacctggcgtctgagtggccagaaggaaggcgtggaagctgccggaaggcggagcctccgagacggtggttgtagtcgtgggccaggcgatgaagcgcagtccaggagaggtcctggtacgcgatctggagagtgggcctggccacggtgaagtggtgtggacgaaggccggctccgtgtatacctccacgggggtaaaggtacacagagagctcacagtgagggggaacacggtccacggagtaccccgtgtactcgggacacgagaagccaaggaaacaggcgaggtcacgaagctgagcgacgtggtgaccctcaccaaaaccgtgggaactgaagctggcgctcactgccatctacaattttgaaagagggagaaagatcagtaaccattttagaaacaaactattgaaaataaagaaaacaaaagaaaccttagcttttcgcaagtagttttgaacttagtatccatagggtcgtcctaaacgtcgggtttcgccttagggccaagcctgtgctctgataccatctcttgtcacgccccgaactagttccgactggaactagcccgtgacgctccaaattaaccagtcccaggaaacagtgctggtatcacaggaagacagaatatcacagcaacagaagtctctttattatagagtagaagtgcagtcatgttgggctgcggacagatcccgagctcacaactgcattacaaaagggaaacggaagccaggacttggaccacacaacacaggcgcgacttgggaactaggccgaaaccataaaactcatcgtagccggcttgctcctggaagaactcctcatcagcaggatccgcttcatcttcttcagcaactgggggggattatttatacagagcaagggtgagtacgggagtactcagcaagccagggaaaataagtgtttattgcaggcttcaaggaaaggctgttatttttgcaatttattttatttgaactcttttctaaaacgactaggtgagtgcttctcaaacgactcggatgagacagtgcgtctcgtccggtcggagtatgtgcaatgcatcaatctttagaattgaaacaggattggcacccggccaacagcttttcaaacggccacccgggccaacaacttttcaaacggccacccgggcctagctgatcccgtcagctgctgatttttcaaacatcgaaccccttttcacaacagcaatttcacaagcagtagtcaaacaaaactacgctaggaaacacctcacatccgcccatgaccatgggcatggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccaacgagaggggtcccagaccaacaacaggttagttcccagaccatactgtgccaggaagcccaggggtcctccccgacaccaccccggcgaatccacatgtctctcggcatcaaggctcccctgataagctagttacttagccaggggtgtcccattccacccatgtggtcgtacttgtcttatgttcggatgaaattccaaggaaacggtccttaagtgcaagagcgggaaaccgtacacccggtacgttcccggtccgcggttttggaaattcatttaattcacaagcaccgacccaggtgtcgggttttccaagtcttttgtaaaactccagttttacccaagttgttactcagattttaagtttgaaggcgaccgtcgatactcgcacagagtgcacgaatatcgaggcgtaactgggtggttacaagggacatggtacagcaattaacaatggaaggatcaaatgcaacaagttaggtaggtccgccaatctgccttgcagacggaacaatagattaagtgcgatcctatcaatgcataatattttgcaagcaatctaattagatttcaaatataggctcaagatgttcaaaggtggcttgccttgctcgagatctggagcttgatcctcgaaatcctcgcactgcgggtcttcgggctccgaaactacacgcaaaacgggacaactcaacaaacggcagaaataaagccctattaatgacctctaagcgtgccattagatagatctcgagatttgagaaattttggaagttgaacggagtcaaacggatttacggttgggaagatattgaatttctaagattatcggatttttggtctaacggaaaaaggatttaattaaatcctttttggaaaagaaaaagaaaagaaaggagggagggaatatagacttttctcaggcggctagggtgcggcccaagagatttggggcggctcggccgagcttaacgggccggctggcccaagacggcccaagcgcgcgcgcgcgggagggaggagagagagggagccggtggaccgggctcaccacgcgtggtcccgggtgggacccgcttgtcagcggctcgactcaccgtgcggagggagcacgcggcgcacgcgcgcgggcggggttgggacgcggtgcacgcgcgcggctcgcggtggacgcggatgcggcgggcccacgcgcagcctcacggctcgcggtggaacgcgcgcacggggaggtaccaaccggggtcggctcgacccggtctaggctgagctggcgccgacgtggcgcctacgtggctgccacgcgggccggcaggaggtagacgacgacccggccgcgaatggacggcgggtggcggcggcgagcggcggagcgaaccacggtgatacaggcaaaagcgagcacaccgggcggttgcacgggacgaggggagacgagccaacggctcggattcgccggaggttgctcgacggcggcggattgcggcggcggcaaccggcggcgagggaagagggaaacggcgacgaggccacgaggggccgattcccggcggtgagaccatctacgcggcttcgggaactcgacgctagcgtcggattgggcggaactacgccgagcgaggccggcgacgagcgggtgctacggagctagggcggcgacggcagcgagcacacggcgagcgacggcaacggtcggggcggcgccggctaactacggggaggctactggagctactaccgaaatataaggggaggagatggagcgaggaggaagaacggagggaggcactaccgtgcgggacggggcgctgtgacgagaggccgacggcgcgggagtaatctctccggcctcgggccggggaagaggaagaagagggcgcggccgaagtcctcttccgcgtccttgctcgtgccggctcctccgacacgcgcgacgacgatcggcgactgcgaaacagagggcggcaatggcgcggaggcgaaaatgagagagtttggagggggagggcttgggcttaaatgggcagcaatgtcggtttgggagaggggaaccgacattgaacggtcaaggc

SEQ ID NO: 80795 - DNA, 69790 bp, Oryza sativa
  unsure (1)..(69790): unsure at all n locations
atggccattaactaggtctgtctaaattaaattagggtgggagtagatgattaaaagtgggagtgcgtctggcttgcttaacaagtcattgattagccgcgtgtatttatagccgtccacccggagcaaatgaaatcatcttttccttaattccccacttctccctcctcttcccctcgatcatctctcccttctaatcccacagggcggccatatctggggaactattctaattcctcgaggagatgttctctcatttacctaaaaaccatctaaacggttatacattcatacaacacataaatataactccacaaaatcttgagtccaaactcaactcatacgtcaagatattaaaaaaaagacaaattcagcctatgaatagtagggtactgtttatatctaaatttgtctttattgtttctcgatgtgtagatcgaatttaaacttgaattttggtggactagtaggtatcattatactatacattgtcaattttttttagaatttttcacaactatttgcatcaaatttgaaagaaaaaggtatacgaggggatatctcctcgaggaattagaatccgctcccccatatatgaactttagctgagaaatgcccaggggtcttccagctagctccacaaggtggtgggctagacgatctaagttcgaagcctcacccattctaattatttgatattagatccttccctaatatttatgtcatagatgaactttagcactgtggttatcgcctttttaaagttcatgcaattgttaaagctattaatcttagaaaatcttgtaaattcctaacattatacaattcaatttgtgcttcagtcacccacctcttccttctttcttctccggtaaactcctgggttcaaggtggatgtagggagaggaaaagaggggaaaatcgccaggcttaaagggatggatgtgggaggcggtggcccgacgatgggaagtggatataagcctgcgtttgcggcggggcaaattgaagcttgtgattaggaggcggcaactggtggtggcggatccagcgatgtgaaattgtcgaggctaggagactcaccaccaccaacttggggaagagtatagggagggggttacatgtgtcattgaccccttctggtcaaccggcgaggccgggaggcatcgtgtggaggtgcatgagctcacaactcactaattggggtgacgtagggagtgacgagaggggagaggaagggttagggctaaaggcacggtccataattatcaatatttgttaggtgttttatgtaaataccctaaagttaaatgtctcattgaaggggatagtcattttcaaagatcattctccaaactaaacatattgaaaaacgggtttgcccaaacctgacccatctagcccctcaaaccaaacatatacttaaaaaggttgggtcaacacatcatgagattgatgaaatcactatatatatctcacggttaatgtaacatatcaccaacatgaaataaaaattaattttgaccaacaatacacggagaaatccattcacattctacaaagcatttcttgtcactcaaatatatctatacttatcttagtaaaagatatgctaccatcatcccaactaccatacaaggcccacaaaaagtgagggaaggctttacatttttcctatatatccacacaatctaagatcctacatgcacatgaaaaatatgttagtcgacccttattataaaatttttcatcactccatgacatattagacaatagaaataacttcttttagaggctttaaaaacatatagaatgaactttttttttaaaaaaaaaagaagatccattgcaacaccacgggcattaggcattacgctagttgattaaaatttctaaaaaaatattatgttatatatcattgctctatgaaaatggaagactatatttgaatatttgatctacacgtttagaaagaacataaatctgggactatgaataaggtacatactttttaaaccaagttaatctgattttgggacaaataatttgtgggacagcatatactaagagaagccaatgcatatggtcaaagttattaaatactagagagatcatgtcaatcaattacgtactccctccatcttagattagtgtgctccttttaaactagagaagtatatttattttaggacgaaggagtctaatttcacccatatgttaaaatcaatttcttatggtctagcccgatgtaagtccgaaacataacatatgtgctcgtattttcttatgactttatctttgaactcttgccaggacgtgtcaacgtgggtgtgtagcgggcgtaaaagtgtggtacgtgcatgtgcactttttttaaaaaaaatgaagatggatgaagtaaatgtcagttaattacatttcagcgcatatccttctttgatttggtttgatatactttgggagttagggcacggtacgactcagagaaaggtgcttaaattgctacttgatatgttaatattaatttagaaacaagaataagttctagcatgatctgagatggatttgcatgcatcatattcagtgggcttaatctatcatgcctgcagcatctctgcatggtgcttgatcatcagtaattactaattattatcaacaattcgatatattggaatctgttttttattatatggaatgtactcccggacagaccacaaatgttgggcctagatttattgacactatatttattcagtgttgattcacactaaatttcgcactagcactataataataatacaataagaatatactgtatatatgggctaccgattgatcggtcattaatttagtgcttccaaattaaaatgcatgcgttctgtcctggatatctatctctagcaaagtagattagtagagtagcaaagcatatgcatatgcatgattttgcctcagctaggcttccgaccagacatgacttaaccatgacctaaccgcacgaaatattctacacatgcacgaattaagctccctgacttttttatatgccattcctagctgctgctactagctactccctccatcccaaaatataagcatttttagctatgaatctggacaaatgtaagcaggtacttccttcatctccaaaatataggccagttcccaaaaaaaattcccaaaaacatcacattaaatcttttaacatatgcatggagcattaaatatagattaaaaaactaattacacagtaaggtgggaaatcacgagacgaatcttttgagcctaattaatccataattagccataaatgctacagtaacccacatgtgctaatgatggattaattaagctcaaaatattcgtcttgcggtttccaggtgagttatgaaattagttcattcattcgtgtctgaaaatcccttccaacatccagtcaaacatcctacgtgacaccaaaaattttcttttcgcgaactaaactagcccatagtaatttttagcatttaaattctattttaaaaatatagttatttcgttacctaacatcttatctcaaccaattacaactatggctgatataaatttttcagctatttactctttttaatcaatcacgttatttcttatttagtctcacgtagtttcttagtacctatgttttgctttaaaaatacttatattttagcactgaggaagtagtagccacactggcatccacgccttgatcttttttagataatggaaatggattacatttccggcttctgtcataagacacacagccataagtttaatagtaataaaaaggtaatataaaagtaaatcaaaatgagaaataaggtgatgggacaaatccccaactcctctttattattgactagcgttaaaccacgtaaaatattttagctagcaattcttatggaactacgccacccatagtggaataagagatccttggctaccgattccaagagtgtagcaccattgcgcatagtatcctgctcctcctgtggtagcattgtagaccaaaagtggagccagtaggaagacatgaagataacctgcatagggttagataattgtttaccattaaaaactttatcattgcgacaatgccaaattgaccaacatacagcactagctccaattagaatcatcttcttaatggacctagttacccctctaagccaattaccgaaaatgtttttggcattacggggtgggggatattaaaagcaaaaagcacacatctccaaacaaactgagcgacatgacactcaaagaaaagatgttggattgtctcttgtgcatagcagaaagaacaatgtttgtctccccccattttcttttagccaggttatcttttgttagaattactttcttgtgaagaaaccacataaagaccttgatctttagtggaattttcaagtcccacagaattctctttttgatccgaacattacagttcatgatcgcggcatacatagatttgatggaaaattgaccattcttatggagcgaccatacaaagcagtccttttcatttgacagagttatattagctagcatgaggatcaaatcgttccactcgattagcttttggccaacaatagctcttctaaaagagatatttagcggcgttgtgctcatgacctctgcacagtagactgcttctttcgagccacattatataatgtagggtattgatctttgaaagcacgtgatcccaaccacgtgtcttcccaaaatcttatgtttgtcccattgccacatctaaaagaaccaaacctaagaaattggtctttgactttcattaaaccggcccagaactgagaaatacctatcttgctggacataccagaaagaggtttaccctttaagtatttatttcgcaaaaagtcttgccataggccttcaccattaaacaactggaaaagccatttgcttaataagcagctattttttatatcaaggttatggacacctaggtccaccttgatcttttggtcgacatatgttttcccacttagttagtctatattttcttttacggtcatcattactccaaaaaaaacatgacctaaagtaatccagtctttgaagcacacctcgtggaatttcaaagaaggataacataaacaagggaaggctcaaaagaactgagtttagaagggccaatctcccaccatatgacatgtttttgcctttccatgtgctgagtttcctctcaaatctatcttcaactcctttccaatcaacattccggagtttctgataatgaataggaataccaagatatctaaacgggaaagatccagaattacaaccaaatagttatctatattgatcctccacttccttggctttcccaaaacaaaaaatctcacttttatgaaagtttattttcagccctgagagctgttcgaacacacataggatggctttcatatttttggcctgttcaaggtcatgatctagaaaaattactgtatcatcagcatattgtagaatggacaaaccatcgtccactaaatatggaatgactcctctaatttgaccatcgcctttagctctctcaatgagaaccgctaacatatcaaccacaatattgaaaaatataggcgacattggatccccttgttgcaggcctttgtgcgtttgaaaattattacccaaatcatcattgacttttatacggacacttcctccttcaaccattttagaaatccaatgacaccattgctgagaaaatcccttcatgcgtagtgtttattagagaaattgccatttgactttatcataagccttttcaaaatcaattttgaaaataaccccatccacgccttgatctatcaaagtatcgatcgatccacagtgcttgattaattgaccgatgaatgcaaagacagccgtggcccgtacttgattaattgagctatacctatatgatagtgagcacagtgtaaattaagatgcttaaaatttacggcaaaaaaaaactatatgtactgcaggtacacacgcatggatactggatagatcactgccctgtacgactcgattggaatctgtattatctgcatggatgcaaattaagtcaaataatcgttcgctgctacgaatagtactagtagctaggtagcaattaaaaggtttcatgcctgcgatgcaccgtgactatattgtcttttgcaaccgatccatcgatctgatcgtgagttgaatacatatgcaaagtcatgtggttttgtcaccgactttttcatattcgttttacagagacctctcatgatcttacattcttaaaattccaaaattgcgtcgcagtggtcagctggtaattaagaacaataccgcatgtacaattgcaagatctgtcaaatgaaccaaacacacgtcgcaattaagtcctagattcaaatactattcgatagcgggggcagcgaatgaagatgggtctcttcaattgtgggagctttagatagatgcaatgcactgttcggtgacagacagactgacagagagtgatggtgcagcgcatacaatcttgtgtcaactgaattgaattggaatggatcgaatcgaattttgcaaggcacagattaggccctgtttagttcccaaaacaaaattttttacgttgtcacattaaatatttagacacatgcatggagtattaaatgtaggaaaaaaaaaccaattacatagattacatgcaaattacgagacgaatcttttaagcataattacactatgatttgacaatatggtgctacagtaaacatttgctaatgacagattaattaggcttaataaattcatctcgcggtttcttggcggaatctgtaatttattttgttattgaactacatttaatattttaaatgtgtgtccgtatatttaatgtaacaaccaaatccaaaaattttccccaaataaacaaggccttaatatcaattatcactgctatgttatcaggcagacagagagacaggctttaatattattattgatgggcaacaagttgagcaagttgtgtttatgctgtcggtcggacccatttcaaccaaagtgatgcatgtttgatagatatggaaagcagcccgttttggctatgtcaagtgtcccaaagatttgcttacttaatttcaccaatcatgcattcatgcatgcaccttcgtcatcgatccaagcattgtcctgccctgtcctgcaatctcgaagaccttgcttgttggggcatcaaaatcatctccccgtactcgaaaacacagcaaaatcaacagtcaccttatccaaacatttgtcctaacagtgatatagtacaaaaaagaaatacagaacaaactacaggtagacattttacctacctgcagtgcaggctgcatttgggttgggtgtcatatggtttgaaggaaggctgagctgacacaacccaggagcccatatatacaaatgtagttcttctggttcagcacccagaaaccacctactatgtgatacagtacgtacttttacaaccgaagcacatgcctttgccttccaaaagaaagttttgcaacttcaatcagtagcaaaaagatctgatgtaatcccttctgcagcacaccaacatgaacagctaagtttccgtttgccaatgcaaagggtacatactctttcttacccatataacttggcaaaatagtagcaagatctaatcatcctagttttcgttgcgctgaagctgctgagctccagcataagtaactccactgttactgccagctgcttgttgggacggcagggaaagaagcagaccttgctgtggtagctgagctccattattcaagtgaactaaattaactggtgggggtcggcccagcaatcctcgactaagctgaggagccactggcaactgaagcgataaactgtagccaaaaccagaagggataataacaaaaggtggcgttggcttgtgcgcacactgagtactagccttagcctgggtgggatgtcgatgtacaacctgaggagcttcagcagttgtagaattagcatgctggtctgatcctactaggtgcacagcatgctttccctttccgagcccatatctgctatctgggctcgtttgtggcttgcgttttctcttgccacgcttcaaacgaggtttactgactagctcatctggtttaaggcatccaaacagaagggtctttagctttgatgtatctagtttacccctcatgaaatctaacaagttcaaagcacaatctcgaagacatctgcaaatcttctgcatctcctttttcccaactgacctagcaaaattttgtgaccggtccaagaaatcttcaacctacatgaacaggagtaaaggaaaattcttgttgagggcataatacttaattcaaaacaaatcttacatttaaattgccaattcctttcttccaggtcttagagatccatgatgcttcaaagttgctagcgcatagcccatgctcccataagctctccgctgataatagctggagaacaaaaggccaactttgtgacttattagcgaccataataaactatcacacaatggtaattaaggtggtacaattttaaaacaagttcaagctaatacaagtgaccaaataattgtacacacaaaaatgttaattgcaatattggggaaaaaacgttgaaattaatagtgtgcaatgtatttttccgtgtaatgaaaatagctaaaagccccaaaagcacaaacaaacaaatacatcctgctagaacgggtacattatgagaatttctggacgagtattatcttgtttgggcttgcctaacccaaagttcttaaagaaaatgatacaaggagaatctgagttcaaaaggaacctaggcacagtaatgaacatttaaatgagtcaacaaatcacattattaataaggaaagtaacttaaacataaaagctatataaaagttatatcccaaaggaactcactttactgatcaacgatacaaacagttcagctacagtttctttatttgttctcccaaaccccttaaatgccaacgtattcctctcaacactttcaaaatctgaaccatctgcaaggaatctcatcatcagctcagagtgactcagttgctgccagcacatgaaaaaaaacaaagataaaaaattatttcaaaaaccttttaataaggcagataacgggggtaatattggaggatcccgggtctgcgctgcacattgcaccaatggtaagaagattcaacttatacttattcatataaaaaaggaaaagaagtattaaatgccaaatgtttgttttcttaagcatagatctagtgagttactagtaaaacacccagtttcataaagttcgatgcaacaaactccaaaacgaatgtgtaaaaagacttcatctgttcaattgaaattcaacataaacccctggcatcattccttgatattataaggatatgaaaaactttttagtgaaaatcctctttgtttgctagacatattgattcaaatccaatagttgaaacaaaatatgggaaaacaactaatcatcatataatagtcaaacagtgcattgtgaaatcctctgtacctgcaaatggaaagcaactaatgaaactattgacatggagctcagcgttcgctctctcgggctattcacatcatgtatcttagcccagaacttcaccttcaaacacaaaagaaaaaagaacattgttatcaccttgcatttgtatagtatatctttttttctcgggggaggggattacattaccaggtaacttagtatctgaaaccttggatcaagtgaagaaatgaacttaaagatcattgatcttgtcatgccatctttattttcaaccgtaatatcacactcaatcccagttccccgatcaataacattcacaataggcaccctagcagttacaacaggcagaaccccacagaaaattccattccctgaaaatgtgagtatattactgcagttggagatagatgggcttagaaagatgcataattatagcgggctatttttatgctttctctatttgaaaaaagaaaaaaaaaagtggccaggatggtccattagtgaagtatatcagtcggcacacccagtgactttgtaaagctccaattttcagataagctgatttgaactaattatcctatgattacttttgcagtgcgcttttttcacttttatgagatttagtagcaactgaggcttagtacatataaaccatctgcaatgttgtcagttttgatatcctttttttatccctgtatgagctatcgttgcaattggaagtaagatcagaaaaccaagtggcatgtcacaggaaacggggtcgaaggaagcattccttgacaccggggaatgccgtccccatcctggaaacgtgggtgcattttcattcccaccttataaaaacctctcacaagtagcataccacgttcctcgatcccatcgacctgggaactttgtgactcatgcaaaggagcctaatgataaaaattggtggacacacaaagtactagtgaatatttagagatactgtgctctaggcagtaattactttgatgagaatatagaactttggtgaacttcctaatagcagaaatttttttcttgcgagcatactgatcgtcagtattagcagtaaaattgacagagaggtccaggtcacttctaggggtaaataaatccattgtaaatgatccaaatgcctccacgactggaaacccattattgttacctgaaatgatttgttaaagaggatggccaatcagcatgctagagacaatgtttagcaactaatcaaactatcactttataaagagttgttttacagtcattgggaggtattgacagatatggaggcatattctagatttctagtggtaaacagtggccaagtagtgaagtagagtattgtgaagaacattagtataggatagtagatgaacattggtattagaaacgattacaggggtatgcaataagcagatgagtaaggaaatgaaagaaaaatgatgcctcttagcataccgaagatttggtttgctatgttgttgaagacatgaaccaaggtagtccgttgctcgtaatcaagtggttttgggcgcagcatagtatacacctgaagaagcaaattatcgagaataggaagaagagtgcgattgactgacagggctgccaactcctccgactcgagacattcggcatgcgcgcgtaacactgaagagaaacaggaaatcgaaattaaaaggagagctagcgcaaaatgcatggaagatgaatgggagcagcagctagtagcctagtaccgtaccttggggatcccatgcgcttacctcactgtcactggacctaggtggagcaccaacaatcaaatcaaagaggaaaacatatgagatccagtggagtatgatattcccagccccagcgagcgggaaggaataatacaggattggattggagtagaggacgccaactaactgtgtgctttcggaggaagatgatggcatggagaagaccgccggcggagatggtggcggggatcgagtagtgtcctctcctgtcatgtgggtcctacaagtcagtctcgctcactgctggaatactgactactcgcgcaactactcctgtcaactcctccgacgccccgccgcgctccccaacttgtcgcccccgcccccgcagaggaccggcggatgagcagggatcccgtaccacccgactaggccgctgggtgacgagcgacgagggatgacgggtggttgaggaatgggcgttgctaccaccgccgcccccgccggtgcgctgtccctggccgccgccgccgccgccgtccgtgcgtggccgccggtggactgggtggggtgggaaatgaaatgaggataacatgggctttttagactcgcgatatactagtagttattattagtctaatatacatcctccggggatccacgggtcaaccgcccccgatcctactcatgaccgggaaatcaacacgcacccggcaccccccggcctctttcctactgattaaatttaactgttagtagtacagtatttgataatcacgctgattagcgttaatccttagggttcttcctactacaaaacatgacagacagacagacagacaaccgtcgtcaatctagcaatctcatataccaattagagcaaggataataataatatagcacacttcctacttcctactattagcctatcttaaagctaacatatataataaattagctataagattgtctacaatttttttctcctctctctaggtatttatcttggagattgtgttaagttagctcttgcatgagagccaacctttacatctctcatccacactagctaattaaatcgtgcattcgcgcgaccatgacatgtccttttatgtattaaaattagaactaaatattgggatgtggatttttatttctcgagggaatatcctccactcattgcttgaaacatatcacttccaacaaattcgatttatacatatggccataaaatatgttgtatttacgaagggctaatttgagttgtttcagctttaatatacgtgcgtagatgccacatcaaactggttaattagctggtgaaaacagcggttttctttatcgttagttggaagaaaaaaaatcagcagtaatgcaggaggctgctacttttttccttggagatggccagcaggattgttgccacgtgtctgtgtttattgctctgtgttgggaaccagagaaacgatcacactcttctagatcattctcttgcctcttagcttttgatcaatccaagccatccctccttaatccaatgactaatataatattgtatacgtggctcaatggcagagggaataaacattctacgttcatatgatgatgatgatgataagcttataataggcttatagttcactgttatactttctcttaacgtgatcactccagtttcattcaacaagcgaggtctatgcgtattgtctgcatcaaaattacatgacaatgtgcaggtaggcgcatgcggccagcattttatgttgtactagacaggaacattagttccctcttactgtatcccatcaatcagtttgttcaaatgatcagttgtgaaatgaattagtagctgcctccggtaatcccagttcccaaacaaaacactttctgccaccccaaaaccatatattacaccaaggcagacaagcagggccccaatctaacaaaacaatggaactcatcagagacaagagacacacaagacaacacaggcatagggcatagctaaaattgaatataatcatacatccactaacacctacaagctctaagtaggaaaaagaaaagaaaaaaacatttcttcttctttatcttcctttctctctgtatctacatgatgaagtatgctcggatcacctcaattatgggtgcacggcacagcgggcatttccctccgcttcgaaccaactcattcgcgcattttgaacatgtgcacatgtgcccacatctgatagaaagtcaacaccccaacccccaacaaagaggcaaaacaaaccatcattagtactgttatactgtattagagaagaacaaactacatggacctattattcattatttcagaagaaaagcatgagttcaaacctgtacaaaagagagtcaatcggagtatcacagcatatacagcacgtcccttttctcacatggatccattttgatccatcgtctatagtttctttactttcacctgagataccaaatacaaagcttaggtacaagtctgagccaatgcgacaagcatctaagcatcaggcgttacaaaactgcatatgatgaaagtttattgtataccaaatttatcgttccatgatagatccaaactacctagctagataacaacttaggtcaaaattaacatagcttgaccgcacatctcccaggacttgacatgttattgactggaaggagtataatagcattcgttcttgaggaaccttattatcttagctaagtgacaatttgaattgtaaggcgcgcctcgcaaccttgacagtgtaagcactatgacgaagaaacaacatccacgtatcatataaatatactatgcatcaaagtgatacaccaagggataatcaaagattaatttcaatgctaaattttgttttgttagtgttgttaatagatgagtactttccagatgagttactaaccttgctccccgatgaagcgattcaaggctgcagaaacttcctgccttacagatcgctgtaactcgagctgcatgtccatacaagcttccaacattctttgcatatgactcatgccctgctgaagcctagccatatcagcccttaagtcattaatagcctcccattcctgcaaatacaaaccaaaagaaaatgagcctttaacaacaaatatagaagcaacagtgcactatgcatggaggatagagaggctgaatgtggcaacctaattttaaaaaaaagtgcaagtctcaattaaaaatggcatgttggcttggccattcagaaaaaaagaaattgtgcacttggaacgaactgaggaagatgaaaagctcacacatgtgacaagaataacataggtaataacttacaatatcagagcgatgtatgttttgtctgatccagttattacgatgcaactccgaatgccaaagtggctggcgaggaggtataggcggaggtggaatcactaagggaggcctaacaacattatcatgaagctcctgttcctcttcatctctatgctgctcctggctttgctcgggtgagtcaggcgcaggaggtgctccttccaaatcccaagagagaggagcacgaccttgcctttcaacatatgaccggataagtcggtccaaattttcacgaaaagcactatgaagaagattagaaacactccttctgcagaatgaacactaattcagtatttacgctgagaactaaagaaatatgttgcagagactttcttcatgaaagaaataaaaaaacctgcttaggagttcccttagttctgtactgtacacattatcatcatcagctgggacaaacgtattagctcttctaataagagcagaatcatgatcaattggttgatcagagttgtcatcatgccaattatctgcagtatcattggactcatcatcatcatgccactcttcatttactccttggaaatgatcatcgctgtgccactcgttgtgtacttctgtaggaataaatggattactgccctcattccactctccacgagattgttgaagatcactgtcatgcagctcttcattctcctcgggaagatggctattgtcctgctgttctccatgagattgaggaggaagattgtcactagctaactcatcatgtgattctggaatatgtgcatcttgaccaccttcaacttcggtaccctcatgagatgaaccattgtacgtattttcatgccaatttatttcagattcctctccagtaatagcatgggaaaattgttcccaatctcttctctcttgttccaaatcatcctgccaactctctgcttgactatgaggttcatacaggccttcagcaatactaggagtattgcttccagattcagatactgtcgctgtaccttcaatttgctgaagaccaatattcagccttgtccgttgatgtctctcgagattatattcagaagaagaagggcttgattcagtatggccatttatagagagctcaacattttgagctgaagaatcatcggattggctaactgcatgacccctgacgacgttctccaatctgaagcggaactcttctctagttattaaaaataataagtattgttattatattttatatcccacaaaacttaatgtatacaagtaaattatatccataagttggtttcaagatgatgtgctcaacaaaaaccatatgctctaatatccatatccagttgacaaggtcataattactcattagttgttcagatatagtctagaagctctaattgtacattaacataggtaatctgagaaaagatgcaacgtaaataagcaacatatagcaatggcggcatgaatagaaagaatgaagaggtctcataagaggtaacacatgcaaccaccgagcagctaaggatatactgacaatgaccttgtaggccaataatcacatgcattccagaagagaagtggaagacaagcagcagcagtagtgcagtagcaaaaagaaacacgcgaaggcagtgatagtatagcacaatggagtatgtatgtagtgggtagagagagacctcaaaccagagacagaatgacgctgtcgtagctggccgagctcggtggcggcggtggatggtggccttctgtcgtcgtcaccattgcgcagaaacctcccccggagtagtgcctggtaggggaatccgtagattagattagataggggcaaggcaaatggggtcaacaaacaatagaactaatggtatgggggattgggagcagggtacgtggattcggttgcggtgggggaagtcggagacggcgcggtggtgggagaggcggtggagctcggcgtgtcggtcggcggccatgcgcatgacgagctcgaggcgagcctggcggccgcggatccggaggcgggcgtggtcggggggcgggtcgtcgtcgcggtcgcggtcgcgggaggccatgtacatgtggagcgagatctgggcggggccggggtcgtcgggccagcggcgggcggcgcggcggacggcggaggcggaggcggggtcgggggagccctcgcggctggatccgtcccagtcccagtcgctgtcgctttggcggcgggtcatgaggcgtggcggcggcgggaggtcggccatcgtcggccgaggaggcgaggaggcatgggttcaggattcacaactcctccatttctgagtcttcctgacactgctggagacgacgaccaccacaatggattggatttggatacaccaacaacaacaacaagaagccgatgccctccggctccgacgaggagagtccactccaacccctagctaagcctaagcaaaggagtcccctctcccctcccctcccacccaaagcctctcgcctccgctccctccgattgctgtttttccgccctttcacttctttctgttttttttccctttgtaaataataataataaataaataagcaagacaaatattctggagggaaacaacattccaaatgcatcacattcatcatcattattgttattaacaattatatttgataataatccagaaacacttgtattatacaaagtgaacttattcttaaatattattattgatttatttgtgaaaagtccatgagatgcacatcatgcgcagcgtgcacgatcataaagtctaagagagtgcgatgattttgttcatggaataaatcctttgtacaaatctagagcttgtcaaacaacgacgactactagatagtatttcacaccgcatgataaattttactttggatcatcttttattgtcggtctagttatgtggcatttttgatcaacctcaactcttatctatttacatctaactttgtcatatgtcaagaaaaaaaatctacatacagttaggggagtttgttgacgtgttggaccactctcaattcttttatccatttaaatcgcaaacttatcatatgtcaaaaaaaactacatacacagaagcaagcgtacccaaggccattcgtatgcttgagaggagatacgagatggtccaaactaaaacaaaacacacaagatgattaaagaatagtttaaagcgatacatcggtgataaaaaaaggtggctcaaagtaaaaataactcttaatctaattaactactcaaaataacataatgactctttgcttttaacactatttggaatattgtgggatttgggatacacccccaaacatctttatagactatactcccttcgtcctcaaataaaatttgaatgagatgttatctaatacaatgaatctagatatatctcgatctagattcgttgtactagataatatctcatataatttttggttattttattttagaacgaagggagtacgtttactactaaaatattctccaaaatgttttttttaaaagaacagtgctcatactctatcgaataatcataagttatttttaaagaataatactcatcacaatgcgcattaacattgcttctctgcaatgcgcagagagggagagacggtaaataatcatgcttttctggaaaaaaaatgtaaagaaatgttatcattataactaacacggtttcagtgtagagcatcacaaaatacttctcctacctactatcactaaaaaacccatttttgttgctggatggcaacatagcaccatctgatcttggtagacgcaatattattcttactccctacttttatttcacatgcagagatttgagcttttcttaagagtagcgtgcaaattaaacatattccttctgttttttttatgaactaaggctgcgttctttcaggggagatagaggagattgtccctcgttttccgcacgcacgcttttcaaactactaaacggtgcgttttttacaaaaaatttctatataaaagttactttaaaaagtcatattaatctatttttaaaatttaaaatagttaatactcaattaatcatgcgctaatggctcacctcgttttgcgtatcttcccaatcttctctatctcctcctcaaacacagcctaactaacgtaatacattttgggatgtaggagatattgtttcaaccagaagtttaaaccatttatctgtatttttttatgtagacaagtagtatatctcctcctcaaacacagcctaactaacgtaatacattttgggatgtaggagatattgtttcaaccagaagtttaaaccatttatctgtatttttttatgtagacaagtagtagtagctccatactgaaactgttactcaatcagctcgtcagaaaccaaccaaaaaactataattcagtagtttttgctagcaacagtaacaagaagcataggatgattcagcacaagcatagatagtcatgcgatacgatcccgcaggatatgcaaaataacaggagcagcatcacaaattaacaaaaaaaaaagcttaatctcccaaaatgctctcataatacacgagtttggcagtagctctagctccttcctcgagcaagcaaggtagctggttcactagtggatcaatatttcaaaacaaaagaagatgttaagcaagttgggcaggagcttgttcagcgacaagcttactgcaaagactgacacttcttggtgcagatgctttcaggcagcgtaaggtaattcactggctccaagtttcagttcacagactaatccattgcaactcttcagtttgctcttcattgttttcagtgtcccaaccgtcaaacgcagctatatttctcttgctaaaatgaaggttttcaatcagctatatctctctgtctaaacgagagcttttcttctcgtaccacaataagacatcagcaaaatcagctatactttttgtgcgtataagagcatctacagctcattcaagaactttctctccagttgagaagacattccacaccactgtccctactatgtacaataccacagccacctgaaacacactatcccaagaacctggcagtccaaaaaagaaagttaagacgtaagagaaagttagcataaacacacattgatacatattccacaagaatgaacatgaaattcattattaaaatatggtctgtcctgtttgacatttctagagataccatgtttttcaacatccctacctttctgaagaatgtagccagtggcagcagtaccaaaaactcctgcaagcacgccagcagtgtttgacagtccaagaagtacaccctacatttttttgtaacattgtatcgttagctgatggatcaaagttaaaaagaagcaacttaacatcaatacagctagcagtaacactataatttctattgtgaactagggaattttggagcagtaacaatctatgtgagagcattactgcataacgtgggcctatgtcctggtgattcgaatatagcccagactgtgaaaaggcatcactcccctgccaaagaaattggatatcaagatcaacaagcattaaaagacaatagtcaatagatggttcagaagctaaatccatatgaatagcctttcagaagaatatcaaacctgactgcatgccatacacaatacagccatggctggagttcggactttgctcagcagtgtcaagaagagggctggtccaaggaaaccaatcgattgcatgatctacaaaatacatttcaaaagtatgtcaaaaccaaaagctcagcagtcagcacagctattcccagaagttcatacaggaaacagctattactgaagaatttaccttacgaacattcgttatggaaacccccctcccaacaagagtgtcagcaatccagccaccaatattcgcaaatatagccattgtcagccacggcaagacacacaaaagcccagattcagtaagattgaacttaagaacctggataagagcacctggtgagtacaaccaccaagaacaggatatgctaccattgtctgatatgggcagtgggtattaaattgtaagaacctggttgtagtatgtaggcatccatgttagaagaatgaaggttccccaattatggcaaaaatgtgatactattagagcccatactggaggctttgatagaattagcttccaaggtatggaggtgacgggctccttcaaggtgcttccacctagaatgtacctcttttcggctttgcttagttcgggatcttcactcggggagctgtgtgcctaattaagggtagacatgcactaccagttagcccttttttcaggggtaacggcaattagtcatgtaagaattaacaagaatgagcatctaagaaccaaatagtacggtcatttccagagttacttatgtggttaacataataaatgaaatgacttcaaaagcaaatttttaggttggaagctagtacatgaattgatttatcttacttttctttgccaaagtgcaaaccagacgcttccaagggacccgaatgcgtaaaaaacagatggccaaccgaatctgctgatcaagagaggtgaaaaggctaggccagtcactgaaccaaggtacattccactgtacactaatgcaagagatctgcttctctctgaaactggaacccatttggagagtatgttgttcatggctggcatggcaacaccctgttaaaccataatataacaaaattaatcacataaaggaaaggaaaagcatcagtgtaaaaactttgtttttttttatactcaatgaaagcaaactgagtggtactggcatttttcaccgagatacttgatgaccagttacttcaaaagcttaactttgcttaatttggaggagtatgacaggtgtttttgtgacagacaattgctccaagttagacagaatttccaccctcacatttgcttgcatttcattaaacctaatctagaggaaccattgtccggactattacgagaagtgtgtttatacaaacattccacttgatggtagtggcagtttgaattatagtagagagaggcacagatatctacctctcctatccccatgaaagcccgcatgacaagtaggaaaggaagtccaatctttgcagcaaggggtgtaagaactgtcgcaattgaccaccagacaaccccaaatcctagcaccaccttaccaccaaacctgtcggcccatatacctccaaggatctgcagtttagtatgaaatattagtcctcacaaaggacagattcaaatgtgagagaaactgacgcataaaaatccctggcttacaacagtaatgcacctgagtaagaaggtaaccccaaaagaaggaggactggattaggcctacagttgctggactccagccgaattctgatgacattggaaggatcgcgatactcatattaacctggcagaaggcagtaaagaaaacaggaggagagttataattaatgaccttacataaaaagaaaagaaaagaaaaaagaggtaattcaactgttgttatgaggtatatttggagaaaggaaagggcaactcacacggtccatgttgcacagaaggaaggaaaagaagcacaagagaacgactgtccatcgcttagggaactgctgccaccagggagaaatctcatttgtatctccaatgagaactgcctcggcgggaacatcagaagggctcaacggtgatcccgttatctcatactgctcggctttacagtcggcgcgtgttctgaccggaattttgtagtctggctggacacaagcagtgtccaaactagtgaagttgtcccatcttcttggttttagccaaccagtgtttattggatccgaagtgagaaagcattcaatccgccgcctcttgaggtttgcattgtaaaaccacctggtgaggtagtttgtagaagagtcaaccacaggctggtggaatcgggcagaaagttgaaatctttccattgaagtgctcctggaatagttagagacttggaaaatggtggtcctagtagtgagtcgactgaatttatctcgggtgggaggtgaggaacaggtgcacttgttgttttgtggtggatgctgctttcctgtaaaacccaaagggaagaatcaggttgacatttcgtgtaaatggccatggccggccctgcccttgattatagtcaacctgattacactgactagctagttagttatgatgttgggtatatataggcagttgatgaataaattggtcagtaatgttacaagcaattgaaggcagtaagcgtgtcatgttatacatagttatagggaatgagagagaaatgaatggagtcccgtaatagctagcagtgaatagtactactagtgtagaaaagaagttagtaatagtattacggacctgaggaggagagtggagaggcgaaggttctgctggagagcacggcccccatagccatggcctccgcctggtcagagcacaagaggatctctctctctcactcactcactcagctctgggggagctgctcccctctcgtgttgcataggaaggatcttgcttggcccctggagcctggaggaggagattgggggggaagacgatgagacgagaggaggacgtgtggtgtggataagcaagcaaaagtagagtagcctctcccttcttctcctcctctctctcctgttatttcgatttcttttttttctcccttttattgcaggatatagagatggctgtttctgttgggattctttccgactgaacaaaaacaaaaagcagagcgcgaaaatgaccttaactgaatgaaaagtaacacactagacacgtctcctgttgtgatgtccacatccccatctgctcttggacggaaggcgtgcttttctccacgtacgcacccaccccgccactccatagccgtccgatcgtctccactgccatgtggcccctggttaattggtcccaacccaaagtaggagtatcttgcatttgcatctccactcagattcagcagcgggaaccggaacaaaaacaagcaaggcaatgggtactacggaggaggaggaagattcgcatatgcttattactcactactagtatcatgttggtttgatgtacgtacgcacgcacaccagatggtagctgccatagttaagttaccacaatttactttacaggcactctctcaaacttcaacattacatagtatctctcattcagttcatgaatcaggtcaggtcaggtcaggtgatgagctcgatgctgtactcccacagcctcttggccagctccatgtcattgcctttctcactcgcctcgttcacattgctgtcactgaagtacttcccggacacacccttcacctgtgggtgcaatgcaacataacaagtggtggccgccccctgttcatttacaccacaaactcaccatcaccaacatattacattcaccatgaatttgatgcaccacccagctcccccctctagcccgccctatctagatcgtcaactaaattgcagataatgataagcacaatctggccatcatgcaatgctctctactcttaacctcaggattaatctgccatttcctatatctcacaaaatccaaacaaaaactggtgtactactaccataccagctagagaacattttgaaatgctcagttatcttgcattttgctttttctttagcacggctagatgtctgtaatagctgattcattgttccacccattgtcatgtaaagagtttttgtgtaatagcttttctgtaagggccaaaactagcatctccaacaaatagtgtatccattaaaacaaccagttgcatacaactgatttctatgaaagatttgctaaccattggcataaccacatataaagcgtagaatggagagaaggcccagaatattaaaaaaggtgcacaaccatacctgctgagcatttttaagcaccaatttaccaagtgtccgatggagaactgcatataacaaatataatattcatgagatcagttattacaacagaaaacaagctcttttaaccatgaaaaatctagttttaacccaccactgcagtcaagtaaaagcactagtatttcgtttcacagtatgtggttattttcttccttttggttgctatccttggtccttgctgctattttctttatggtgtggtaagtccataggtggcatgaattttcaagagattttgttttgttacatgtttcagttcaattattttgagttcatgagtgaaagatccctttagcttacaaaagcaggaatactaaatatctcctagagttcaattcaagtatattttaccatctaggatactgtggtgacgaagaaggttcgtgatgatagatccaggatgaagagaatttgcagttatgttgacaccctcatcctgttaaaccaatgatgatagtcaatacaaaacaaaactatgggacatgtacaaatttaaaatttatttcagaaaagtacaactattttatcaaaatatcggtttactgcaactttagttagacatttcaggaaactgcaacaacagtcaacagttgatggctttggcgtaaaactgcacctttatttgcctgacgagtatgggcccacctgtcaggtgaacattaaaaaatcatacagctacaggtcgggcccacatgtcagtcatatagtgggttaaagttacagtttatggttgaaatcatttgctatagtttgtagctttgtcaaatgcctaactaaaattgcagcgatgtgatagttttaacgaaatagttgtagttttatgaaatttactcaattcaaaatggacaacacctgaaataaagacaacgttcagttggccaatacctgacacgatgtgtttatctatcatgggtgtagatttcttactaaacagtgcaacagacagctagctggtgcaatttttagagtttagcagcaaattactagagatagaattcattgctggtgcttgtggaacaacgctcctgttggattacacgctaataaacatatctcaattgaaataactccaaatacagcgttgcaccaaaaaaaatatatctataactggcgacatgatctaagagaagagcaatgcgcaccttaaatctcctagcaagttcattcgcatgcaaaatgtttgcaagctttgactgcccatatgctccaatggagttgtacctgtacaacacaagattgaaccatatattagtacagtacaattcctttgaaggaagttaacaaggaaaagaaaaacaaagtgcataaaagttgcatactccgactcgtcatttatcttggcaaagcggatgccttcccgatatgcaaacctgtgcccctctgatgaaacattaacgattcttccttccacatttgattcacgagaggtctttttcattgtctccaagagaagatgagtcaaaagaaaatgacctgaaaattatgacaggagatacacattttaacgcaatgatacacagctctctccagcatgtttgagagaaaaagggacacattttaactcattggtatccgtaactatcataatgaattagaacattgaggaacaggtgaagtagaaaattgctatggactgttgaaataaatttgactaattagaaggatgcaaagtcttccttacttcttaaagaatatggctggaaaaacatttgcaacactacgtagtagttaatgagaagcttttaaatcagtgtaaccggtgcatgaagttcataccaacatggttagtggcaaattgcaactcgataccatcctttgagagagagaaaggagttgccatcacccctgcattgttgctgcaaacaaaaccaccaaccaatcaggaagtgtgatgagctataaaagaagcattctaataactacgcaaccaaacaagcatgaaacacagacacttgtcggtagtactaaatgtgatttttagggtattcataggaaggagctgtactatcatagtagtataattaacggcagcaagatataaatgaagatatccagtggctgcagaaaaattttgagcaccaaatgtaataaaacacaaacacatgcacaagtcatgccattgttcctggagttataccatttcatggttaaaacaagaaaccatacatttaacatgccctccctgatttttgcgctagaaaagagtaaagaaaagcataggaagagcttgttgtgaccttcagctagtaagattgtttacaataaaaacatggaaatcgtagctaacatgatagaagaaagtgttgtttacagtaaaaataggtccatgcggccgtagtagaagtaatatagcagtaggctagtcatatgtatccagcatgcaactagtactactcctacttgagaaagcaaaaaggaagttgtagtccctctgagagctgaatcataattccatgaaaatggcttccacccactcctggaattggagtatgtcttagcgtggggtagagatgcaggattgaatgtgtagagtatgatgttgcattgtccaaaaaaacaaggtgcaactgaggtagtatagtactagtagctgaatttagtgaaagcagcagtgagtagtgaatgcagtgcaggtaggtaggatactgctggtcctaactgaaaaatgagggaatttgtacttggcattgaaagaggagtactagtacatgaggatattgagggggaggcccttggcggcgaagtcggaggcgaaggcgcggacggagtccatggaggcgaggtcgagctccatgaggtcgagggaggcggcaggggcgtcggcgaggatggcgtcgcgcacgggctgcgcggcggcgaggttgcggacggccatgacgacgtgtgccccgcggatggcgaggacgcgagccgtctcggcgccgatgccgctggaggcgccggtgacgatggcggtgaggccggcggcggagagcccggcggtgacttggtcggcggtggaggcccacgagaagcccgagggcccactccgccggaacaaccaagaagacatcatcaatctctctctccgccgcgcaaccgcaagatgtgtgggtgggacaacgcagtcgctgttgcctcgtcctagtactgtctaccctagtcagtggactactcgtcacaagtcagcatcatcaccatcagcagccagactattgattttattatagaggacgtgcggattggatgagaaaatagttatggcacgcgagattttattacagaggacatacggattggatgagaaaatagtccagacacaaattttagggtaaaaaagtcaagatatgcgaatttgatgctaaaaaagtggcatacgaacaaattttatggtaaaaaaagtcaagatatgagaatttgatgctaaaaaagtggcatacgaagaatttgatggtaaattctctaaattctccacaaggagagcatccatccatcatcaattgacgaaccagaaccaaaaatgaaaaaaaaaacattgctcttgaattgctattcttcagtcatcgtcgatcaaacgaaacaaaatacgccttacaataaaaacataagaaacggagggagcagtaaataccccatttactcctgatatgatatgatggagtatattacaattacatacatgcaacccaaaaccaaaaccaaaaccagcacaacattcactaatcttgtccatgtttgcaacgaatccaatgttaacgcacgcaccggctgtcatatcatataactataactgtatatataaacaaataaattcaatgttcatgaaccccggctgtcatctactccaaaccaaattaaaatgcagcttaattccctgctcgtctaacaaaaagccatcacttcatttcctacggagtagtgcccacacgccaggaacccccctctgccaacttcactagttctagtaactccgattggttgatgatgcagactcaacccttgctacttcgccggctcaacaggatcccacgttacttgcttcagccttcagggcacaggacaagcttcacatgatctgcgtttattgcttccttccatcctacaaaaacagtacatgaccatgattccagctaaacaaggagatgtacttataagtttgatcaaccttttatacggtatgcgagtggataaacagtagtaatggaaaaaaagaaagggtgaccatcagcaccaattggaaaaagaagtggaacagccactagcaattaacaaatataaaaatgcgcaacaaccaccagcaattgaaagagtgcaagaaccagaaagataattactttgagaaaggaaggcagctgcttctttactggaaaagatggcgcctcgtaagcctccaccctctgccaaccctgcattgcagcagcttgaacaattgtttccatctgtcataacgccggatgaagaatgatcctgtgctgttggagtaatactaacttcaacatcattatgagcattgtatccgtttccctcttctccatggttaaatggctgcatcaccttcgttacaggatggttgccaatattcaattgagaagcaggagtcgggtattccttggaatattggttatcctccaagcattcgctgccgtcttcaatggcaacacttatggatcctattaatacacgagacttcttgttcagaacaatctcttgcccatcatctatattcaactcatcttttgggctgtgctcttcaatctcagttcgcactttccatgtccatgttttgtttctatttgacactgcaccggcatttgcacccctgtaatgtgaatgccttactgaagctggatgctttgaaccaattgcagaaccaccagaggcaaagctattttgggcaaagttttctgttcttcctacacgatgtcttgaaaagacttgttgattcaaagtaacacttggattcacttcatggcctggatcatgaatgtcatgttctacaggtaggtcagcaaaactactattatcttccgaagccactggcgttggcaactgtgtatcttcttgctcataaaggccaggatccgaagtggcttccttcagacttagtattccagaagaatctgttgtcccatccacagatccaggaaaacggtctgtgacatcctcatccttcaagtctttcaatctctgttctttctgcctcagtttcttcatccgtttcctttctatcagttcagcttgccttcaagatacagatgatgatgttgaattaaatgattttgcattgatacaaacaataagctggtaaatagtgctttccagcttttagaaattgcaatcatccatggtattaagcactaaccttttctgagcagcttcctcttcctccacgagcaacttctggcatcttaatgcttcagcagccttatcagcagaccatgcttcgacctgatgttttatgtacagccactataaaaactgaatgtaaatgcatatcatattttgcaaattgtagtgaaatcttaccagtgtttgttcaagcatataactagtgcatgcaacagcatttttcaactcaggtgcaactttgtcagcctccccgttaaatataaacttttgtatacaggcggttgggttagtagagagaaacgtattctcacttgcttcgtcaagcatgctaaatagttcattcgatgatacaggtaaccttgaagctgttgtttcaattaggtcctatagcgggtaaaatgaagcttagatatgagactaataataggtttatatggtagagcaggataatttaggtcaaaaaccttaccagaagttgattgccagctctggcatatggcagcggtaatgaagcataccccggcttacacatccatgtggacagtgctgctaaaatggaaggaccagtgacaccctgaaaatgtattcacattccaactttagatcactgtttatgatcaacacactgatccagagacattattgcacatattttctggagttacctctatatccacatctgccaaggacaaaattgttttggcctgatccaacgtaagctgaagagcgtgacaaataaattcaatgctatgagaaacagttaaagtccagcgcatgattaattattatgtcatctatataaggagttgttactcaacatgcatgcatatggactagtatagatgcacatgcacttcatggtgtcaagataacaaaaacagaaactagacagtgaaaaatgcatgctggcggtagagtattcttcacgtgaaaagtacggaagcatttaatagtcaacaaagcttcaatcagtgaaaacattactcaatttaataaataatattgcgattgaacttaatagaggaagatggtgatgttatgatgggcatttcattcaagaataacttactttgtcccagaatgcagcaatattgtctctgttcttcaggaaatcctacagaacatcgacaaatgtcactgcttgcaatgaatgactgaatggtaacagggaatagcttaaatactagaaacgaagtttaatatagtatttagttgtactgacaagtccatgtacatataatcattttgtatgaacaccttttctatccgaatcccccgataaatgtaatcttagccaaaacaaaaaagggaagagataaaagaggaaccttttcaatttggagagttcggcggtgaacacgggtatggcgcctgtagttgattgaggagcaaaattccctgggacacttggtacacttttgcaactgaagcttaggaggcgaaaacaatggccatccaggaagatctgcgacaggggaggacctaacgttgggcattgctgaacccgaagaaattgccactgttagcaatatacacgcaatctgtcaaaggaagaaatcgagaagaaaccaatccaaatccggatgtgttgttgaggagggagggagggaggagggggggatttcgggagaggaatgaatgaatataccttggattggattggaaccgaagatgagaggcggcggcggcggcgcaggaggaagggaagggaagggaagggaagggaggatcgatcggaaattcggtttgcagatgggatgggtacagaacagtaccctagaaccaaccaaccccaaatgaaccgcaagggcttcttggtcaattctcccttctctcaattgaattgaaattataataatttctcagtaggaaccacattttcttttaaaaatattgtatatatctttgtttttttaaaaagctaggtttgtttcagtttaaaattattataatttagttttttgagctagattactataagctactcccttcgtccaaaaaaaaaaggcaaaccctagctattttttggacggagggagtagattataataagatgtgagctgtttttatttctatagattattggatgcatggaggctaatgtctataatactctcatctattttggatatcttgtgtaactgtatataacaagtatataatatgaagtagctaaaaaatatattaataaataaaacattcatgaatatttttatttgtataataggctgaacacgaaatattatctcttagcaaataaagcatcaataatactatcccgaaggagctggatttgcgcgcagctagggagggaggacacgaatgtgtgcatgatcggagaagaaagggaatgcacactcggctagggaaagagccatctccataatcgggaaaggaagggaatgcgcgctggactagggaaggaagggaatgtgcgctcggacagggaaagaggtatctcgatctgtttggttctcgcagtggtgggtaatttacgtaaagtttttaggggtaatgggtcttttgtcacccaataatctataaaaaaaacacctttagaggagattatcatattataccaatatagcttatattttataataatctatctggtttgttttagattactccaaataatttaaatcattataatcctaagctaaatcaaacatggcctaaatttaaactttcaagtttcggtcaaagctaattagttgtacgagtgcgttaaaattatattgacatttttaaatgttttcacttagggcctcatcttttcgtttatgcttatgtttatcagttaaaatttgaatttttaaccttaaatttggagctgattttgaggttttttcatcaaatattatttttcagcctttacttttagatcgctaagaacacatatataaaagttttattcacaaattacttttcatttgcaaatatgtcgttcctcttattctgtgaataagcgaaacgatggctccgtcaatgttactactagctattaaaaaaatatttattaaaagagtaatatgtaatagttttaaatcaaaatatgtgttctaaaaccttataaatatttaagttatgatattttgttgcatgctaagtatggtagtacaatttccatccttcaaagcataatgatcttttttttaaataaaataaatcaaagttggaaaataaaagcactggtcaacagtgacaggtaaataggagcatattgatgcatacattgatacatatggcaatcttgaagatgaaaaattggagcaaccattataatgctaaaataattacattgacagtagtacaaaacaggttatttgacactttgactgttgactaccgtagaccccctatccttatgtacatgcacaggcaacatgcatactgaaaagtagctagctactcctagtttttcttaaaagaaaaaagaaaaagaaaaagaaaaaaatacgcctatactgtaggagtagtaattactatcgacggctaggttgcatgaatagaaatagaagtccatttccgagatttagatggtgaatttgccatgcggagcataatgtcaagcgacctccactcagcgtcgcacgtgattgccggtcgccgcttcctctccaggctgcagcagcgcagcgccaggcggagcagcttctcggcctgcacctccggccagctcccggcggaggcgtccagcacggagtggacggcgtccatcttgagggcctcgcgcacctggtcggcgatgttgaggtcgagcagtccggtgagcacctggaggacgacgacgccgaaggcgtagacgtcggactcggcggtgagctcgccggtgacgaagaagacggggtccatgtagccggtggtgcccatggggttggtgcggcggcagatggtgtccgcctggtcctgcagcggcttgacgtgcaccgcgcgcgccgtgccgaagtcgccgaggcggctggagttggcggcgtcgaggaggatgttggtgagcttgaggtcggcgtggatgatggcgtgggggcggcaggaatggaggtaggccagcgcggaacgctgctcgccgaggatcctcacgcgatccttccatgacagactcttggagttggagaggatgtccaagagggtgccattgggcaggtgctcgtacaccagcccgcatgactccgggcacacgcccatgagcctcactatgtgtggatgctccattctactcagcaccacaacctgcaatcatcccatgcattctatataatacaactgcttccttcttcagtaaactaactacttaatgttaatgacataggaggaggagtatatatatatttacctcctgcttgtactctggaaatccttgcctgccatggggtctcagcagcttgatggccactgccacgccacccagttttcccttgtacactggcccatagcctccttcacctatcaggtttcctgagcagaagttgcccgttgctttactgatcatcgacatggagaaccgtgagatatgttgtggaagttgcagctctgggtatcttcctgttgatagcctcttctccttcttcagtgaagcagcagcagccttttgcctaggtgacaagatgctcctatcatcctcttcttgcagctctttcagtttcctttggagtttgtctatttcttcctgccaacaacaatgtgaagcattcatcacatatacaaacttctccaagaaatcaataaataaattcaaatgattctgtgtttttatgtccatgcttagataggccctgctgtttctgatttcataactggaatataagctagagaaatgaagcatatatgcaacttttaccatcagttcttcagctctttcagttgtacttctaaaactctgtatctcatcagttctatgagcagtctctccggaagagtgctccccctcctcctcataagaatttagttcccctgtttctatgctttcctcatcctttgtttcggtttcctgcacatcacactacagaaagcaaatcagctcttctctttatttatgaacactgcagctttcacaaatcacaagttgtaacaccacaacatttttaccaaatatagttactgtgaaaaccaaccttattacacgcagtgtgaacctaaattatcaatctttcctgttgtgtgggcaaacttgaaaaaacatgcataagttttcaccactagcgctcatgctctaataattatcttatgggtttcatctatccattatctaaaaaaatgttgtaataattgtcttgaaagtaaaattaaggaaaatagccataccgttgccaattcatcagcaccatccatttgaataaccccatcatcatacatgatttcatctgcctaaagtgaaacatattcgagaatacatcagaaattagtattcgaaatctgaaccaagatcatagactgcatgcatttgtttagtgctttgctaggaagccgcttacaaaatcacttggtggtgttgtgtagccatttgaatcatcgctcagctcatgtacagatgccaaagattcagcgctccctccatatccaatgctcccggtatgttccagatgatcattgctgcattttagaatgatctcatccatgaacttgttgctagatttgatccaatattgctgcaggtgttgattatagattttggagaatatctcaaactatacctagtacacatgtgttttccattgataaccacccaaacctgacagcatttgcgcagcatcgcttcctttgacatgctcctgcataataccctggtttagcatgcgcatggagtaatatatgccaatagagaaatggatctcttttgaaagaaggaatggaaattcaaaatgtagaatttgggatcttaccttgaaccaatgataattctcttaattttgagcttctttatcagattcacaacaccagcaagaacatcatcgtgtgaaaggtaatgtgccctaacctgtacggacagcctgcttagataacatgatttctttttcttttcttttttttggccaaatagtaactatcccaccacacttatattttattggttcaactgtcaatatcgttgaagtcaattattcaccatatggtaggaagctcattcattgcatatttggggttcaaatagtagacctaaggcaaaattctagtatttacaactagaactcatttccacgcttttttaggaaggactgcagaaaacattcttatgtactccatagtagtttatgaatttgctatatgcttacaaataagaaaccctgaaaatctcatagaattaatatctgatttatacttgtcagatgagtgggatgcttaaataagcactgcttaatcggactcacatgattcaaactaagaaccgaaggataattagtatcacctttcttgatccacaaaggtttttgtattgtgacaacatcttgaccatcgcatccgtttctttggctcgatgcatctccttctccttttcatctgcaaacttatatagaactttgccacccactgcagttgttggaaaggagcaaagtattgttcatacagcacatgacaatcaggacacgctatgctgttagtttttacgttcatcaagaaaaactattttatggcaatttattatacttccatttcgcagaataacaagagtgtatgaaagccagcgttttacacatgggaaatcacaagtaataggaattaggcatcttccttttactctactgataggaagactaggatgcacataaactaagatggtcatgaatattaaatcaacaaatcatcttttatcgggtacaagatcacctatcgtactgtcaacaaatttccccccttttttaggattgaatggtgtagcgctttctttttaacacagttgaaagataaattgcattggcttatggaaataaatttgtctgaagaagtatgaagatcttactgaagggcatccacttggaaggccagtgaacatgaacaagaactatagtggcccttgggaaccttgcagcagcccataagatgttagccttctcctttctgaagttcttcccaaccgcaatatgaatctcttcctcatccatcttttcttgccctcttctacatcaggaactaaaatcaaattgtggttctgatcttgtcaatatatctggttcagcagcagaagcaagcaaggcttgaaaggaagaaggtaagagtatatctgaacttgatccagaagaaagggaagctaaagtaccttattgtggtgcaccacttttcatcaacttcacttcatggtggtatctgtatcaataccatcaacttcatggtattcttaaaactagaaagtatcagttgaaagaagggccaaaggtggggagagacagccgggggttttaaagcttgtttaccatggtctgaggtttcaacagcttgatggtatccagcagcagtatcaggctgtgggtcccaaaatgcaatccaatcaggaaattataccacttccaacttggcagtattgttttgccctctcagtattcagtagccactaactcctgctgcatacttggtttgcgaaacggcaggttcatttagatcatcaactgcaaatgattttacaagttgcataggagagactgtaatctcatcaatgtttctattcaatttgaatttttaagctaaaatcatcatttttacaaatcttttgtaattaatggcttgtctgtttgttcatcagatagaaacaagaacgaatggtattgttccagctgagggttccgagttttccaagaaatttctgtccaagacgctgtcgtacatgtttgtccttgatcgacgactgactttggaagattagcagtgaagtcttgtatatatctccccggccggtcggcaatataatgcagctaaacacgttattttcaagttgcagaagaattgattagtcgtcattggattggatgcaagctttgaattctggtgtgcatttgctgaatacctgaatggttattcgacatttggccctcatccttctctttccctggacgttgctttcacagaattcttgctccccaggctgtcaatatagtaatgcaaatgaagacatgtcattaaagcgatatgaacagcatataccagaatcattctttctttctaccactgaacaaatcaagtgcatgcgttaagattgaggtttgcattgtaatctccacatcaaggaggcgcagtttcttccagatttctgacttcagaagatcccagttgattcatcacacattattcttactgtaactctttaagcagcaatttggtccgacattgcacctttttataatttttcggcgaattgcatatgcaaggaactttgacaaatttaagcactggacgcatatttcaaaaagaaggttttgtcctactcgatgactttgtgtcatcagcatacctaaccagctagcttttgcacaattcaaactttcaggttagacatcgtggcacaggaaacagtatataatcagaatggttacaacacgtaagcatgataacattataaatggtgaaattctgatctgatagttctattcatacatgtatttccacttccatacactctagctgagcatttttttggctattgctcagatatcacaactctctactacactgacaaagtgacaagtgactacctgtacaatgtctaccatgctactgatggagcagagatagctccgaatttattatattttttacatacaggttttgctaaaaaaaagaaaagaaaagaacaaccgtgtgtatacctttaattagtcattccttcagaacaaaaaaagacacaagacgtttggtttcctgtggtttctgcttattaaccctggtctgagatgtatcttcagaagatatatgacataattttcattgttactttccatgatgagaatccaaacatattaatctgcatttgactgaagccattcttgaattgcagaacggagggcatggttcggcaaaagatcacggtgtggtagatcgaggtttgtcatgggtgatgtatagtgaccactatcaaaccactctcttatagcctctgcttcgtaggtgaaaccatctgcagcaattaaagggtccctcatgacatcctgcaatgcataaaatgcacaggtgaaccaagggagaagaaaactgattatctttccttaggtaacacacaaaaaatttggtgtgtcattgcatcagggttgagaaacacacatacaaacagtagtttacaatggtcatttcattagtaacaagaactgagagctcccataacttgaagttcacagagatgtttgcagaactgatatctcaactgctgtccaggcaaacaattgactgactttctctaaaattactaagaatcatactaaatggaaacagaagctcaggagtaatttggagttaatcaaataacatcaggaatcataaatggaagcagaagcgcaagaggaatttaaatccaatcaaatgtcaccctttgatttctcttattgtatacaaaaaatatttcatctagttatcctttagagactagtatattaaaaaaaatagaaatggatatcattacatagacggaccaattaccaaacatgagagtctgaaggaaatcatggtgaggaaatacttttgagagaagggggagtaataatcactaagtaaagtatatatgactaacctgttgtattggacagatgaagtaggatggcacattaccaaagtcttcagatactgatttaaatgataatgaacatagcatagaggaagcagacctcaacattggttcaagtactgtccaaacctctgtttgcaggtcaggacggttttttcttctgatttcacagcatcttaggcctacccgagacaactgctcagcatgcataagaggccagtctccagctgatgaatccaatattgcttgcaagcaaccctttgctactgcccgttgcacatctttcaaaagaccaaatcctgatcttccagtcaagagtcgcaggagtatgataccaaaagaatatacatcagataggggtgtcagatcaccagaaatagcgtattcaggatcaatgtacacaaaagttccttttgggtgggtatggcggtatagagtggttgtggccttgaattcatcagttaacattcggcacacaccaaaaccactaagcttagccacattatttccatcaagaagaatgttagatgctttcaagtcactgtgaacaatgctgtggggtttattggaatggagaaaaatcagtgcagaacaaatattggaagcgatgcgggtacgcaactgccaactaagaggctttgaattgtccttgcaagccaagcggtcatctaagcttccattgggcatgtattcatagacaagagctcgggcatccttgcatgcccctataagagttacaagattcggatgtcgcaccctgctaaggatttccacctgtaaattatcagcaagaacaacttaactgtctgaaatacaacagtttatttggaccaacaaaatgtcaatcaagtttatagaaggtaagtatataactagaacaaaaacttttacctcatgactgaactgtgacagtgactctgtgctttcaggattcaacttctttacagccacatttgtttgccgaagaagtcccttatatacacttccataaacactttccccaaccttcgatgagtgatcaaagttgctggttgcctccttaatctctgatatcgatagctctgtaatgggaattgttctatccgcaattgcagtagactctccattttttacacgtattgcttctgcctctcttactgctttgtcacgctgcaacataagatccttgataatacggtcagaatgggcgcttcgcttctctaggaccaatatcttctcacattgctcttgaaattttgcagcaagttcatcagctgttcttgcaagcctgtcaacttcctccattgttgttgccaattttacctctatttcattcttttgcttcagttctccaaagtacaaattctctgatacctgcacctgttggtgatattaaatgtgagaccaaggattttgtttaaatctgtaggtatcacttatccaaaacatcatttccagatttatactccacgatatagagtataacaatcatgaaagttttttacatggacagtacgaagaatttctctgctctcattggcatgcagccatattatcattagaataaccattaagtatagcacacattatatgagagataaatataattaatctattcttactttctggagagcctcaaataactcctgctctgctttctcacgcctacatttctcctcataagcttcttgtcttactctctctaactgcatgggtatatgctggagctcattgtcagactcaccacgctctttagtatcttcctgcataagattgggtagcttattcatgcatcaaaatttgtgagagcactgccattaagatattagagagctcccaaaattcaaaggaaaactagataagatgatcaaaagtacaaactggtgagctattagacaaaatggcataccatgtaatgatcctctaacttatgtatgtatcaagcaaatgctccatcatggatccatttcaagtgaggatgcaatgtggacagatcaattagtgatcttaatcagatccaacatcgacgtaattgtgcttaccttttccttatcagagtatctgtctgaactagttgtctcgatatgtggttcgaggtttagtttgtgtagccatgtgtttgaaacacaccaaatctctgacaagctactcgatctctccactgaacattgtgcagaagtagcactttgcctacagtcctgcatcacatcatggccaaagggagcagccttcctagtgtagagaatacaaaggaagagaacatagtaaatgcaaatggatgcaggctggaaagtccgtaatgtaggaacaaagtgaagtgtatgatcagcttacaaccatacctacagtataccagtgtgcctttgcaaatgaaccatattttgcagaaatgatctgcatgctgttctacaactcgtgctttcctggatttcagaaccttcattttcctgaactcttgaaacaaggagttaggttttagagaattaatagggcaaagattactatttagattttagaacgtactgaagcagtacaaacactaagtttgcttcccagaaaaccaaggtgcaagcaattagtgttaacatttaattatcttgaagaatttatttagctaagtagacaaaaaccaacacttctcccaagcatggttccttactagcatccactgtgatcacagtgtttcatcatagttactactactacggataaaaatgcataaaagtattccaagctttggcacatgcgtactttgtatagtgcttatcatctgcggcccccattacaagcatggaaacattatgctcagagatgacgtccaccaatccgtatgcaacatcatctgattcaaccaccaatttctcagcttgtacctagagatgaatagcacagtgaagtatcaatcgagattacggatgacattttgcaacaaacaaaaccaatgaattgatacatccgtgttggcctttacatgtgaatacaactgaattttagttcaataaagtgggaaacaggcagaccttctgctgcgcgcatatgagttggtattgatccaagttgtcactgattctttgcaggttcatcttcttgtgtgcaatcagctcctgctctcgcagctggccggcgggaatcttggctccgactgcacacgacaatggatggaggttgcataagcatttgcagccatacacatacatggactgaaaactctaagaggaagccagagatgtaaacaaaatggaagccaaactcaatctgaatgaattgagttggcctcgattgtaaaaacgtagggggtaaaatggtgcattaaaaaaagagagagaaatgatttagtgtgtggggaaaaaggttgtaaatttggagtcattgagggaactggacaaagaaactagacgatctgtgccaatacaatcgtggtagatcggatcatcaatctagactctagtactagtgtaggtaggaggaagagggatgcgtacggatggggaggaagttgggaggggagtagacatggagcagcacgaaggcggtgccttgggggaacttgtgcagcgcccacagcagcgtgcccctgctggactcctcccccaccgccacgtacaccttctcgccggagaaggacggctccggcgaatcaccggggtacggagagggggagcccgccgtggccatggctttgttggcctcgcctcgccggcgccgctttggaatccttctttgtgttggactctcttcttgttgcctccctccctgcctgctctcactttaatactccactgctaatctcaaaatatataagcatttagatattgtcataagtcaaattatgaggacaataaacatcattagatgcattgtgaaatatatattttagtaattttatcttttttttatgtgatagtagatgctaatgttcttatttataaacttgataaacttagcatagtttaaccaagaacagactcgtaaatacttatattctactagaacggagagagtagcattctacaaatgttttggttatgttctggtgatttgaatagtaaatatcaagattcttatttcaaaccaaactatggacactaccaacatctaattctttttgccgggtgggccaaaggctggccgacaaattttcattaataatgaaagaaaatgacagtttagacatataaagtgtcatttccaatggagttcaagagtatttttaaatggtagtttctgcaaggtcccttttttcgctatattttgaatgacttcaatgcttgtgaaaatacaatatacatataagagagttgaattgaggttgaaaacagaaggcataggatttgtattgcagttgcggcagacttataggttgcaaatgcatttaccttctgaaattgaattagttatgacgatgtcatttctgcatttactaatttgtcaacaggacctatgttagcacaattgactacaggcacacgtctgctcggtgcattgccgttgacgcttaactgttaattggtgattggctcaattaagagtgcattgtctgagtatgttccataaaaatcaatttctaactataaatctagacatagcatatgttcaggtttacagtcatgaattagttttaaattttattggaacggatcttcccttctcttgtaccatgtcctttctttttatttttcaggcccattctgtaaatacatttatttctcttaataaaaaatacgtgtctcgcgtattcctaaaattttgttggaacggagggagggagtatgtgttaaatacgtatacaaccatctatctgtataaaatcgcactgtctaacgtactgttaatctagctactagctatcaggcttcacggtttgaatttcacctagtgatttaagattatcctgcaggaagcatataactacatttttcacacctgaccttgcacaattatcctgtaggagtaacttcctttatatagaacatagtacaatacaactaaccaagattattatgaaatgtgcaactactacaattgcgtacgtaaattacctcgtcaattacaacatatcacaagtctccgtaaacaatcaatgtatgaaaggaaagaagctttttaaaaaggttgaaattaaaggttgaaaatttccttgtccttaacactactaactgctactagtgtctatgtcgaccgcacttgctcactcacaaaaagcttaccgtcatctagtacaccagtatcaccttcatcgacgaccgactgaatgaactccaggtcgtaaagtgtgctccctccgtcccagaaaagttaaccaacaaatatatccagattcgttgtattacagtacagcccccgctaaccactgtcttctttctgaaatatgaaaccttatattggacgtctcgatctaattgatagtactagcttatatattttgtgatagaagaaatactgtaatagaagcatgcatgtgcatatcttcacttaatttatgaaagcaaatgaaatatctttgcttgaaattatctaagctatatatatataagagcatcctagtcatctactccctccgtagaaaaagccaacctataaggggatccctctagtactataaatttggacaaagagctgtccagattcattgtacttttaagattggattttttttttacggagggactatagtgataaggcttaacttgtcagttactcttgtgcaaaaagctaaaacgcgtggaaaaactaaacagaatgtcggtcactgatgagtcctttgctttgctggattccgattgaaacaatagctccgttcatggttgatttgaatctctagctagccacctcaatttctctgtattttcctttcttctacttttttttgataaagtgaggatggagcgatattaaatgatgctatgcagcatatttctattaaaaaaatccattttactctctcgaataattaaaatccctaaactttttttggctaattttgttcccgtaaactattaaaattgttcactttactacttgatactctatctatctcaaaacaaaattatttctgttccttcttgtttgtctaaaataaatttatttttgagcaattatttcactgaagtttgtgaaagtggaaccaaattcgttgggagtacataaagtgggtaacatcttaatatgattaatatcttaagctgattttttaagccatagataacactattatgaaaggtccaaaatatttcaagattatatcatgaacgcttgtttacacttcaaaatctcgaagtttatatcaataagtgtttccaacctactccatatgttcgacaaaaaaccaacataatactagatgaggcatttcctagtatatcgaatctagacatagcctgtccagattcgttgtgctagaaaatgtctcatccaatcttttttttttacggagggagtatgtaaaacaatgatatttttttaaaaaataatatcaggaggtaagtgcaattttaggagtgagaggggaaaaataagaggaagagaaaattacccaacacactctattagatgaggtggtagagagtaggatggtagttaaaggtaaaatagagaaaaaaaataaatgagatgtgattaatgtgataagtagtatgataggattgcacttattttgagataggattaaaatctaggccatgtttacttcccaaaaacttttcacaaaaacataacatcgaatctttggacacatgtatggagcattaaatatagataaaaagaaaaactaattacacaatttacatgaaacgagacaaatcttttgagcctaattagtccatgattagctataagtgttacagtaacccacatgtgctaatgacggcttaattaggctcaaaagatccgtctcgcggtttgcaggcgagttatgaaattagttttttcattcgtgtacgaaaacccctttcgacatccggtcaaacgtccgatgtgacaccaaaaattttcatttcaccaactaaacatgcccctaaaattgcacacttgtagatctagggatgaaaaattttgacatgtcaaattggatatacgaacacacatttgaagtattaaacgtagactaataacaaaataaattacatattccacctgtaaattgcgagacgaatttattaagcctaattaatctatcattagcaaatgtttactgtagcaccgaattatcaaatcatggcgcatttaggcttaaaagatttgtctcgcaatttacacgcaatctgtgtaattagttattttcttatatttaatactctatatatgtgtccaaacatttaatgtgaaatggcgaaaaaatttgctagaggatctaaaacaggcccttatgtagagagagagaaaagagatactttagacatgctagacaacgtgtttttctggcagatctacgcgtaaaatgagaaacatggttaacatgtggtgattgagtattaacttaaaaacttaaaaaatagatttatttgattttctttaaacgcaaattctatatcacaaccacgtaagtttagtagattgaaaaatgtgataacgaaaaaacaagaagtagctatggtcaaatagcactttagaacagaccccgaatatagttccggtattgaaatatagaatgaattgcgcatcttttctatcagcttaggcgcttttggactgtaaagaatgtataaacagttagtactactccaaatcgtgttccacatttctattttgcacatttgcaggcaggcgccgggttgatgagtccatcttgatttgccgctgcggcggcggcggttgcgagttgggacgaacaggccaggcggactgcagggcataggcatggccgcccgccccccggacccggagctcatcgaggtaagtttcggattgggagttcgtgcttgcttgctttattggcttaatttcgagcactatgctatgcaatgctatgcttggtcaactaccgatcgatgatcaattgcagcggctgctcaatttttttttttttgcctcttccggtcctcccccttctctattgtttgggtgccttgagctgttgcacgccacctgtttgtatgaatgccatgccctcgtgcttgaagattctgcaaccaaatgttgcattcgtgctaatattgcttcacatgtactgctcatcctacccatggatcgcaaggagagccttcatttttcaccaatatataattccactaaaaccatgactcagtcatgtagttgtggcgcttatttcgcctcattgaaaaagctgctcatgaggcttatcaactaaagctacggcgaattaatcatctttttgttgttaaactatctagggcctgcattccatgaaaattacctagggcagtaaactcatgcttcacatgtctctttcaaggttagaggtgctagagggatggagggttgttaaggaatacacaatcacatatcgagttaaattattgcacagactaagccaatatcaaatggatatacgcaatttggaggaaagtcatgaacaaataaaagtctgtaccttccccctttctggttgaataagcttaagtttttctttttctcaaacagtatgactccaagccaacagtgacctctccctttccttttttcctgtttgaaactagaacttcaatgctccagtgtttgtgaattatcatcagttttattttttgaaagtccggcagggggatcctatatctccgatgatcttcatccttgccatggattctctgaactcccttttcgtcaaagcggaagagttggggctcctccaaccattggggatcccccaccgggtctccctctacgccgacgatgtggtcgccttcgtcaagccgacagtcggtgagctgcagtaagggttgcaattgtgtcaaatccccgcctgctagccctcccaactttaaggcaggaattgcagagccagagatagaaagaatagggtcttcaattctcagcaaaggccttggtcagagatagcccgagctttggcggcggaagcgactctctggtggttggcacacgcggcgctgccggtgctaaccatttaggtcttgttctaggtcatcccctttctgttgccacgagaataggcttaagctagctgttgatcccttgtatcccgtcccccttctatttttcatttttggctcggtttgtacatacacttaatacaaagatgcgctccttgcgtattcccccaaaagaaaaaacataaggatgaggaaatcccatacaatatccctttcctaaaagcagcttatttgacagttcagggcagtcgagcaacaaccttttcatattagtgcagcatgttattcccttatcttcttcttgaagggcaggagaaatagaaagtgtaacaaaactatcatgccataccagtagttttaactgaaaaatcgcacatacattgttaatttctgaactgcccacactactataaactatccatgctcatggatttttactgcttaccatctgcactttttttttacgataataaccatctgaccttttgaatgatcgtgttgtagttttgcttccatgctgtaacgaacttctaactttgcaaaaggcagagataaaataggcatccattgacaggtggatctagtatccttttctgggtactacatcttcttggttaggttacgttgcaagtaagttcatcctaaacgtgtgagcctcctcaaatatgtacatcacttctatccatggactccaaaattttgagaaagtattagctgcttcagttaaaatgtaattccctacactatacaatttaaactattttcttaaactttagatacacgataaaatacaaaccaaataaaaggtcatagttgctgtttcatttgccactcttgaatggcaaaacgaagggcattattgggaatcagctcgtagtgtgtgaaactgaggtaggtcatgggggacgtcttatgccccctttgaagccagtcttttatagcctcaccttcatatgtgaatccatcagcagcaatatgtggatccttcatgatttcctgaaatattcaaaagatgctagattatttcaaattaaaagtaaaaacataaattcaggagaaggtgatgatgatactgataatagatttggcgaacgcgaagagttgttggtttggcataagccatcacacgatttgagtgcttaatttctttgatttgttatccatgttgaccatcaatagagtaatttctcatgtgctctatttgtgctggtgcttaatattgtttatgcaatagatatacagtggtagagatgctttgaaatttctattaatctactgtctcatgatgtaactgacctgtgtcattgggcagatgaaaaatgatggtatcttgcatttgttgtctggatagttcaccatggcttgtaaaacaccccaggcctccttggcaagatcagggcgctcctttctgtcataccggcaacatctcagtgctaggattgccaactttttactatactcaggtggccattcccctgcagaagcatcaactacctgttgcagcatttcattgttcagggctgcctctacctcactaggaaggcctagtggactcttgccagttagcaatcttagcagcactactccaaatgaatagacatcatactgtgctgtgagctcccctgaagcaatgtatcctggatccatgtatcccaatgtgcctttaatttggtttgtttggtggtaaggtgtgatggtggtgtttgtcagattcaacgaacgagatatcccaaagtcccctagcttgcctacaaagttgtctccaaggagaatattatcaggcttcagatcaccatgggcaatgccttttggtttgttggaatgaaggaagataagtgctgtgcagatgtcagcagcaattttgatcctcattctccatggaagtggatctgtttggtgtttacattgcaaacggtcctctaggctcccgtttggcaagaactcatagaccaaagctttggcctccctgcacactccaatcagggtcacaaggtttggatgtctcatccttcccagaatctctacctgtaatgtattggcaaaatcacatatttatataaagttttttactctctttctcatgtaaatatatagccataagttagaaggattggtgaaaaatacctcatcatcgaactctttctctcctgttatgccttcacggttgaatttctttatagccacagtggtatgacggagaaaacctttgtagacacttccacatccaccatgtccgatcattttggattcatcaaagtcgttagtcgcttctttaatctctgtgtaggtgaactctgtcaaggcaacagcactagtagaacaagatacattgttgcagtttatttggctcatcttttcagcttctttcacagcattgtctttctgacgttgcaactctccttgcacagtctggagctcttccattagagaattggcatgcataagctttctctccagttccattatttgctcatttgccttctgcagctcattgtagatctggaggtgctccttttcaagactgaccttttctctggttagtctttcctctaccgcaattttttctttacagagtgaattctcccgtgctctaaactgcgaaaaaaaaggtttgcaatttcgatataaagttgagagactcatctatcatgtagtaaaaactgtatgtacgtatttcactaacacatttgtgcatctttcaaaatacgacgtattttgaggcccaaaggtactaaaatcagtagattaagcataaattcttcatgatgagagggatatggggataacaaacaccataccatcttagacgcttcaaacagctctttctcggctttctgtcggctctagaggatcccgatgcttcctttcttgaccgttctagctcattgcgaacttgctgccattgttcaaacatttcattctgcatgttagcttccacctgtaaattattaaggtttgatctgaattcagtagttgtcctttccttacttaaaaaaaaggtgcatccatgaaggtatccctagagatttgtttcagtacaatatagcttaccatgaaatgctgatgctcttcggagcttgagcttgaaacaggtactgataatccatccacagtgtccaaatctgtcagagttggtgaggaacctttgctttgatggctggaattcggggagcaaccttttggtgctacgtcgactgagtttggccttataggtgatatattttccacgccgttctctaattgtcttgaaaagggaaagggatgactaatggaattggaccgccgaggtagcgattgctgatctggagagcctaagaaacctgaataccatgacggcaacgacactgatcttggagggaattcagacttatctgacagagaactcccggagctgcttctgggggaatctcctttgtcagcaaactgactggcttccctaaaatggtaaacaatcacaataacgttgttttacaatcacaataagtttgtcaaaatggtaaattcaatgtggaattggatttatgttggagactaggtaggactgcatgaacattcatacctagtgcaagcaagagcttctttgcaaatatataagatctggcaatatggtttggcctgttgatgtacaattgctgcaacttttgattttggtacttgcctcttcctgttcatgaaagattcatgcccatggtcaacattgaaattttcagattatacactaattagaggatctggtctctagtttagacaagaagatgatagccattaaaacctagcttgttaacagtagtttaacgtcatattatgcttgccatttgctaagtaagaaatatacaagaaaggtaaattgctgagttgtattaggaaggggaaaatgcattgttcaagaagtgtttgcttgttggtcctgacgcctttgtcatcaatacttgttagaatgagcgacacaaacatgacaaataataaaatcacatctacggactacaatatgctcagtctagagatatctcagtggttgtgattcatgatgaggcctcagtacaatggaataagggcatcttggcatacactgagaaggaagatgttcccataacaagctttgtaatgtgatgttgatcaataagctcaacaatgccatttgcaacactgttcttctcaatcaccaatttttcagcttgcacctgcaaatttggtgattttgctgagatgacatagaatgggaagcaacttctgattagcataaaggatataaaatattgcatagatttctgtaatttgatgttcttattcaatccacttcatcagaacaattagtcataaagcttaatttgtctaggcctggtacaaaatgtggttaaaatattgattgttatctttccataaattgatcctcaagctgaccatagttcactttgttgaaaaataaaattcccatttcatatgacttgagtgagagtgcttatctgacctttggaaatgctctgcagtaactcaggtactgttctaaaagtttattcatatcgtccttctcaatctttctgtatgctctgagctccttttcttctagctgttttgcaggaaccttacacaagcctgcaaggatggcatcatcgcaggaaaccatgagcaccggcgtggacttcttttttttttttggcagagcaacatgtaacactaaaacaagtattatttcctttttctgtgggaaatatagaagattttctgattattaagaaaatagatgtctggtagcaacttgggttaatgcataacatctaattgacagaacaccactttggttattttcaggttcattgtttgtatgatagctgcggtacagtctcttgagaagcagggcatatggaaaagaaaaaatgtgtgtgctgctgctttcccaattgaacagaccaaaggtgtctttcccagaagttgcagagaaaaacaacaatttgtggaaatggaaatacaaccgttgttgcctgctacgtggtactagttatcatactagtaatattgttagtgttgttgaatgctactacttactaataataacagaagaaaagggcaagtagaaggaaagaaattatataccgctcatgattctgtctgcaggctggtggacatgcagcagcacaagaagcttgttgacatcaccctgctgaggctggagtttcctagctgcccactggatgttggccttgccgtccttgaggtccttgccgaccgacacgtaagtctttcctccgtcatcgtcgtcgtcatcttcctcctcgtcaatctctctgaggctgcgggttcctccgcctgcgcgcaccaacatccgctcaacgcctgcaggtactaccggctgaggagacaagggcggcaatggtgacgacgacgacgacggcaacgaagaacgagcacttgccacggccatgcagcgcaaacaacttaaattaactgccctgccaccacacaaccgacagaataagaagcaaacaactgggagtagctagctaggcaggagaaagaacaagtacctactatatctttgcttgctttattatagtttctgctgctgctgctgctggaggcgacggcaacaacaaagcaaacaaaaggatcgaatctctcacaaaggggacttttggcttcgcttgtatgtcgtctggcaacttttataaactcatctgcttcagttattcgacaaaagaaagaaaaatctctgttaaatctatcttacatactccgtactagatagataggatattattgattgtgagatgaagacatttgggagccggggaagtttcctgcaggtatcatccttcatttttcattcatattccttcttccttaattctttttttgtcttcggtcaacaataggagggcgtggatttgtcctgcacagctgttaacttggaatatactgcctgcctagcttgcttttggtcttgggctagctgtacctgtactcccttttaaaagatcctgcatacaaccatgaccatgaaggaaactctcactcttaccaagtcttgcttctactgtttgccttccatcattggttaaaggttagtaatatgaaaatggaagacttattgtgcttaatcctatgttgggtgaggtcaaccttattagctgcgtaatggagtattattgtagtatactatatacaggtctgtgaatgtatatgattctcggatgtataatttatttgtgcttgttcggtgtcatcattctctcttactccatatatgtatatataagtagaagtaacacaagtagtagcagggtacattgacattgaaacggaacacttccttttgttgttgtatcacgttaatccaacatgaattacttaatcttttctagtcgttggatctgcattactagttcaactgacaaattaaggcggcacatacaaggttgcttgctagggaccctgctggtatatccaagatgtatcaggtatattccgccaagtcgtcagtcatcagacgaagaaatgagagaaaaattcttttgtttgaataaattaattggatggttggtttaagctatgcgattggtcagtcagtcatacgcatttcctatatagaatatagctcaagtatactcactctgtcctattttaaatgtaactatgattttccgtgcacaactttaaccattcgtctcatttattttttttaaaaaaaacatgtactattcatattttatcatctcataacaataaaaatactaattataaacaactttaaataagatggataattaaagttgggcacagaaaattatgattgtatttaaaaaatgggacgggggagtactaggtgcatgtgtccttgttattgttaacaagttgtaattaatgtaacacgtaagtagtgcaacgaattcaattactaatacggccctgtttagttcacatcaaacttccctcaaactcctaacttttcatcacattacatcacatctaaaactttcctactcacataaattctcaacttattttccaaactaccaacttttcctaagcttcttcctaatttcaaaaattaaacacagcctacatttcagaggcagtctagctggctatcgagaagtgcaggccttgggcggcggtgtcgcctcttcctgcgcggatatatggagatggcgtctcacatattccaacagttctgtcagcacccacaaaatcaattggttgttgaatcaccccattcctcaagtcaatgggtaggatccatgccttgtgagcaaggtggtcgatgtgcaagctgagcacgggatgacccacatggagcttctccaagataggaaagtagttgggcagcttaggcatcaaatttgagacgtccgaagcatggagctggcagtcgttgcgccagcaaccagattatgtgttccaactctatttagcgagttatgaaattagttttttcattcatatccgaaaattcctttcgatatttggtcaaacgttcgatatgacacccaaaaaattttatttcaccaactaaacatgttctaagtggtggaggcagctggatgtagcttggggcaggttcctcttgaaggagattgacaagcacgatgcccagccaaaggtcaacgaaacccatcagtccaggagcttgggcggcgatactctctctccccaatctcacttccagggaagccaaaccaaaaaaaagaaaagaaaagaaagcgcccctcttctactcctcggttatgggcttatgggctaggtgcctaggtacttgggatgggcctttgcgacaagtgtgatccagtggaaaaagtacaccaaagatccctcaacttatcgtaagatacaaaatcgtcctcgaaccgcaaaaccagatatacggggtccctcaattatacaaaaccggtcacccaatgtctttggtggttttgaccctggttttggtccggtcactaagccaatgatgcaggaaatgcacgctaggagaagtttggcatgcttagttagtgggagcacttgaggaagactaaagcttgaaaggggcttcacttctaggacttcttggctaagaggatgcttgctataagaagtataagtaggcgggtaacgtttcatttcttccatagaatctcaatatggcgagaatgaagcagggcaattaaagtttgaattcaattcaatagtcaaggtagagtagaaagggggggcgtgctacttaacgcaactgcacttggctaagaaaataggatagagcagagagagcctaatctcccgcttggtcattgagcagtgagccgaggtgcgatgagcggttgagtcacgcactacaagatggctgaaggttggcggcttagtcctcgtgggacccacatagtccccacatgtcaggtgtccacgtcaccctctctttttcccctcctctctctcacttctctgcaagctaaccggggcgagacgggagggcagcgccgtgacggccgccggcggaggcagcgtgcgagcgcgacggcttctccgctttctccgcctcctcgtcccgctcggccgacgtgggcgcgctcgccggcgaacgcgtcggccctgtcagcggcgccggcgacgcgtacgcgcggtgggacgcggcggtggggtgccgggcgctcgcggagaactaccggccgtggtcgcccgacccagcggcgctgcagcacgacagcacgtacgtggttggttggttggcttcttttcggtttgttcgttccttgtggttgagagtgagtgaggtggaggagagagaggaggaagaggaggggattcattcacgtggtttccggagagagcaggagccaacgtgcggcttgactctggagatctctctctctctctctcaagcccaaatcagaagtgagtgagtgagtgattgattgattcctcctccgtgttcctgtccggcatttatgattttctctcctacgttcttgtcgccgtgatgtgcgtgtgccaccgatgaaggcgtcgaggtcgtgagagggagaggaatcgacggagagagagaggcggcggcaggaaaaggtggagaagtcaagaaacaagaacccaatcaccattgagattgggttcgttttccaccctcctctgcgccgatgcgtgtttcttggtgttcttctctgtattgttcgtttcttttttgtgtggatggaatcatggaaatggaataaagatttgcatctttaccatctgcatgcgtggggctccaggttgcagggtatcaggatatatagcatctggctagcgtcgattttctttttcttttgtgtgtctcgaaatgataggaatcgtagtactgatcatttctcccttcgtcggcaagaataattcctctctttatcttggcgcaagaatctaatttgcagtagaagaacatgcatggtttgagtagtaatatcctgtattatgaatctggctgcagaacgcctcatcactgcagcaatgccatcatcagccatggccgtcgacaccactgctcctgagcattggctcgactggaggttcatgctctgcgcggtctggccgtctgagtctactcctgcatggtcctggcatgcttcttgatctggaagtacgaggggccgagctcgcaggacggcaatggcgatggcggcggggacagtgaggatgcacggccgccccgggccgcatccggggtcgatcgcccggcaccccaccgccgcgtcccaccgcgcgtacgcgtcgccggcgccgctgatagggccgacgtgttcgccggcgagcgcgcccacgtcggccgagcgggacgaggaggcggagaaagccgcctccaccggccgccgtcgcggcgccgccctcccgcatcgtcccggccagcttgcagagtagagagagagatgaggaagggagagaagagggaaaagagagagggtgacgtggacacctgacattgtggggccacgtgggtcctatgctgacttaaccccacgtagactaaaaccgaggtcaaaaccaccaaagaatctcgggtgaccgattttgtatagctaaggactagcatatttggtttttggttttggggttggaggacgattttatacccaacgactggttgagggaccatcggtgtactttttccgtgatccagtcaattgaaaaaaggtccacctgacgtccttcaactctagcttaagtttataactagtaaacgtgcacgttcgcacatcatgtcacactaattaattattatgtacaatcaccccaagataataatcttgcaaacaaccaaagttcaagaattatatatattctagtgtaaattggtaactcgtttttagacactttctattaaaaaataaatacaaagcagagaacggtatgaaatgtatacaatggtgccatagctttgatatacacgcactaattaaactcagctctacctagctacatctaatcggaaaaaaaagcctcccttatctacataatagcttcccttcatccacaataagttcaaatgcgctacaaaacaatctgcaataaaaatatcatttaaatgatctccaataaataactcctgtcgtatcaccagtaatgaaaaccacaagccctttagtgttgtactgttgttgtatactccatccgtttcgaaatgtttgatgccgttgactttttagcacatgtttgtccgtttgtcttatttaaaaaatttaagtaattattaattcttttcctatcatttgattcattactaaatatatttttatgtaggcatataattttacatatttcacaaaagttttgaataagacgaacggtcaaacatgtgctaaaaagtcaacggtgtcaaacatttcgaaacggaatgagtacttacaaatgtttacttatcgatactgatattcagacataagctcgctgaatactccagctacgcggtcggtcagtaagtcatgtgcatgtgtccttgttatggttaacaagctgtaattaatgtaacatgcgtacgtagtgcaatgaattcaattataaagtacatttcacttaggcagtctagctagttatctagaacggcaggcactattgcattattactgttccccgtcctccggcggtgtcgcctcttcctgcgcggatatctggagatggtcgtttggacatacgtctcacttattccaaacgttctgtcagcaccagcaaaatctgatggttgttgaatgacccagttcctcaggtcaataggtaggatccatgcctacctattgatcttggccatgaggtgaacaagatgggcgtcgtgcaagctgagcacgggatgacccacatggagcttttgcaagcttggttgaggacgacgggcagtgtcgtagtttggcagggtaggcatcatatgatgtgagatttgagaggaacgtaggcggcagtccatgcgccagcaaccaactccatttagcggccgtccagccatcagcaatgtgtctctctgcgggtgtggaaggcctttgaactcaaactcaacatagttgatgcaaccctctaagtcgatggcaatgtcacgaacatcgcttgcgttgccctcgtcaatgcctatgcctgattcgtggaggcaatgggatgtagcttggcgcaggttggtcatgaagcacattgacaagcacgacgccacgccaaaggtcagcgaaacccatgaggccaggagcttggcgggagaggttgatgaccttgtcggtgtgatggaagaagaaagttaggggaggcgagctttggttggtggtggagtggtagaggtggaggcggtattctccccctggcttcctgatgggagtgagcgcggcgacgatatgatgtagtgctgctgtttggcgtacgtgcggaattagcgggtggtggccacggaggatgccgacgtggttgtcaagaaagaggctgtcgaggtcgccgctgggatgggggatgcgcgtgagcgatggcgagctaccatcggagaggaataaattgtgacggttaccatggccgagggtgaggcggaagaggaggaggtcgtcgtgagcggcgatgatcttgggctcacgggcaaagtcatccgagggatttcatggccctcccttgttttggaggtggcgttgcagatatcggcaaagtaggcggtcttgtcgaggagtgcccagggtggcggccgcccccgccggcttttcttgtgaacgtctcggccgtgcgcaggaggtcgcagggaggagtccttgatgggcttgccaacctccatctctgatctctctctaagacgacttaattagcttgattgatctttcaaggaagaggaagaagagcaccacagaagctggacatacttatatgctggggggccggcctgggcactgggcagcagtgagtagcaatcggagtcggagatagtgtgtttcctctctctctctctccaatctctcttcggccggtgcacaggacaacaaaaaccgccatctttgctcttcgctgtgttctcaagggtgagaagaaaccatccgtgtttttgggagaaattttcaactctaggaatgacttattttgtaatattctcttctctttctctttgcatcacaaatccacaggttaacaatattagtaacagttcaagaatatgaataaataaccttcttatagttcaattgaaaaatattagtatcaaacaaacaataatctcctagttagtaaaacatccgagggcaactacttctcacagctgataatatcattataccataccaattcgttatgtatggatgatggataagatcctatgaacagagagccaatttgaaacttccaatggatttatggaacaatccggttcgaatagaaataatgtgctccacaagcacgtaaggaggatagatgcccaatttatagcggccaagttgatacctccagcaagcagctagctacaatgtttttcacacacactccaaaaacaattgagagtccagaataagctgattatctaccaaaaaaaatctcaaactacacagggcttctttctgttaacttccaacatctaaagctcctgtcaaattcatgccttctaaagctaccttttcctgcgcttggaagacttcactgtcaacgtccttggcgcttcatcagacatcttaaattcaacatactgctcctgcacaaccgaccaaggaagagcaggattcgtgttacatatgttccgtttgaaaataatgcgaggaatgtaaatcacgggattatctgccattttggagaaggacagatacagacctcctcccactttttctggagctgcaaaagctctttacagcatgccacacactcagcatggtaagcagcagccagttctttaatcaaggccttccttttgattattcctatcacttcaaaacaccatggcattatatacaagcacaagaatgctggcaactattttacaaatgaaaaatgttttttagattttgcaagcaatgcatcaacagaactcaatatatctctaatactataatgaggccagtgtaccatgtgaaaatcatggagagataaagctttgacatttcataactcactcatgacaatatactagcaaggtagctagtacatgcataacaattgtacttctattcagtatctggtaggataggatacctgctccaatcatttatatagagtcaaattttttgcaacatactagacttactccatcccgaataaactgagatgttggttcaagaattaccatcctatgcacatctctcagaaagctttataagtgaactgaattatggaccaagggctacgaaaattgaggccatggccatggcatttgataggatctttgtgcattcctagttgtgcagcagatgtttatttcgtgtgactgtgagatttccaatttgattcgtggcgaattgttagttagcaatactagtttacaaaacctgaaccctctaaagcaaatcagtatgagtcgtgatttgttatactctagtaccgaataggagtaaccaaatctagagcacgaacacaaaaggtaacaaaaattaaaggtgcgtgagaaagagagagacccttacttcggctgggatcgaagtgttgctcgtcgggcttcttctccccgttggccgtcggctccccgctgccgctcgcgccgtccatgggatgggaggcggaagatcgccgcggttaggcctttgcttagatccaaccaaacaagccaacacccaggaaaggggaaggcgacagagccgagccggttctctggatgtgtatttgttgggatttctcgcttctaggtcgccggcgaaaaggggctcgctggccggagacgaagacggagacgcagatggagacgagagtgacaatggcggcggcggacgcaacgctccgtcggcctcgagtaggaaagtgaaggaaaccaacacaaaagaggaagtatatgggcctcagcccggcccatgtacagtttttctgcataagcctctcgagcggcccaactactacacttggactctttctctctcattccacttcttgctcgccgccgacgccgccgccggcggcggcgaaggggatcgatcggatggggacgtcggtgcaggtgactccgttgagtggcgcgtacggtgagggacccctctgctacctgctcgccgtcgatggcttccgcttcctcctcgactgcggctggaccgacctntgcgacccctcccacctccaacccctcgtcaagtacgcttccaccattttcgccctaactctcctcttggctagtcggggtcagctgctttggtgctagtctttctcctttgccgcatgctgcgatgagttcggatgggatggggatggggttgccatgcgcgccacctgctcgttcaattgcctacacttggagacagtgaagggttctccggctctgctgtgattttgtcatcttagggttatctgtgttgctatgtaacgaatgagatcgtcggtttaggagattgatttgcctcaactgaattgctgagtccgacaggtgttcgggtgtgcttgtgcatagtcaggcttggtgcatgttatgcacttgtgttggtgggtccgtgtgcacgaacgcatatgcacttctacattgtgcccatgatcctgcatacataccatatggactacttactgatgtgttgtttatgtatgaccttaattgttaattagtatgtgccaaagatgtagctcgagtttctaaaccgtgcttaatattgcttctcaagcttgtcttactgggcgttgcccctcaacatttcatgtggtttttacatggaaccttcagtaattgctttcatttgcttaaatggtgaatatctatcttaaggcaattatagagtggcatgatcaaggcaattttttgcctccctgtaatagatagcctgctttcaggttgaactctgactcatatttatatttatttttctatgctgaataaacttattcttgttcgtcttccttgattgttgagtaatcatggcatagatttagtagcaattatctcaccagcttggtactagtagcctcaaaatcatgcaaaagttccattttaagctcccatgatctttgttgttcaattattcaaattacacatctgtaaagattgaagggaacacttgaacatgtttcagtatttttatggattatgaatttgatcagtatttttttttcagggttgcaccaacaatagatgcagttcttttgtctcatgccgataccatgcatctaggagctttgccatatgctatgaaacatctcggactatctgcaccagtatatgccacagaacctgtatttagacttggcattttaaccttgtatgattactttatatcacgacgggtaagctttctagtgtccattttaacctcttgtttgtttcattgcatatagtggatctaaccattctttattttcctttgcagcaagtttcagattttgacttgtttactttggacgatattgatgctgcattccaaaatgttgttagattgaagtactcacagaaccaccttttgaatggtcagtaagcatgctgttgatgtatatcctttgctaaattacatccccttacatactattgattggcagataaaggtgaaggaatagttattgctccacatgttgctgggcatgatttgggtggcacggtatggaagataacaaaagatggggaggatgttgtttatgctgttgacttcaaccatcgtaaagagaggttaaatccttcctttgtcatttacttgtcattttagttttctctttattagcaaataataacagcaatgtgcttttccaggcatttgaatggtactgctcttggatcatttgtacggccagctgttctgataactgatgcatacaatgccttgaacaaccatgtctacaaaaggcagcaggatcaagatttcattggtacaacactggacatgttattatcatagctctctatctctatctctttttcaaatgctttcagctctagcattactactatacccacacagccatggttgcaggtaacagctcatgataattttgttggaagctgttttttacttatgttttctccatcaaagtagcactgatgaatatatcttctattttccaaatttgcaacttggacacaactttttttatttctcaattattttttagtgctacacattgttgagttcaataataaactattaatattttagactccaaatatatgttatcgtgtatatggtttgttttagttactgtatgggaatcctcttgtgatgtctaattgacatcctgtttcatgcagatgcattagtgaaagttctaactggtggtggtagtgtgttactgccgattgatacagctggtagagttcttgaaattcttttgatattggagcaggtgaaatcttgaaggtcttgttctcgtactgttttattttgttatgtcaataatatgttcaccttttgtcttgatttattgcagtactgggctcaacggcatttgatctaccctatctactttctgacaaatgtttctacgagtactgttgattatgtcaagagttttcttgaatggatgaatgattcaatctcaaagtcttttgaacacactagagacaatgccttcctattaaagtacgaatgattcttgttactttcctttttttcagttcatcgttttgttttattctgtgcatattgacaattgctatgcattgcaagcctgaagattcatgatgagcttattattttacatttcaacagcccaatagacatgtttcctctattactttctccttatggagtcatatttatattttatctcattgggctgtcctgttattacaatactgtattatcagagccaattcaactgcctcttttcctgaatcagcgctatactattatttgtttataaacttcatatataactttcttaagaacgatatttgtatgattgttttgtttagtttctacaacttttgttttttctgtgttgcagatgtgttacacagataataaacaaagatgagcttgaaaagctgggagatgcaccaaaggttagagtaacatttatttcctccatactgtcggaaacgtgaatttaacaaacatttagcaggtggttctagcatccatggcaagcttggaggttggcttttctcatgacatatttgttgatatggcaaatgaagcaaagaatctagtactttttactgagaagggacaggtaaatccatgtactcaatatatctggatggtttatttctttctcagcacatacattcaataactagctacatacaaaccattatagcttcaaacctgtaagtgacaagtagtccaacaccttgaaggggccttagcaaattgattgctacaacctacatgaaacttttaaaatttgtgtaaacaacatgaatcttgatgatgaatccaaacttacgtcacgttaaccatatcctctctgccttcatgttccatagatttctgtatttgcaaaaactgatcaaacatttgtgttgttctcactcagcaaaagaattctagcatcatatatctatgttctacagctatctaattacaaagtatcccattccagtttgggacactagctcgcatgctccaagtagatccacctccaaaagctgtaaaggtcactatgagcaagcgaattcctttagttggtgatgagctgaaagcttacgaagaagaacaagaacggataaaaaaggaggaagcgctaaaggccagtctaaacaaagaggaggaaaagaaggcgtctcttggatcaaacgcaaaggcttctgatcccatggttattgatgccagcacatctcgcaaaccatccaacggtatagctaggctgcgtttgtaagacctttacgatctgatgcaatatattatatgtggttaacaacccttcttggctctgtggttccatcagctggttcaaagtttggcgggaatgtggatattctcattgatggatttgtccctccatcatcaagtgttgctccaatgtttcctttctttgaaaatacttctgaatgggatgacttcggtgaggttatcaaccctgaagactatctgatgaagcaagaagaaatggataatactttgatgcccgtaagtttgcttatgtactttttttcttttttttacaatcggaaccctgtggccagatggtttaattttgcctggagcatatcagccaactatgtttagggttttctttcttggaacctgaaaaaacttgaaatgccaacaaaataaacttgaatgtcaatgttttcatgaattgttttcagggtgctggggatggtatggatagtatgcttgatgagggctcagcacgcctactccttgattctacaccctcaaaagttatttccaacgagatgactgtaagttttttttcccatttacttcattttgtctgtctgtttatttatttctagaaaaatctttacttctatttaattatgatcaacatttttaggtgcaagtcaagtgttcattagcatatatggactttgaaggtcggtctgatgggcgctctgtaaaatctgttattgctcatgtggccccattaaaacttgtaagtgctggaaatacccttcttttagcatccatgatttaggatttagaatttatactttttgacacatgattatctccttcttggaacatatatttttctcacgtatatagcttgtcccttttcaacaagaaattagtttgaaattccctaaacctatttactgattattattgatgcccttgagctatggaaaccatttacaaatacaattatttacatttccgtttatttcttgagggtaaacatgccatcacatactgaagctcctgttacattttcaggttttggttcatggatcagcagaagctactgagcatttaaaaatgcattgttcgaagaactcagacttgcatgtttatgctcctcagatagaagaaactattgatgtgacatcagatttatgtgcttacaaggtctgtataacgtttatgttaacagccaaactcttattatgtgtgacgggcaggcgttgcctgatgctggtgtccaattcttatccgatgacttaaacaacatgaggcaaaactgaatagttgccatttaccaatcatttttactgcactatcactgtatcatatatttccatacatacacaaacttattcactatctttgtaatttcaggtacaactttcggagaagttaatgagtaatgttatttctaagaaggtaagagcattggtttcctccttcactattaatgtattttatccttcaactggtgctaataaatctccttgatgtggacgctatcagatgatataaacttgaaccaaattaagctatcaaactgatttttttgcttataaagtgagccagattcccaggaccattcatgtttcagtagtaataagattataaccagaaaaggcagaacttcttctattgttgcaaaaatgttacttcatatgcaatatgtatatgaatgaccgaggtccttccaatgcagttttgagaaatgattgattccatactggttactggatggtccattctgttgccctagtcagtcgaatgtttttcagcataagaagcctttcatgacaaaattgtctgtgaaccagataccacaagcctgtgattatttctttttttttttgcccatacaagaatatgaatgaccgaggtccttccaatacagttttgagaaatgattgattccatactgcttactggatggtccattctgttgccctactcagttgaatgtttttcagcataagtagcctttcatgacaaaattatctgtgaacctgataccacaagcctgtgattatttttttttttgcccatacaagtatacaacctttgggggctaacctgaaactgcactttgttgttatggattagcagtaagaaagcactaacactggcactctgtgcagttgggtgagcatgaaattgcatgggtagatgcagaggttggaaaaacagatgacaagcttactttgttgcccccgtcgtcaactccagcagcccacaagtcagttcttgtgggtgatttgaaattggctgattttaagcaattcctggcaaataaaggtttgcaggtaagttttcattttcaaatatgttagtactgtataatattaagttcttggatatactggcccttcacgtttcagtgttgagagagagagagagagagagagagagagagagagcatgtcctgacagttacaactgttactcctgctcccatacagaaccagttgttagatggctcctcttaggagtacacttaatattgtttgcataacttactagtagctggaataccaaaatcgattaacaaaactgtaataggctaacttggaagcagatgttaaccaggctgtaagcatgagtaattatagctgttgatacattctgaaaccattgaaattcagggctaagagatttcttgcaggttgaatttgctggtggtgctttacggtgtggtgaatacatcacactgcgcaagattggtgatgctggccaaaaggtaagtagtggtgaagtagc

SEQ ID NO: 80796 - DNA, 13593 bp, Oryza sativa
gagaggggaagatgggccgagggaaaatcggcccatcgaccctgggggaggcagaatggacttttgcggaggaatttgatttggagggattggattcggaattgaactcgacgatagatcggggattgagatcttgagatggcatggacactagacaacaagcaaagaaacaaatttcgcaattagggtttttaagagataattttcccgctaggcgccacgacggaacgggcgctacaccctttaaggagataccacataaaaatcttaatcttaagaggcattttatgtttccaaataattttatttctctcaatgtaaccattattaattaaagctaagtacatagatcgtacaaaaaattggccattttgatgaaaattccatctgaaaatgtcatcctcgtctatgcacattgaaagcacacaaattatgccatattattagatcctgaccaactaatgctcttctaaaagaaacattaatactacagcaaaacaaccagctagagacgatctgcttactacgatttatcaaaccgtctgtaatgaactcaactaccgtataccacgagcacaccccgcaaatgtagctacgaaatgaagagacggggattaaaaccgtggctactcccccaccccacgtccccactaccatcacatcttttagaaaaaaaatgtttatatcctatttaattttggaacggagtacgtacgcggtcaaatccaaaaccctcgaggtggttccgcccaccgccgccgcttgctgccgccaccgtcgtccaccactgccgtttccccctgtcaccagccactagcgacagtccgttccagccgtcatggcctaccacccaccaccgtctctcaccgccgctgcccaccactgccgtcgccaaacgcccgccggcgctccgttgcagccaccagggcgtactggtcgccaccgccgcgccgttctatctgctgatttgtgggcgatttgggatgggatcagacttcaatcggctgattcaatgggccaaaaaaggattgatcttccatgtggagcctcgaggcagatcgatttagttgaggctgtgctgctacttcaacaaggtaatggggctgctttctctctccatcgagactgcacattggtccgagcatttgttgcaattggttgtgatccatgctgaacaatttgatttgggatccgattaattggttctgattagaggtggtgccctatattataataacctgttttgctgaagtaggaattattcgaacgacagcaatattactagtcagttatgttattgagttctcaatagtaaaagataatactgtttctgaaatctgaactgaatccattgatttctgaagtctggacagagcacaccaatataaatttgaatgctttatctgtatttttttatgcagggcatctcttagcagaatagaggaaaaacttgtggttctgttattttgacatctgtgttaattgattctcatgaatgttggttatggctgaagcatcccatgtaactacaaggtaagattaaataattcctaacaaattttgtgcatatatgatggctagtctcatgagaaacaaactctgtacatgctgcgcatgctatgttgatatatatttgggcagaccaaataatgacagtactgataaatcattagtaattttgtttcagtgttctgctgttccattgcataatcagaagacaattttgttcacagacttcaatgtttattaggggcattactgcaagatgaacctgctgaacttgaaatatcatggtattcttgatgactgaaaggtacactccttcgcgtccatagtgttaaatctgtgagatagttcatgcctcatttctttgggtggtacttgttaatattttgctcacaaattttttttttgttgctagcctcttcacaaacagtgatatattttcaattcaaatggccagataacccacagcattaattttcatatgctatgcgttggaattactatttccatgatcaatagtcgaccccatgttggtaaacttgtcaatcttttcttgacgaaaacattttattagtagtttttttctgctccacttatttttctgtagactaataaagtttctttatactgctgtttcattgtctaaaaggtatgtgaagatgatgataaacaactgaatggttcatcgaatctggagcaatggggagatgctatgcctgtttatgacactctagctgaaattgtactagttgaggaattgtagttataattgtacactgtttctataacaagttctattgtatgatgtaaattatcacttgaatgaataaaatgtgtgttttctttgatgtccctaactgtaattttttttctgatgctaaatgaaatgtaatggtatttgatattgcccaaaagaatctgtagatggcacaattgtggtctgttcccgtgtcaaacaatttcttccctagagacggttgaaggtgtgtctactctctcaaatgcttgaataatggatttttctttttatatccacaaaaaatggaaaataaatgtagagacggttttgcccatttctattgaccgtctctacctcatagtcacggttcgcacaaccgtctctcttttatagagacgggagcaatggcaacgcctctgagacggtttcaggttctgaaattgtctctagtagatgtagagacggtttaaaccgcgtctataggctactaaaaccgtctctacacgcagtttctgctgtattaagccggaacagaacccataacattagcaattgaggcatttttccttctaactatagaagacaatgaggggtacttttccttcaaagaataactccctagccatttggacaactaggactatgcatatattattaaggtccacttggaaaatcttaatatctcaataatttcttcaggcatgtactctgtgtattctataaatacatcctccctaccattgtttccccaacaaaatataggcaaatactgaatgggtggtctgtgtggcaccatgattaattcttatcttggccatgctgccagcaattctaactatggctgatccatactgtgactgtgattgttcccagcaatgtgtagttaagttgcagtatttcttggaccaattccgtgctggagcagaccatccaaaccgcaatgaataattcgtgaaacgtggaggaccttctgggttaggcactgggcttattcatgactggagtttaaccactggacttgaccccaatgtaaatattgttgggcgtgcacaaggatggcgtatcgttgccagccaaagttccccagttaattggtacctttctcagaatatagtatttcaggacaagtaaatgctactcactttttagatagactatatactacttttccattggcttgtatcactaattaaattgccatccatggcaccattatagtaagtatgcatggtctacactttaggtgatgggaatcatttaaggaagtgaagagtaagttggagagtggtcaattattggtgggactggcgaatttactaatgcgcatggtaatatcaagtatagggaacttgatattcaggtgttctacactccaatcactcaatcagatgcaagtttcttaagaagtactgctacaactcttttacaggttgtttggttggaacaatgggatatgtgatggtctacaaaattattgttatatgttacagctgggagaccgctgcctccaccgccgttgttgttgccgccctgtccgaggcccaccgtcatcatccccgcagtggcaagcgacggatccgctccgccgccaccaccctagccaatgctgccgccgccgtcatcgatgccgctgcctctctcactgatgcagccgcccccgccacccttgacgtggccaccgtcgccgggaatgggtagaggggggggggcagggggagagggaaagggagagggagagggatgggatgagtgggaatcggaatgggatcgagatgggaggagtgggaggatgggaggagcgtggtaccaggagaaaaataagtggggtaggtggggcggtgggctattttcgcatgcgggtcacttaaaggtccgcatgcgaaaataaggctattttcgcgtacggatctattaagaggctcacctgtgaaaaatgatttttccgtgcggtccttctgaagagccgcacgcgaaaatagagcactatttttgtagatgtgaccacttactgtccgtctgcaatctaaagtgagttttgtacaggaaaatcatctctactagtgcgacaccctcctggagtatgctagtttgcccgtcaggctacccgatcagataactccaacaccacatgtctaaccggcggtacccgctcagtgtgactggccacttagagccgataaaaccgttcacaatcgaaaaacactgttcaccgtattttcaactaacacttacctttcacaattgtttgtcaccaagattaatcatcacatgattctacatgtacatatatatgttatgtttgcgaatgacaggaatttactcgctgaaattaagtgattagctgatgccaatttagaaggtctggtatcctattttacgcatatcatcatgtgggcttggcgttctataaaaagaagatttcgccatatcagggtttgtggataacttgtatatttttagcttttcctgttctcaaatgaccagccatgagtatgccatttcttaggagggatcgtgagagttcagttaggggaacaatggggaataaatctgatctagtatattacttttcaatttctttaggagattttgcataataggccagtttggtttggtaccgtaccaaaatcttggcagtgccaaagtgttggtaacttttggcacaaccaaatttggatgggcaaaatttctactatctaagagatggtgttgctaaaatttagcaccaatccaaacatctagaaacactactgaagattgccaataaattagtagggcataatttggaaccaaaccaaagcatctccaatagatgcctaaaatttaactcccaaaaatctcagattggggtcatcccaaaacaatttgagccaaaaaatcacctccttgtccaagagcttccctatttttagttcccaaaagcattgaataatgccacatcatcgctggtgggtcctcttcaactgtttctagcaatctggtttctcatgtcgctactaggccgatcgttggcaagatcagggcatggcaggccgatcgcggccacatagtcgctagcaggctagcaggcaatcaccacagagacatgacggttaggcgatcggggcattgcagctgggagccggcagcccgggcagtgcgcggccagcctgcgacacggtgagggtgccagcagctagtaagtcttgcattatgacactatattgtggatctaggtcaagtaaagattacactatgacaaagttctggtttgacgaaccagatgtgctgaaactgagctctccaacaatcatggatcttgggatgactataattggcaaatgcttacaagctttacttgaatttgaaaatgaggacatagtataaccataaacagggatccctgaaatcgctacaaaacaaatcccttgaattcataatatccgtgaatatatctaggtgaattcctaacaaatacattgaatttctgaagttcaattatgattgccaacaaacattaccatttctagccctctccttccctgatttggtgtcacaaatcatcacaagaataaggctaggtaatgccctctccttttcccgagttatgtaaaaaggcataaaaatattattatttactgaaattttgactgtaccacacgcataatatggtttagattttcagactacattctaaaccagattattcagttcagcaatgtcagtactaccaacgccaaattattcagcatcaaagagttgataccttgcagaatctcttgaagcttcagtatgcaattgcttcatgacaggcagtgcagtgtagtgttgcaaattgaaaaacatcgagcaaactgaaaaccaagtaaagtgttgccctcatccgacaatttaacctcaaaataatgatttctcaatcaaccaaaacttaacaccatatttgtcattgtgtgcaagaaaaatagcaaatagacatccaccaaacaatattcagattcaatttgctctagaaaaagtacaacgatacacatagtcaaaattttctttaggttcattcagtactagggcttgagcagcttacagatcggcgggtggatcaggatgacctgccgatagtatgcagacggccttggtggtgctgtggagacgacccagcggcgtggagcggtgaacaaagatggccctagcggcgtggacgacaacggccacgacggcgtggatggaggtgtcggtctggacaaagacgaatggaacggagaaagcccgacaccggcagggtggcggcgtctgatgcgagctaggagaggggactgagcgacggcagcagggcacgacgaggagaggagggaggaggaagaaattggcgcgagcaaagaaatctacgtgtgatcgctgcgattgggaacgcccagggctgccccaaatctgactcggttttgggactggattgggcgtgggggatttttgggagcaagtttgggcagctgttggagctttcctttgaactaaaatcctaaaatttaatttttggggacctgtttaggcatctgttggagcaagtctgtctaatattttgatatgttgtcagtagtgttctcatatttgcttctgagtcagctagataggcgtatgccacttatttggacatgactagatagagaccgcactctatattgtcttaaccagagacttatcttagacctggttgcatactagtacaccaaatgatacatgtttttttttcttatagatttttcttttaaattatttatccgatttataatccgattacaccattgtgttcgtttaaattaaatctttacaacaagatcttacatgactatattttgataaaagaaatatctatgttgtaaattaattttattatatatgtaagttacttttatcatatatataaattacttttcgatttgattaaattacttattatacaatcataatgttgtgagttgtttattttattatcctttttagtcaattctacaatttgtgttgattaaatttagtttttagatagactcacgattttacctccataacggatctatttttaatgtcatgacaaagttacttcctttttgtcttaagttacttctataatatatgtaaattacttttatatgtgtaagaagtaatttagtgaaatctaaaagtaatttagatatactgtaaaagtaatttgtaatttttcatcaaaatataatgatgtgagatcttgttgtaaagatttaattcttacgaacacaaccgtacaatcggatcgtaaatcgaatgagtagtttaagagaaaattttatttgaaacataggtaataggattatattttctacttacttgatggggactagtactatttaaggcagatagggtctctcgttagcactaaaacgagaggcctcttgatttagattttgcccacttattagttattacgatgttgtccagcttctcatcttaagcaaaacaattaatggaacttttttgcttccttcttatctatttaagtggtcgaacaaaatactggaagtggccacatatagtagcctcctcaccgcttgcaaccttgtcgtgtacgatgctaatcgataagccatgcgctgacagaggcatagagcaggtgtacatgaatagctactacgaaaaattatcgcaaaacagagtaaaagcagagtgctatcaggattcagaaatactctctgataaggttgacattactgatcttgtggctcaatcaagaaacacagacccacacgttcaactgagcgagcagttctcagaaggctgcaacagtaatggcttccttcagatgtaggaatacccattcctgtatgtatagtttcctgatgcctctggttccaattgatggttagtgtatatatacgctgctgctgtattttctaagaggggttttacagtgcttgggaggtacctggggtacctcctaagccaattaataccaaccgttgattctgaaaggataatttaggaataagaaatattgttaacgcgggtagattagtaattactcaaccccctacccatcgactggccagcgacatcctatgccgatgctgagcgccggtgcatagggcgtacggcggttgatctaaaggtagcagatgcagagagaagaaagagaagttatccctcataggatctgaaccagaaaaggtacttgcaatggatattggtagaaatgagacgaggaggtgaaacatatatataaacactggtctagaaatccttagccaaaaaccgacacatctgagtcatttcccatcgagcctaagccatgcacatgtaggtggtgaaaatgaagaatcaacagatatatatttgcgtcttgttagataagcttttcaagatgtatcttataaaggcaaactctatattaaaattgtaccacttcatgagtattagaattagattagatttgtatagcctagatactgtatgtgcacatctaggcgccaccccgctctcgccgcgttctccccgcgccactcccctgcatcgtgccgcttcggccgtgttctcgctgcgctcccgctgtgctcccactgcgtcgtgactgtgccacgtcttcgccatgtctaccgggtccaccagattctccatgacttcgggcagcacggcatcaacatcttccggctcttctctgacctccgccgccagcaccggggagtccattggtgcaatcttcgtcaatccatatgccgccatcaacgtcaagactcacatcccaatcaccctggagctcaagcatcccaactttaccaagtggaaggccttcttcatctccatgtgcagcaaatttggtcttcttcctcacattgacggcaatgctcctcctcgacccgacaattcggcttggggacaagccgatgttgtgttcaaggctggctctttggcttcgtttcagatgccatcctcgacatcgccatggaacccgaacaaacatcccgcgatctatggctcgccatcgatgatctctttcatgtgaccaaggaaccccgcgtcatctatctcagtcatgagttccactcgatgacacagggcaacttgtcaattgctgactactgccataaggtgaagaccgccgtcggtgccctcctcgacttcagccaccccgttcctgagtctcagctcatcctcaacctacaaagtggcctcaacccacgtttctccagcaccgccgaccacatcgctggtgcccccatcctgtcgtccttcacttcggcgtgcaatacattgttgctcaaggaacttcgcattgctaatgaccacaaggtctagaccgaggcagccacggtggtagctgcctcctctgccaacacttgtgcctctggcacttgcgccgcctcttcctcgtcgcagcctcgcggtggctgcagtggctccaaaaacggacggaagcgcaaccaacgacgcaatggcggacagaacaacagcggcggcggcggcaccggcgatcgatagaactacgacggcggtggcggctatggaaactctggaggcagctttcagcagcagcagcaagtgttggcattagcttcgcgttaacgacccatggttctgctttaatccatggcccatgcagcagcagcctccctggcggccccctggcaacggtgccgggttgcttgggccttaccatcaagtccacacggactttgccggcccatacgtctcttcaccaactccgggctggcctcaaatgcagcaagcttagcccaacagggatcaaacaggtctggttgctgccctcaatcagttgtccgtgagcagtccaaatccctgggtgcttgacataggagctacttcacacatgtccaccatcgatggtattcttgttacttgcctccctaattcacatacttttattaccgctggcaatgatcatactattcatgttatatgtcatggcacatcttttctacctataggaaccactaagtttgctcatagaaacatccttctcaccccttctttggtttgaaatgtactttccgttcatcaattcacccacgacaataaatgttttattgagtttgatgagtttggtttttctgttaaggaccttcggaccacacgcgtgattcgtcaatgcaatagttggggtgacctctacaccctgaccactgccgcccctgctatcgccgccaacaacttcctcgccgaatcctccacattgtggcatcgtcgccttggtcattctagttcagctgtaatctagactcttctcaaattaactattcttccttgtactaagacagatcataaattgtgtcatgcttgtcagttagggaaatacacgcatctattttttctcggtctcattctagtacctcttctccttttaaacttgttcattgtgatgtgtggatctctcttctgtcttgagtacttctggctttaggtattatttagtggtgcttgatgattttagtcacttatgttggacttttccactttgccatatgtctgatgtacaccagcgtcttgttgagtctgttgcctatgataagaccctgttcggccttcccattaagtgctttcaggcggataatggtaccgagtttgctaaccaagccaccaactcgttcttcgctagccacatcaccatgcttcgcctatcatgcccttacacctcccgacaaaacggaaaagccgaatgcatgcttcgcactatcaacaactctatttgcaccctccttatccaagcatcatgcctacatcctaccaggctgaagctctagccactgccacatagttactcaatcgacgaccccctactgtagtctacaactccatcctgttccaaatcttgcaccgcaaagttcttgactattctaaccttagggtttttggttgcctttgctatcctaatcttagtgccacgactcatcataaacactctcctcggtcagctgcctatgttttccttctctaaccggcctctcacaaaggctatgagtcttcatatctcgtcatgtggttttcgatgaacaaacgttcccatttgcagctattcccctggccgctcttctgtcgattttcttctaccgggtgcttctacagcggtagctccgtcctccttggacgttgagcgtttgcgccctctgccggccggtccctcccccgaggtcaagtcgccgatctccgatgacttggccggccctgatataaatcagcttgtccaacacagcagacagatgccatcatcgcatactccggaccaggttgcctcgtcgcctagtgcgccctctggtgacgactcttgtcctacgggcaggagcatctcctcttcatcaccaaccagaacagtctacattgagctcttctgctgatcggcagcccgttcggcagcccattttgcatggtgttgctcctgcccgaccgttgatctctccgtatcgacatacgtatatatcatgttggtgttccagaacatacgtatatattcagaaacaatatatacggaagttggctttcagaaacaatatatatcggcataagtattgatagagagaatagatgtggaagtatacttacagaagtggaatacaagatgatgacaaaagagaaagagaattgtcacaatacctgtatttcagaacaaatatgaatagtagtttgccttttacttgaaaaatgatcctaattacaattcaggattagaagacaaatatgacaaattcagcattgcaagcaggcatctgaaacaataacaggcattttgttgggtaaatttgtgcagcctagtttgtttgctttgaaaataaaacaattcattttagcaaacagccattacagtagagtagcaacaaaaacaggcatcttaaattatggccttgcataaatctagctaggtatttcttgggtattgcacaacaattggatatacatgaatattcattggtcgttgtgttttgcagctcaaaattagttaagtacaataaccatgttattaattgccaatttgttgccagagaagctcagtatttggggtactattatagtcatcctgctgacgaaactaattaattatgattccatgtcctatcttacgtataaatctactagaaaatcgtgacaatattttactttgtattttttagttccttaagtatatatgattctggttttcagaatatgcatcgcatttccagagtatgaacatatgtagtaggacatatcatcatgtagtttcacatgcgtagccatcacacaattgtcagcttcgaaaatcaatagctgtgcataaatcatagatgggatcaaattattttagaattagggccaatgaaattgtttcacatcgggggcatgtgctatatatgtcatgccaaaaaggaaaaggttcacatacaaatatttagtacaactgaaagctaaattgagggtatggatttatgtatatattcagttgtttccttgctcacacatacttccatcaaacaggttaatttccccgcttgcgttacatggttatgtttatcctctttgtgcaaaaaagtccaatactgaatccagttgtcggccctgtagatttcttacataggagaacaaaattttgtattgtcaaaacacgttgtcaaaatttttgtttaccctgtatagccacattccaaagatattaaaagtactatcaggtggtggaagaacaaaagctattttagttgcatcccaaataaatttagcaaaagggcagtaataaatagatgttctcatgttctgcagctcaaaattaattatgtacgataaccatgtcgttgatgccattttttttttcgaatgattacatgtcattcctgtggggaaatgggagtaaacacatctagctacggcaaaaccatgataataatattttgtcaatgatcatctttcttacgtataaatgattctgatttcagaatgtgcatctcattcccccggtttatttgttttgcgaaacaagaatatatataagtgggtcttaacatcttgtagtttcacatgcgtagccatcacacgattgtcagcttcgaaaaccattggctgtatataaatcatagattagatcaaattaatttggatatggaaccaatgacatggtttcacatgggagacatgagctgtatatgcatgtcatgccagaaaaagaatggctcacatacaaatatttagtacaactgaaagctattccgaggataaatatgcctttttttccatgctcgatcatatattttttctgaaagccaacttccaccacccccagaaaataacatcctataccagcccattgtttctgatggcattattacaacatgaacagctagcttgtggcaccattcagatgggcaaaa

SEQ ID NO: 80797 - DNA, 8568 bp, Oryza sativa
  unsure (1)..(8568): unsure at all n locations
aataaattataattacgtaaattttttgaataagaacgaatggtcaaacatgtgagaaaaaagtcaacggcgtcatctattaaaaaacggagggagtattttttttcaatatttactgggttgtcccacttgagaacagatagcacctggacctgggaagagatcggtggcacctgctgggtcagatttgctggctttcggcatgtgccataaaccgtatttcaagctacacacttgaaacactagtgcagcaatatgatattttaataagtagcttaacctcattgatggggtcgagttaaaacaatggtggattcgtcctctttttcttcttcttcaggttagctgtcctggaacagttgttcgtatttgtactttgatctgaaccctctttcttgggatttgctttttgtaatctaaagcttgctgattcatcataaagaatgcagcaccattttcacatgtatccctaaacaattgtagaagtataaagtaatagcatgcaaactgctgacgaagttcacaaactgcgtagtgtggacttacgtccaacaaaaaatgtacacatccgtccaaaaacatcaccatccagctacctactgtaccatccgatttggttcgatgcagccagtacatatccatgtacgaattgcacaactcagctgcaaggatcgaatttttgagtgctttcgtttcgtcgtcagatgagcacactatctaacaaagtgtcactgtcgtcgaacctactgaatcttcagacaggtcttgctgaggtctgctcgaagagttgtttgaactattcttttataagatcgcatatttctgggagaaagagttgtttgaactcttcttcagatcgcatatttctggtcgagagagaaaaaaaagataccagaagataacaacagatctcccgagatcaatgccgtgatgtcaacatggaaccagactacacctgaaaaggcactgaaaaagaaattgaaacgcgtgtgcagagccaaacgtgcaaatatttgctgggtgctcagtactcgcctcaactacaccttatctcccgaatgcaacaaggagcacgtggacgccttattcggaacagcaatgcccataggttcagacttcagactgtttcagtagttcacacggccggttggcctgtatataaatcacgagaggatcgatcggaagtcaagaggagataggagacagcgaaagcaaattcaacgggcaagaagtacgtgtatttgccttcgagttcttcaggattcagagtttcagacgacaccaaggcccaagctaacattaggcgatggacgagcaaaaccagtggctcacggagccggcaagtacatccagtccttccatgtaagctctgaaatcttcgagcaaagcgtatgacgaaatgattattgcattgttaatgtcaggagcctgaagagttaacctacatgtatcatcaagaagagcacgccaggatgcaagagcaattcgctgggacgccgctcgtcgagcaaccagttcgatttgatcagttctacccagcatccatggcgccaaaccagttccatccgtctcactgctccagcttcccggccttcggtggctcgtcggcattgccaagcttggcgttcggagcggtggcgacgaccaagaaggagcaggtgcagcagccgtcgccttcgtcctcgaacgtcctctccttcgccggtcaggttcagggtagtaccaccacgctcgacttctccggaaggggatggcagcaagacgacggcgtcggcgtgttccagcagccgccggagaggaggagcaggccgcccgcgaacgcgcaggagcacgtcatcgcggagcggaagcggcgggagaagctgcagcagcagttcgtggcgttggccaccattgtccccggcctcaagaaggtgtgtgtacatgtgccccgatcatggcgtgcattgattccttggcaaatgcggcattaacacggttgtccatttctctctcagacagacaagatctccctcctggggagcaccatcgactacgtgaagcagctggaggagaaggtgaaggccctggaggaaggctcgcggagaacggccgagcccaccaccgccttcgagagcaagtgccgcatcaccgtcgacgacgacgatggcggcagcgcctcctccggtaccgacgatgggtccagctccagctccagcccgaccgtggaggcgagcatccatggcaacaccgtcctcctgaaaatctgctgcaaggagaggagagggttgctggtgatgatcctctccgagctcgagaagcagggactgtccatcataaacaccagcgtcgtgccgttcacggattcctgcctcaacatcaccatcactgcaaaggcaaggctagctttacctgtctactactcctagatcatttgggtttcgcatctgtgtaaatgtggctgtaaaattgtaattagatggttgttgttatagctggttttgacaggtttcagttttgtgcagatcgaagagggtttttcgacagcggttgagcttgtaaagaacctgaccgtggctgtcagaggtttcaaatgaaggcagaaaaaaaaaaggaaactggtgtacagaggacaagtgactagtataagtattatgcagtggcggatccaggaaaaaattatagcggggctaaaccaaaatgatcaagagcaactaagagagatttagggttggttttaggacttttttagcctttttagccttttaagcattttaacaacctcaaacaaagtctatattagcccctcatatatgaatatatagattataattttagggggtattatgggggctctaatggtatattagggggtaggggggtctaaagaccctccgcccccacgctgtctccgcccctggtattatgtacgtaaaaaatgtacaattggcattatatgaagagaccaaagatgtattgattcattcgaagaagtacgtagcgtataaattgttcggatctcatgttagatgattagtgcgtggctgaccgctccataaactctgctgagtgggagttggaggagttctctagcattaggctgcgttcgtttgttcgggttaggaacccatctcctccgcacagaaaacggagtgttccattagcacgtaattaattaagtattaactttctttcaaagttggatcaatatgattttttaaacaactttcggatagaaacttttttaaaaaacgcaccgtttagtagtttgaaaagcgtgtatgcgaaatacaagggagaggggttgtgaacacagaccaaagaacacagccttaggagctttagggacagtggaaagcaatgaaggtaggaggggcataaataacgccagagaaagagaaaatggtagaatgggaggaaccataaggggggaatgagactcccctataactttataactttatgcagtttacagttgcgatactgacatgtgggccatacattggtaaggtccacatgtcagtgccataactgtaaactacacaaagtcaggggatccgtttccacacgggggagataggctagctttaagggaaaagaaaaatagagtcggaggggtggaggtcttgggctagctagcgggcctcgccgatgcaaggcagagggtcgcagagtgcctctgactgcatgtggctagcggcaaatcaagaaagtgaagaaggtggtggagaagataaaagaggaaattagggagcttcgtgtatcgctatatttgatctaatggtaaagaattcgtaagattagaggcctgcctggaaacattgaaaaaaattataagtgtaaaaactttacacttgtattttcaagtgccccaagaaaataatccttgtgatctttccagctgtattgtaaatacacctcgatttttttttcttgtttgggtaaacgctacccctgaaaactcagcactgtcatgaactgatgaattgaacaacatgctgcatctgggcatgttggtatacacaccattatccatgttagagtactatattgcagaacacattcatatcaaagtaatatattgcaaactacatgcatgtcaaaataataacgtggaatactagcagttttcctttcggtatatatgacaagaattgagcaccaaattctaaactcctgccgaatacataggagaagaaagaaacacaacggtttaactattataaggatgacaagttctcttgtagtttgtgtcacttggccatttgttcaataattgttctagcaagactattttcatgttatgaactattataaggatgacaagttctcttgtagtttgtgttgcttggccatttgttcaaccagtacaacatgctttcctcattacaaaatggccatgtgttgcagatgtgaaatcttcatatattcattgtgtaggatcgtaaagggcatttcccaccccaaaaactagacattgaggtgaggggctccccacttatatcttaggtcatttgcccttttacaaccaaaagctagccattgaggtgaggggctcccccacttatatcttaggtcctttgccctttcacaaccaatatcggactattcaacagtctcccccttcacacattggtgtccctcagcccttcaccgccccttcaccgtatacgggccccacacccacggtccatcaggtatacggactccgcaggcacccacggtccatcaggccttcacacactgtgtccatcgggccagagatgttaacctagccaggctctgatactaattgtaggatcgtaaagagcatttcccaccccaaaagctagccattgaggtgaggggctccccccacttatatcttaggtcctttgcccttccacaaccaatgtgagactattcaacacattgcagnnnnnnnnnnnnnnnnnnnnntgcaaattttagtgttaaaagtgaatgaaagtcgggcaaaaaaatatgaactgcaaaggaagcagaaagcagaaagttacaatcatccagtcaggctacaagcgattagcattttaatttttcaacaactcatgaaggaccaagatccaattagcaatatttgatatgtactataaataaatatctcatattaaggagcctaaatttgagcattagctcagttttagcataggcaatgttagcatcacagggttgtcatcacatgccgcctatctctacgactcatggagtcctagcctctagcctaacaccgtgtctatgctatttattactacctttatcttgctatgaactaaaaactaaggtactctatctaagcagagcgatgcacacacaacaatgagaatatatcttacttaaataaaaaaataacaactaaaggagatcatgaatacacttataaaagaagcattcgtcgaggtacaagatcggagagagtgacaacatctccggaactcccctcactcaattcctactctactagagcaatgcctaagtatctacatatgtgaaagcaacaagctctctccaacaaggatgagccacgtcacctgaataacaatagccctaggatgatagtgggaagaaaagtggaccgttagatcatcgggataatacaccaatcagctatcaggatagttccagatgaaaggtcatataacagtgttagtcaaagtagcttagtcaaacaaatatttaaaaaaaccatccggaagatagcagaaaaaggcagggataaaaaaccatcgagattctctcatataaaaatgagaagaagactacccaaattaaatctacttatagtttatcattaaattattatatgatttatatattgcacaactttttcactgaagaaaactctctggtttacataactcttacatctgatcggagggcaacaaaaacctaactaccaactaaggtacaataaccttctaaatttttaaacttaacacattataatgcgtcaaaccttttataatttgaaaataaaaggatggtttgaatataatatgttcattattcctctgcaactcaaatcaatattttgaatggtgccactttctatcactaatacttttggttagtatgaatcatgaataccatgcatatgttcttctactaaggtaagtgccacgtttacatgccaaatttctttatggacaaattatagatcttttatagtaattgtattataaatttgtacaaggagtagtaaaagtataacagctaaaatatagaacacattatgtaaaactttaggaccatcaatatgtgttgttagacttcttaaagcatttaatcaccagcataattttgaaataaatcataaagcatttaatctactgaacataaatcttatgttcaatctattctataactaggtggtgtttttggaatatatgaagcacaggttctacctcctagcaacaactatcaaactattatacctcttgtcaggtgatatattattaataaactatttactttcattcttttatttcataatgttcagcacttatactttacgaatttatggaagacaaattccatctcattgcccacaattatcaaactattatacttctatccaactaacataatatggaaatgaaataaaatatttgactgctatccttctaaatcatacactttagtatggacattatgtctatatttttataaattacacctatcattgcacgactactcaacctttctatatatgtactattcatatatttaaattatcatcagatatttctttcagctttaccattttaataatcaatctatttacatgtatacaggtgcaacaatatgctccagtaacaagttcttcatatgaacgaagaaatattaccaatcaacttatgatagactttagcaagctatatataccttaatattttgttatgaacactactgttagtacatgtcttccaaattatattatacatggttgtccaactacaaatgcataatgatgggacatcaagtttatatatattcacaatctgcagttcatacaatgatttcaggcttataattacttcaggcacatatttgttttgatggtctgctggtgctgggtgtgtgtattaattattattacctgatgcgtgtatattgctgacctacaggattaaaatttgcgtggactacaaaggcagttcatcttaaccgcttatctctatagtgtatcatgctcacttgcagaggtgcttccatgaggagcataatacttcaacatattaatgatttcaggctttgacaattgctcttcctgttgctacacacttcaacagtgttttaatatggtcaatggtcatggctatgctactgttcggagtcacctatgtgattctaaggtttcataaagtttcataaattatttgtgattcaaggcaacaaagtatcattgtcattaacagaaactcaacttatcgtttcatcttgcagaacatcgtcatcttacaagggctataagcatcaggaatcttctaaacatgattggtttgggcaaatgaaaaatacaaaattggactcagaggtattgcctccaaatagttgttactacttggactcagaggtattgcctccaaatagttgttactacttttaactagctatacaagaccaagttttgatgtcttctaagctttcctgtatatatgttactgttgtgcttgttagggaatcttggaaaactaaactctatagttatgcctaggggaaaacagcgtgggggcggggcctctttagacccctacccctaatataccattatagcccccataatacacctaaaattctaatccatatgtttatagatgaggggctaatatagactttgtttgaggttgttagaaggcctaaaaggctaaggcccaaaaaaatcctaatccaaccctaaatgtctcttagttactcttggtaattttggtttaacccccgctaatcctaacccaaccttaaatgtctcttaattactcttgttaattttggtttaaaccccgctataatttttatgctggctccgccactggttatgcccaaatgcttgtagtgcctaatcagcttagatggccctatacttgatcttgaacatctacactttttcagacaaccaattttactatttgttttgctttttaatagttgacatagttagccggtaagcaatccatccatgatcccagagtgctttatcttttcccatgctgtcattctcgatttattctactgccagctgccatttgacatgttattgctttatcttttcccatgctgtcatcctcaatttattctactgccaactgcccttcgacatgttattggtggtgcacttgctatagcattacattggtgatgaagtgatgaaccagggggttaaaatccaagttgtgatgtggcgatgaatcaacgatgagaattggacaagaacccaagcagacaagtaagatatgaaagtgatgcaagtaattatgatagcaatcatgtccgatcaggcttctcaatataatccttttaggaaagggatgagattggcagcattttttttactcttttgattgagattttgct

SEQ ID NO: 80798 - DNA, 13119 bp, Oryza sativa
  unsure (1)..(13119): unsure at all n locations
agctcaattgtccgtgtttgccgtctggctaggtcacccttcaaatttgggcttcagcgtactagcattgcttgggccaatatatggaaaatctgttcattataatgagccacatcatgttgggccgacacagtgaatgagaaaatcccaaacatgaattctaacacattgagggtgtcccctcatatacttttttctctttaaaatttaatgcagatggttatgaaaaaaaaatcaatatagagcatagtagcatctatcccttgattgttatcattatgtcaaaatggagttgctagaaatatgacgccatatgctatttcagccactttgcacagtagtgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaaacggaagccaggacttggaccattcatcacaggcgcgacttgggaactaggccgaaaccctaaaactcatcgtagccgacttgctcctggaagaactcttcgtcagcaggatccacttcatcttcttcagcaactggggggggattatttatatagagcaagggtgagtacgggagtactcagcaagccaggggaaataagtgtttaatgcaggcttcaaggaaaggctgttgttttcgtaattgattttgtttgaactcttttctaaaaattctaagtgagtgcttctcaaacgacacggatgagacagtgcgtctcgtccggtcggagtatgtgcaatgtatcagtctttaggattgcaacaaggttggcacccggccaacagcttttcaaacggccacccgggccaacaactttttaaacggccacccgggccaacaacttttcaaacggccacccgggcctagctgatcccatcagctacagatttttcaaacatcgaaccccttttcacaacagcaatttcacaagcagtagtcagacaaaactacgctaggaatcacctcacatccgcccttgaccgtgggcacgactattcgaacagttcaatgacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacatgttaggtcccagaccatattgtgccaagaagcccaggggtcctccccgacaccaccccggcgaatccacatgtctctcggcatcaaggctcccctgataagctagttactcagccaggggtgtcccattccacccatgtggtcgtacttgtcttatgtttggatgaaattacaaggaatcggtccttaagtgcgagagcgggaaaccatacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcgcagagtgcacgaatatcgaggtgcaactgggtggttacaaggggacatggtataacaattaataaaggaaggatcaaatgcaacaaattaggtaggtctgccaatctgccttgcagacgggacaacagattaagtgtgatcctatcaatgcataatatttcgcaagcaatataattaaatttcaaatataggctcaagatgttcaaaggtggcttgccttgctcgagatctggagcttgatcctcgaaattctcgcactgcgggtcttcgggttccggaactacacgcgaaacgggacaactcaacaaacggcgaaaataaagccctattaaagacctctaagcgtgccactagatagatctcgagatttgggaaattttagaagttgaacggagtcaaacggaattacggttgggaagatattgaatttctaagattattggatttttggtctaaaggaaaaggatttaattaaatcctttttgaaaaagaaaagaaaagaaagaacagagggatggaaattagacttttcctcgggcggctagggcgcggtccaaggtaaatggagcggctcggccgagcttaacgggccggccggcccaagacggcccaagcgcgcgcgcgggagggaggagagagagtccggtggaccgggctcaccacgcgcggtcccgggtgggacccgcttgtcagcggctcggctcaccgtgcggagggagtacgtggctcatgcgcgcgggcggggaaaggacgcggtgcacgcgagcggtccgtggtggacgcaggtgcggcgggcccacgcgcagcctcacggctcgcggtggaacgcgcgcacggggagggactgaccggggtcggctcgatccggtctaggctgagctggcgccgacgtggcgcctacgtggcggccacgtgggctggcgggaggtagacgacgacccggcctcgaatggacggcgggcggcggcggcgagcggcggagcgaaccacggcgatacgggcaacagcgagcacaccgggcggttgcacgtgacaagggaaggcgagccatcggctcggattcgccggaggttgctcgacggcggcggattgcggcggtggcaatcggcggcgggagaatagggaaacggagacgaggtcacgagaggtcgattcccgccggtgagagcatctacgcggcttcgggaactcgacgctagcgtcggattgggtggaactacgccgagcgaggccggcgacgagcgggtgctacggagctcgagcggcgacggcggcgaacacacggcgaacgacggcaacggtcggggcggcgccggctaactacggggaggctactcaagctactaccgaaagctagggggaggagatggagcgaggaggaagaacggagagagacatcaccgagaagaggaggggcgatgtgacgagaggccagcggcgcgggagtaatctctccggcctcgggccggggaagaggaaggagagggcacgcccgaagtccccttccgcgtcctcgaacgcaccggctctcccggcgcttggcgaaggacggcggaggcgagacagagcacgggggcggcggcaacggtgaggaggcgaatgggagaggaagggaaagggggaggcttgggtttataggatggcaatgtcggtttgggaaccgacttagggcggtcaagggcgcgagctggcgctcggcggtcgcggccaaagcggcgacagggaggatgacgccggcgaggaggaaaaaggggaaaaggagggggagaaagggggcttgcccctttgccgattcgggaaaaagggggaggggagcgggggcgacgcggcagagagaggagggcgcggcctccttcccttggcggcttgcgcgcggagtggcgggggccgggcggtgacgacggcgatgacggcgggcggtttggagcggagcggcgacactggcgacaggcgcggcagacgctgacgacggcggcgaccgggcggtcggccactcggcgcgcgcgcgcgggaaacaacgggcggcgtccgcacgggcgctcacacgcgaacacggcgcgcgggaagcgtctttgcgagcggggagctcgcgcgaggggaggggcgctcggcgcgggcgactcccgcgcacgcgcgcgcggcgcgcgggcgggccggagggggggagcggggaaaaaggcgctcgggcggctctcgcacgcgcgagcagcgtgagggcggggaagagagagagagagagagagagagagagcgggagagcgcccggggggagagggagagatgggccgggaaagaggggaagatgggccgagcgagattcggcccatcgaccttgggggaggcaaaatagacttttgcggaggaatttgattggaaggaattggattcggagttgaactcgacgatagatcggggattgatatcttgagatggcacggacactagacaacaagcaaagaaacaaatttcgcaattagggtttttaagagataattttcccgctaggcgccacgacggaacgggcgctacagaccaacccccctaacaagaatctcgaccccgagattcagcacctaagggagcaggtccgggaactcggcgcggagaagatcttcttgctcccaggttgcctcgtcttcggaatgattgctctattggactttgtagaacttgatggtcttccttcgagtctgacgttctgcctcttcaagaaccttgatcggtctttccttgtaggtcagattcttttccagctcgatattacccaggggaacttgctcttctggaactcgaagacatttctttaactgggatacgtggaacacgttgtgcacatctgcgagaccttcaggtagctcaagctgataagccacttcgccacgtctggcggttatgaggtaggggccgatgtagcggggtgctaacttgccggacatcccaaacctcctcataccacggaggggtgatactcgcatgtatacatgatctcctttttcgaactcaaggtcacgcctccgattgtcagcgtaattcttctgacggctctgtgctgtcttcaaacgttctcggatcagcttaacttgttcttctgctgacttgagtatgtcaggaccgaataccagtgcttcgcccacctcattccagcacaagggagtgcggcactttcttccgaacattgcctcattcggcgacatcttaatgctggcctgataactgttgttgtatgagaactccgcatacggcaaacaacgatcccaagtgccttcgaaatctaaggcacacgcacgtagcatgtcttctaggatttggtttaccctttcggtctgaccatcggtctgcggatggtaggctgtactaaaattcagatcagttccgagggcttcatgcaactgcttccagaaccttgaggtgaactgagtgcctcggtctgacacaattttcttgggacagctaaatctacatacgacatgggtcatgtagagttctgctagtctctttccatcataggtggttttcactggcacgaaatgagctgatttcgtgagtcggtccacgattacccaaacggagtcgtacccgctgggggttcttggcaaaccggtgatgaaatccattccgatctcttcccatttccactcgggaatcggtaggggttgcagcagaccagctggcctctgatgttccgccttgactctttggcaaatgtcacacagggctacgtattctgcgacgtctcgcttcattccagcccaccagaaatatgccttgatatcttggtacatcttcgtacttcctgggtgaatggagtaggcggactcatgagcttcctttaggatgagatctcttaactccttcttggccggtacacagatgcgtggtccgcaccaaactgtgccttgatcgtctatggagaaattggtgtctttcttctcctgtattctttttattaattcttttatcccttcgtcgtctttctgagcctcccgatttgcgactctagggtaggctgtactgtcaagctggcagggacacctgactgtaccacggtcagtcttaacttctccaattctctgcacaggtgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgagggtgtaacatcccggcctagggcttaataggattaatagaatactcatatcaacaagttgcaacttcttttccggaagccaatctccaaagaactccagggttaagcgtgcttggcctggagcaatttgggatgggtgaccgaccgggaaattcttcccgggtgcacacgagtgaggacaaagtgtgtagaaaagacatgtgttggtctgtgagggcagtctatgacctatgaaagctatcatatgtaagcgggcccggcctgggggaaggcgggacgttacaaagtggtatcagagccgactctcgcggtttcacgggcgcgtgtgtcgcagttgcgcaggcatggtgcgcatggctggtgtagaccgagagtggttacacagcatggcacatgcgctggcactggacacatggacgtggccaagaaaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagactcccagggttaagcgtgcttggcctggagccatttggaatgggtgaccgtgcttggtctgtaggccagtctatgacctatgaaagctatcatatataagcgggacatgtgttggtctgtgccagggttgatcgacgggggcgtcgatcagtgtgcccgggtgcacacgagtgaggacaaagtgtgcagaaaagacatgtgttagtctgtgagggcagtctatgacctatgaaagctatcatatataagcgggcccggcctgggggaaggcgggacgttacaagtagttacacctcatttatgtcccacttacatatgtaattagtatgtaatttttaaatttacatttataattttagtacttacatatgtaattttgagacttacattgtatatacactaaaattacatatgtaatttagggacttacaatgtaaatacatgccgactattttttgatgaaaaatatgacgccataaatatagctacacccatgtcaaaaatcaatttcaaactatatttacaaattaagaaagaaaaatattcaggtgtgaatattaccaaatactagtatcatacattgaatctcttttttatttctcgatacatagtttttttagacttcagattttctatgtggtatatgtatgttgtataaatgctattaaatttttaaatatttttttcgtagctatttgaatgtttattttacaaacgaaagatttcccgagcgattgaaagagttcccttcttcaaataaaagaagagtttcccaaactgatgcccttttgtttcctccggggatactgttgtaaaaaaaatacgaggcacggcaccatgataaattaagggactataataacaataaaatattaaaatatgccgtcataaatttagcaaatccgtaaatgaaataaattgatcttcaatccgttttacagtacaagaataactcagtccttcgagctaacgggtcctcctcccttaacttccattgacaaatctgcagctcttccggacctccccctggctgcccgtcagcggctggatgttccccatgttgaccatggacctggcgaagctcttgaagaaggccttctggctgatggcgaagctgttgacgatcgccgccgtgggcgcgcccggcgtggacaggagctcctggtcggactggaggaagccgcggttcacctcgatgttggcgaagtagttcttgtcgaaggcgtccggcgtggtcgggtccaggtcgttcagcgccgacgagttcccgccccgccgcgggcagctcttcgccagcgcccgccggtagccggcgtccagcgtcgggtccggcttccccgtcccgctgaagttgtacagcctgtccgtcacgaactggcactgcaccctcccgaacgtgtgcgcccctgcccatttacattcattttcacccacaattttcagtttcagttgattgctattccctccgtttcaagttataagacattttaactttgatcaaagtcaaactgctttaagttgtaaaaaaatagtaatatttttaacacaagacaaatttattataaaaatatattcaattattgatttaatgaaactaatttagtattataaatattactatatttatctataaaattaatcaaagtctaacgttttataatctggttcggagggagcagtaggtagcgtcgtacgttatctccctatctgttactctgtttatttacctgagagggcgacgaggtcggtgacgtcgaggccgacggcggcgaacttctgctgaagggtggtgaggttgtcgcgggggctggggaggttattgtcggcgccggtgaggttggccgtggtgccgtcgcgccggccgaggggcacgcgccaccgggggcctccggactgcacgcattgacacacggacattgtgggcgtcatgtggccgtgttggagtaaagtgcggcacgaaaagaagggatttggtgtgggatctcgacgtctggtcgtcgacacagccgatgccacatgatgtgtgcgaggacataatccacgtcgtaccatgtggtctctgttttttggtgctcataggattattatttttttacagacggttaatgttggtgagattatgatctatctgcagcattgcggttcaattatttggcaccgacgtctagctagctttatgtctcgctccagtccagttcccagcccagtcacgggcatattgtaggctgtagcgtcaacctttctactggagataaagctagcacgaactactagcttgccagtacgttaatttgtcactatgctggcgtgaaaagtatgtgaaagaacgtagctaaactgcttcgttggttagcttccaatgaagttgacgtgcgattgttatcgggagataatgacgggtttacgtgcaaagcatatgcacgtatatatatacttcgcgccggcagatcgatttctcgcgagcgtacacataccagttcgacggagatcttggcggcgatggcgaggatgtcggcgcaggagacgacgccggggcaggcctcctcaagtgccgccttgatgtcgtccaccaccgggtacccccgcgccgagttgttgttcggcgtcgcgaacttctccgacacgatgctcgtgctgttgtccagcaggatcgacgcgtcgcaaccctggaaaaaacggaaacgtcgcgtcagacgaacatcctgcgtggcgcggcgtacgagtgcgcgcgtgcacgccggcaatggtgtggcaatagctagctcacctggacgaagcagtcgtgaaagtggaggcgggtgaggctggcgaaaatgcgggggtcgtcctgccgcgccctcttcagcacgcgccgcacgatccggtgcacgtccgggcacgtcccgtcgtagtacttgtcgcacagttgcgccgacgcgccggccgccgccgcggcgagggccacggccacgaccaggaccgcggcacgaaccgcagccacagcgcccatctctctctctctctctctctctctctccgctgcagccttgagctagtaacgtatgtacactgctcactccgtgacgcacaaatgagaaatgaccaagtgttaagtcggtgtgacgaagaagaaaggaagctggctatatatagacacgcacacgcgatcaattaatctgacatgtgtatgacatatctcgccatgcacaggcttaattgtttaagtatgacaaactaactagcggcacctttgcttgaacccgaaggatatataaccaatcattcgcggaagaatcgaacgtgttaacaacgtagatagctcttcggctatcgcggcgtcgttttcagagtgcaacgcatgcatgcatgctggtgtgcgaacagaaacactgtgctttagaatagtttcccctttgcatatggccttcccttccctgtgcgttcgttgggtgcacctaattctctcgcccgatcgtgtgtgctagtgccaccagattcaggcagtacaacgctgactcccgtttagtttcagtttgttgcaggtgcagcaatgcagcagctaagctgtgatgccttgactgcacggtccctcgctctccccatcactttctgaacgaataattgcagggccaatgaaagtagtagtagctggcaatatttggagccttcttcttccatcgatcgatcagagaggtggtcgttggtcgtttggaggggaatgatttctccggttgagtggttgctgacaactagtgctatatccgtacgtggtaagcatacacaaattaaggacaacgtacctgcttcttccctctgaatattttgtgtacagtatgtagcttgtacagagttctcgtcaaactaaaattaaactcctcaccgacgtttttccatgacattttagcgaatttttcaccctttgtccttctccaaactaaaaatctgcctgtcatattcaggatcatcaaggcatgatttttggccacatcatcagtcactgtatcatgcaccacgtaatgaaaaagtagttgcagtagtagtacgaaaaagctaaacctgattggatgctggagagaaggcgaggcatcgttctcggaacataagtggtcgatgatgagattaggtggcagatcgatccagaaatgcaaagtcaaaaatctaaaagtttctttgcaacggagtcgttagcattcattccggttttttccttgcttgttcaaggagctgcatcattcagttcggaggacgtacccgagcacctactgataaaaccatatggcagttgcatattctttcttttactctgatagacacagcgcgtttgtctgtgctctaataattggtgatacacccactgaaaatgcagctgcagattcgtgtaggacgagcaactttgcatgctaattgcttattctactcgtgcattggagagagaatcctagatagcttgaacaaaacgaaacatgtagcgctccacaacacattaaaaacgacagattcacacttgagtccaagaagacgatatagcttctggcaaatccaagatggggtcatggcagatgcaaaaaatctttgcctttttgctcatcagttgacggccctgcagttcttgcgaatctggccggcagagccggtgagagggctgatgttgcccatcttgaccatggagttgccgaagtcgcaggagaagcgctggccgttggcgctgtaggcctgcaccagcgccttggtggcggcgacggcggggtcgccggagctggagacgaggccctggtcggaggcgaggaggcccttgttggccagcaggttctggtagtagtggttgtcgaacgcgtcggcggagttgacgtccagcgccgccagctggtcagcgccgccgcggcacacctgctgcaggctggacgccagcgacgagtccagcgtcgggtcgacggagttggtcgccgagaagttcgccagccggttgctgaacagcaggcagcgagatcgcccgatcgtgtgcgcccctgttcaggttcagaagagttcagatcagtcttggattgattcgtagccaaacataactatattttgaaacggagggagtaacaaattggtgcagaaactagtttttgatctgacaaatgctaaatcatgcataatccacgtaaactgctatgcatgccacaccgagtagagtagatgcgacatcgttattgatatcataatttgtgtctttatcaattcatttgtcaaatcccaatcaatgtttgattgaagaattgacgaggtaatttttgctcgatgcatgaagatataggagatagatagaggtacctgataagaccacaacatcggttgcgttgagaccgacatccttgaacctcgcagtgataacgctgatcgaatcgaaagggctaggcaagttactgttcgcccccgtctgatttgccaccagaccatctcttcttcccaggaggacatcataatcaggtcctccactctgcaaagaccaacacagatatattcagcatgactgaaaaatcaattgttcttttgctcgattggtaatactatagtgctttactatcaaagatgaattttcatccctccattcgagacataggaacgtacaagtagtactccgtatttagctgcaagggctactatgtcggcgcaggagacgactcccgggcaggcgctctcgaggtcggcctttatcgcatcgatgacttcgtaccctctcaccgagttgttgttcggcgccgcgaacttctcgctgtttgtgccgtcaaggaggatggacgcgtcacagccctgcagaattcacagtgtgtcggtaagaagttcagagttcagtctctgaagttcagtaacatatatcacatgaaagttcagagtcctctatacaggttaattgagatcgttaatttcattttcttgtttcggtatgtgtacgttttgaatgcgacttgcatgcacgtagtgtatctagcgcactgcaatgagcagcagaaaaaggggaaaaataaaatagttggatgattacattacgaagcagtcgtggaagtgaagcctgagcagggaggcgcccatgcgcatctcggccttcatcgcggcggccaagagggaccggacaatgcggtaaacctgggggcagcaatagtcgtagtagtcgtccgtcagctgcccgctcgccgccgcggcgcgaggcccagcaagancggcgatattgcagaggaaactcaggcagctagccgtgcgatctccacgagtagcgtactccatggccaatcgatcgaattgtaattgatcttttacttatgcacttgtgattggactcgatgtctactcgcattgcttcttgcagtgctttatataggctgttcaaagtggccagtgattcagtgttgtcactgtgtcagctcatatcatatggaattatggatatcaattctttttggacaaaggttagacctcgtgcatgaatggcagagtaaatgggcggctagtgagagatcgatgtgtcgtcgtcagcttccataactggtaatcagttttccatatgctgcatgcatggcgatgggtcattggacgctaggacccttttcagcgtttctgaatctctgactctgaagaagtgtgtgatcttc

SEQ ID NO: 80799 - DNA, 807 bp, Oryza sativa
agggatcccttttagggtgatagtggctcaattatatctctaggaaagtaaatcacactcctatgtcaaagttttgcaatcctagggtgaaatgatctcaagtatgtctctagaaatgtaaattgcacaaatgtaaatgcgacaatcaaatgagacaaggagacaagagatttttcaccgaggtttggaaactcgccggtttcctactccccgttgaggcgagcccaactccaccgctcaaccacgaagccaccgcacgccccctttgtcaaggggtgggcaaggcgggagccggcccacggagaggactacccaagcctcgatcactagggtagttcttccttcactccgaaggtggtgaactccaaaccactcacaaaccggcgccgggccttctccacaatcttctcggagagatcaccgggcaactcctccacaagccgtctaggaggcggcaacctccaagagtaacaagcaatgacccggcatggagatgatcaagtgccacactagctctacaatggaagcaaatgcacttgactcttggctaaacaaccctctaacacactagatggatgaacacaaagctcaagtgagtgtgagagaggtgcaaggggtgtatgcaattgaattgggtgccaagagagcccccttgctactggtgggggagtatttatactcccacccaccaaaactagccgttgggggcgaaatcccccaactctgtgctctgccggtctgacctgaggtatgtggccggtcagaccgtgctactctgcaacgactagaaaactagccgttgtagcc

SEQ ID NO: 80800 - DNA, 17493 bp, Oryza sativa
ttatggaatcccaacacaatagggaccaacactttcttccataaagtacctcatatggtgccatttgaatgcttgcatggtaactattgttgtaagaaaattctacaagcggcaaatgatcctcccaactgcctttctaagaaagaatacctgatctcagcatatcctctagagtttgaatagtcgttcagattgaccatcagtctaagggtgaaaagccatattgaatttcagttatcaaatggctcttgcacagactcccagaacttagaagaaaatttaacatccctatcagaaacaatcgagcgacacacaccatgtaacctcactacgtcgcgtgtataaatcggtgctaagttactcgatgaataagtggtgcggataggaatgaaatgtgccaccttacttagacgatctacaactacccagatggcatcctttcctcgtgggttacgaggtagcccaaccatgaagtccatagcaatatcatcccaagaccatacaggatcttccattgattgtaactttccagcataactcttatgttcagccttcactcgctgacatactccacatgatgccacgtactttgccacatccactttcatcctcttccacctatagatcttcttcagatcatgatacatcttgttcttgccaggatgcacagtataaggtgttcggcgtgcttctcgcaaaatctcttccttgacttcagctttctgtggaacacataaacgcccaaggaatccaaagtgaaatctccagattttccttcccttacacgtttcttaactttttgcagcaaccgacgtgttgttgggcctctagcactcattgtggtatgacggactcaagaatgactcgtgactcggtattcgccactccggcgtagcaataggagatattcatccgttcaaaattagttatcaacaactcacagtcagaggaacgaccttacggcttagagcatctgcaaccacattcgccttacccggtgtatattgaatattgagatcgtaatctttaatcaactctagccacctcctctgccttaagttcaaatccttctaagtgaagatatatttcagactcttatgattagtgaaaatatcacaaaattctccatacaggtagtgcctccaaattttgagagcaaagacaagatcatgagtggagtaattctgctcatgcttctttaactgcttagacgcataagctataacattgccctcttgcataagaacacaaccaaggcctactcgtggagcatcggaatagacagtgaaacgcttaccaggttgggggcaaagtaagcaccagagcagttaccagcctcagcttcaattgttggaaactacgctcgcataggttcgtccactgaaacttcacatccttatgtgtgagcatcgtcataggtttagcaataattgagaaatccttcacgaagcgtcgatagtaccctaccatacccccaaaaaaaaaactcgtcacatccttaacattagtcggcctttcccatccgacaacacttaaaactttgctaggatcaactgagataccttgctgattgattacatgccctaggaaagccacttcaggaagccaaaattcacacttctttaatttagcatagaacttgttttcccgtaaagtccctagcaccatcctcaaatgacgctcgtgctgctctacatccttggagtaaatgaggatatcatcaataaacaccaccacaaaattatctagaaagctatgcaacatgcaattaatcgcctccataaaataggctagagcattggtcagcccaaaagacattactttatactcataatgcccatacctcgtggaaaatggagtcttctcaatatccccttctcgcactcgaatttggttataaccagattgcaagtcaatcttagaaaacacctttgctccctttaactgatcaaacaaatcttcaatacaaggcaatgggtacttgttcttgattgtcgcagcatttaaggcccgatagtccacacacatacgccaacttccatccttcttctcagtaaaaataactggtgcaccccatggcgacacactccgtcagattaacttcttggataatagatcatctaactgtttcttcaactcttcttggaaaggacgagctaaccggtatggggctctggagataggtcgtgtaccaggaacaagatcaatacggaactctacatcacgctcaggtggcatccctagcaattctgcgggaaaaacatcaggataatctcgcactacaggaacatcttcaatcaataaaggcttggatgccttctcggctaaggcccacaataaccctgtctttatagcaagctgtctaggaaacaaccttgccatcatgaaaagagaatgcggaggcgcgctcccttggaaaaccatatcgtcgcctgatggagcttccaaggtaatagtcttctagaaacaagagattacagtacggtatcggttcaaccaatgcatgcccaagatcacgtcaaagagcggtaatggaatcacaattagatttgccacgaattcttccccatcaatagagattgcacaacctggacatactactgaactagagattataccccctggagagctgacttggacagattgagagacctcttgactaaatagattagctcttttcgcaaacttgattgaaacaaaggaaaatgtagcaccagaatcaaacagaactagagcatcatgcgaatcaattgaaagtgtacctgtaaagacatccgggcgaccaagagaataagctgcaggcatgttgtagactccagccatagagcctgaggcctgctgctgaggtggagctaaagcagaaggatgcaccataggcggtgcaggcaactggagtggtgtacgtggagcaataaattgaggcgtggaccaatattggcctggtagtgatagtggtgggtaattatgtgtgaactgctggtgaggaagtggataagttgtcatcatctgaattgcaccatgaggactactagtggatgaacctgaacctcgagggtaactagttctcgaagaggttgttgattaggagatagacctttgccacgtgatgatagaatttggtttacgcttacataccaactctatgtgtccagccttgcaacacccacgacattccccagtaaacccacactctgcagaatggtgattctttacacacttaaagaaaattagcccttgccctggtacagggcgaattatctgagactctgcaagacgtgaagctgaataaaactgagaaacccactgcctaggtttggatgatgattgagtggcctgattttatttgtacttcttgaatggtggtcgttacgggttctcgtccccttcctgatgggctctctctgttcgttgctagtgacattgccaggacgattcttctatgcagtagtaatttggggctcaacctccatcccccgagcctcctcaactgtattgaggtatacagtaggcgggtttcttcccatcacttttgtatatcgggcattgagccctcgaaagaacttcctagccttctcatgctcatcactagccacgctaggcacaaagcataaaatattgctgaactcccgctcatactcatccacagtcttgcttccatgttggatattgtttagctcatcactcatcatgtccccaaatgattctggataatacttagctctgaactgctgaagaaaaacttccagagtaatagcaccacggtcagggttccacgcttcaacaacttcgtcccatcaaatgttcgcctgactagtcaactgaaaaggcgtgaaagcaaccttctcaggggtcattctagatccactcatgtacttctccatcttgcgcaaccagtctgcagcatcaatgggagtactagacccatcaaatgtgtctaagcgcacggatgtccatctagtgagtgtcattccccgagtagctcgagcagcatcattagatacaaacagccggtccatgtcctcatcttccatctggttcgatgatgccgcctcattatggcaacctctaccacggcctctagcatggcccctaccacgacctccacgattaggaataggggattctgcaaccgagttgttccctacctcttcatcctgattattttcaacttcttcattatggtggcccctaccgcgacctctacctccgcctctcctgcggcctcagttggctaaccgagcactcactaggcggcatagctatatcaaacaatagcatgcaaagaaacacaatcatacacacatatatgcagcagaaacataaatgctaggaatgacccatgcacccccatcctattgtgcaccagtgtgtcaagttttagatgattacatctaatccaagttttactttttattattttctatcctaagagaaatttttaattggataggaaatctagttcaaaattttatgtcgatttatatttgatgtaacccagtcacttcacatggacctaccgcctgctctgataccaactgtaacaccccaagtaaccacgtacctaaagtgccacaccaaaatacattcaaaaccactaactcccaaaattattagaaatttcagcaaagcctcccctaaaaatacggacatccacgacaagcagttataagataactcaataacgatataatccacataatccaaaccatcctagctccatgaattccccgtgaaaataaggaccgaaactttaaatgacatttacaagttctacgcaaaacttatgctaagcagaaacatagtctaaaattaaatttcaatagtgtgcagtaataatgtgtagtccaagggtgctactcccgtcccatgccgatcaatattattaggtacctaaaaaccaaattaaacacaagagtgagtaaagaatactcagcaagtacaatatttaactagtaaaacatacacaggtttaatgcaagaagaaaccaatatgaaacatttgatttcctttattttaaaacgaaggaggcaaagagttgtagttccctcccgggcaggtgtgaatatcctcttagcattaccggtaagccgagcaagcgtgatcagcgcttctcaaggatcatgaataaaaatccaaattgcactcccatgactacgcatggtacttgtataatgtaaacaaaaaacttccggaagaatgaaacatgaataacgtcgttaacttgaacatgaagtgaaatatgaatatgtagcataataccaaaaccacacaattaataataggaagcttcgaataataattgggtaaatgaaaccaacaaagcaacacagtttatccatcactcaagcccatcttgtacttgccttaacttcttcgataatccaactcaactcctccaagttggaaccctccacacctgtggagaaaaactacgcataaaccactatatccaactaatgattgttacaagggacatttagtaaaatcgaaacctagaatatataattttttaccgatttatattaaataacctatagctgttcccttactgttttatgcgtaactcacaaaccgtctaatgaaatctaagaaataatataacttcggatatctgtacaaaattgtctacaactttcatgttgggcgaaaattccgattatgcctctgcaaatcccagattaaggaaaacaaattgctgtcctgatttccggacccagtcagcagtactgtttctgttgtttctcccaaaccgtttatcggaattgagtgaaaccagcgccgtttgaaagatatcgacgatgactacaaactttatttaggtcaactaacctgaatcccgacggtttattactagatttaaaaatacggtttcagcctataatcaataacctcaaaaattgcacaaagggctatcgaataaatttctatttgaatcttatacttctaaggggtaaccaaaagtaccgttgcagcgtggatactagaatttgagaacaaacccgcaagccgcgaaatcaccgaaatctccaaaattccttcttcctcctattatcctcctccctggccacgcagcagcagcctgcaggctgcagcagcgatcagcggcagcagcaatcgcatgcatccgcagcagcagcaggagcaagcaatcgcatgaatcagcagccagcaaccaaataaggagacgacagcagcacaaagatcggcggcaggagctcaccaagaacgagccgagcaggaggaatcaagtggccctgatggacgacgacggccgaagcagcggcggcggcgcagaggcgacgtgggcaaccagaacgaccgcggcgacggcaagggcgcaggacggcatgagcggcggcggctagggttttgctggcgatcccttttttcttttttttttgttatataaagagacaataggagatctaacggcccatatcgattcgatccccgggacttcgttcggactccgattactataaatttatagtctattttgcacaactcggcgagctctacgcatccacgattcttgatcgcctattcgaataacggtttaaaagttgaacttttacgtgtttactaattcgaaattcggggcattacattcttccccccttcaatcgaattcgccctcgaattcatccaaccatactctagaacatggggtattacattcctccctccttcaatcgaattcaccctcgaatttgtccaattatacctcgaataactacagaaaggaactcataggtaggacttgtataactcacttggtgtgaacaactccgggtacttctccctcatttgtgactcaagttcctaggttacttctcgctctgtctggtgcgttcagagaatcttgacgtacttgatagttctatgcctcagttccctctaagattcctccaatattcgtacagggcgggactcaaatgtcaaatcttgctcaatggccaccggctctacgataatacgatgatcagggtctctcaaatttttctcaacatggaaatatgaaatacatcgtgtacacctttcatggactctggtaactagatgtgataggctaggattccaactctttccactatcgagaatggaacaatatacctagggctgagtttacctttcgttccaaatctcacaacgcctttggtaggagaaacctttagaagtacttgatcgcccactttaaactccaattcccgtcttctgacatcggcgtcgctcttttgcctactttgagctaccagcatgtgttgtcatagttctgctatccgttctgtgtcaaacatcaaggatcacaattatgcaaggtagggaatgcagcaaataggtcataactaccttaacccagtttcaaataccgatatagtctaagttcacatgcaagtttgcaaacaaacatttttcattcctcaaatcatgggattcgatgtgttcaaaggatgggaggagaaaaacttgccttgatcagagaaatgttagcacctaatccactccttcaccgaatatgcaattatctaaataaaggacacgttatgcaattaaacaccgaaagagctgaaaatccaaaatgctctaaaatgcatgatttatacacagtgattaggtactggtctaaaatgaatttaggtgaaagaatttctattttatcttattccatttgggagttatgaattttagaagttttatcggtttatagtagtatagtcttaggtagtgctacaaaatattattgcaaagtggtttttattagatttgactatacaggggcatagagatgtgttttgtaagactatcgcatttggtttcacaatttttggagttgtaatgattttcttatagattttacaagttacaacttattctaggcatatagtgttctatatgtgcatgactcttaagtcgtaggttcagaacatgctacatcatgtttaagttgaaaaaataagtaatttggttaactaaaatatttttagttcacatgtttatagtttttactaccatggttcatactttataaactagggatgctctagtctaagactagcaataccttatattaacttagaaattacaatatgagccaagttcttctatgttttggtggatagggatggaattatggttctactggtctataagttttatttaggtttattcatagctagagtgcattataaatagttctacacctatattttgcttaaccatcactaggtaattaactcctaggtcatctatttaaagattaaagctataatttgtataaaaggtgtcatatcttattttactatgttgaagctcactattttctggttctatagaaacttggttcatttcatttaggctaaaaatgaattttctacaaattttacaatttaaagtctgctataagttagtaaatccttacatttatttagaggcttttactacacagtaaatataaaattttatttcataacctgggaatacacattttggtgattctacagaacttaagtttactcaaattgaagctaagttgaattttatatgaatttctaaactttaactcatttataactagtcattttaaagataatagtttgaggcatttgatgcaaagtaagtaattacttttatttcacttaatcagagagagagtgcatgatgatgaatctgtagaatttgagtttgtatcaaaataagttaaattgaattttctatgcattttataagtttgtatatgctttatgtatgacctatcttagataaattttagagacaatatttgtacagtgagtgtcaagttttctattcctggaataaagttcataactttttgaatctttagaaactggaatcacctcaaaataagctatatttgatttcatatggattttacaagtttgtgcatttttctgctaaacatatatttgtttgtgcatttccttagttattttccagactttaaaagatggggtccacatgtcattggctgtaaatatgcagagaggcccctagagttctcaaaaatagaacccgcagtccttatacatgtatactatcaaattcattaagaactagtagccatgtagtcacgctttgcacgactttagatgcctgtcttgaaatcatatatatgtatatatgtatgtatacgtatgtatgtatatgtatctatgtatgtatgtatgtatgcatgcatcgttaatatgataactaggaaggtagcccgcgcatatgcgcgggcatgtgcgtaaaattttattacgaatgtccttgtgtggatggttttctatcaaaaatattctttcactttatcataaactaaaattgaacttacttaaagtgctttgaacgttggttacttacaatatataatattatgataaatccactttataaagcatctttgaaatgctttgatcgctgtaagtcgggatgaaaatataagtgggttgatcctacaacctggcatggggtaaaggcattatttctaaattatctcgctccaattaagtaagaaaaattaaaatagctgccttagtattttcttagcaaattagtactaaactggagcgtcatgtaataattacatgtttctagattgttctatgctatatgtcacaaattcatgatgttcctgtagcaagttttaccaaaaaaaaaggatatggtcttttaattcctatctttaggcttatatattgctgaggctacatcacgattgttttactcttaagattcctcggtgcaaccaacgtgctcaggacaataagtatgttgttcaactggccacgtgacttcgtagatcatatatataatttagatgctatgatcatcttaagattatttatatatctcctaaaatgataatttattgataaaagcatcaataccaaaatgtatgggtaatagctcctatatacaagctgaaaaaaagttgatagaaagacgttagatgtctaacgggatatataagtaatgggtctaccagttttataaaaaaaataagctgggacattttgatttttagtgaacaattttagtattttcttttatttagggtaaaatttgctataggacattaaaaaaggtgtaatcggccggaggacaccgcaagaacgcgtatctgttgtgggacacaaaaaaactggtaattagttattagaggcccgtgacattaatttataatatccaaaggaaatgcagagagaaagaataacaaaagtatgacttttccccttcctaccaagtctggctcacatacaccttcgacgctgcaaccgcactagccgccgatgaggtggctctctagagggggggggggtcaaggagggcctgtgcgcctgggcctttggctccatgtcattcccgcactcgtcgcgctgcagcgtgagggccatgccagcactgatgctctgccacacactgcgcttgggatgagcacaacgtggaccatctccagattcctaacgaggagggcgccgcagagcacaggctattgttgtcggtctcacagccatgccatgccacgctgccatacctccaccgcccatgtcatgactaccacggcgtcagagcgatatgcgagccacacatgacaggaagaggcaaaatcatactttcgcgattgtttctctccccttttcctttggatacaacaaaataatgccacgggtatccagcagctcatttaccagtttttttgcggtgtccatagcagatatacgttcttgcagtgtctcttagctaattatactttttttggatgccctgtagcaaattttatctttattgagtagaggctgggtccataatgttatttttttgttagcagttaaatatagtcaatatggacattaagttattgttttctcttaaagaataatagctggttagacctaaaaggtggagattcgtttgtggtcttttctttgcccataaaaataattttaattttaattatcatagagatattaaaaacaaagaaatgtaattccacacaccgcatgggaacggggatggaggaagggttgtgatacttattttttttaagaaaaaaaattgattgatccgacgacctaaaataatgtgtcgatgtttaagtaaaaaaccgttggttggatgttatttttttctcagatttattaggtttttttctaatttaagtgggataaatagcaacttagcaaaacatccatagggatggagaggaatggaagatggtttgggatgtttttttattaaataattagatacaataacgatgtaaaataatgtgtgaattgatttaagtggaaaccaatggatggattaataagatgtttataagatgtttaatggactttaagaatgtcatacaatgatttagaaatatttataagatgtttaatggactttaacacctatttttgagattattttctataaagataattttaatttaattgtgatagggagcctacaaattgatcactctatgcgtggtgcactgtacggggatgtgggatgttttggttttctagtatagatctaacgatctagaataatagtccaccaatttaaatgaaaattgacggttagatttctcaattttattagggtgctacatgatgacttgagagtatttatatggtgccatgtgatggtttgggagtgtttgtagatgtttaatggacttttagtatataatagatagatagtactacgtacatatggtttttctctttatcttatatggtagaaaattatagtttatatttttctcccaattatactatgtactttttttttgactttatcacacaggcattctttttcttccgacgaacggaacctaagcttccaaatcatatgtactgtagttacaatttttcgtttatgccgacgatacatattttcccttttataaggggaggtattaatatatacacctaatgattctaaagtaactggtccaccaatttaaataaaaattaactatagatatagatctaatctaatggtctaaaataacatatccactaattaaataaaaattgacggtgagatcgtttatagaaagtttaatgaatgatatttacgtaaatttatagaatagtatgttttatctttaaataatagaattaaagatcatcaatttttttcaatgtgtaggtttagtttttctgtacgtctgtacttgattgtttttttcagttgtacgcacgtttggagtacttgcaatcatagttctcccgcatatacatatagagattaatgaattagtttcttaaaataaaatatatctaatctaatgatttaaaatattgggtccaccgatttaagtgaaaatcgacggtcggattcgacagtgctacgtggcggcttagaagcgtttgtagaagcgtttataggaagtttaatggacttttagtatataatacatagataagtcaaagccaagtgaaaaaaaccctagctttttatataaccattttgaattaatttatttgcataatattgattggttggattttggatggaggtatgttttactccatgattttatacaattttcttcacatattgctaatttaattacattttcccaaaatagaatttattttacaatctttttgttcttataaatttggccttttggctcttaagattttagaacttaattaggtgaattattttcgtcttgtaaatgaattaaacttgtagtagaacttaattaaaatgaactattttgaatgtatgaaaacaataaccttgaatcatgtaaatttaaatgtctttgagaaatgtatatggacgtctagtttagatatttatatatttccagtgctaattgggtttaagatgctaatttataatattacacctaatctgaaatatactactaaccacatagataacattgtaatatttttaggactgttttacagtttaatacttacttagaggtttaatgcaaatcaaccaggtggggcccacaaggttaggcatgccgcatgcccactgacaaaggggtttcctttctattggtcttggctatgtctcccccctctctctatgttaattttgtgatagtctctagaaggttcttgaagacttgggctagcctcttttaccattctacatccaacgtcagatattggaccccttttacatcctacggctcatatttaattgatgatgtggctaaatgaggtttcaagaaaggttattcctttcgttactttagattcttgagttttgcagcttttactaatagatccttggtcccacatgtcattctaacatattttataatttagaccttgcaagttttaagctctctctaagcggaatcttcagcgcctaatgacgtggggtctgctggtcagtgtctcagcaagagagcaagggcagcagcagagcagcggcgactcggcgagtttctcgccggcgccggcgatgaacggcagccgttctcgcggtgcgaccaaaagagaaaacattcctaagcttcttgcgcatctattcgtagtggtttcatggtcggaggtgaccggaatcgatggtgacagtggtgtgagcggcggtggttctcggggtgacggtgcatgtgtgcatggaagtcgatcccgaacgaaagggatgcatgcatgtggtcttctagccttcaggatgctcaccgtgggtcaagctaaggttgtcgaggtcttggcagaagcgatgacttgcggaatggctcggcgacggcgctcctcctcgggtgaacgatgacggctcgaacgggacgacgagctgctacaagcaggcatgcacaagggtggtgaggtcaaggagatggtgtctgcgcgaggaatcgaacaatggctcaccggggcagcggtaatcgatgatgacggcggaggcgattctagatcggcgccggggaagaaaagatgtgttctccagagccggccggcgctcgttctctccctctcagtttttcttggtcggctgagggtgagggacagaggaagggcgagctggagaggctgccaggtggggccaagtcgatggaagctaggcttgggagagaggtatgggtaggagtttgggtagacttagtttttggacaattttcggaattatttcttctccctaactttgcaactcaatatcttaatatgtggaccggaagaattagtgcagattttactggtggtagatgtttatatctagattccattttctttagttggactaaaaaataatgggtagactgctcacataaattagataaaaatgggctatttaaaagttagatcaaatttttaagagacctaaacagaagataaaaattctagaaaaattatatttattcatgataaataatctagtatttgaatagattatttcccatgttcacttatgagcagttaaatgtacttttgaatgaagtatggcgttagccgattaaaatttaatttgatttcttttagttgtctgtttttactgattaatttgaggtgtcaaacttagttattaatttataccaatattacagtgaattacttatgctaaacatagtttacataaatttttccatgattttatctagattattttagagaattagaatgacctttctttgtatatgtgttcccactttgtaattgcacctaatattattacagggattacattaaatttcttttgggctgagaagatgatatttgagtttaatattaagtccatattttatcgcccaagatccactataagtctgtttagtaaattttaacctctttaggttatgctcatggaaccttttatgaaatacgagaccaaaatccaaatgcataagggactcgagcctaggcatgcattatgcacatgtctgctcatatgctcggtgacatttctagtctaatgttgggaatgaaaaggttttattttgttatcaaattttaatcatgcaatggtttaagttggtcatcacctaagttaaaacggaaatttttgggtcttaaaattggagaagttaacctctaattattttgacaagaatattttttgagtcctagaatttcgggtatgttacattaggcatcctcttgccaaaaccacacgagcaattggtgcaagcacgctctagattctcatcctcttgtggcagcgtcctagtttctacaagttggccatattggagggcatagggggagaggtgttccatcttctctctcaccctctctccctaaatctggaagacgtggatagagttgggctttgtgttgattgtaagggcgttttttaggcgatctcgtctatgttccattgttggcctagcggcggccggtccaattctagccttctcctggaccagtgtgttggcgctgtcggtgtgtgggtggtggtatatttttttccttttttcctggttacgaccctccagggttgtaatcttatagttttttcatgctctatcaatagaagttcgcaccgtcttgtgcgagtcgttcaaaaagaaacaaatctatgtgaaataaagaaatcaagcagatattctattagtaaatttctatccatgcatgcttggcgtttattttctatcaaagtagactaaaaagagaatatgttgttcttacatggccccatcctcctctttttgcaacaaagcctcatactaatccagtgcgcatggtgcctctgaagattaccattaatattggctacagttttgtgttgtcgaaaaagatgttattgtgacttagccgtataactcaaaattgagcgcttatcaaaaccaaaatttgattctttatttaggccatgtttagttcccactcaaaaactttccgccctgtcacatcgaatgtttggacacatgcatggagtactaaatatagacaaatagaaaaactaattacatagattgacaatatgtagttctacagtaaacatttgctaatgatagattaattaggcttaataaattaatctcgcagtttacaggcggaatctgtaatttgttttgttattaatctacgtttaatacttcaaatgtgtatccttatatccgatatgacacgtcaaaacttttcacccctgcatctaaacacaaccttagctttttgtttaccccatatagctactattagaaaaacaatttattgccacgaaaaaaatcgtagcattaatgctaaaattgtggcaataggtacatgttgtcacaatcttaaaatcgttgctagccgtggtaataaatagcatggtaataggttgttgtaacgacttttatttagttgtaacaaattttgatattgccataaaatggatgtggcaaaaaaaatatattgcaacacttcacatcgttaaaataaataactattgccaccactccatgtgtggcattagttctatgtaccaaattaaatgttttaatattaatttatcatcttaactattttttttatatcttgtcatggttaggatttgaacccaagatctttccctcacgcgcgctctttattaccaactcacctaggcatcattttttttaaaaaaaatgcatatcatttcatttgagcgtacctatctgagatttaaatcgtgaatttgagtatttaaaagatttcaaatgaaaaagttaagttgtagagctctaaatttcatacaaaatttatcctaatccgtgtccatataaaaagaataagtcaaattatgaaatcataaattttttattgcaacgaatttattgatcgcggcaatagaaaatagtgaaaagtaccatgtactatgcaaattgccacataaattaaaattgtagcgatagaacatgtttttttgcaatagtaaagttttttttttgtggcgatagctcattttctattgcaacaaaaataccaaataaaacaacgattgtaaatcgttgcaacaaaatatatttgccacaagaaaaattatcattgcgatagtacaatatattgccatgaattatttttcgttgtaataaattggtggcgatagcacaattatcttgtagtttgccaacattgtagaagtactatcatatgttggaagaccaatagctatttgtatttgaattgcacgccaaataacatttagcaaaagtatgatacagaacagatgtgttgtattctttcgttataattacaaatgcaacattttgaactataagtctatactgtccttttgctaaattatcttttgttaggagttctccggtaacatttggaacctttatcttgaggggaatttttatattccatatatagcggtccattatttgtcaatcctctatatatagaatgagctttgaaccatccatactggtgtaaaagaccatcaaaatgtgtcatattggtaattgagtcctatttcccttttttttatctacaagctcactatatctcttcgtaaagaatattttagaggtttataatttaaaacctctgtgactgttgcactttggttccttacaatgcaatatagcatttggtattgttggtttacatttt

SEQ ID NO: 80801 - DNA, 746 bp, Oryza sativa
ccacaatatgagagggagaggtagaggtgggtgggtgggtgaaggtgagagtaccggtgtcggaggtcatgtgtgcagtggcacccgtatccatataccattcatttgtagccggttggggaagcgtcatggtgttgaaggagttggcgagagaggcttgatcccactgcgagggagcccccccaaaccagcccaccgactgctgaagagcgtggggcatggagggctgcgtctgtgcctgctgttgggccggctggcccagtccaccgaagccatgtgtgccaggaagaagtccataggactacggcccgtagactggctgtggagccaagccgaggggcggcccagctagagctgtaccagcaaagtgggccggcactggtcacggcccaaggacgccacggcccatggatcccggccacatatgtatagtgccggcccatggattgagtgggctaggccactgcgcaggttggcctgttgggggcttgacgctgccctgtccaggcgctgtggcgccgttgccgccgccttgcttcccgccgccatttccgccgcgacgacagcgattgtgggagttcccgccaccgttgccgccgccgccaccaccgccttggttcccggcgccgaaaccggaggtgtgtgcagaggtaggggcgccagtcttggggttggaggagcctgtgccgctcccggcggggaacgctgcagcccgagctccgggacgaggcgtctggctgagttcc

SEQ ID NO: 80802 - DNA, 5936 bp, Oryza sativa
  unsure (1)..(5936): unsure at all n locations
gtactgttgatgctgatcgagatggtcctccagagaattctacttcgaccagtactgaaacagaatgtggatcaacttcagaagttgctgctcctctgcacattcaacgacgacatccgccgaaacaaattattggtaatataagtgagcggactacaaggtctaaggtaacggctcataatgtttgtgcaaattctgcatttgttgcttcttttgaacccaaagatgtgtctcatgcattaactgatgaatcgtggattaacgccatgcatgaagaacttgaaaattttgagagaaacaaagtttgaactttagttgaaccaccttctggacataatgttattggaaccaagtgggttttcaaaaataaacaaaatgaggatggtttgattgtgagaaataaagctagacttgttaatcagggttttactcaagttgagggtttggattttgatgaaacttttgctcctgttgctagaattgaggcaattagacttttgttggcttttgctgcttcaaaaggttttaaattgtatcaaatggatgtgaaaagtgcttttctaaatggttttatacaggaggaagtttatgtcaaacaaccaccaggttttgaaaatcctgattttcccaaccatgtttttaaattgtctaaagctttgtatggtttgaaacaaactcctagggcatggtatgataggcttaagaactttttgcttgcgaaactttttacaatgggaaacgttgacaaaacactttttgttcttaagcatggtgataatcaacttttcgttcagatttatgtggatgatatcatctttggttgttcgactcacgctgtggttgtagattttgctgagactatgcgcagggaatttgagatgagcatgatgggtgagttatcgtactttttgggattgcaaattaagcaaacacctcaaggtacttttgtgcatcaaacgaagtatacgaaggatcttttgagacggttcaatatggagaattgcaagccaatttcaacaccaattggttctacagctgtgttggatccagatgaagatggtgaagctgttgatcaaaaagtgtatagaagtatgattggatctttattgtatctaactgcttctaggccagacatacaatttgctgtgtgtttgtgtgcacgctttcaagcttctcctcgtgcttcacatcgtcaagcggtcaagcgaataatgaggtatttgaatcatacacttgagtttggaatttagtattttacttcatcttctatatgcttaagtggatattccgatgctgattttggaggttgtagaattgataggaaaagtattagtggaacatgtcattttcttggtacatcattgattgcatggtcttctaggaaacagtctagtgttgctcaatcaactgctgaatctgaatatgttgctgctgctagttgttgttcacagattctttggcttttatctactttgaaagattatggtcttacttttgagaaagtacctctcttttatgataatactagtgctatcaatattgctaagaatcctgttcaacactcacgcacaaagcacattgatattcgttttcactttttgagggatcatgttgagaaaggagatgttgagttacagtttttggacacaaagttgcaaattgctgatattttcactaaacctttggattctaatcgctttgcttttcttcgtggtgaattgggtgtaattcatccttttgacatggtttgagggggagtttgtacctcatggttttatcaagcaataatatgacaatgaaaaaattgagaaaagagagctttgtttatgcatatggtattttcttatgcatgctagcaatactttgaaggtttatttgtctctagcatagcttgtatgtattctagtcttttcatgagatttagattttgcttttaagggagatgatgtatgacacttaaattctatacttgaattaagcaaatatgcaatgttgatgctagcatatggtttgatttataaatgctctatatatatgctttattgacttgttattcctcaaatagctttaattgttcattgtaaaaaagagaataaaaatatgaaaaaatgaataccgaatccttggaaacagtcttgacgacaaggacgtattcgatgtgagcaaaataatgggtgccgaatccctggaaacagtcttgacgatagggacatacccggaataaaaaagaaaaaatatgagcaaaatggctcaagaaaagaaaaagttaaaaaattctcttggttattttgtgctagaggttatttgagaaagagtgataaatgcaataggtatatgtgtttcgtgtttattcttcaacgtatgtgcttgttaagatgttgcattataaatcgtatgaaatcacgaattttgattgttgattcaagcttaattgtaaaatctttggttcatggttatactttaattcatgcttgttttgttatagatgggtctatcttctttttattacaacacatgacttgatatgctatatgtatgctaagctcttgaacattaatgaacataattcctatgcttgatgaaatcattgtccaaagggggagaagtaatttgaaaatttttttggattttttgaagcaaagtgaatttttgaagagttgttgagaagagcatgttgttggttcaattgggaatttctttcttttaaaaaagagggagaagttttcttttggatttttgagcacgatgtgtacatttgtacgaagtgtgctttttaccaccaaatatcaaaacatttttatgagtttgccaatgtgttcatcaagggggagattgtaaaatcaaaggtgttttttattattattctgtgatgaataattgggcattggagattattggttttgttatttggaatttattctcgaagtggttttggagattattggatttcacnnnnnnnnnnnnnnnnnnnnnnnnnttatgtggaccggtcagaccgggctctggtagccggtcagaccggcgtgtaattcgcggtcagaccggcgcagcccgcggtctgaccggccgatactgtgtcggtttcggtttcgggctgtttatttggatatccgagtttattccatgattatgacttctatatggatactatacgtatgtaatactattgtttgctgctaatgagtcaagttggagatagcttggtctcggaatatagtttctttgtttgttctatgtgtaggtgactcgatgtctcgggagagtatttgcggtgatggaccgggagtcggcttggggataagacgacgtccgtggtggtcagagatcatgcgggatacttaggctagagttgatgcacgtggttgatggagattccatatggtatatgatggagttattgtgtgcgtatgggatgcggagtcgaatttggaaggagtccaaatttggtacgtttggttatgtaaagtttctttcttgtactagtgggtttcctaaggtgtttaggactcctagtatgagtttggttcgtggctttagactgcctacctcatgtataaatagagggggagcgtgaggcttcccggcatcgctttgtatcgcgttagagagcaattgagttgagttttgagttagggtttcgagtttagtcgaaatttttgtaaggagtgctattggtgcactttgtaaacacagagagaagtaattaagtcatcatccactttaagatttcttcgatttgtgtttcaccgggtttcggcggtctaaccggcgatctaccggcggtcagaccggcggcaagtggcggtcagaccggcggtgtacaggcggtcagaccggcggaaaccaggcggtcagaccggcagggcaactttggtcagactgcgatctatcgatttcgagggtaatttttatttccgctaaaagttttcggtttttgggtataccaaccattcacccctcctctggttggcttagttcttgtgtttcgattgcaaacgtctccctgtaaccgaagatcacgccctgcagcagagctagcgtgtacaggacgtccagtgccgattgcttcagattgtcgccgccgtagtcgcgctcgattagccgccacagagaaatcccggcggagatgtacagtccatagaggtagatggcgaacagaagccacattacgatgctcaacatcgctgcttggatcttcatcaccgtgatgtatgcactggggcctgcactgatctctgccctacttctgcagatggcaaggtaggagaacccagtgttgctcaactgcttgttcatgatgacattgaacaccctgttggatggtacggtttgagcagcatacgtaacacatggtttgaaatttcggtaatatcggccctcccgtcaagcacaaatctacccaaagtttttaattttttttatcaaatatttgtaaaaatttgttaaaattcagtcaaaatatgttaaaactttaaataatttcggccataaaaatccggaaatcacgaaatttcaaattttcggcaaccacccaaccgaaattgtaaaccctgatgtaacaagtggaattaaggtagaacgcagacgggttcactattttcaaatgcataatttctgggtactgaactttaggattttctgaggtaactaaaaaaattctaattcaaataacttgtgcctaaacttaatttctcgtaagagcttaaaatttttgcgagaagaacatcctacaggaacatccggtaaacccgaaatcttggaaaattcagtccaaaactgtgaaccctaacaagaacgtcatgttcaaaaatcgatctacttatgtactagttactctctccgtcccataatgtaagggattttgattttttgtttacaccgtttgaccactcgttttattcaaaaaaatttgggcaaatacaaaaaacgataagttgtgcttaaagtactttggataataaagtaagtcaaaaaaaataaataataattccaaaattttttgaataagacaagtggtcaaatggtgcaagcaaaaactcaaaatcccttatattatgggacagagggagtagacaagaacaccatgatttaaaccatgtgtttcgacagatgtgccgtttaactagtggctagtttgaagtctaaataggtaatgggaaaagaaaaatcagtcgtgaggagacttaaccaaatacctgaaagagggtgattaccgtgagacaccaaaagtccttcttccccagcatggagacgaaaccgccgaggaggacgaccgtggtccatgtaaccacgaggaaaccaagcccattcacggctattgtcatgtaccccataaggacgccatagctgttgatgtactgcacttccaaccagtcggtgtcgctgggatccagggatgggagacgccggcgagtgtttcgccgtttacggtgctcggctcgcgcgccacggtcatgcagccccagctctaccccgtcggccattcttgtcaagaccaagagaatcaagatgatcgcagggggcaccccactccgagaaatcagccagccatttgatcggacagtccatgggtgtagttgaataacatggaagcgaagtaaacgatatgttaatttatgccaagaacgaggttggatcagggagggcgagcttgttatttaattccagcagagaagatgtgcaaatatcaaaggtcaaggtgcgatgcgcgggcatcgtatatatttttatataaactaggatggtagctcgtacaaatgtgcatgcatgtatctcgtttatatgggtggagaattaaccggattatttatatcttgattcaaaagtacgatttctcttaaattatgcccatcaacattgcttggatattttttccaagctatttgataaactatgaaggtagcctacatattcacgcgagcacgtattgtagcctg

SEQ ID NO: 80803 - DNA, 3603 bp, Oryza sativa
tatgtattcatataatacatatgtccctcggcaaaaaaaaaaaataccatgtacaatgagttaggggcaaataggtctttttacagctctaacagatgcccaactaacagcttctggactgtgatggcacgcagtagacgttcgggaaaacacgatggcatattattcaacttgacaaagtcagtggtatattgtagctagaagtagtgaaaactcaatggcactgagtggattctctctttctttaaatataagtaaaacaacaatttaaataaactaaaactctaatataacttaagaattataatcatttatctttgtaattattgatcgttattattaattagttaaaaatcaagagacgaagaaattaagtgagagaggggaggaacagagttcacggggatatagtacgcgtgcataactgtaatattattttcatggataatactgttttagttgctattattttgttaacttaaaagtttgattaaaatctatcttttctttctcatcctttcctacagtatattaaatatagtagataccaaaattaagaacactacaaatctaataaatctaataatgttattttgacttattgtaacatcagaataggttcattttaattactttgaagttatataggatgataaaatatatatcattattttttgataattttgtaattgtttgaatggcacgccaaaatcagaaaatacgggcccaaagcaacatattcattaagaaatactcatgcttggttgtatgcatatacttgacggtcacatcatacatgcttggcgaaatttcagaagaaacatatcgtccttcatcagatataagtattcatgctcctttctgtttttgaatcttatagaccaagttgccggtactacatagtgaaaatcagttttctctaagttggtcacttttatttcagattcagctcatacacgtgttagtgcgtgcattgcctactattcagctttccatcagacaaccattcagtagatcatggtcaaacaattgctctgaccatctactctggcaaggtattctgtacataaagttcttcattagaaatctaaagatcatattgtaattaaacgatgatcatatattgtaatccaacaaaccaaaagtatattgttggaaaattaaccattcctgcttggtgcagtagaaactatagagcacactataaaactgtatttagaaaaattgttatctgttttatcatcatatattcccgcagcaacacgcagggtattattagtagtgctaacggggagccgcaaatggatagcacggagaacgtcacagattctgagactgttgatcacccttccttggtaaaccttatgttgaatgatccaggtgtgcggatttgaaatgatcaaaaatttgaggatgatcctgcgatttggaccagaggttcaccggtccaaaattttgggaccggtggatccttctatgtgtatccaggaactaaatttttaggactttcagaaattccgatatgaaagttatgaaatttctctcggcccaactcctaatgcctcccatgtctaagtgcgtgatgttcctggatacacatagcgatatgcaatttgcagtatatgtcatctgtgcagacaaatggattgcagtatagaagatcttactcttgattgtccttttctagatggtgaacactagatattcagtgtaacagctatcacatgagaagtgtatgcacatgtgtttttacgattcttaaacagttaatgtgagattacagacagagattagtcttggaaaagaaaatggttatatttttttcctcgtataattacagaccatgaataagtagtgttcgtcaagttgtgtgaaacagattttctaatatctatgtccggattatgtcaaaacggttggactaatacgggccaatgtatttcttttggtcaatttgaatagacatcaccgattaataaaaaaaaccagaaaaaagagggaaatcaaacagagcaagatcgagccagaggcctagctatggaaatacaaattgcctccaccgaatggccatgtctgtacttggactgaatgaaaactagccgtactcagcaatgtcatgtgtctactgaacaaagtggcgcagaagattttggccgtgtttagattcaaaattttttgttcaaacttccaacttttccgtcacatcaaatgtttagacacaggcatgaagcattaaatgtggatgaaaaaaccaattacacagtttgcatgtaaattgcaagccgaatcttttgagcctaattacgtcatgatttagcaatatgatgctacagtaaacatttgttaatgacgaattaattaggcttaatagattcgtctcgcagtttacaggcagaatctgtaatttgttttggtattagtctacgtttaatacttcaaatatgtgtctatatactttaaaaaatttttggcacacatattaaacacaagtacacaacctttattgttcaactatgttggaacagggagcagtgttgctaccttgacagagattatctgcgaaatgctggctcatcactgtcaacatttgggaggataggatggggcagggtggatggcttattatgattttgagcatatcccgtgaatttgacaggtcgtcaattcctacgagtacgcttagttgaaccgaaatttcggcgattttggcacctcctgttcgaaatttcagtccttgtcactgctctattccggatgcctgccatgtctaagttcctttgcaaagttgtgttgtatattatctgtgcacaaaatcgacctaagaagataagatgtatgagactcatcatgcttgcagctatttaaattcaagctggagtcgatgcctttctttagagggcctcagtatcctatgggcttggcactccgtggaataaatttaggcctcggtcggcaccaacagcttgtttggcaactgagggaaggggattggaaatttacacgaggaaattaatggtgagattaagatgagaatttgatttttcatctcagtctcttgtttggtagaggtggtgaaaattgatagggagtttagttggagattagatcattaatgaaaacggatggctgagatttgtttaggcgaagtaaaggaggaattccctcccaattacctgcccctacccaggtattgaaaaggagggagttcattcctcaattccccatcccatcccaccaaaattcccatttcccccaaccaaacaaaacagttaatagcctcatctctctaaactcctaatcctcctagaaactccctccaaccatacagaccgcaagggataattataaccaggtaaaacggtcaccggaggggattgggttgatcccctcccaccacccaatccctttcaccacgggattatcatttggtttgtttggacaggtaagggattggtgggattgatttatttggactaaggtttaaagatttcattacataaattttaaattgtcacgaacaaaattgcagaaaattcaaaacaccacccaaaaaaatcaaaaaattcaaaaaaaatcaaaacaaaaatacaaaaatgggaaaat

SEQ ID NO: 80804 - DNA, 3896 bp, Oryza sativa
gacccgtacctacgcgccgccgcccagctcctgcccctgcgtgccgcaccgtgagagagagagagagagagtgtgtgtgtgtgtgtgaagagataaaggaagaggggaaaataagtatgacaggtgggtcctatattttttttaataaataaaatgctgactggattgccacgtgtacgccacataggacaaaaccactttggattaggttgaagggggtaattcgtccggtattgaaagttcagtgtgagcaatgcctggtttttgggtttatggggtaattcggtcgatcgcgatagttcagggggtaattcatattttttctactttttcttaaatctaaacataggctatcaaattaaaaaatacaaaaaaaagtcaaatcagtgttagaaactgaattgggccgcagatggcatgggatggccacatgtcaagtgaagcccatgcaagcacactgaacaacaaatacaaactcttaatttcccataaaaacaaacctaagacaagttaagacacatcataatagttcatccgttttttaatatatgacgccgttgattttttacatatgtttgaccaattcgtcttattcaaaaacttatgtaattatcattattttattgtgattaaattttttgtcaaatgttctctaagtatgacttactctttttatatttgtacaaaagaatccaaataagatgaatgtttaaacgtttgtcaaaaatataacggggtcatatattaaaaaataaagatgaatgtttaaacatttgtcaaaaaaaagaacggggtcatatactaaaaaacgaatgtagtactatgaatttgtactgttcggattttttataatccggattttagtttagaatatatcgcatctcatcctaagtttgttttttaaggacggagggagttgcgcttggtagggcatcgaaaaaatagaacgccagaatgactacgacgataactttgaggccggttcagctcctcgtcgatcttcttccctacatctcatcttccctacttgttctacaaactcgccgtatcttctagccttgtatcctaaactattttcctcttcaggtacaccaaatatatgtgattttcattgttattagaattagagaaaaagttgctaacaagtacatgcatggtcctaaatgtttaaagcgaggtcacatttaggtccagaatattgtaaatacaatatttagatactttttaatgtattatagtaggtccagtgcacgtctgattgtgttcgacagccgacgtggctatccaccatgcctacacatatgtagttagccccctctatggcgggggggggggggggtgagggggggtaatgcgcgactagtcgcacggctcccccggcgcgcgactactctgtacgtatgttaacaatcaaatttggtaatatctgcatcggaaagaagattggattgaagcggaatcaaacatgagaattatcgcggaaacagagtaagaatcggctgaggtttggatcggctaagtccgagtcagactgggttaagtgatacaaccgattccgacaatacaacttgtatccgatatcgggtttgagttgacgtacttcaagatgattgccatacatggatagagtcctgggaaggcgattaattgtatctattaattaagatattttatgtaaattccttagagataaatatgggtaaaagtctgccgcaaagacttatggtatcttagagtttgttagagataatagtcgtgtccggtatgggcatatcttgtaattctcgggtataaatagaccccgagccctatgtaattttaaacacacgttcaatacaatttcggcgcatcgccaccctttcgctttaattttattttgacaagttcttgctttcgtgttgagctgcatcggtttcgatcttcgacaagaggtaaaacttgttatgacggcttacgttctcgagattcgtcgagttatcatatatcttacataatctttgacaatatcgttatctaacctactatcgactaacatctgttagtagaaggcagccgattaggttaaattttgacgttgatttagattatataagatatctaccactctatgaaactcccagcggcttgattgtctagatattgttcttcttttcgtacttaatgctgcatcagttgagtttgatctattaagtcgtgcttagaatcggagtttcagccgatcttatctgatttaactatatttgctctatatgtttcattgacacgttaaatctgccctttatgtcaaaatattattgcatctaattatattaagcttctgtttagtatattctgcctgttttaacatcttaacatagagtcgtataggagtattagccattatatgctagatctatctgatcggctatgctatgaacatatataatcctgttattaatgtatatttcgatctaagtgatttatacggtctcggcatggcgaccgaatctatcccaatcacttgatttaagtatgtatcgatataaaaattatatattgttaatatctacagccgatcgaatagatttagttctttattacctatttgcaaccgccgatcgatttacatatgacatcggctcagagataaatgatacgtcatcggcacttagccgatcggctatcatttataggtttaaactgcggtttctttatatttatttcttgttgattgcaggatcaaatcaactggcacgctagcatacccgaagacgagttttggacctacactggaattaagcagatctcccaggcctcgtgtttttcgtcatcaacgtactagtactagtctattacaagtagtactactacactaatgttataataatactaatattattactatatatatatatatatatattatatatatatatatatatatatatatatatatatatatattatatttatatatttttgatgtataaaaaatatacacatacaaagtttatatacgtgtcgtatataaagtttgtatacacgtatacaaagtttgcatgcgcgtacacaaagtttgcatacacgtacacaaagtttgtatgaatgtatacaaacttttttataggtatacgtaaatgctaaaaaaccgaaaagaaaaaaacggaaagaaaaccgcaaaaaactgaaaagaaaaaaaaagcaaaaacagaaaaaaaaaccaacagaaaaaactgtaggccccacctctacgcatgcgctgtcgtgtggccccctccgcgcgcgccacgtgcctcgccgcgcggggaggcacgtggcgcggctgaaataaggtcagtgtcctacaaccaaaaaaattaccataattttcgtgtgtagtcaaacaaagtcaacttttttatgatatccttcaataaatatcatatttcttcgagtgtcatgtagtaaatagtttagaaaacaagatacgtatacttatcctgcactcattttcgacctaaaattgcagccattggttcaacacacacacacgagtgcttttggctaaaatttcataaaagtattaattttaagaaataacattaacagttgtcctctggccctgcatttcatcaatattaactctaataaaacacataaatatcaatcttcatcctaaaacaaatgaatgaatacttagggtttgttggcacacttttcaaacatcagtgtgtttcgtgcaaaaaagttataatattagagttactttaaaaaatgaaacagaatctttttaaaataattaatacttaattaattatgctaatcacttttgtttgcatgcagctaagggcagtcccaatctctacctaggattgtatctatgacatttactatattgctatatagaacttttagtttatgtggtactatattaatta

SEQ ID NO: 80805 - DNA, 11574 bp, Oryza sativa
accttatgcggaattctcgtacaacaacagttatcaagctagtcttcagatggctccttacgaagcactgtatggtcggaagtgccgcactccgcttttatgggatcaaacgggagaacgtcaggttttcgggacggatatcctgagggaagcagaagaaaaggtgaaaatcattcaagaaagattgtgtgtggcccagtctcgtcataagagttatgccgacaatcgccgcagagatttgagtttcgacgaaggagattatgtgtatcttcgtgtcacgccttttcgaggagttcatcgttttcacaccaaaggaaaattggcaccgcgttttgtgggaccttataagattgtcagtagaagagcaaaggttgcttatcagttggaattacctcaatctttggcaggagtccataatgtgttccatgtgtcgcaattgaagaagtgtttaagagtacctaccgaagaagctaatcttgaacagatagaagtccaagaggatctgacctatgtggagaaaccaatccgtatcttggaaatagatgagagaagaaccagaaatcgagttatccgtttttgcaaagtccaatggagtaatcactcggaagaagaatcaacttgggaacgagaagatgaattgaagtcagcccatccgcatctgttcgccagttcttccgaatctcgaggacgagattctgtttaaggggggtaggtttgtcacatcctaaaaatcctaaatttataaattgttgtttaattggaattattagaatttattttaaaagcctagaagagaagatctaattttaattaataaattccaatataaaatggggccagataaaatttcattaaataacttgcttaattctataattcctagatttttctgggatttatttgagctaaggaagtatttttaataaatggaattgcatttcatgaataatttaaattgaaaaaggtctttaaaagtctcttttggctttgggccgaaagtcggcccaaaacccctttctctctctccctcggcccagtcggcccagtccagcagcagccgccgctcgcgcgcgcgcgtccgtccgctgacaggtggggcccacctgtcagtcttcgtctacctccggtcgccgccgccagaaaccctagcgccgcgccgccgccgccgctttccaaattcggccgcgtctttcccgatccggtgaaatcgattgaggggaaacgatcttcgggatctcctctaccttttctcttttggaatcatcggctaaaatcgtttggaaattcgtggattcgaggtcgaatcggatcggtctctttcctccgaaccccaaagtttccttctcgtcgccggtcgccgtgggccttcgccgccgcctccttgcccctataaaaggaaccccggtgtctccgctacccgccgccaccctcgccttcgtctctcgccgtcggaagcgccctagccccgtgtaacctcgtgccgccgtcgtcgccgccgctccagccgtgcgtcgccgccgttccggtcgtcgtcgtcgctcggggaggtcgccatcgtggtcgccgtcgcgtcgccgtcctcgtccgcctcttcgccgtcgctgtagaccgccgtcgtcaagccgaaggtctccgccacttcgatctcgtcgccgccgccgtccgttcatcttccgccgacgttttggtcatcggtgagttcgccgcgtcgcgctctacgtcctggtatcctccgttcgcgtcgtcgcgccgtcattcgccggcgagcttgcacgctgtcacaccctaaaaatcctaaatatataaattattgtttaaatggaattttttttagaaattattttaaaagtctagaagagaagatctaatttttaattaataaattccgatataaaatggggccagataaaatttcattaaatactttgcttaattctataattcctagatttttctaggatttatttgagctaaggaagtatttttaataaatggaattgcattttatgaataatttaaattgaaaaaggtttttaaaagtcttcttttggctttgggcggcccaaaaccctctctctctctccccggcccaagtcggcccagttcacagccgccactcgcgcgcgcgttcccgtcgctgacaggtggggctcgcctgtcggagtcgtcttcctcctccggccgccgccgcccgaaaccctagcgccgcgccgccgtcgtctccttccaaattcggccgcgcctttccttctccggtgaaatcaattgtggggaaacaatcttcgggatctcctctaccttttctcttttggaatcatcggctaaaatcgtttggaaattcgtggattcgaggtcgaatcggatcggtctctttcctccgaaccccgatgtttccttcgcgtcgccggtcgccgtgggccttcgccgccgccctccaacccctatataagaacccccggtgtctcctctacccgccgccaccctcgccttcgtctctcgccgtcggaagagctctagcgccgtgtgacctagcgccgccgtcgtcgccgtcgctccagccgtgcttcgccgtcgttccggtcgtcgtcgtcgctcggggagatcgccatcatggtcgccgtcgcgtcgccgtcctcgtccgccacttcgccgtcgctgaagaccgccggagcaccgccgtcgtcgtcaagccgaagaccgtcgccaccgccgtccgttgcttctccgccgcttctttggtcaccggtgagttcgccgcgtcgcgctctacgtcctggtgccttccgttcgcctcctcgcgccgtcgttcgccggcgagcttgcgccgtccgagctgccgagccgccgagccgccgccggtggtgacgtcatcgccgacgtcatcggggccgtctgccgtgagccgccgtagacccgatcgatctcggccgttcgttttggataagatcgatctcggccgtccgttcccgtgaaccgctgccgtgcacccggtcgaccgctaaccctagccgctgacgcaataattcccttttccttttcaaaaataattcattattgcgtcataattcaattaaaatccatataagtgttttaatccgatttaatctttacaaattcataactaattcatcttagctcggatttagttggttcaagtctctaaatttttctaaaattgagatctacatgttaaaaatatccacatgtactgttcatgcctgtttatgtgctgttttggtgtttttgctcttttctgtttagattccgacgtttccggagagtccgttttcgcagaagaagaatttgaagagttccaaggccagcaaggcaagtcacacagatcccaaacaaccctttgagcatgttgatcccgtttaaagctactgtttctagtcaactattgcatttattttcgaatgtcattgggtggaattaacctattgtttgttatagccctttttgattttgattactttattccttgataccttgggttattataacttgactagttgggctatatatatattggttcaactagatattagatatgattgcttagccatgcttagaaacattagcacactattgggataactcatgattcactattaattaattaatgatggcttaatgatagttcacgatggtcaatcgtgattggttaattaattacttgccaactaaaacctgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagtacagtttattgcggggcaccagactgaaaagtggcggagataagcccacggggccagactgagaagtggcagagataagcccacgggggtcgctggggagtccatgccttgttataagggggtgattatgatgcaggaatggtgcgctgcggtggattgtgttaagcaaggggtattgtcacatctcctttccgaggtaccgtggtggtattgaggcacatggtgacatgatgtggggctgtgtcttgtgggtacagtggtacacttctgatcagagtaaaactattcgaatagccgtgcccgcggttatgggcgggtctgacaatgtctttcgtgattagtctcacacctctcatcataataaaagatgctataactggtaataatttgtttagctcctagtttggaatggtatattcctggtttggagatagatctgtacagccgggtatggttgttcagaatggttgggcctatacaacagggtatgttgtatagcgttggattaatattgtttaaatattacttaactgttttattaaattctcaaatgtttgctaaatgctgtttatgcaaatggaaccctattatgccatcctttgttatcctgtgcacttgcatatttgctgcgtgacttgctgagtatgtcatatactcaccttgcaatcattcatcagaggaagagttctacaatgatgctgatggtatggaggattaggtgtagccctggtcaagctgcctgtggagtggagtcgtttgcgccgtttatctttttttttccgctgcttagatctttattgattgagaggaactatctacctctgtaatgacattttattcgctttttaattagagtaataattgtactctattatcaatttgttattgtgtgcctcggttgatttctggacgagggttcacacacatgtaagcgtttggaattttggatagaaattcagggcgtgacacgcgcccgagccgccgagccgccgccggaggtgacgtcaccgctgacgtcatcgtggccgtctgtcgtgagccgccgtagacccgatcgatctcggccctccgttttggatggatcgatctcggcagttcgtttccgtgaaccgctgccgtgcgcccggtccaccgcaaaccctagccgctgacgcaatagaccccttttccttttcaaaaataattcattattgcgtcataattcaattaaaattcatataagtgttttaatccgatttaatctttaaaaattcataactaattcatcttagcacggatttagttggttcaagtctctaaatttttctaaaattgagatctacatgttaaaaatatctacatgtactgttcatgcttatttatgtgctgtttggtgattttgctcttttctgtttagattccgacgtttccggagagtccgttttcgcagcagattcaggatttgttcccaatggcgagtttgaagtatggtctacctcttctggatcaagggtgttatggattatagtccaagtgactatttggcgcacattgattttatcatcatgaggttgtttagaggttgaagatttttatgctacaagggaaattcgtctcaagatggagattgttaaatatgtgatctgaattttgggcccacaatatattcggattagttatctaataggactctactttatagaattagtttcctattaggactcctagatttctcctatatatatcacttgtaagccgcacggagagggtacgacagcccaatgtatcccctgcgtttgtatccaattcctctataatgatcattgccggtcggtgcccgtggttttttcccgcaagggttttccatgtctccgttgtgcatctattttcataacacgaccgatagcccggccttaatttaccgtatcgatgatccgttctctaaaggaagttacagtgatgaggcggtttctactggtatttttatatataaaagggcattttatctttaggataaacagggatacaattgctttcgctcagaatagcttgggtcaccctggaggcctggactgacaggcatattagcttagatgaagcaaacaacactcctttcgctttatatctttttctttatgcatgctctttaattaaggagggcccagcagcgatcagtggcagtccaagcaacgaatctgatgattattgatggagcgcacagcttgggagatagtatatcgatttgggacacttttgccgaaaagcacattaccaaagcaaacggaaggaataatagaccaagcatgtaatgcacgcattctatgtaggcttctgctagctccatcagctctccccaaacatcatcttgcattcagttcttcgatcgtttcattttgtatgctcccatgatgcgtgcaagcatggcttagtttgttcactcccggccgcccagttttctcaacatcgtgatcaaggtaagctacatgaatgcagcttgctttctcaacatccatagttttatatatgtacaaataatcaacacagtgatatataagagtcttatatatctctctggagttttggttctcaacgagctagcaagggacattcttgaatgcatgtttcaatatactccagttaatttgtatttagttttatatcatcaatttatattcatatagaatcattgattaattaaattaaaagaacatattctagattttgtaacgtacgtgcgattcaaagaacatcgactgatcaagatatgatggagctgctcgcctagactgtaattcaacaattgaagatccagctagctagcaagagatccaggcaacagatcgactcatcatgccagcggatgaggtatatatttcactccgtgccaatgtgccattatatttttttctcttttcattttgaatggaaattattcagcgaccatgcatgcaaaatttggcattccctctgtttcatattataagactttctagcattgctcacattcatatatataaatgctaatgaatctaaacacatatatatgtctagatttattagcatatatatgaatattgacaatgttagaaagtcttataatatgaaacggagaaaagtatatattagctaggcaggcatgtatgcatccaatttggatgctattaatttgttcaaacacactttcattaattcattacatatatatggggtatattttaatttagacccaggagtgtcattaatttattcagtttggtggtcttctctataacttcactggttttcaaatagaagtccggcaaaatctttttgtattttcgattacatatatatgacttatagtacataactcaaaatatatttactagcttatatagccacacacccccacgcaggccatatataacaaacttgcccatatctaactccacgacccaaactaaactttcagctgcatggacacacatgcacacttgctaattactacctccgtattttaatttatgacgccgttgacttttttatccatcgtttgaccatttgtcttattcaaaagaattatgtaattatcatttattttattgtgacttgattcatcatcaaatgttctttaaatataacatctactgacacacttcacgccacgagactcacttcacttgacacatctactgcatgcaggcacttacatacaactcatggctttcactgatatcacactaattaactcacacatgcacgcactgtcgtgctcctagcacacacgcacacgagacttagtatatataactcaaaccaaaagatcacttaaacaacaacgagattaaaccataacactagctaattaactatactatagtacgtatcattaatttgaaagttttccaccaaaaaactgtcagaagtacggtgatctatttcaaggccggaggatatggattggggtcatccgccgtcctcaaagaggtggccaaacgactgagatggtcgtctgtaccggagaagctgaagctggggttggacaagatcatccacgttgattgctctctgtggcagagcaagagggccctgcagaaggccatcgcccaggagctgaagcttcctcggtgggtgatggccgtgtttgatcagcgtgacgaggaggatgatttcgatggcgtggagcacggtgccagaggggtgataccagatgtcactgaggcgattcttaatgagcttgccggtcacacatgcctagtgatcttccacaacgggagcggcggctacatagatgtgcaggagtgcggtgttcctgcaataatgggactctcgagcaaaagggtactgtggacatcccaggtcaggtttgggccctggatcgggtccgatttgcagaagattgccggattgagcgatgtcgctatgtttgctaatccttttaatgttcaacccctgctgcatgaagaggctgaggaggttgctaggtccactggtgtcccaaaacctggcatgagccctgagattgtcaaggagtgcatcatgtactacaaggtggtgagactgttagatggaaaccatggtattgactaggccacccacgcggctaactactgggtatgcagcgggatcatacgatccgctggtaatacgtcagcatgggagattgcccaagctttgcataccaacctgagattggattggaatgacaatcagaataataatgaaagaaaactagctacactacaagtgccatgtgattctgtaaaggcatcattcttctggatggaagcaaccggaagatgtaaagaatcactagaggatggaatgtcccaacattcatctgtagacaggttgcgtgtgataaatctctcccagtgtacatttagttttacatctccgcccttcctcggttgtagcagcctaagattcctcctacttgaccgttgcaaagacaaagacaagctctgctcaggctcaacaccaaatagtactagtgctggagatactgacaaggagactggtattagtagtggagcatgtttccagaagctatgggtgcttgacctgagttacacagattggtattggctgctatcagtagaggcacaagatctgatggttgagcttagggagctaaatgtgaagggggtcaagcattggagcataaaccatctactccgtgatggtaacaattctagtgctggtgtcggaagcagcaccaagccccttgggctactcaaccttgtcaagctccaagtcacaaccgaaccaataactgaagatcaacatcagtcacaagtatggaaggaagatcaggtagcagcaacattattcccgaacctgtctagctgcaaaatcgtaaagacgatcattcttgatggttgttttgagttgacgcgaattgaccctcatgacctaccgccatcactcgagtcatttagcttctctagcagcagcaatgacaatgatgttgatgtcacagccaagatagagagcatctccttccgaggatgcacccagttgaagagtgtgcttttgagaggagtgtttgagaggctcaagcaactcgacgtctcaggcacttgtattaaaaccctcgacctacgttcaatgcgaggcaactggtctctcaaggagctcctactgcttggatgcaaggagcttcgtgcaatactatggccaacacaagatgtatcattggaggttctgcacatcgacactagtagcacagaacttgatcatgctacaggtgtagaagaatcatcatcattctcacctgttgaatttaaatggtatatttcagtgagggacagaaggctccttcgctcgctaaatgatacaaaatatcccttggatgcaccatgcatcgagatctcgtcccctcctgctagtgttgctactgctactactgatggttctgaattaggcggaacaataagcaagagaaggcccattgccgttagcagggctgaacaacgttggttgatgtcgaccaaaagccgacgaccagctgctgacaacaagaagttatatgcggatgtcgactccacgatccagcacttgcaactacaagcaaccatgaacggcaactggatgtggccatgtaaatcggagggcagcacctctcactacattagcttacaagatgataagaggatgcagacgaaaccattgtcgtcgccatctttgccaggttccatctgtgaaagagcttcaggcctgcacgtgcatgacagcttgtctatcgcaagtatcacaagccattcagataaggcacggagatggaataacctagagtggtgcagagtggagagatgccctaacattgaaggcgttgtattcactccacctagtaccggtagtgacacaattttctgtcttctgaggacattctgggcatcccaactagcaagggcgcgccacatctgggactggggcacaaggggccagctgcattttgagcctgaagatgggtcattcgacctgcaggtgctacacctagattgctgccccaggttgatatatgtgcttcccttatattacaacagtctttcctatgcatactgtgtgttggaaacccttgagattgtgtgctgtggtgacctcaaggatgtcttccgagtggatgataataatcaagagcttctggtggcaactatagaattctcagagctgaagcacatccacctgcacgagctgccctctctacaacgcatctgcgggcataggattgtggcgcccaagctggagaccatcaaaatccgaggctgctggagcctcacccgcctaccggctgttggtctcgacagtacccacaagcccaaggtggattgtgagaaggaatggtgggatggactggagtgggacgggttggagaacggacaccatccttccctctttgagcccacccactcacgctactacaagaagaacctgcctagaggttccatgctcaggtacgtacgtatgtgatatgtctgtatggatgaataattattacttgggtttcattccttgcacgcacatacatacattcatagaaacacataaagctcattactttacttactccatcatgtatatatatgatcgagcattttcctttttcttaattttgtctgacttggcgtgctttcttttcttgctaattttaggtgatcgatatatacgtccatacactacatatttgatacagtaatcatctacgtgtcattccctttccatcatccaatggctcaaaatcttcagatcgatctatctctattatatatgtccttacttgggctggtgttcaatgtgctcgctcatttcatcatatcatttgcaacggcagcaatatctaatgcatgatgagtaagtacatctcccgccggcgaccagacgctcgtcatctgcttgttactagcttggattttgttcatttctgcttcttgtttttttgtgtgaaaattaataaatggatgctcagctggtgtgtgagctcatctatctgctaagttattttctccatacatgcttgctttccgtttggtcggttggtcgatctgcttgttcgaccgatccatccatcggattactacgtatgcttcatctttccggatagatgatcatacatgcatatgaaaactttgatctctagctccatttctggtgtggtgtgctagctagagatcgacgaataaatcatcagcttcagcggcatgagcagattcattgggtgatcctcatgcagtcgagttgctgttgtgcacttgtttgtgggtgcgtgtgtgttcgtgtgatttg

SEQ ID NO: 80806 - DNA, 2699 bp, Oryza sativa
atcaagattggcacccggccaacagctttcaaacggccacccgggcctggctgatcccatcagccgcagattttcaaacatcaaacccattccacaacagcaaatttcacaaggcagtagtcaaacaaaactacgctaggaatcacctcacatccgcccatgaccgtgggcacggctgttcaaacagttttaataacctctgcagaggggggtacactttacccacacgacattactaacccggatcatccagtccgtgcagaatggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtcagcgattttggaaattcatttagttcgcaagcaccgacccaggtgtcgggttttccaagtcttttgtaaaacccaagttttacccaagatgtttctcagattttaagtttgaaggcgaccgttgttacccgtgcagagtgcacgattaccgaggcgcaactagggggtgcaagggaacatggtataacaattacaatgggggggtcaaatgcaacaaattaggtaggtccgccaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaattttagaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagacttccctcgggcggctagggcgcggcccgagagaatggggcggctcggccgagcttaatgggccggctggcccaagaaggcagcccaaggcgcgcgcgtgggcggggaggggagagagagagccggtgggccgggtccatcccacgtgggcccgggtgggacccacttgtcggcgacttggctcaccgtgagcgaggtgcacgcggggcgtgctagggtttggggagggaggcgcggcgcatgcgcgcggttcgcggaggacgcggtgcggcgggccacgcgcagcctcacggctcgcggtggaccgcgcgcgcgaggggcggagggaagcggcggaccggggtctacttgacccggtcgcggccgaggtggcgccgacgtggtgcctacgtggctgccacgcgggccggcgggaggtagatgacgacgccggccggaacggactgcggacgacggcggcgagcggcggagcgaatcatggcgatacaggcgaaggcgagcacaccgggatgttgcacaggacgaggggagacgagccaacggctcggattcgccggagggagctcgacggcggcggattgcggcggcggcaaccagcggggagggaagggggaaacggcgatgaggtcacgaggggccgattcccggcggtgagagcatctacgcggctacgggaatccgttgctagtgtcggattgggcggagctacgccgagcgaggccggcgacgagcgggcgctacggagcacgggcggcgacggcggcgagcacacagcgagcggcggcaacggtcggggcggcgccagctagctacgggaagactacacatgctactaccgaaaactaaggggaggagatggaacgaggggagagaacggaggaaggcactaccgagatgaggcggggcgctgtgacgagaggccgacggcacgggagtgatctctccggcctcggccggggaagaggaagaaggcgagcgcccggagtccccttccgcgtccacgaacgcatcggctctcccggtgcttggcgatgaacggcggaggcgagacagagggacggcaatggcgctgtggcggtgagcgaaacgggaggaggaatcgatgggagggcgccttggtttataagacgacgatgtcggtttggaaaccgaccttgggcggtcaaggtgcgagctggcgctcggcgctcgtggccaaaacggcgacagaggcggatgacgccggcggggaggggaaaaggaaaaagaaagggagaaagggagcttaccccttgctactttgggaaaaggaggagggagcgggggcgaccggcagagggaggaggagctctgcctccgtcccttggagactagcacgtagagtggcgggggccgggtcatgacgacggcgatgacggcgggggcggtgtggagcggagcggcgacacgggcggcaggcgtgggcagg

SEQ ID NO: 80807 - DNA, 17579 bp, Oryza sativa
agccagcgcgcgtgcccgagccgtgtcgctcaaaccgccgcgccgcccgttgcttcccgcgcgcgcgtgccgtggtggccgaccgcctggtcgccgccgccgtcagcctctgccgcgcctgcccgcgcctgccgcccgtgtcgtcgcgccgctccaaaccgtcccgccgccatcgccgtcgtcatttcctcggccccgccactccgcgggcaagccgccaagggacggaggcagagccctcctccctatgctgcgacgcccccgctcccctcctccttttcccaaagaagcaaggggcgagccccctttctctccccctttttcctcctttttccctttcgccggcgtcacctcctggcgccgttttggccgccagccggagcgccagctcgcgccttgaccgccctaagtcggttcccaaaccgacattgccatcctttaaacccaagcctccccctttcccttcctctcccattcgcctccgcgccattgccgccgcccccgtgctctgttcgccgtcgccgttcgtcgttgcgcgtgtcggaggagccggcacgagcaaggacgcggaaggggactccgggcgcgccctctccttcctcttccccggcccgaggccggagagattactcccgcgccgtcggcctctcgtcactgcgcccgcccgcacggtagagcatctccccgttctccctcctcgctccatctcctccccttagactcgggtagtagcacaagtagcctcccgtagctagccggcgccgccctggccgttgccgtcgctcaccgtgtgctcgcccgccgttgccgcccgagctcggaagcgccgctcgtcgccggcctcgctcggcatagctccgcccaatccgacgctagcaacggattcccgtagccgcgtagatgctctcgccgcgggaattggcccctcgtgacctcgtcgccgtttcccccttccctcgccgccggttgccgccgccgcaatccgccgccgacgcactccctccggcgaatccgagccgttggctcgtctccccttgtcctgtgcaaccacccggtgtgctcgctctcgcctgtatcgccgtggtttgctccgtcgctcgccgctgtcgtccgccgtccgttccggccggcgtcgtcgtctacctcccgccggcccgcgtggcagccacgtgggcccgccgcatccgcatccaccgcgaaccgtgcgcgtgcaccgcgtccctcccccaccctagcgccgcgccgcgtgctccctccgcacggtgagccgagccggtgacaagcgggtcccacccgggaccacgcgtggtgagcccggcccaccggccctctctctcctcccctcccgcgcgcgcgcttgggccgccttgggccggccggcccatttagctcggccggaccgctccgtttctctcgggccgtgccctagccggccgaggaaaagtctatattcccttcctcttttcttttcttttcttttcttttcttttccaaaaaggattttcctttagaccaaaaatccaataatcttagaaattcaatatctttccaaccgtaaatccgttggctccgttcaacttccaaaattcctcgaatttcgagagctatctaatggcccgcttagaggtcattaatagggctttattcttcgcacgtatattgagttgttccgtttcgcgtgtagtttccgagcccgaagacccgcagtgcgaggatttcgaggatcaagcttcagatctcgacaaggcaagccacccttgaacatcttgagcctatatttgaacttaaattatattgcttgcaaaatatcatgcattgataggattgcacgtaatatgtttgccccgtctgcgaggcagattagtgggcatacctaacttgttgcatttgatccttcctttgttaatcgttacaccatgttcccttgtaaccacccagttgcgcctcggtatccgtgcactctgtgcgagtatcgacggtcgccttcaaacttaaaatatgataaacatcttgggtaaaacttgggttttacaaaagacttggaaaacccgacacctgggtcggtgcttacgaactaaatgaatttccaaaaccgcagaccggggaacgtaccgggtgtacgatttcccgctcttgcacttaaggaccgtttccttggaatttcatccaaacataagtcaagtacgaccacatgggtggaatgggacactcctggctgagtaactagcttatcaggggagccttgatgccgagagacatgtggattcgccggggtggtgtcggggaggacccctgggcttcctggcacagtatggtctgggacctaacctgttgttggtctgggacccctgtcgtcggcatatggtaaacctgtgtcggctttcgaaatgccttgtcacgaaagcttggaggtctcccgacgtggctgatccccacgggctggtgatccgggttagtaatgtcgtgtggataaagtgtaccccctctgcagaggttaacaaactgttcgaacagccgtgcccacggtcatgggcggatgtgaggtgattcctagcgtagttttgtttgactactgcttgtgaaattgctgttgtgaaaagggattcgatgtttgaaaaatctgtagctgatgggatcagctaggcccgggtggccgtttgaaaagttgttggcccaggtggccgtttgaaaagttgttggcccgggtggccattgaaaagctgttggccgggtgccaaccttgtttcaattctaaagactgatgcattgcacatactccgaccggacgagatgcactgtctcatccgtgtcgtttgagaagcactcacttagtcgtttttagaaaagagttcaaataaaatcaattgcaaaaacaacagcctttccttgaagcctgcattaaacacttatttcccatggcttgctgagtactcccgtactcacccttgctctatataaataatcccccccagttgctgaagaagatgaagcggatcctgctgatgaggagttcttccaggagcaagccggctacgatgagttttagggtttcggcctagttcccaagtcgcgcctgtgttgtttggtccaagtcttggcttccgcttcccttctgtaatgcagttgtgagctcgggatctgtccgcagcccaacatgactgtacctctactctataataaagagacctctgttgctgtgataatccgtcttcctgtgataccagcactgtttcctgggactggtatcgattaacaggttaatttggagcgtcacgggctagttccggtcggtactagttcggggcgtgacagccagctggggacatttcattgttttctatgagactgtctaggctcgtttttcttagatgatgaaatagggcattatggtctttgcttaaaagttacagccaattattataatctcacacttaaaataagtgaaattaaaaaaacttaaaaatgaaaccaatcaacaagaagaaacaaactaaagagtaaagattgtcaacctaagataattatacaattattgaattctgtttaaatttggattttatgaaaccaactcattgccccggatgcaacattccaatatgatttatagattgctgtgcattaggaagggtatatacagtggtgtgatttcagctggctgggaaatttggcacgcaaaaatttcaagtgacgtgaagaacataataatatcatctgttcaaacatcttgtagatagttttatagtattatctaaaatactgtaggaactgcctatataatcagttcatttcgtgttaagggtggaacccatgcacccacgtcgtgacgtcgtccatcccattttctccgtcttgccattgctagggggcaaccccatgtggttgcgaggattacattggcgggctctcttcctctctcacaccccatctatattggttgagaaagtttgtattccctctatcccaaatataacaatataaaagaggattaaacagcgtatccagattcattatatctaatcttttttactagattgctatattttaaaagagagggagtatatatctactaataaaaatgacaaaaaattgtgcatatctaacaaataccatcatactatacttgcaagagcaagttcccaacactcccctctcattttccgcgtgcatgcttttcaaactgctaaacagtgcgttttttacaaaaaaaaatttctatacaaaagttgtttaaaaaaatcatattgatccatttttaaaaaaaatagctaatacttaattaatcacgtgttaatagaccgctctgtttttcatgtatgggagatgggttcccaacacccacctccaaacacagccttagagcatctccaaattccactctccaaatacttatatatctaactctttaactgatttgggtaatcaaactaggtgttcactccaacagtctctctatttacatctccaaaataacaaagggacccacatataagcctctattaccttcttcctcttctttctcttctcccacatcgacccatccccgcgcgaggtggacggcgaacggcgacggcgactgcgacagcggcagcggcggcggcggcagctcctcgtgcgggcgaggcggaaggcgacggcagcggcggatccccgcgcgcgaggcgggaggcgatggcggcggcagctccccgcgcgcgcaaggcggacgacgacggcggtggctccttgtgcgcgcaaggcggaaggtgacggcggcgccggcggcggatccccacgcgtgagggcaatggtgttctgggcggagatgatgaagacagtggcgttgagtggcgacctcggcagcggtcgacggtggcgtcggcaacgcacgacgacaaggcagcctcggcagcagagggcaaccggcggcgggcccggcagggggcgacgacggcggagtggtggcgccggcggagctgtatctggggagtggtgaatcggagaaattgcagagagagtgtgggatgggaggggaaaaaggtgtgggatccatgtttggctaggccattttggctggccaaagttggccagcgtgagaagtgctttggccagccggatggcttggctatacggttggctagtctgttagagcatgattttgatctaaaattgccaaaatttggcttagagagtggagtaaggaggctgttggagatgctcaactttcaaaaatgccggtttccattagctcatagactatatgtattgaagaaaagtacatttttttcttatatagtagtttgtgcctacggagtcatgtagatatttacattacctcatgcgttccaaattgctgatcacgtggtatattagcagtttgttagcacacgcgagctaacctcgagagacttgtcattaatcaggttcatagcttatgcctacattctaccgaccgagttaggttaggtaggtgcacgatttgtttcagtctgagatatctaatctgctcaaagtccggagccacaactgacaacaacaaaattcggcaggggcggccgcgcgcggtccttcgattttctccgtttctttccaatcctctagacttccgagtgggattggttcttcgattctccccgtttcctgcctttctctcggtctctcgcgcggggaggtcaagtccatttccgcaaattctcaaaaaaaaaaaaagtccatttccgcagcggagccatcctcgcgcgcggtcccgagaccggtaaccacaccaacttccgcaggccagtgggggcgaaagcaagatctaaccgagaaagtgagggcgaagtgaggccccgcgccgccccgcgcgataaggacaaggatttttctccgtttcgtcctgatacgatatgcgtgacgtgacggcggcagcgagcgaagggcggcaggcaggggcattcgcgaagaggggaagaactttccgacgtcacggcgcgcgcgggcaacttgcgcccaacgggaggcaaccgcatgggggacggggcgcgtgcgtccgtgcgtgactcgtcgcgctcttacgccgtggcgtggtgttccgttttgtgcttgcgcttggcttgttttgttttgttttggggtgctttgcttttgcagctgaggtgccactgcccaccacgtactactgtgcaaattggccgcaagaaagcgatgcttggataggtacttgctccgttgctcgtcgtgtggcctggatcagtggatctcggaggggataagcatgcatgtaccgtgcgtgcacctatagaagtgtaagtagcgagaggtgaactattgggcgaggcaactcgaaaacttgataggtggcacggcagcgaacacaagtacacaacatgtagtagtagatctttattttttcaccagtggtatggctaggaacgatcgtggaagcgtgagtgaatacggtgaattttttgcggtgatgtacaacgggccaaccttttgattttattttttatttttctgtgcgtggggccaggttagtgtcaatttcagcgtcgttttccaatggcataaacaatgctaaatgacgcacgcattgttcgtgataggatatccatcccgtctctctctctctctctctctctctctctctctctctctctctggccccggctatcctctccctttcttcttttttaggcgcaacttgtcagttgaacccatctcgctcggtattagctttgcgttcggttctcgtaaagacggaataaaaaaaccgtaatacctttgtgaagtaaaagtaaccaacccccatcattcaatccaatccaacctgaggtacacgtgatcgaatacgaagcgcgcacgatggcacgagaggcgcggcttcttccgcctcgcgcgattcgcaaccgtccgttcctgcctccttccatttaactgtggatccattcctgcctcacccctgcaaatctctgtgcgccttgcaggttggaagaaaaagacaagagatacgaagtggtctcgtttcatctcgtgcgctagaaatgctgagatgatgcccagtttttttaagaaagtttctcgtggaattatggtggtttgagctcacatcagccgcccctgttggaggaaatctaacgtccgaaccatatattacgaagtggatggattaggtgtgccatgtttagtttttcagataatgatgcgatgattagctagcagaattccagcaactaaacatcgtactacgtagaaattagtaattggcatacgcgcgcatttgtctcattgtggaggagtgagtgcttgaagaatctcacctgctggccgtatttggtacgaagccgctaagccatcgaaataaatcagtggaaaacgaaaaactcattgctagtcatccaagaagatggatcaaccaactatgcttaaacgtgcagacgattgttggaaagattcttcacccccacttactagtgttctgttttgtccgatcctgtgtatagaataaatgccaactattcttactcgtagctaaaaaacagagtacagtggttcaatgtgaagaaccgttcctggagtatatcccatttcgttttctcaccgcaccaaaaaccaagcaaagatttaggcatgtattgcttgccatcgcacgatacctgatagttgatcaatggattcactgttatctaaccatcatgaataagacctaagcagcgacttgatgtacgagtagttatcggagttcctctcgctggcattgaaagaaattgagacaggacgctggcagagagcgattggatcactgaaacctttttggatcagctgaatttcaatttgcaagagatagtaacatcgatacattaacaagttgctccataattcttaagaggttataccacttgaaacataacatatcttatgtttccatatttaggataaatgccatgtaagacacatgcatggctttcgatcacctggtgagttgcttgtgatattaataagtcctaaaagagacaacttccattctcaactcgcaagtaatctacattaccatgttacttggaggtgatctataatattaatagggtagaatggttggatatatattagagcactgagtctacctgtatataaatttataattgcttccaaatgacttataatcttgcccacagttattatgtaagaaattcagctactctctccgtcccaaaatataacaacttctagcattaaaaatttatcccaaaatgtaacagcttatccaccaatattctcttcacaaccaatcacaatccttcaccattcaatttcttcacttacctccacgtctcaaccaatcacaatattctcctattttattatatctactttcttaatagctatatcaaattataaaacttctaatattctgggacggaggcagtagcaaattcggtaaagtcatcatagttcacaaatattataaagattatgagcattttcaaaactcgcctatagctctgtactgttctattatattattgcatataaggtgaaaagttcacaaatttttcaacactcgcctatagctcttagactgtcatattgaacgggatagcaaactttggaccaactcactttgcatttgcctccatgcatctcctcattgccaacccataggaagcgcacctcttgttgccttgtcaatatcttgaatggattgttttggcggcttcaacactgtgaggacgtatgttgggatggcacttaggactgagttcaccataatctagcgtccccctgcatataagaacgatggattccatctcaagagacaacccttaatcttgtgttggacaagctgcagatgtatactttgtgcaaatggccaagggtgagccgtagtccaacaagttggtgggaaggtagccctcaccatagaggagttgcacaaaacgtcatcgagatcaatttcctgacatcgtatgggtgccaacaggccctttccgagattgacatgcaactctgttgcctcgcggaagtccctaagaatgccaataagattttcatagctccacttcattccttgctggagtgaggaaaacagccgcatcacccacatataagattttcggatttaaatgccaaagttgtagtatagtactaatataattatatttataggtagataaaaaaatatcggtattaaaaacaaagaaaacgactaaaagtaaatttacaggagacatggatccacactttgagagagtgggaaggggcaaataagcatttaccatttttcgatgtggcgttaaataatttgtcacttatatgtttatgatttgtaggtttatgtggtaaaatattacatctaaaagtgacaaataattaaatatctctgtcgatgaatggagtaaccacttcaggttcagtagttcagtgccgggactggttgatcgccacctgctcttcacttcagcagcagctgaaagttgttggcacaccacattacccgtcgccggctcgccgctaacgtgccgaccctattcactctagaaccccaaaaggcagacggctcaacgagagcgcgggcgcaagtggggctgaaaggggggtgtacgcgaacgccctcccttctttctgcagacgcccccaacattcggggcacatgcatgaacaacactctgattaggatggctcaacaaatgccacgcacttcatcatagagaaaagaagccacgccctccccacctcgttttcctcatttttatggcgtgcaggaactctcgcgatccgagtttttaaagtggccgaggcatcgggcgcagccggggtccccactaggccactcgagcagcggcacgaagatgaccgcttcgtccacttcaggtagcccacctggatgcagacccttcctgttgcatcctggagatagattggaatagagaagtctagagaataaaactagagattagtagtagatgttttgatgacatgtacctgagcaaacgaggtggtactctggatcttcagctaactgaacatctgtttgcagatccagaagaagatgatactactagtagcattttattcatcccagaatctgaaacctgagcatcagagtatctgagtatgcgtctttcagggtcacagaatcgaacctcgtgcagtgcaataccacccggagaacaaatttcattctggcaccagttgcaatttgtaaacaggatgtttgattagaacaacaaagtctcaacctttggttgcccttaacacaacgaaggctgattttaagacagcttacaacaggaggttagtcgtagtcactgaagccggcagtagtagcaaaatttcgtggttgcgatgctccctataagtctggtgccatcacaaccacgtttagccggcttctttgccctcttttctaccctgctgtcaaactaatgctatgcacgaagaattagctacagtgcacgtgtactatatacacctcctcctaagcgactctgtacgtactacactgtgtttctgggaatgggcagaagattgggtcggcatatcacctgggtttgttcaaatcaggaagcataattggtcaaccattcgagactctgcataaaaggattactgcacgttatatgccatggcacgctaaagatccgggtaatagtcaaattgctgcaaactgtgtacaacacttttcaccagaatcataatttgaggagaaaacaaaccattaggcattcaggcagatcatcattcttcgttctcatgtgagtctgcatttatgtgaagagcaagtggttagacatttgtattctttgcaaggatcagtatgttgtgaattggaataagcatgtgaagacctaggtgattcatggcatttgtcatctggctacgagataaaatgaaagcagcaacatacaaaactgagcaaaagttcagaatctttttccttaaggaagttctgaacgaatagcagactgcagatataagagaaatagcatagccagtgatggaagattaaagtatttacctccataaccaaatggcatgatgactcattgtttgtggcaaggcaagcaagggctaccactgcggctgccacagtggagggccagaaggagagatgtttgtggtccagaagtgagagcaaggccaagtacttcgccaggtcctcgactctgtcatctgcattcgcagccttcagatagaacctgcaaagttgaaccaaacaattgtaagtttcttattcattctgtccagctgacacagaaaatgaagcaaacacacaggcatagtaccagaggaaatgatgggttgttgtgacaaagcactggaagtcaaggacctcctgaaccagccactccatggcgacgacctcacttcggctgtaagtattgatccctactttgaaagctttttgaaggatgctgaaagagatcgtattattaggttcctgtagagtgttctaaagaaaaggtctatattgcacattgcccttgacagaaactaggcgcttgaaacaaatgcgcatccagaggcaaactcataagttcaaaagtgatacttcgtgcaaagtagacaggcaaagaagaatagttcctgggttcacttcacatgcttctgtgcagtaataagtggcacataaaacattcatttactagcaagttctcagggatacaaataaggtctactttcaaaaatgttgaagattcatatgagtttagtctttaaaacttaagggaaaacacagagaatatctcgcccaccagagcgctgatgtaatagctttattgtaacatcaaaaacagagaaataaaactatatcaaggagatctatgcaagtgataatttctcaaaatcgcatctctcccaataattgatagcttagttctttttttcttaaaaaacaatagctcaaggatgccaactggcgcggtaaattattttgagagatgcttgatcatagtcaacacaatcaagaaacttctggtgtgtttggttctcagccaatcaaaaccataccaatattttggtctgcctaaaattttgttagctttctttttgtcaccaaattttggcaacaccaatatttttccttggtagcaaactaaatactaaactaatcaatcttgccaaaaagtttgtcaacaaaccaaacaagtcctttgccaagattttggagtggctaaatcttgccattgccaaaaaattggtatggcccacaatggcttagaaccaaacaagcccttcatttctaaaatacccatcgtgtgaaacctttttgtagaacaatggtccaatggtctgagttctcacatgcagtgctcagtattgaaagtgataaatagctactagatgagatatgagttaccatcggatgttcctgttgttattaagttatttatagaacataattaaactcataaactcatgctaatgtctgttagaattaagttcaactttcagaaaaatcaaactatcaaagaatactaaggaatttgcagcattgcaattgagcactatcccatttaataatacatgctatattcaaatgagacgaactatttaggtgagtaccagacaagcagacaccaacaacttgcagaagtattcatactgaaactggtcatttaagggagccattaccaattatagggttgattctcttcaatgcgggttgccaaggtggtgcaggcgattcccagcaactgcaggttcctagagccctttacatatccacgtgtcaagaagcggtccatcagccctatccccatgaacacggtctctggctgcagcttcatcgcttgtgaatgctagcgatgcatagagaacaagtcattctttgcaagttatgtatgaactctatgtaagaacaaacatattctccacaaatgacagtacattattttcagaaaaatcaaattacaagtataaatgatcatatcacttaagtacttatcgctgagttgcccaaaaaaacttcaaacaaaaaacacacagcgatttcattttcaaaggctacctgaagtttcaatgcaaatataaactgatggaactagagttagaaaagattaaattcagatgatggtggatacacaaaaaaagggaatacactggcaatatgtttttctaacacttattgcatatataggtttagaagtaaaaagtgatgcagacatttctggaggccatatgccaatgcccaatgccatgggatttcagatggcaaatgactacagagcaactttcaggtgcgaaaataaacacctagaaaaatcctatgtatctcttttcttttcatacaagcatgccattacatccaaaaaaaatatgcaagcatgccaaaataagcacctagaaaatctttatcactgctctatagaacttgaatgcgatgacataaaagttaatgactagagttacattgaaatcactaggattaccaccacactgctggcagactaacacggggaatgctgcaaaatgtacaggcagctaactgtgtgataaacgaatcagcaaatgcaatgcgtatattggtatcagatagcttcccctacacaaaatatgcaagatcacaaccggatctgctacctcagcactcccacccagcacagcatttacactgcagagtagcatgttagtgcaaaatgcaagcaactactgttcttgcagaacacatcagtcagacagataagctgatagaatctagatcagtacagcactccgaaagtatacatgtgcattatcagcacaatacccgtgcaacaaacatctgcagctaccacacaacaaattgcgctcgagctagatgaattattggaccaaggcaaagtcatggtcgcagcatacgtgtacaatgcagagcatactgacctccatgatccagttcaccatgacaacgcgctgctccacgacggcgcggccgtagctgccgagcatggaggagtacacctcaatgtagtcgcgggctaccacccctcgccgctcgcgccgccggaaccgctcgtagctcacctcattgtccaagtcctcaaatctcttcccctgatacaataattcccatctgattacatcaaatgtcgcactgattcgggagagagcagccaaactccaacaaatttgagagaagctgtgtggaacctgcttacctctcccgcttgtagagcgacatccgtggcggtgggcgttttgggatgcgtgaaggggacgaactgctccgccaaggcgaggaacagggagaaggtgggggagggcacggcgttgtcgtcgtcggacgacgaggacgactcatgaagggggctaaacgagcaatcggtgcagatgcagggaccactgggcacctcctcttcatcatcgtcttcctcggtctcagacagcgtgaggtcctcgcgggctgagaagtaggcggtcgtctcggcgtcgttgccgagctgctcggggcaggcgaggtaggactcgaggacggaggcgaggcacgacgactcggagacctcgacctcggcggcgcgcggcctcgcgccaccgatgatctcggagcactcggaggcggcgggctgctcctcgtccacatcctggtaccgaggccgcttctccgggcgctgagctgcgtcgagggaggtggggcaggtggtgaaggtggcggagatgacctcgctgtggaagcaggaggaggccgaggtggacgactccgcgggtcgcttggctgccgccgccgccgccgccgcgatctgatcagggagcagaggaggagccgccgccgccgcgcctcgccgccggcggaagggatgggagcgcggcctcgtcggcaccgatgcaagcatggtaggaggcattggcgtgcggcgctgtgtgctttgtgtgtgaattgtgaatttgtgatgctacgggcctacggctatgttcgtttggcttgctagttatatagccgtgacttgaggcgtggagaggaagggggagaggagtgttcagcaaccttcggctgttcgccgcatcgcctgatcggtgaagtgttttttgaacttccaaaaatcctcaagccacgactgtgctgcgacgatgcacatgcgccgctcgcgctccattggatggcctgtgtactccagtccgtgtagattcgccggcgtatccctgtgggtcccagatgcatctggtgcacgagcgatccgccggaataacggccttgcctcccgtgtcccagcctcccaggcaaatcgaggcgtttgcttccagtggggaatgtcgggctggggccagcgcatatgcgggattggcggacggcggccaggttgtcaaaatgctatcctgaccctgattaattccttacccgaacaatctcgatcgaacgatccggttaacccagttgggatcggggaagaattacccaatcccaaccaggttgtctccaattgggtcactgcatactcggatcactacgtttttaaggaagtacagttgaagctcgattgtttgaatctgctggtattccggtggtatttcaagttacacatagctcctttgatttgtaggaaaaatgaaggaattttggaggatttcaatcctatgaaaaaaaaatcctatgaaggcatttgaaacaaaggattgaatcttatccaatcctttaaaattcctatggaatggataatcctatgcacattttggaggaaagttagcaataggtctatcctcttggaacatttcctctgagtctatctctctcatctgattcctgtgtttttcctgtgatccaatcaaatggccattcctgtgttttgcaatcctctattttacaattgtattcctgtcagaatcctgtgtttttcctattcctctgttttttcattcctacgattcaaagggcccttgaaacggcttggataaggtttggagcaaatagctcggtaaagaggaaatgaaagaaaaggaaagtgtatgcatgtagatgggaccctgatggactgattgatagtctgatacacacttctgaagaccgtcatttgccgcagacttcagaaacgtctcctctgaatctgaattctgaacagagtaccgaaaaccttggttcccttgtgcatcaccctggggaaacacaagagttcccgtaaaacaacattcactactaaagtcagtgaactaaaacacttgcatcaaaggatgcaagttggaacattctagctgtaaatcggtaacctgatcttgattagagttggccgctatacaacggaggtcgaagaactactacaagttacagtgtcagcatatgtgttctttaaaaatgtaaaacatttgattgatcaccacttaaacaaacatatctgtttgggagcatactaatgaggaacctgagaattccatcgcaatcatagttcacatgtcctgaagcatcccttggactggaggatctgaacagagttcagaaaaactacaggaaatgggcaagtaaatgaagtaactcatccacattttgctcacacaaatcactctgtgctgcaccctatccccaccaatctatttcagcgtaacaaaccctcaaagccttttcttgctgtaatcatgcagcacggaagcatttttcttgatttgaaatcaaccaagcatgatacttgtaggagggttcggatcacacattggttaatgtgacagcacttcagagcacctcctcagttctgatatttttggtgctagctcctcatcaccatattgctttagcaaatccatcaaacgatcagcacaagaagcctctatgagaatccccctctcagcaaccttcttagccaacgccaaggcctcaccaacatgcccttccacacacagcctaagcaacaaaccattgtagacatcagtgtcacagagcaccccgttctcttccatgactcctatccagtagcaagcatccaatagcctattcctattgcaaagctctctgaccataacactggccgcaagagggctcagccgcacccctttcttcatcatcctctgcacaagcccttcagcttcaccatccatcccaaccctccacaggcaaataagcagcacattgtagcattggtcgctcgacacactcccatcgctgaccacacgctccactacagcataagcgtctgcgaccatctcctctgaacagaatccgccgacgagcgttcgcacgaacacccggttgggcatcacccctcttcctgtcatcctatccagcaagctcagcgcctcccccatcctctttttcccacacaggcatttcaccaaacacgtatacgacaccacgttgggcacgcaccctgcacccaagctccaacccttcatctcttccaccagcctcagcgctgcatccacatccccgaaactgcacatcccgtcgagcaacgcggtgtacacggccacattggtcacgcacccaaactccggcattttctcgatcagctggcgggcaccgacgaagtcccccgcggttgccagcttatgcaccgaggtcacaaccagtgggacgctcggcgagacaccgcacgccgacatgataccgagaacggcacagacatctccgggagagccggccgagcggagggcggagcggaagcaagcagcatcgggggcgaggccgaaggagcgcatgtgccgcatgagagcgagggaggcgg

SEQ ID NO: 80808 - DNA, 16973 bp, Oryza sativa
atttgaaaactttcaactcgaaattttgaattttttaagtcaaattttgaaaactttcaacttttcatctcaattttgaaaactttcaacccagatttgaaaactttcaactcgagatttgaaaactttcaactcagagttgaaaacttccaactcaagatttgaaaactttcatctcaaatttcaaaaactttcaacccagatttaaaaactttcaactcgagatttgaaaactttcaagtctaaatttgaaaactttcaagttaagatttaaaaattttcaagtcatgatttaaaaagttataacacaaaatatttaaaagcacttgtgctgaaatttttaaaaagaataataaaaaagagcaaaatgaaaagaaaaaaatcgccaaaaaaaaggaaaaacgcacagaaaaaatcgctaaaaaaaagagacccgtggcagcgggtggagggcgctcgcgctagatacggatctggcgcgcgcaccaattagcaaaagcccatgcatgtaaggttgcactaaggacggagatggtgacacaatcaaggtcattgttgacaaagatgttagacattgatggtgatgctgccaaagctgttgaggaatgacttgggagcgcaatgcgtggcatggaggggaaaatgctgctgtggtccactggctcttgtcttagaaggatgaatatagttggtgaagaaggtgatggtgctagcgatgaggtggggtggacgaacgaagcaatggctaaaaagtaaaaacagcatggagtagtttttgattaaaaaaatgatttccctggtttgtggaaactcagttttcattattcatgggtttatttatttaaaacatgattaaggtaaatcagttttataaaatatgagatgacaacacctaatagaagagactatggttcagaacatctgatccatgctatgtaattgaatgatgaaagttttgtaatatacatgcaacattagtgatggagggggaaacattacttaaaaaaattaattattggcatatcacactagatgtttgatgaaccatttgtaactgaaatgtgaaacatcatttaaaacaatgcacaatattagccaaacggaaagttatgcataatctctaaaaataattagtgaaaaataaaaacaagagagtttaatagtcgaatgcagtgagtgcaccaaataaagaaaaggaagcaacacaaagatgttgaggccgccatgcctgtgccacctcgttgcggggaggattgccgctgtgacgatcacctcgttttttatggcgaggggcgagagcgaggatgaagagaggaaaaaatggcctgggcggcggcaatcacggatattatggtggcggaattggtggaggtagcgcgtgcggggaagcaaaattggaagagatacgtgcatgaggattgagcggatctcgtccgttctcctgaccgttccatgaagtatgatgtctgtaggatgtagggtagatcacttggtagattatagggtagatcacttggtgaattatagggtagaaagatagatgtatatctcctatctctttcttattgaccttttttttacttatatgttaaattacactagtatatttttctaaaggatttaagtagacaatcaactgtttttaccaaattcttctatgcagtgagtactagaaaaaaaatacagtgcatatctgaaatttacagtgtaagttttaaaaggtgcgctataaatgtcccaattagccctgggtgttgtgtgtgggtcagtggggatgtcctgtgcagcattcatcagggtgtagaatcttggtcatatttttttgactgaaaacatacaccgtgcagtagaacatgcctcatgcttactcatggatacaacaacacatgtcatttattattatgctggtgtcaagagttgacaaacgaatgtccatgtgttgctgcaatctgttcccgtgtttctgtttcatgcaccgaaaagcgagaagtcaccaagaaagcctcatctgttgcttaaggattggcaatcaataccatctgccatgtgtgctaagcacgctgttagagaggtagagagggagggattatttcatttaggcatacttcaccattcataaaatccttctgtagggaatgcgtgctatatcgtcccaatttgatcccaagaaaaggaatttgcagccaatggatcggaagtacagcagagatttaggtagttttggaagggaccggatacttccacagaaatcaaaatataactccttaagtgcggtgaggttctccaagttgttgggtaagctgttccaatggcaggaagtaaacccaaggtaagctagtgaagtcaagtgctctaggatccactctcccctcagttccaccgagtgttcgagcgcaagccatttcagtgatggatatgcccctcttgacaaaagcttgggtacaagggacatgtcatcgacggttagccgaggaactgcgtgtgctttgccggctactttcaagtccataaggctgggacacttgatgatggtaaggtgctccaggctatcaagatggttcaggccttccaagcgaactaattgcttacagccaccgatgtagagatccctaagcctcactagagacctcattgtctcagaaggtatctctgtgaaagagtcaatttgacttagtttcaggctacccaggacagtgcatcctctcaatgaatcgcgcaggacagtgtcttcgacagtgcatcctgtcaagtggagacattctagggatgcaggaaacaacctttggtcatccatggatgtcacctccaaacgcctgcagccgctgatttccaggctcttcagcatgcctggaagtcttgggagccttgtcagattgggaagaacattgagcctaagcttgcgaaggtcagtgaagagcttggcgatctcagggagagtttccaggttgtaacactccctgagttcgaggaattgcaggttactgacgcccccatgttcccttgacagccaacttggtgttgtgcgacccaggtagtggcagatgttgaggcatgtaagttgctctggtggttggaggccgtcgagtatctccacttggaggctgtagatccttgtcagctttgacataggatgcgtgataagcatgccattcaagtgacaatgttgtgaggcacttcttctcggtcagattggcttctagagctttctccttgctctcaacactctcaaggccactgattttcaagctgccacgaaggttattttgcttcatcagctgctttaaccgatacgcttcctccttcctgaccttgaagtgacttagctcttgcagttgctttaaatcctccacgtaaggaattcccaaatcaacataaggagatgaaatagaccgcaagttaatcagctggctgctcatccttttgacattggaacagtttaaatctaaataatatgaaagagggaactctaggttctgcaaagggtagagtttgccaaattctgttggcaacttcacctgtcttatatgggatcccaaaaggctgagaaaacgtaaatgctttaagccacaggctactccgggacaatcactctatcttgatccagatatgtttgcaccacacgtaactcttcaatctttcagcattcgctcaagaacttgttctgttatccccctcgatccatcagcgctaatgattaatgtccggagtttcttcattttgtagatatcatgtttatacttcattgcattgctggaagtaataaacagatggcggacatcggaacggaacacttccacctcatcccccagaactcgtaagcaatcatttccggcaaccatctctgccaattcgtgcagcatatcaggtatagtaaaccactcatcgtcactgtcagcaagctttccttctgattttataaatgaccatgactttaggtcttcaaagtatttttcacctatatcttccattttctgtccattgctagtcttgataaacccttcagccatccacagcttaaccaatgcattgcgtttgaaccggtagttccgtggaaacatactacagtaagcaaagcatcgccggacctgttcgttaagtttctggtagctccgccactgttcttgtatgatgtcagtacacggtacttcattatctctaattttttgccaagagctggcatctaaatttttgcatagcctgtctcctactcgccttgctgcaaccggtaatcttcttagcttatttgcgatccctctgccaatcgaatgtagtttttgaagtttttggctatcaagtactctcacaccatcaagtgcataatgcatgaatagatcaaggaaatcattatcatccatctcagaaatttcaacggggctcttggcacctagggacatggctgtaacgccccgattttcgttcgggaataaaaatcaattaataatacattttctagaaattaaataaaagttaaatcaacttaatcaagtgaattattgagggaattaaaaatttcctttaaaaatcattagctgagaatattttgtaatattctttgtgccctaaaatactctccggatttttccgcaaattttcggagctcaagaaataattttaaagtcacaaagatcatttaaccaattaaataaaaagaaaacaaataaaattctccttccttcccttttgggcttggcccaagccttcccctcctctcccgcgggccgcgcgcctcctctctctctcggccggcccgcgccttgcgaaagtctgctttacgtcccccagtttccctcctctctctccatccggccgacaggtgggaccgtgggccccacctgtcagctcctcctcctacctctcgccggccaaccccaaccgccattgccgcccacgtcgccgcaaaatccggcgccctcccgcacccgagctcgcatccaacgacgtgggcacgatcccctccacgtcctccaccattttccccgctcgtcccacaaaaaccggcgccggccgagccaccaccaccccccgtcggcgccccacttccccgccggttgccgcccctctcggccctgtttccgccgctccgaccctataaaaacgaaccccgaagcatcctctctcttttcctctcctcacccgagccagccgcgctctctctccccctccccacgccgctcccgcgcaccgccgcttttcggcgagctccggccgcccgccaccgctgctccacccaccgccgcgccaatccgccaccaccgtcggcttcgcggcgccgtgccgcagcccggcctctactccacttcccctctccgcctccggaacaccgccgcctcgtgcaccaccgcctaccgcctccggccgcctctagccgccatcctcaaccacctcaagccgcgccactgcctcggttagatccaccaccgcaagggcaagcccagccgcccatccatttttcccctccactaccagaaccacctccccaccacgccaccctaccggccattttttttccgtctccggtcgccgttcgccatcaccccggctgccgccgcgacacgccggccgcattgcctccttcgccgcgtcccgctcttccccgtccgccgcccggtcgccgccttccgccgccgggagcccctcctcattgtcgacctgtggagcgccgccgcctccctccgccggctgctctcgccgtcgccgtgcccctcggtgagctccgccacctccctctccctcactgcccccgtttcctctcgccgcttcccgcgctgcgcgccgcagctccctgcgacgcccggcccgtgtgccgccgtcgctttggtcctggccgccgccgccgccagccttgtgtgcgcgctggccaggccgcgccgcccggccgtccccagccgtccgatcggccttggccgatctagatcgtcgggtgcgcggccgcgtggccgatcgccaccgtggactcggtccacggtgggccgtgccgctgacgtgtggggcctgccccctttgtggacgtggtccgcgcctcaccccttgctgacgtcagcgaggaccatttcctttgtaaaaataaataataattgcgcaataaatcgagtttaattctagaaattcatttaaatggcttagaacttctaaaattcatacctaattcattcgaactccgaattgagccattcaacttgcaaaattcatctaaaattaagctctacatgtttgtttagtttttatgtactgttttcttggtttttattagagtttttcctcgttttgcgtgccagcgtgtagttcccgtcgtttcggaagatcgtgttcgcaaggataagagttcagaagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagctggtgttactttgatgacctagctagaactatatgcttagccatgcttaattaccactagctcagtcgatgggataattgcagtattagacattttagtatcttggtgagctgcgtgctcgagacatctggccatgcttcatggtcgtaattattcaactaaaatgcgactgaatggtgggctgtgggtgcatggttttgctggtcgcatccatggcagttaaggaccggttcgcgggatgccttggaagaatttatcgtacttaccacaagccagcgtgggcaacggctgggcttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcagtcgaccagattcaccgtgattagtctcacacttaataaatcgacccaatacactgtagtttaggtgggttggttgggcctgttcaacgtggtgtagcgttgatcagtggagatttaatgttactttaattactcaacagttttactgttttgctcaataaaatgttttacaaccgcctttatgcaaatagacacaaaccatccttgtatccccttgcacgtctgcatcgttggtgtggcttgctgagtacggtggttgtactcagccttgctattattcccccttttcagaagtgtagtgcttctgagctgaagatggagttaaaggaccaaggctcagaccccagttgagttttgcctgtggagtggagctgaagccccgctaggatcgttttttttttccgctgctgcttttgtttcggtgtgaggactaagtgcctcttctgtaagtattttacgcttattttacgtttggaactgtatattacttgtcgttttgtgtaccctgactggtcctagacagggatttaatacgcaaaatagtctggaaatttgggttaaatttctgggcgtgacaatggctgcatctttggacaaagctgtaactaggatcttacttccccgcttcccaaaattcagtgtattacgtacttggtcccgttcttgctgagcaacatccgactggagaccatccagcgccagcaagaaccttttgtctctcaattccgcttttagcttattttctagggcatcaagattttggtacttataggatggtcgcccaatggctccttcgagcatctgtctgtaaattttatccacactgaaactttgagaaacatcaacccacatgacaggtgaaaaatggccatcctctttttcatactcacagacatattgtgcaaggattgtcttcccggatccagcaatgccatagatgccaattgttgttgaataacacgggttgttgctggagcctggttcaccgtcccctgctgcttcgcgcaacatatttactatctttgtacgatctacatctcttccaaatactcgccccgtagctgaggaagtagtgcccgacatcgtctcctcgatagttgtctccgtcattaataattctcgattcacaagcccgcccttagttagtttttgtagcttctctaggcttttcttcagcttactggttgtgtagcttcttctggcttttcttcagcagctcacgtaaccatgagtcggtattagagggagagctgacctgcattaagtttaggcatggcagagtcatgtaacatgaaacgtgcttattggcccaaaggaaaattttagtagcatataagttttttttttttggacttgtagttttatggctccttcagaacgcatggatgggcacatgaatcatttctttctatataagtacaatccactaagtacagttatggcaataaagttctataagtgagccatcggaagacgactcacgcgtcgcctcctctcgggcgacacgggaggcgcccagctcgccgtcgcccgccgctccctcccttctcctccttcgcctcaccgctgcccgagcggccggcagcaaagtcgcgcggccgcaaggacggcggcgacggggcttcgctcagtctcaccgcacaagggcaggggggactgccggcatcgggaggcggaaaccgcccagatccgtgccgaccggctggacctggcgcggcggttgctggtggcggggtacttcgttcgggcggtagcatttggcgggggtggcggcggagtttggaggcgctggtggtggaggacgaggctgccagatccgtgccggatctggcggatctggcggggaggcatccggcggcgcccgacgctggcgggaggatgtcggcgtctgctgggggacggtggagccggacgacgattggcgacgggggcagcttcttgtccgatgacagagggtgcggctagcggcgacgggcgcgacgacgaggaggccgcgacggtagcggaggggcacgaggccgcgcctgcagatctggccacccggcgaccagatcgggcgggcgagcttgcggcggtggaggcggagctcgcggcgaagggtcggcagcagcgggcgagcgacagctgcgacggggcttcgctccgtctcaccgcacaagggcagggggtactgccggcgtcgggaggaggaaaccgcccagatccgtgccgaccggccggacctggcggggcggttgccggcggtggggtactgcgttcgggtggcgacgtttggcgggggtggcggcggagtttggaggcgctggcggcggaggacgaggctgccagatccgtgccggatttggcggggaggcatccggcggtgcccggcgccggtgggaggatgtcggcgtttgctgggggacggtggagccggacgatgactggtgacagcggcagcttcttgtccagtgacggagggtgcggctggtagcgacgggcgcgacgacgcggaggccgcgacggtggcggaggggcacgaggccgcgcctgcggagttggccacccgacgaacagatcgggcgggcgagcttgcggcggtggcggcggagctcgcggcgatgggtcggcggcagcgggtgagcgacggcggctacggcggtgcgcggctggtgatgacgacgacagcggtggctgaggcagccgcgacagcgcccgtggtggccggcgcgaggctctcggtggcgacagcggcgcgcggctggtcacggcagcagcggtggttgacggcgcggtggctatggtatctattactctagcgggtgaatatcaattttcgcaagcgggactagatttatggtattatctgtagctattttttgcaaatggtgatttttcatagtccgactggaaaaataaatggtgacattgggaaaaatcgtttttctggtagtgaaaagtatttgcaagttactctagcgccatcaccattggtggaggttttgcacatctcaacatcatatgtcggagttttacttaagattttaattatttctatctagaagattattcttcgttatgaatttctaaataatatttattggctttgtggttacatgtaaagctacacacaatgaattcgaaaacctcatctcatcgtcccttatttaaaatttgggtttatccagaaggacatttgtctatctttttcttcggacgagtttacgggtcggacgtccgatcggtttagagaaaaatcgggcgccgatgttagtgcccgatttacgtgcaaaactattttaaactgatttttctcttaaattacttatccaaatcatgatccgattgcaccattaaatttgttacaattaaatcttcaaaacaaaaccacacatggatatattccgacgaaaaattttttaagcttattattgaattatttttaaatgttgcacgatgttccattagatatatcggaattgtttcactaagtagattgaaaatgtttcactcgtttgaatcgggtgtcgtttcaccttatataaaaacaatgtttcagcaaatagcgaaagaatgtttcaattcactgcaacatttgatccatacatagtgaaacattataagtacactaggtgaaacatttttcggtggaacaaaaaatgaaatgaattctcttaatagggggtttccaaaatatgtgggttttttttgttgcaatggaatatttcagtgcactgcaacattagatctatacatagtgaaatattgtgagtacactagatcggggggaacgcccgattggctccacccccgtcgggctcccgagccctgtcattctctttttcttttcatgctttagaatgcatcacatccaacaatttatttttatctattcgacaacaatgcgtaggttgtcttctagcaatagccaataaggcttttgatgggaatctatgagtaaaacagatgattggaaaatataggtaaaatacaaaattaaccacttggataaaccacgtgaattttaggggagaattctaaaaaatccccttgtcttgaaccattccaaataaatttcatatgatttttggaagttctaaatttcaatcttttgttccaaactgatcaaatactcggtagaatatttactgtatgattcaaacactaaatttcttccaaatgagccttaaaaattcctttctacgatgttttcaagcaactttgtactaaagcttcagcgtttaatcttgaaaattaaatgaaaaaacaactgtcacgtgtttgaactaaccatgtgcttaaaaaaatggcaaaatttgcaagctggatttcaccgtcatgtcacaattaattacttatatattattcccatgcatacccactctagtctccaggccattctgaatacctaagcaaaattgtaaaaatggtactccctccgtttctaaatatttgacgccgttgacttttttaaatatgtttgaccgtttgtcttattcaaaaattttaaataattattaattcttttcatatcatttgattcattgttaaatatacttatatgtatacatatacttttacttatttcacaaaagtttttgaataagacgaacggtcaaacatgtgataaaaagttaacggtgtcaaaaatatttagagacggaaggagtactacttttatctcccccagtcctgaaacttcttgtggtgaaggtggaggagggggctagaaggtgtaaagtatactaccattgtggactaacaagtttatctgagcaaggtccaaaatagagttgctaatgatggaacaatctccgaattcagttgatatatcttatcatcctcaagcttgccggtcttttgccatttgatttggccacgtgccatggttaatctatactttctgtaaagttataacccactaactctaaagtttcacatgcaaccataccacatcatcacccactaacaataattacatattcaacctcatgcaaacatgcaagagcatccacaatctatttaattctacaaattagcacgcaagcatattcaatcaccacatctcacatcatttccacaatagttttacaaatctctattatttttataatatttaatatatacttataaacatgttctacattaaagtgcgaatttcatttgtttcttgataaatatcgataagccctgagatttgattttttttctttttactcctacctgaattgtaacgaaaaataatattgaaaattacttagtaattcccacagcaaacacggggaatcccctagtttttaagataaatcatggccatgggaattatgggcttgtttggtttagtgctctacgaatactagtattggtagtgcaatgtatcaattcttttttattattatacggatagtaaatcagaatttttattatagtaccaaattagttttaatatatctaatattgaacgtattttgatattttatttttttataaatatggttagtaatttgaattagaagggggaaaaaaaggtcacttggtttggtttgcagccaaagcgacaaagctgcatgtggagggcgaggttaaggtaatcgtggatgtccacgatgtcctctgcgtcgtagaaggcagatctgaggctctgcacccacttgtccagatacggcatggatgtcatgtgttccatctgcctacgcagctgcggctcaagacatgccaccaggttgcgcagctgggcttcttggtcgcagttgagcaggtcgatgcctttgttcaccgccttggtggtcatgggcgacacgatccatccgatcgtcctgatcgcccacccaaccgccacaacctccaacgccatgacgatcgagactcaaagtaaatgctgcttgttggttaattgaacgatcgatcaatataatcgtctctcgtcgacggagttggagcacaatgcaagactatatatgcttggtgccggccggatttatggaacgaggacctagctatagcttaactcaagtcaagtcaaccccggccggtgcaccatcagtgaggctatctgtggaaattaatctaaaggaaaatcaacccacgtggggtttgggttgttcccccaccttatttttttgaaaagtactcattttattatatagaaaagacagagattagggaaagaatccccagtacaaattgatcatacaccaaaccatcctttctaaagatgagacagactgaactaagggaaacaaattcctgatgtagccatacagtgataatggatgagatcgacaggagtagcggcgttgccgtgacgactacatccatgggccttcattgacgtgcacaccgcttgacaaaccgataatcccctttggttgcctccacgggaacggcacaaattgaaggtttgttgttgagtcgtagattttggtgtgagcttcaccggactttaacagttgatttccacggagtttatcattgaatctgaggagcactgacttgcaatcctgcgaaacaagattgctcggacggtctgccctcaacccgaacgacgaacccagcatgggtaccactgcatagaaacatcaagaaagaggtccccaaactccggccaaccttagtcaagaactaggatggcattgattgatctgctgtctttctacttcagcttggagctcaacaaaggaggatgaggagaaattaacctggtggccagctgcaattccttgatgagcaactatcatccccagcccatctaccaacagatcatgcaagcaccaatccgaccagcaccaacgcagcattctcgagaagcacaggctgccaaatattttgttacctgctgtccttgaatccgagagctgtcgccaccccaacaaacaccgtcgccgccccaacatctggagggggagaggccggagacggagagggtgggtcatggtgtccggggacaaggcagccaacgccgcaactgtcgttgcgtgccggccagatgcagggagggggcagcgccaccaaacttgtgctggatctgacaggttgaagaagttcctttgaccgatctgccttcccctcattgcaactcctcctctgtttttccaaactaaaccctcggcgactaaaagcgactccttccgtcgccgggacgacggtgccgaactccggcgatccatcgacttgaacaaacgggaagaacccgacgacaggaagacccgactacgagagaagaccaacacctaagctaatagattactaaagggacgaaaatcccgccccctcccctcacgccggcgatcggagggtcgccggagatggaagggaaggggccgggagaaaaggggattttttttttctccggaaacgcctgtttcaggttgttcccccacctgacacccaatccctccctgtgaatccccctctcgtccacttgcgcgggtggttggtgggattattagcagatattatccctgggtttggatagagggggattagaagggatcactaccattcaaaataattcagaaatgataagaaaaaaaattgatcatgaaaacagaaaaaaaatcaatgtgcaaaataattgtaaaaagcccccaaaaatagaaaaacgtagatttaccacagacgaattctgaaaaatagtccagaattttttttaaaaaatcataattttggatagattaaattctacaagcagtaaaacatccaaaataatcatatgttttccatagatatgctagtcacagacaagagattgagttgtcatactagtatagcaatagattggaaattaagcgcatatatcgtcttccacattcggccctgcatatactgatctgttgaaacagtacaattacagactcctaaatctgcagttctgctaattgaattaccattctactacgaataacagttctgcaggcaaaccccaaaagaactgacgaaactaaaactagtttatcatcaagcccttgaaaacaaacttttccttgtctccgaatttttcccaaaaataaagagagttcggcaactaccaccatcagcttccaaatccatcaaaagtcatgtctcttaatcttaaaaacctgaaaaacaaacaggaaacattatggacacctgaatagtcatatgaaaatttgtttggaaagtgacaattattctgtgttaatttggaaaactaaaataagaagtgagttatcatctacaattctggaacaaaaatatttttaagacaaggaagaaggtcaggcacgattaagcccagtacatatactcacaattttcagcttttaagcactcaaccatacttgctatagaaaacaaggactatttggacagataaagtacttaccctgatatacatcatctctacttgtctttgtctgaacggaccagaaagccagcgtctcatttttcatattgttcttccctgaaaggttaatccttgaatataagcacagaacttgcaatgccaacagttgcaatatcaacacaaatgagttatatgtcgatttgtccgtactccgtagttctgcactacatatagtaataattgagctagtcaatgatattcatgtttttgtcatatctgtgagaccatgggcagtggcagcactgctgaatgtggtaaattcatcagatatatcatataattattaattatgttcgtgatagagcaggtagctccttggaaaaagaaaagtatgcataatacctgttatatttgtgtttcttggagtatcaaccaataatgtaggacctgtccagcaaagaggaaatcggtcaactttaaatatctataactacctgacaaattttcactcaagtttcatttgcaatttcctttggaatgtattacattacagagagtgcacttctaaagaattgttgaataggcatttcacacttttcacagctattatctcacaacatttcttcagctaaactgttaattttgttgatcgaatcatatcaggtgaaccttcaatgttggaacaaagccaacgaaaaaattgatctttgcaagcagcaggacaagaagctgtgctctgcacctctgcatgagagaagcaactggaacaatgacaggctaatactagcacctaacactgaaatggagctgtctaatttcacttgatcctgtcaactgtcagtatacaaagggagatcgtgcaaaatcagaaagactggtttggcttctactcgctcatcttaatgattggtgggagaaaggacagacaccgagcaccaactaggttagaaatatgactaatacttcaatccatacagccactcaatacatcaactagcaacaaattcatccactagaaaagtcacaaaatcttttcatagtaggaaaagaggagatcaagaatcagacctgcttcttgatgtccgggctgttgccctcgaccttgccctctcccgcaaccggtgaatccgaagcgaggaaggagagatggcgagcggcggcggctgtagcgggatggagaccggcggtgaccgagggcgggaaggagaccagtggtggctggagatatgctgctcccggacctcgcgccgcctccaaacctagcgccgtgaggagtcgaggaagatgagcgccgtgtatgctcgggaagaaaaaaatcgtctccgagacgatttttctgtaccgggggtttggcatggatcgggtggagaatttcccccaccccacctcgggccaggcgaacgcgtacatgcaccacggaagaaaattagatctggccgggatggcacacggggatttcggcccattccccccaaacctagcctataagaacgaggcctgagagatctattcttaaatcatttgtgttgatcagg

SEQ ID NO: 80809 - DNA, 5642 bp, Oryza sativa
agcgctagccctctcccttgaccgccctaggtcggttcccaaaccgacattgcctcccatttaaccaaggcgccctcccatcattcctcctcccgtttcgctcgccgccaccgcgccattgccgcccctctgtctcgcctccgccattcatcgccaagcaccgggagagccggagcgtgcgaaggacgcggaaggggactctgggcgctcgtcttcctccgcttccccggcccgaggccggagagatcactcccgtgccgtcggcctctcgtcacagcgccccgcctcgtctcggtagtgcatctccccgttctccctcctcgatccatctcctccccttagactcggttagtagcatgtgtagcaccccagtagctagctggcgccgccccgactgctgccgtcgctcgccgcgtgcccgccgccgtcgccggcctccctcggtgcgtttcctcctaatccggcgcaagggacggattcccggagtcgcgtagatgctctagctcgcccgaatcgatctcccgtcgcgccgtcgccgtttcccccttccctcgccgccggttgccgccgccgcaatccgctgccgtcgagctccctccggcgaatccaagccgttggctcgctccctctcgttctccctcgtcattccggtgtacaccccgtcgcccctcgtcgtcgcacggcgtcccggagaaaccgccgccgcccgccgtccattcgcggccggcgccttcgtcttcctccagccggcccgcgtggcagccacgtaggcgccacgtcggtgccacctcagccgcgaccgggtcgagccgacctcggtcggccgctcccttcggccctgctcgcgcgcgcggtccaccgcgagccgtgaggctgcgcgtgggcccgccgcaccgtgtcctccgcaaaccgcgcgcatgcaccgcgcctcccctccccaaaccctagcacgccccgcgtgcacctcgctcacggtgagccgagccgccgacaagcgggtcccacccgggaccatgcaaggtgaacccggcccacccgctccctctctcctctcctccccgcgagccccttgggccgtccctcaggccggccggcccaatggcaaggccgggccgcgccaacccctctcgggccgcgctcaagccgccagcgaaatctaattcccgtccctctttcttttcttttcttttctttttcaaaaaggatttaaataaatccttttcctttagaccaaaaatccaataatcttagaaactcaatatcttcccaaccgtaagtccgtttgactccgttcaacttccaaaattcctcaaatctcgagatctatctaatggcatgcctagaggtcaataatagggctttattttcgccgtttgttgagctgtcccgtttcgcgtgtagtttcagagcccgaagacccgcagtgcgaggatttcgaggatcaagctcaagatctcgagcaaggcaagtcacctttgaacatcttgcacctataatgtaaatctaagtatttctttttcgcaaatattgcatgaataggatttacacaagtaattcggccgcggcttgtgagatagcctgccggccccccaatcctaattgctgcaattaccctccttgaattattgaacacttaaacctcctttgtcaactgttgtgcttcgatgcacgggccctcaggtacgtgtaccggaacacccttccccccccctcaaaatataaaatatccaacgatgggtaaaacttgggttttacaaaagacttggaaaacccgacacctgggtcggtgcttgcgaactaaataaatttccaaaatcgcggaccggggaacgtaccgggtgcacggtttcccgctctcgcacttaagaaccgtttccttggaatttcatccgaacataagacaagtgcgaccacatgggtggaatgggacaccccgattgagtaactagctaatcgggggagccttgatgccgagagacatgtggattcaacggggtggtgtcggggagaacccccgggcttcctggcacagtatggtctgggacctaacctgttgttggtctgggacccctctcgtcggcatatggcaaccctgtgtctgctctcgaaatgccttgtcatgaaaacctttaggtcaccagacgtggccgttctgcacgggctgggtgattcgggttagtaatgtcgtgtgggtaaagtgtaccccctctgcagaggttatcaaactgttcgaacagctgtgcccacggtcatgggcggatgtgaggtgattcatagcgtagttttgtttgactactgctttgtgaaattgctgttggggattgggttcgacgtttggaaaatctgcggcggctgatgggatcagccaggcccgggtggccgtttgaaagttgttggccgggtgccaaccttgaaaccaattcaaagactgatacattgcacatactccgaccggacgagacgcactgcctcatccgtgccgtttgagaagcactcacttagatgtttcaaaaaggagtttgaataaaatcatttgcaaaaacaacagccttcccgttgaagcctgcattaaacacttatttcccatggcttgctgagtactcctgtactcacccttgctctatataaataatctccccccccccagttgctgaagaagatgatgtggatcccgctgacgaggagttcttctaggagcaagtcggttacgacgagttttagggtttcggcctagttcccaagtcgcgcctgtgatgattggtccaagtctcggcttccgctttcccttttgtaatgcagttgtgagctcgggatctgtccgcagcccaacatgactgtactcctactctgtaataaagagaccactgttgctgtgatattctgtcttcccgtgataccagcactgtttcctgggactggtatcgattaacaggttaatttggagcgtcacgggctagttccgttcggggctagttcgggacgtgacaagatagatgcaatcttgtcaggcttctcaagctaacaaggccaactgttggacagaaggaacaatgaacaagtcgaagagactgaatagagtcgccactctcattagataaaagtgagcatgggaaattgtacttttcctcatttgaagtcaacacgagagtgagttctttaatcccagatgtaatagcaatctcaagccaactattgagatgataataggtgttggcattggaaaaaggatgtaattcaaggctaaatgtctttatacctcctgagtgatttttcattatgcggtcaactttgttgttgtaatctctaactatcccaccctttttatgtggcactttattcaaacccatcgttttccaactgaaaatgaggttgggatgacacctccagaaacgtagaaaagcctgagacacgcaagcagcacgggcagcatcttgcagtggcaacaaggaatgtatatggtgccatatgtcctgcatccacaagcatttagaaaaatctcaatattggaattcaagagtaaataattaacacaattagagaaagcaaaaaaaaaaaagatacatatatagtggcattctataatgttgctctacacatggttgtataaaatgcatatggcattcgaatggagtctgagctcatttttcagtttgtgtttgtgtattgtgcacgatgtgattattttttaagttgtagtagaaccagtttgtttgacaaaccaaattttggtgcaaccaccctcactagggaatggtccgttgccatccctatgtaggaccgtacaagattgcagtattgcaggatttgttcacaactcaatattttgctaacgatcaacccaacggtttgtggttagagcaataacggtgacattagctccctctgcttacaaaaagtcttttggacattgacacggtctccaaaacagaacattgactaataatttacattataatctattgttagcctgataagattatgataatatgaaattactttctgagacatccaaatatatgattctggcatttacggcgtacctctggaaggtccggacctgaatatctcattctcttcacacattgagaattatcttgttggcagggagattcctttcttttagcacattgagcaagaaattgatctgcaacatgttatgctcatgatattacatacaagaagaaaacaacaagaccaaggttgataccagtcacaatgaaacacgcagagaacaaaattggatccattagttacagacaagaatttcagtagagggaacttgttacagtatataaaaaaaaacgtcaattgagcatttgaggtattattgaaaaatgatgcaaccgtcccaaaagaccatcagacaatgagttggaatctccaacctcgtagttataacatctaaccctgctcactgttgtgtttggctgaataattcttgctcctcttaaccatgatagcctccaccatggaaaggaagaagcgtgctatatatccaactaggtatgttttgaaggtcacataaaaaatggacaaacagcaaaacacattaaaaagaggatttttcttcaacgttctgtaacgtatataagcttaggaatcggctttaacagtttagaagtggtatagcacagcacgtcatgaatcgaataagaaaaagcatgtcatgcggatagcacaatataggactagatgaattatatggacctaggagccaaataggtggcttacaggtttcgatttggagacggcgctgctcccgccttagggacattaaccgattcagctcatgtagtcccctggcgcgatgatatctcggatctagtcgagaaatcggaggcatcgggtcgggggcacctcagacttgccttctctcccgcttcctctactgatctaatgtctttctcctctcgattctctgattatttgaacccaatgctgcgctcgcttacaatttctttctgaatcaaacgagacgcgaggggaggaaatcgagtcggcgccgccgggccgggcgacctaccaagcctactcatactagtatactactacactggatgaggaggacgacgacgccggatgcacacgatagcaaagctgggccctaaagatgagactggacagaaaccgtgcaaattaagcgcacacaccgggaaccaaaaagtccaatttaagtcccttattataggtcagatttgatttgtatcctcaaccgtaaaaccgggtatttgacccatccaattactgaaaacttaaaaattgactcctttttgttgttcccatggcagttttaggaagatggattctcacccgtttattgcatgccaactaaatgttacgaaaaatttaaaaaattaaaaatatatatcaatatgtaatatatcattccataactatgcaagttcaaattaaaattctacaagtttaaaaaaataataaatttaactgcaaataaacgtatagtaatttgagctttgtttgttatttttattacaatttatataagttgattttttaacttgcatggttgtggagtgatatattacatattgatttatcttgtcaattttacacggttttaatagttgaaggggtcgatatatccggttttgtgattgagatatacgaataagatctgacca

SEQ ID NO: 80810 - DNA, 2564 bp, Oryza sativa
atttctgcacggcattgcgttttctatactccattgcgtgagttattagccctgtttggaagtaaatggagttggttatgacttatgtgccctgtgaacccatatgcttgtcctgggatggaccagacggtgagaatcagttagagcaaggtgaacatagagtaggggcagtgagctggctatatttttttgcgagatttttcttttttgcgagagctggctctaattttattcaactcatttacagatctgtatagtcaatgatagtagggcctttcccacccaaaaaactaaccaataagataacatgttccgtcacttatatattaagtcaattgtccttatgcaaccaatgtcgaactattcaatatatagcttgtgtataaaatatatagtaaacggtagaaattgcggcttttatctcatccaatctatatctcgacagtagccgataaaatcaaccaataattttgacacacacagttgctgccaggctcccactcaacttccatataagtatgttacgactgaagataaccccatcaaggccaccaggcgatccgtgagagtcagatggcccaatactcgcgtaactgggccggagtggggccaagtcatgtaccgggtatatatgtttataaatacccaggggtgagttaggaacacgatatgggatgacaaacttgcacacggaactatgtcccatatactccctccgtcgcaaaaaaaaaaaaaaagacaaatcctggttttcgtgtccaacgtttgaccgtccgtcttgtataaaaaaattatgaaaaaattaaaaagataaatcacgcataaagtattaatcaatgttttatcatctaacaacaataaaaatactaattataaaaaaatttcatataagacggacagtcaaacgttggcacggaaacctagggtttgccttttttttgggacggagggagtaattcaaatcctcttcctgctcctctgttcttctctgcctccttcctcctcttacctcaggtgttcggcggaattcccatgagagaccgtaacaaagtactggggctgatatcggacagggcaggctgttgattctgattttgaccctatccagaaacttttacaaggggctgtttcctacttgcgtacatgctgaaacaaaatgtttggaaaattcagaaattcctatcgaatatttcaaaccctgttcgctgcataattttggggtccctcccatttctgtgtttctaatttttcttgattctcatatctccattgcatttcaagttggtgtaagcaaacttttcttatgtttggaacttttaactcaagaacatgcccatttgtagaggccctgatatcctttaggcttggcatttataggtgacatatacttctgttctgaaatgggaccaaacaaattttgcattaattaagatattttgtctatatgtcaagaaataaatactaatggtcccatttcagaacaatttggaaggtaaaggctagaaatcaatttggtccggaagtaaatactaagagaaattttacagtcattgaaaaggtaccataaggtatcaaaaattgtgtaaaatttggtacctcatagtatttagatactaaaagatataaaatttacaatagaaaaattagtacctcatggtaacttctaaaggaccataaaattgctcatgatgtgctatagttgcatttaaaattcactatgtactaataattgctatacatggcatcttgacattttgatgtttagtgggatgatgtgtatgcttacatgttgagttttagatttttagtgggttctaactatatagatggtataagtgacctaattattaacggatatacttattaacattgtacaaattagttagaattgaataatttaccgggtcatttgacccggtaaaactgcataggtacgcccgtgatctctaatatgttgaaatacaatcatctttgttctaagaacattggcatgacgaccgttggctctgccctcgtgtctgtcgctcattgccacctgtctcgattaatatggttctggttaagtcaagctggcaaatgttagtgccagatttgttttaaaaaacgacagtacccgttactaccagttcataaaaaaaatggttatctcgattaaagataaacaaaaacaggatgcgatagcatcaccattcatttttccattactttttgtgttggttctaaataaacctacaatgttgaggcaggggcgaagctaggtagtactaggggttcctaggcacccggttccaaaagaaaaattagtgattaataccccttagtgaccatatgtgcaccccacgctagaaaatcagaccacacaagcacgaatggcccactataaccacgacaggagcccaatacagcccagcttgcattaccgtgaggactaattaatttcattcattggaacagtagctcctaattgtgagtgataggttttcaattacgtgataatagctctcgtgttttttttagatcaaatggaaggtttggaatgaaattatatgagagaatccattaca

SEQ ID NO: 80811 - DNA, 16701 bp, Oryza sativa
caaattttagccaaaaacttgaaatctgatatttcgattattttatccaaattttggaagtttttatcctaggggtattttggttatttcgacaaatttgtacagtactaacggaggctaactggacggcgatggtaaatcgtagaagttaagcaaaagtcgatggtatattgtagaacgtgacaaagtcagtggcaaatcgtagacttgtgacaaagtcagtggcatataatggattctctcatcctataatgcagagtcctattagacaactaatccgaatatattgtgggcccaaaatttggatcacatatttcattttttttcattgagttgttattgttgaaatttgagtcgtgcgaaatacatcacttatattctagtattgttaattacatggcctgtaatttgagtgatcgcttggaaaaatagtgctgaggagcttctaccaatgtgggagctaggccctcactttgagtaattgaacttgaggtcgccgatatcctagctacctagctttgagcaggtcgagatcacttcctagttgcttcgagctcagcccgacacgtaccgaaggtgtactgaaacacgcacgacgattaattagcagggagcttgatacatcccaaaacccagacagctaatccgccacgatagggagcttttacggtagtgacagctccggtcgctgtttcagcatagagcattttgctaggtctcgacgagatctgaaccattggatcgggcatgaattcgtgatgactctcaaccctaggtttttgtttttccttgagccaaagggcgggcaaagctctgaataatgcccaagccatgatctctcttttagcatttgccaaaatgaatttgaattaaataactgtaagatcgatgcgtgtttaattgactacataagacaacggagatgttttctatgggtatttttgtggacttggaaaatgtttttatagattcggagtatgaccatcaaaaggaatcattggaaaggatggctcatcacgatgttatatatagagttaattagatcaatgccattggaaatttgcctattaaaaaatatcattacaattcatctattcgtaaccgtgccactagaattttacaaaattataaccgtgccattaccgtcacatttccatctattccttcattttccgtcttctttccttctcccatcttcttactccaacagtgaagtcgagccggcggcggcgagcacggcgtccgtgcaaggaggcgagggccctgccgagcgcgtcggcagcagcggcgagcacgtcgtctgcgcaaggaggcgagggccctgccgagcgcgtctgcgccgtccgcgtcagcatcggccacagaggcggagctgtgcccgcccgcgcagagtgccatcttcggcggacgttgagcacctggaacgcagcggcgtcgccgaggagctgccgcggcgggtcgctgctccagtggcaggtgaggtcgaacccgagcgagcggcagcagccggcaccgatgctgaacgggaatggcatggctacgtcgccgcaggtggtcgggcagtctccggtcgcggcgccagcgaaaatgaatcctcttgcctcccattgcatcgatcgatcctcaaggcagcatggccgactgaagtgagaagaaagtcagaaaactttgggtgtatgtatctgcagatgaagtatcttcattctcaactctcggcggcggcggcagcagcagcagcagcagcacgccgtccccacacaagcggcagcagcagccggtggcggtggcggcagcagcaaccggcaaccgcagcagaacgctcttccggtccatggtgagcattgtagtattacatatattgaaaaaaccggatgtagtactagctatagcctgcctgtgcctgaacttccaagcctccaaggtgggcattgtgtgccagttgttgtgaaaataccgatacagatgtggtgttatatgtacaaattgtttaatcggcacatatagacctactctctctgtcaaaaaaaaatcaattctagatttgaatctagatagacactactccatccatcccataaaaaaacaatctaatactggatgtgacatatgctagtactacgaatctggatatatctctgtctagattcattataatagaatgtgtcacatccggtcctagatttgtttttgtgggacgaagggagtatgtccagattaaaatttaggattggatttttttttatgatggagagagtatgtgtctaatctagttctcccttatctagaagacttgcccaaattcgttgtactaggaaacatcaaatcccattctaggttagctttttatgagatggaggtagtattacgtagtggtatcaatgccgttttcgtgatggtggcgactaatctgacacctttggagcggtaatgattagccttccagtgatagcgatgttctctgtcccaaatcacctttatattagcaacttgcattcggagtttatctaatttatgaattgactgtaccacaattaaatctttaaaataaaaactcggatgattataagttttcgtttatttcatccattctatatccctccaaaatagtaagaaattagattatcctatccaaccaaacataaaaaagatcagatcactaatccaacaggactatatttcacgcataaatgactgtgaagtgtgaagcagacaccccattcgcccaattcagcttgttgtattacgtgctcttcccggtgacgacggccggcttattttcgtgtttctcggcctgtgtggcccattaactggatgagcgattggcccatacatagctctgtattgtactccaactatttgatagcatcacttatcccaatattttttcatttctttttatacaagttatatttcaaactgaaatttgttataggcttatagctattttatttctaaaaaaaactttggtgtcggatttatgtaatacgaactgatcttagagaacatatatatgaactcaagtcattcaaatcagggcataaatcaaatgaaaagtttcaacatactatttttttaataagaccacttgttaaacaatataaaaaatgaaaagcatcatgcatttaaaatcgagggagtaattaatcaacaactatatattggaaggtagtactgcacacttcatggtgagggaaagtgcctgcatgtcatctaaatagtcataaaaaaatttaaaaaaaattgaaaatatagattaatatgaaatatatcactccacaaacatgcaagttcaattttaacttctacaagatgtaacaaattttgttgcaacttataaaagttaaatttggtcttgcatgtttgtgtagtgatatatttcaaattaatctatgttgtcaattctttttaaaaaaattttaataactatttacatggcatgcaaacaactagagaatgttctctcgagggatgaaaatccacgtcctcatgattgacaacatgcatacatcgaaatcaaaatcgaagtctacatctcgagaaaaccacttaatttccaataaacatgactaatccgcgaggggcctgtctaggcatctgtcgtgtgatttttgaaaaaaaatcacccagattttttatcccctcagatttgcatccaacagaaaaaaatagtacacaaacaataagatcgggccaatacagactaataaaacagatacaatataggttgcaatatgctaaaattacagtgctttgtaactaaaattacagttgtaaaaacagtagatatggcatgtaagtgcactgtaattttagtacaaatgtaatgtaaaatttggtaactagaatatttgtcgttttagtacaaatgcactgcttgagaaatcgtccaggtatctgaagtgttaaatattgcatttataagtaaaattacagtgctttataactaaaattacatttgtaaaaaacagtagttatggtatgtaagtgcactgtaattttagtacaaatatattgtaaattttggtaactagaaaaagaaataaaagaaatagagagaagcgacatcagcgagaaaacatgggcgcgcaaatcaaaatatcgcacggagaccgtggtgaacatggccccacgcggcgccatgcatgatcgattttctgtcgactggaagctgagatactcgggctactgtctactgtgttactatcagcttatcgatcgtttcctccaccatgtcgcccgtgagacgtgtggcgctggaccgctttgtgcgtgtctgattcgtcgcgcctaatcgcggtgcagatccgacggttgaaaaaacgtcaaatacgaaaaaaaaaacaatcacacgagagatatattggtataatcacataaaattaatgataggacaaacataagatgacactagcttaatttgggaaattccaagcttagaacagcagcagcgaggcaacgagaggcacgagcatcatcgtcatcagcgacaccgccgccgccgccgccggtgcagtctcgaacgtcagccgcccggcgtcgacgtcgtagatcatgttggtgcccgtctgcagcagcgttcccagcaccgagccgccctgcgatggcagcatggtgaggcactccagcccggtgtcgttgtcgatgtagaagtagttcgccgccgacagatccatgtcggcgccgccgtcgaacaccagcgtcagcttcggcaccttcaccttcgccatggacgacgcgttgtagcacaggtcgagctccagcgccgccgagccgttgacggccggcaggccgatcctgctcgccaccgccgccctcacgacgtcgtacgccgcctgctcgaggtacgtcaccggcgtcgtgctgctgaggatcaccccgccggtgccgttggccctcaggtcgaacgtccccgccggaatggcgtccagcctgttgccgtcgacgcgtacgccggtgaggttgacgtagtagaagtccgggtacagggtgctcgacagcagcggcgtcgaccggccgcgcttcgtcttcggcacggcgtcgtcgccgaaccggatgacgctgtcggcgctgccgtcgtcggtggcttccggcgccagcagctggtacgagaacttgccgaactggagctgcgagatcagggacaggttgcctctcccgatgccgatgacgcccgacgcgccggcgaagtcgccgtagctggcgtcgctgcagccgaacaccacgccgggcacggccgtcgcgccgaacgtgaacgtgtcggtggcgaggtagcccgacgtgttcgccgccgacccgccgtacgtcaagctgtagctgtcgcagcgagcgccggcagtggcgttggccgccgcgccggcgaggccgcacgtctcccttaggacggggaggcacatgtcgctggagcaggggagcggcgagaacgtggcggagccgttgggccggaacgcggtcgccggcggcgggaggcacccggcggcggcggcgcacggcgcgcactgcgcccacacgaaatagctcgtgatgtcgacgaggccggagacggtctgcgcgacgggtgtcccgacggtgatgttgatgacgagcggcggcgcggcgccggacgccgcctcgccgccgagctgctgctgctgctgcttgttgcccctgttgcgcagctgcttcttgaggaatccggcgaccagcttggacacccatggccggcttttggcggagtagccgccgacctttggtctggcgcggacggcggcggcggaggccaccggcggcgggtggagtagttgcaggctgaggagagaagcagctgctagtagcagcaacgtcgacacggccatgctcctggccatgtttgaattttatgtgtttgcctatcaagctagctagctttgctgtttgtatgataactatgcaaaacttggctgggatgtttgatgaacatggctagttaaatgagtatatatagggtttttggtcgtcctgccatgcatagctagccactggcagaatttagaacattatgttgttggattgtgttgacacttgacctaattttatttcatcgtgctgaaccatatgtcgaactgctacatgtgatgtaacgaagcagagtaacacttagtttctgaatacatgacgttagatcctgaatggtcgaacttattattagtcgcctaattttttgtagctatcatgattgttttaaactctttgtcacctagagttgcaaacgtgtcaactaaactaatacaaggtgtacagttatttaaacatcaatctccagtagacgcagtggcctcccaccccctcgcacccaccgcgcataacgtaaaatactttcgtaaaaaccgaaccgaccaacctctcccagtcccatccataccacccctcctaagattaacctataaaaccaggcagaaaaaaaaattaaaccctataaaaccaatatattctattatttcaaataatagaaagaaattttgtcctttcctcgaagatttgcagccaattattacataaatcctttcaacggcaagcataaaccaacaagtccgtaatagcacacccaaaaaggcaaaaactaatgaccaccaacactagacaaagacaacaaagttactaaaacttctttgtgaatttacatctgtagttggcgagaatctgtataatctttgcctctaggttatgcataagtttgatatactcatcacacctttgcagttgggcttaaaaccgaagcgaatatgttgcgctaaaaaatatctgcatataagatttagacggtgatttgtcaaaaaccatatcatttctgctaagccatagaaccttacatataacatatactcctactagactaagtttcttggtttttttatcaatacccacaggccaattaccaaaaatattagatttactacatgaagatataaacaaaaagagatttgtactgatctccagagaaatctggcaaaatgattatctcaaaataaatgatatatatcatcttatttttcatgaaaaaattacatctcacactacctttccaattcctactaaccaaattatcattagttagcactactccttaaacataaaccacataaaaatatgaatctttagaggcatctcaaatttccagataacattattcctctcaatataaccaaaaaaaatttgaactaaatacatagaacgaagcgagaattgacgattttgatgaaaattgcatttaaatacatcatttccttctgtcaaacgaatatgcacaattaaaacacataaattatgtcaattcatcgagttatggtctactaattctcttgtgaaataaacattcaacggaacataactcataacatttgcagccggattcttctacgaactataaagtactaatacgggtagctgtacttaaaagaagtatttcctatctacttacctcctagaatcttagttgttcaccattattaactaactaggaacccatatctaaaaatctactcctaactttcttcataagtcccaaccaacaatgagaatactcttgtttcctctcaacttacttaaatgattcattcgttaagtattttcttttcaataagtcttgttgaacacatttctcatttattaacttaaaaaaaccatttgcttaataaaaattggttttgaatttctaaatcttcaaaatatatatacattgttaggtggcctaaatagtttgtttaactcgtatgctgtatacatattcaaggatctactaaatttgtaacactaattcaaggaggtgcaaaaagttatatattctcacattaataaaaaaatcttaatcagtaatttaattgagagaatctattatatgcaattcagtttatcacatgtctacgatttaccactcacttttgccattttctacaatatgacatcgacttttgcttaatttctatgatttataatcgccgtctagttagccaccattagtactgtacatttttttccacctgaccaaaatacccatgggacaaaaaattctaagatttggacaaaaacaattccaaaatatcatattataaacataagattggaaacattcaaaatttggccaaaaacttaaaatatgatatttcataatttttatccaaattttggaagtttttgtccatggggtattttggtcaattggacaaaattgcacaatactatcgaaggctaaccgcacggcgatggtaaatcgtagaagttaagcaaaagtctatagcatatattatataatattaaaaaaatcaatagtaatggaatattaatggattctctcaatttaatttaattattgcatgtatagctgaatcatatgaaatataattgcctacatgtacgtgctgatgtcaaatgtatacatcatgaaataatttttgtatttatagcagacaaattggtatttcgtaatatttataggtgtgaaatggaacttccactacggaagtatctactgcgccattcacatatcagctatcgtcgtcaaatttcgaaagattcagaaataactgtagaggatgttcacgagacacatgttatattgctagtattcgctagctataagttttgtttatatgctatatataggccctgtttaattcagcttagaattattataatttagattattaggagtaagttaaaacaaacaagtagattattatgctagattattataatctataagccagattactataatccaataatcttctctagaggagcttttttcagattattgagtggctaaaaacccactacccttagatacctctaataatccagagaaacaaacaactcgtagtttattttatgtcaacttattataatccagtttaaagtaatttgatttaataatctagattacaataatcttaagccgaaacaaatagggccatagtatatcaataaccattagttcaataatgccaacttttaggctcttagcgagtagtgaagacgacaaaaagaacaaaatatacgatcgtccgagtctgcgtgcgtgtggtcttccggccggcacgagctagtttaggtcaccctgaaattaagtcaatcgcgtcgacgtcgttaattaaagatatatgacatagagagaagatgacgatgctgactctgtctaatacgttcctctcagtgttacctttcgttaattaaagctgtgtgaccactgaccacgttgaagagtgaatgggttatactaattgatatcgcctcatgtattttttaatccaatataaattgctatatttttttaaaaaaaggatgatatataatgcaatgacaactcccttcgttttattacaagttgctttgaattttttcgtagtcatgttttttttttttacattttacctaattagtaaaaaaactatataccattttagcataaaataaatatattaaaaattagttttattgaaattaattcggttttcaaaatgttgctaaacttaattatctataaatttggttaaactatttttaagaagaaattgaaatgacttataatatgataaaacagaaagagtaccatttaagttcaatatcttgcgttcctaaattttcgtggtgtggatatatgtgttatgaatgttataaatctttttaagatttatttacatggatttatatagaagaaggatattaactcgagggataaaaatagctagattcccatcgcagaaaactgcatcttctgaccaggttcatccgttgcattattttggcatacatgcatgcaagtatctggcctacggcgactcgtctagccagcagagcgcttatctggttggatcatctatcgtttcgtccagcggcgccgctgtctacgagaggtgattggtgtatatagtcagcagttgggcgctgttaaatttgttcaaattgattgaccgggtgaagatgcatgtgctttcatcctgtgtgaaaaaggaaagcaagcatggatcagtaagtcaatcagcaccaactctatcctaaaatataaatttctaacacattattttgtttaaaatatagctatttctaagattatctactcctcaacgaattacaagtattattattgttattatgaatattgaaattttaatcatatatatgttaaatttgttggttattaattttgttgcagtcgatatgtagaatttgttttgaagtgctaatgacaacacaatatattataattagatgaatattataattagatgaatatagaatccatcctaatatttattctattacacaacttaatatggaatccatcctaatacattctttagacattattttatagggcaattgcttatttgaccctgtttggatgtctaactaccaatttgaccctactttttctactttgcgtttttggccttattttttatagacgacgctactctctgaccctgttccgttaaggtgagctaatggtgttaactttggagcaaatagtccattttgcccttgcttatttgattctgtaatatcttgcttatttgaccctattatgtcatattgtgtatatattaagatttgttgacatttttttaataaatttgacagtatttgctttaatttgataaatttgattcaatttgactacaatctgatagtttttttttcacaaatttgacaaattttgactttaatatttccacgcgggttccacatagcaatgtctagtactaattctcttatcctctctcttctctctctcctctcttcccgatccagggcaccgggagcccgggacgagcggcggccggcagggaggatggcacgacgggcggcgactggcggggaggatggcacgacgggcggcgaccggcggggagggctgcacgatcgcccctgaagtcgtgcgccgccgctccgcggcgcgacagcgccgcgaccgccgctccaccgtgggacgccgccccaaagccgcgcgccgtagccgccgccgcccctccgccgcacgacggcagcccgaagacgcgacgccaccgctccgccgcatgacggcgccaccttcctgggatgccatcgtcgccccgaagccgcgcggcgccaccgctctgccgcccgacggcgctgccttcttgggatgccgccgctgccccgaagccgcgcggctgccgctctaccgctcccgcaaagccgccgtcactccgttgtgcgatgccgccgccgccgccttccctctgcgcgccgttcgcaaaagatgaagaagagagagagatgggttggatagggttgaagaggctaagggtattttggcccgtttaaaaaataaatagattttttctttttcctaaatgaaaccgtaacggtgtgatggaaagagggtcagacggagtgttcgattttgaaaaacagggtcaaataagcaaactaggaaaaacatggtcaaattagtagttagactttgaaacggggtcaaataagcaattgccccttattttattgaattgtactaaactgtagacaattcttgcgcactgccttgaggctaacttttcaaaaagcatgtaaacacacaaataaatcttctagttaccattatccgcagattctatagatgttctatatgacagacgatatttatagagtattgggatcgttagaaccagggtatatgcgaaatacggtaaaagaaacaggagacctactcctgttggacgaacccggtgttgcctttatatatcaatatcatacaagcataatatttgggataacctaatctagtctacgtcggcttagcggcaaggagctctcacacgtaatccacgactagtgtagtcttctcctcgaacataaaccttgcaagattggaggtagttctagatcccttatatatgtcatgttctatggttcctacgtacattgggtttgtcctgatctgtattggcttatcttttgttggtgcacccccttccttctatggggtattctatttatagcaaaaatcatcttcctctataagtagaacttggagatttagaacaggatatggaccaagaatactttatcttctccgactaagactcttaacaccttctatttcgggaagataattttcttctttacctgccgcatttccttaatcaaataatacattatggtattatactaggtatatggtatctcagtattggaggcatgtcttattcttgacaataataggttctaataagaaaatagttgatattagcactactagaaaaagcattttcgccaacgttaggtatttattttcgtaggaggatatgacccttagagtcaaatagccgcctacaaaaaagcaaattggggtgaagggcgttgttcgcctgcaaaaatctattttcacaggcgaaccacttaagcggcgcctgcgaaaatcattttcgcaggcggaccacataaggtgcgcttgcgaaaattagcgtggtatgtgtcacttcccctcactctcctcttatcctctcccctccccttcacctctcccctctcctcactctcctcttatcctgtcccctccccttcacctccccgccagtggaaggggcggccggcggccggcggcgtctcccctccctccctaccctccagatctagccggagaggggagtgggaggccggcggccggcgggaaagggcggacagcgtcgggcgaagcgcggatcggctgccgggtggcggggcggccggcggcggctcccctccctccctcccctccagatctggccggaggggggtggggggaggccggcaaacggcggcaaagggcaaaaggcgtcgggcgtggggcgcccggcggcggctcctctccctccctcctctccagatctggccggaggggggtggggggaagccggcggcctgcggcgtcgcacgcgggacgacgcgaggcagctggcggcggctcccctccctccctccctcccagatctggccgaaggggtgaggggggaggccggcggcggggtgcattcgtgcgacggcgatgacgacttgcgtgggaaaatttgtgatttgatttgatttgattgtgaaccactatgatgtatgttaatctgtgatgtttctatgtatttgatttggtttgatgttgaatctggatgggggaatgtgaggagaatgggaagctactgctaccggccggaatggcggtgggcggtggctgcacatttttttttaattccaggtgctattttcgtaggcggaccagttgtccgcttgcgagaatcaactattttcacaatcattcggttgcaggcggtgaactggtccgcctgcaaaaatctgtttaggccgcctatgaaaagctgttttctagtagtgtagctaagcaagataaaacaaaattagtcaagaattagtaaaaaaaaagttaataatttcagagctacgagattttcattccgaagcaacgttaggaacgcccccacagatcgattgagttatcacatatgtgttttaatcttattggttaaatgctttattaatcaaaaattacatttatattgaataagtcgaattagaaactagttaattagtcaatcttagtatttaaatgctaaatcacatatcaactatgcaaatcataaaatagttatacccgatcaattggttgcaatcgtaaataatgtaatcaccgtgtttaaattgtggcataaacaatgctcctactgctcaatagctcttggtctcgcccaatttgtttgttatcttcccatttggttttctcatatgtattgatcaattacatatgtatcttctaatctgctcaggtatgatttggttgaaaatgataaatccaggcagcttccatgtgactaatttttcgtaggctgttggtccggaatatattagtgaaatcatctaaaaaattattggaaattttacacatagatatcaactgatatatttttatatcattttatctattcatatgaaaatgagttttcaaaatttaattgcaaagttgaatatttaaaatttgcagcaaaataatttaaatttattaacaattctaacaattaaattattaattaaaaatatgtactcccgctaatatgtgaatttattatttaagattgttcgcagaagcatattaaaataaataaaaatgaagaaaagcaacaaacctgatttacttgcaacattgactaagtaaggtcaactccttttctcctgatttgcatatgcgcagctacactcttccatggtcggtcatcttgtcgctaaactcttctaagtctgttttacgcatggccatgtcctcaagtgcgtacaagagcgacatgtcgacacacatgcatggagcaccgagcacctcataattaaacacaaatagagatggcctgtttttttctttttgtgaaggatgggtttgttgaggatttccaatttcataaaaatgaaaaaagaggccatttttttcaacttaagagaagatcatcaacgttgataagatcattattaatccctccgtttcatattataagtagtttgactttttttttctaatcaaactttgttaagtttgaccgagtttacagaaaaaattagcaacatataaaatatcaaatgtaatgttgaatatgtttattttgtgttgaaaatattactatatttctgtaaacttagttaaacttgaaaatgtttaaccagaaaaaaaatcaaacgagacggaaggagtatgtttcctgccgttaatttttttcaccataacatcaccagccaaacatctgtattaaagcctcccaccccccccacccaaacctggcgcaagaaatatatgcatgggtgtctacatgaacatcaaaacaatcgaattagaatccgattaaccgatcttgacttgtgcggtttgccttcgctagcttttcgttcacgaattcaatcgtgcatgcacgagatggaattttagttattatttttaattatttgcatacaagtatttgcgtctacgtgaattgagcgtagctcaactccctctggtggaacaaactcacttgggtttaagttctagacataacattccaactataattttgataaaaatgttgtgcaagtaaatatatattagtcactaccaggatgcgaaagtttcccgtgtgcctataacacccaggaaactaggtgaaacacccgggaaaaatcttcccgtgtgtcaacacccgggaatgctcacacgggagcgttgaagctttcccgacttggattcccgggtatcaggaaggcagcgctcaggaaagctctagacatcctgggtggttagagcagcacgggagaaaaatctaacgctcgggatgttcaacggaacggaaacggcaacggaatacttctcgggtgttggttcttttgcaacacccgggatgtttcagtactacagctcaacattcttcccgtgtgctaaccacacccaggaagtttcagtcctacagttcaccatcacccgggtagcaaaaataataagcaatgtaatagaattggtacaagcactcaaatattcagcaatgtaatacaatcagtgcaagtacaaagcataaactgatctgtacaaatgttgataccagatatttgttttagttgcacacatacatattcaaacagccacaaccaatctatggaatacacacgaaagtaatgtttgctccttcatataggtagatttttttctaacatcataagtaccagttcttgaataatatctgggagtccattggataggtaggaccaaaataacatgaactacatccaaaaatcattgttccagatcttgatgtttggatggatttctgtagcaatgaatcatggctggcaattggacgcacttgatcttagatgatggctgaaaaattatagtgtgttagaaggtgctgataaatattgtatagaatatattgccagataaatattgctatagcatattatgaaagtttaagagtgcacattgttagattcatgcctagatggattagaatcacaagcccaaagacaattaacagtacaaatgtcaagcatgccatttgtctaaccaagtggttcctacttgtcctgtacaaagagcccagttagcacaaaccaggtagaagatacataaagaactagattgaactacagctagcaactagatacatgcatcaaatgtaattagtcttacttcttaggtacctatgcattttacctattcagattaaactatgtgttatatctcaggcaactgtttacatattgaatgcattcagattatatgctttttcgaagatggaactatccggtaaaaaggtcattaatgttggtataagattgctcacctaaatagacagtggggcatgttggggccgctggtcgtggaggcaaaacattaagtttcattgcagattgaagcgcctgaaatttatttacacataacaatgcaaatagttaaatttatacatgttgatgaattttaaaattaataagtacataaaggaggcaaaactacaagttaccagctgtatcgcagatgttaagtaacatgtttcatgttgccaagccttaccatcaatgggttatttcatcaaatcaggacttgcaccatgcttttccttaacaactccaaaataagcttcctgcatgataagttgggtgtttattcaaatggaaagagattaaaaagttgttgatcaaattttgtgcaagctagagtgcaactactta

SEQ ID NO: 80812 - DNA, 5535 bp, Oryza sativa
gttctgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggataggccctgcgacggcctatgcggcttccggattcacctagtcacgagaggggactgcccgctgcctcgcgaggagtgggggtgaaacctgaggtgtggtgtgcttggttagagggggttatgcgaatggtcctgtcacggcctctttccggtatgtcgtggtggcatgtcggcgcacggaaacgtgtcgtggggctgtgtcttgtgggtacagttgtacacctctgatcagagtaaaactattcgaatagccatgcccgcggttatgggcggtcaaccagattcaccgtgattagtctcaccctagtgtaatcttttgaaattggatagtttaggtggatggttgggcctgttgcaacgtgggatcgcgttggacagtggatagttaatactaattaattattacaactgtttaaatttttcaacttctgtctataaatgatcgctttatgcaaatgaaccactctagctcttctttgataattccgtgcatcatacccctattccggtatgacttgctgagtacagtgggtagtactcagtcttgctctacttttcccaacccccagagttcgagtatgtgtcagatgaaggtttctccgaggagtaggcttcgtccgtgccgtcgaggatgtctgtggagtggtgttcccgctgcagttctagtcaaggcttagctcctgttgtctttctttctttccgctgcatttatgtaagacttttatgatgtttgtaagacgtggatctgaatgtcaacattgtcgtttgtgtaccccggctggtcctggacggggattttaatgcacattctgcttgaaattctattcgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagcgagatttgtcaaaacaagtcagtctagggttttagtaaaactgttgagatttattcatcagtcagtgggatttgatgggtgaaatgcattaggtcctagctcaggaacatgggttgcaaggtatttatgctcttactgttattattagtatgtatctaatttccccattattttatcgttatgtgagtctgtcttatttattcgctctcatgcaaaatgatctatgcataaaatttcgctcttattcgattcgcttatttgagtcttttattgctttatttaaatttggatttgagcatgcattgatcctactcctttgtcttctctagatggccggccacccacccaaccaccgcggagaaggcatgattgattttgtggcagagttggcacgcatgacgctggtggtgggctaccccaacgcgccagagtacacgactgttccaccgctcagtggcgagcttcctcaccgtgttcgcttggaggtccacggctacgtgggtacctgcctagataatatggtggttgaggcatccggaggcactgcagatcacgcttgtcaggaggcagcatacctgatgatggccagactacgggagcgccacaactacatcttccacgacacggcgtaccgatttcacccttgccgagccagcggtggtgatgtcagtactttccgtccgacagccggcgagaacgacaccacctttggtcacatgtgtgctgtgatgaggggattggataggatgcactcggacctgcacaaggcgaccaaggccttgaatgatgggaagctcatgaggatcgtcgctctgaaggacgagatagcgcgcctgaagagggagaatgctcagttaaagggtcttcccgcgccaagaggagtccggatccgcactacaccccgcaagacgacgacggcacccgtgcgcatccagcttgcgcccaggaacccacctccatcagcagctcccgcagcacctccagttccgcccgcagttcctgcagctccagctccagctccagctcccgttcacatgtcagctcccgcgtccgctctctcctttgctccagcatcagctgccaggagtccagccagtggcaacggaggttggttgtctgctactcccattggcagccgcgatctcagcagcagcagctccagtggctcagagtcgggcagcggcgagacttatctgccaggctccgggagtcgctcagagggacctggtgacgagcaggaggacgccttcgactccaccgaccgcaggagccgttccgagcattaggctcgttttccattagtttatcgactgtctagcttttgtttgttagtttgtgtgtctaggttgcttgcttgtgggtcagtcgacggtcgatatcatgtgcctatgatatggctgtcttaataaggatttttgcttgctttttaagtgttttaattcagatcagaacaattgcagtttaaattcctatgtaataaagcttagttcctgagcatctgtttttcttctttttccccgcctgcttttccctccagatggtctacactaggaatggtagccgcgcaacaggcgagggcagcaacggcgaagagcgcactgatggggtgcatcccaacagtgattccggcaatggtccgccaccacttcccgagaatccgacactagcccaagtgatggcacatcagactcagatgatggcagccatgatgcagcagatgcagcaccagcaccagcagatgcaccagaggatgctgcagcacgctgaacagcagcatcagcagtttggtccccctccccctcagtctaagttgccagagtttctacgtgtcaggccacccaccttctccagcaccaccaaccctatggaggcgaatgactggctccatgccatagagaagaagctgaatctcctgcagtgcaatgatcaggagaaggttgctttcgccacacaccagcttcaaggtcctgcgtcagcttggtgggacaatcacatggccacccgcccaccaggtactgaagtcacttgggcagagttctgccgtagcttcaggaaggcgcaggtgccagacggggtcgtggcacaaaagaagagggaattccgggcactccatcagggcaacaggactgcgacagtgtatctccatgagttcaatcgcctcgcgcgatatgcaccagaggatgtccgcaccgacgccgagaagcaggaaaagttcatggcaggtctggatgacgagctgaccaaccaactgatatctggggactacgctgactttgagaggctggttgacaaggcaatccgtcaggaggatcaacgcaacaagatggacaggaagaggaaggctgctcagttcagggcagatcagggaagtcaccagaggccgcgcttcactcccgggcagcagggtggacctaccaccatgatcgttcgtcagcaccgcccgttcaaccctagcaactttccccagggcgccagtggcagtcagaaccaccatggaggtcagtccaaccgcggtgcagctccacgcccaccaatggcaccggcacagtcaggcccgcccgcgcaagccaagaaggagactggagcaaaaccagggtcctgcttcaactgtggcgagcttggccacttcgctgacaaatgcccgaagcctaggcgtgccgggccaaggtttatccaggctcgtgtcaaccacgcatctgcggaggaggcacaagcagcaccagaggttgtactgggtacgtttcctgttaactcaatccctgcaacaatactttttgattctggtgcaacgcattcgttcatttcaaagaagtttgtcgggatgcatgggttaaggaaagaagagcttagcacactaatgagggtttataccctgggaaatagttcaacctcagtcagttttagcccttcagtgctaatagaaattcaaagatcaccatttctagctaacctcattcttctcgaatccaaagacctagatgtcattcttgggatggattggttaaccaagtttaagggagtcattgattgtgtgaatcgcacagtcaccttgaccaacgagaagggagaaacggtagtgtacaaatcaccagactcaccaaagcgaggggtctctttgaatcagattgagacggaaatcccagtggacaccgtggagaagaacttgagaaaattggaagatatacccatagtctgcgagtatccagaagtgttccccgaagacctcaccaccatgccacccaagagagagattgaattccggattgacttggcaccgggaaccgctccaatttacaagagaccgtacagaatggcggccaacgaattagccgaggtcaagaagcaggttgatgagcagctgcagaaagggtacattcgaccaagtacttcaccttggggtgctccggtcatttttgtggagaaaaaggataagacgaagaggatgtgcgttgattatcgcgcactcaacgaggtcacaattaagaacaaatatcctttgccgcgaatcgatgatttgtttgatcaactgaaaggagctaaagtgttttctaaggtagacctgcgatcaggctaccatcagttgagaattcaggaagaggatattccaaagacagccttcaccactcggtacaggctatatgagtgcacggttatgtccttcggacttaccaacgcacccgcgttcttcatgaatctgatgaacaaagtgttcatggaatttctggacaagtttgttgtggtattcatcgacgacatacttatctattcaaagtccgaagaagaacatgagcaacatctccgtctggtactcgagaagttgaaggagcaccagctatatgccaagttcagcaagtgtgacttctggttgacggaagtcaaatttctgggccatgtcattacagctcagggtgtggcagttgatccattgaacgtggagtcagttaccaaatggaccccaccgaagaccgtgtcgcagattcgaagttttcttggacttgcgggatattaccgccgattcatcgaaaacttctccaggatcgcccgacccatgactcagttgcttaagaaagatgagaagtttaaatggacagctgagtgcgataagagttttgaggagctcaaaaagaaattagtatccgcaccagttttgattctgcccgaccagatgaaagacttccaagtctattgcgatgcatcccgccacggacttggatgtgtcctaatgcagagggcagggtggttgcgtatgcctcgcggcagttacgtccacacgaagggaattatcc

SEQ ID NO: 80813 - DNA, 13932 bp, Oryza sativa
ccgagatcctattttgctaatgatgctatactgctaatgtgatctacttatatttatatatatttctatacaaatagttcccttctgacgtcgattgttcaaggaaatgctcttctactgatgtatatttcctccctgtaattctgctactttttatactatagttctattcatagcatggattaatgcctaatgcagagcactgacgataactcatttttcactcgcagcaggtaatggagctactgatagccttgcagtaatgccttctgctcttgcacttacggagaatttggatttttgggactcttactttctgtttgtatgaaatgaatgtaattagttttcagtggcttatcctagctgattgtggtgatgaatatgatgtttaaatgagtaaatcatgtattgtgaatgggtgactgattgtggtgactgaatggatatgatgcaagcaatttttagaacattctatgcggtattcagaattttcataatctttttaggcaatcttcagaatttcttattttctccagaaattttagttttttatttacaatatttcaaattttcggtaatgctatttttaaatttcaagactatctgtttagttttcttggtattttcagtgatatgaaatttaaatatcagtgttgaatgttgtttggcctgagttaatgtctgaagtgaacgttaaccttccccaccatttgcattccgaatgaccaagggaaccagatccctggggtggaggggattgggtgatgggaggggattcatccaatacccccctggtggcgtttctcccagggaaaatgcttaccacgtgccgaacaaacccaatggtgttttagcctcgaagctagaagttgtcaaatagtgtgtgcgaagctcacgacctagtcgctatgtgctatttgcaaaaattttgctacaggacactccgacttcgtggttttagctatgggacaccgcccgaactcacttttggggaaaacgcttcataaacgtggtaatttgccaatggacactgcgctgattaaaataataatttacgattggagaggagagaagaatcacgtgaaatgtcaaaaatgcccttgggcccacatgtcagctctcatatctctcttctcttctctctctctatcttctctcccagaggggcacgaggcggcgtcggtcaccggggctcgagctcattgtggcggaggagatggtgaggacggcgggagcggccgccgtggagttcgcggcggaggacgccgaggaggagagccgcatcgtcgccgccaactgcggccactaccacggcggaggacggcgacgatggcgggaatggccgccgcggcgctcgcggtgggagcggcagaggacggcgaggacgcggcgaagcggcacgggataatgattatttataggatattgtaataatgtattaattttatagcattaatatatttatttgcagggattaaactatttacttataatgtgccgacaaaattcttaaagtattcatgctgttccaaatgtttctagttttcacttaaaaaagtatagactaatttatcctaatatgttgctaggtccaccctgtcatatgcacacggatttttctttcgttccttgtatctcgctctttgacctgagtaggcaaacaaccagaacaaaattcccctgatctgccgcaccaccacagcccttacgccgccgtccaccaggcgctgtccgccagcaccgctgcaccggttccgaggccgcaccgtgcagagctgctccatcgagccgctcccaagaacggcgttccccatatcctgctgatgctctgcccaagggcggctggcatcttccctgttctctctactgcatcttcatcagctattttggttgtgcccaaagacctctcatctgcaagtgcaaactacgccaggttaggagcactctgttttttatgcacaccaggtgttcgatccttgacctgtatagacacacctctatctattacttgtttgtttcagtgcaaacgaaatatttcatcgtttttgttttatcttccatcctattatatctggcatttatttgttcagatcgtaggtaaaggctgtatatctagagtatcagagctccagttagctaatcacagggacatatttgtagtgcacaaatgttctaaaatttatatttgtaggtcctgttatctcctctgctcctaatcaagattgacatgcaaactgttcttgtggaactgtattttcagttttcaattgtcatgtaatgtccttatcatgtggctgttcatgttgcctcagattactttcatttatccagagtgcttttttcaggcccaacctcttcaccgatgcctgatctacccatctgctgctccgcaatatgtccaatatagccgccgtatgtactggatcacaacgtcaggagtccaggtgcggttaacctcacatcatatatatattctgtagacagactaattttgagttgaacttaaaattatatcaaaaaaatttagtgggtggttgtcaaattaggaacactgatgtactaaccatatttcttatcccatcacagaaaaccgatggatttaaatgctattaagaagttactgctttcccctagaccaagtgatgagtaccttgctggaatagagggttttcttgagtttgcatatagggaaaagaatcctaatgataagatccggtgtccgtgcaagaaatgtgttaataagtggttactaaggcgtgatgaagtgtatgatcatttagggagtgttcgttaggtggagataggagagattgtgtctcgttttccgcgcgcacgcttttcaaactactaaacggtgcgttttttgcaaaaaatttcaataggaaagttgctttaaaaaatcatattaatccatttttgaaatttaaaatagttaatactcaattaatcatgagctaatggctcacctcgttttgcgtatcttcccaatctcctcaatccccttctcttcaaacactcccttagtgtacaatggaatgttacttggttataatccttggggttgtcatggtgaaactgcatcattcatctctgctaacagtgaaataaaatcacaaaatagaattgataataatatgcaacagctagttcaagatgcttttggaaacacaggcagcagccctccagtgaatgattatgatgcaccaacttcttctaacagtgggccagactctgaaacaaaagcgttctatgatttactccgagatgctcatgaacctttatgggaagggtgtgaacttacaaggctttcgtttcttgtagtcttgttttacataaaatccattaacaagtggagtaataaatctttaaatgatttgctagcgatcctgcaacaagcaattccaaatggtaagagtttacctagaacatttgttgaggccaggaagataatgggaaagcttggacttaattatgtcaagattcatgtttgtccaaaaaaactgtcaactttacaggaaagacaaggcaaatgatgacttttgttcaaaatgtggaacttcaaggtggaaaaacaaagaagataaaactactttaacaaagaaggaaagaagaagggcaaccccaagaaaagttttacgatacttcccaattaagccaaggcttaagaggttatttatgcataaggaatcagctacagcagtgaggtggcatgatgagggtcgcacaaaggatgatgcattgcgtcatccagctgattcaaaggcttggaaagacattgattctagatatcctacctttgcatcagattctcgaaatatcaggtttgcaatggctagtgatgggtttaattcagttggaacgatgagttcgacctacagttgttggccggtcgtcttagttccctataaccttcctccatggttttgcatgacagcatccttacttatgcttgctctcataattccagggccatcttaccctggaaaggattttcatgtatttatggagccggtttatgaagagttgattgatttgtttaaggttggaacccccacatatgatgcatcccaagatgagatgtttcaactccgtgctatattattgttcgcaatcagtgactaccatggaattgggatctttgcaggttatagcgtaaatggtgaatttgcatgtattacatgtcatgatgaaacatgttctaaacgtttgatacatggtcgcaagtattctttcatgggacatcgtcgttttctacccctagaccatgagttccgttacaatcgaatttcttttgatggaattgaagaacatagaccagagcctattgcattttctgaaactgcaattcttagtaaaataaaggcaattaatgattttgagaagtcaaaaacatggaactgtgttagtgggctattttctttgccttattgggagtccaatttactacgccacaatcttgatgtaatgcatatagagaagaatgtttgtgataatatatatgggacacttctaagactggaaggcaaatcaaaggataatttacaggcacgactagacctgcaagaaatgaatataaggctaggattgcatcctaaaaaaaaagctaacaataagtattacttgcctcctgctacctatacaatgtctaaaaatgagaagcaacaattttgcaaagttctccatgatattaaagttccggatggctactcaggaaacatatcaagatgtgtaaatgttggtcaggcaaaaatttcaggacttaaaagtcatgactaccatattctaatccaacaacttcttcctgttgctttgcgaggtgtgcttccagacaatgttacatccgtattatttgaactatgtggttattttagagaattaagtgcaaaagtcctatacatagatgtgcttcggaagttggatgaacaaattaaaatgacattatgccgtatggagatgatatttcctcctagattttttactgttatggtgcatttagttgctcatttagcaacagaggctgaaataggaggtcctgtgtgttaccgatcgatgtactttgtggaaaggtatgtttatattacaaatacaattgaatttgttatccaatatatatttcttaacttttttttctcatttccatgtttatgtagatatttgagtgtgttgaagtcatatgtgcgtaataaagcgcatcctgagggatgtatagctgaagcatatttggcagatgagtgtatgacattttgttctaagatatattgaaggttttgagacaaagcacaacctactgtaacgccccgattttcgttcgggattaaaaatcatttaataatgtattttctagaaattaaataaaagttaaagcaaattaatcaagtgaattattgagggaattaaaaatttcctttaaaaatcactggccgagaatattttgtaatattctttgtgccctaaaataatctctgaaatttcccgcgaattttcgaagctcgagaaatagttttaatagcacaaagatcattgaatcaattaaaataaaaagaaaacaaataaaaccccccttcctttctttgggccattttcggcccaagtcttcattctctcccgcggcccgcgcgccccctttctctccctctcgggccggcgtcctccctcggcccgctcggctctctctctcactcaagtccgttccgcctccccagccggcctctccctccctctctctccgacaggtgggacccgtggaccccacctgtcatccccttcctccagctccaactgctgccatggccgcccgagccgccccacgacgccgccgtttccacccacctcctccaccccgcgcgcgcgcgctcgtccgtgggacctcgccgcccacgtcctcctcgttcccccacctctccccgcgaaaaccgccgccaccccgagcccactcaaccacgtcgccggcgcccctttctcccttcaaatccgccgccaaccggcctccccgtcgactcttgaggctataaaaagcatcctcggcctcccctcttccatttccccatttttcccgagctccccgcgcctccctaacgccctccccacgccgctcccgtgcaccaccgctttccggcgagctccgtccggccgattccgccgctccacccaccgccgcgccaatccgccaccactgtcggcttcgcggcgccgtgccgcagcccggcctctactccatttcccctctccgcctctggaacaccgccgcctcgtgcaccacctctctcccccgccgcgccgccttcagccggccgctgctgccgcgttagtcgtcgccgcacctcgccgtttgcgtcgtcggcaacgccgtgccaagctctaccccggcctctgctccgtttccccatttcatcgccgcaaccacctttccaccgtcgacccgagctctaccaccgccgttcactgcctccagccgtcccgtcccgctgctccggtcgttgccaacccgcgccgtcgcctccttcggctccgcagggacgaggggaacctcggccacctcttcccatcgccggagactcacgggacgtccgctattccgtgcgccggtgagcccttcctcccttcttttcctctccggccggccatgtcgttgccccgtcctccctaacagttccccttccatcctgtggcgcagctgccgctcgtccgcctgttcccgagctcagctcgtcaccggagcgtcgtcgtctccgtccgccccgagctccgccgtcgccgcctcccgttgccatctcgccgccggccgcatccttcggccgtgtgccgctcggtgagctcccctcccctttcccgctaccctccgccgctcacccgcgcgtgctgccgcgccggtggtcgtcgccagtgaccatcgggccgcgcgtcaccgctcctggccggtcggtcggcgagctggctcctgcccgcccgtggccgcccgattcaccccgggtgaatctgggccgtccacgtggccgctcggcgccgccccgcgtcggtgccctcgtgtcgccacgccggcgccaccgctgccgctcgtccgccgtggccgtccacgtggtgcgcccgcgcacgtgccgcgatggactgagtccaccgtgcgccctccccttgtgccgttgacgtgtgggacccgcctatcggcgtcggcccctctcttgctgacgtcagcgacagtccttttcctttaagaaattaattattaattgcgcaataaatcgttaaaaattctagaaattcatttaaatggctcaaaacttctaaaattcatatctaattgattcgaactccgaattgagccattcaacttgcaaaattcatataaaattgagctctacatgtttgtttagtttttatgtactatttccttggtttttattagagtttttcctcattttgcgtgcctgcgtgtagaatccgtcgtttcggaagtccgcggtcgcgaggaaaagtgttcggaagattgtttgaagaagcaaggcaagtcacacattccccttgagcattttgatcctaatttacaaatgttttaccgtttgcaaataaaattgcatgtcttgctaattacatgggattagggtttacctatctgctcgcttgtgccatgtttacttgatatctgtccttcgtcaacattgggtaataaatcgactagctcatgttacttatgtgacctagctagaactatatgcttagccatgcttaattaccactagctcagttgatgggataattacagtattagaccttttttagtatcagaatgagctgcgtgctcgagacatctggccatgcttcatggtcgtaattatccaactaaaatgcgattacatggtgggctgtgggtgcatggttttgctagtcgcacccatggcaattaaggaccggttcgcgggaaaccctggaagaatttatcgtgcttaccacaagccagcgtgggcaacggctgggcttgtagtgtagctttcctctagccgacgcatccaggcaagggtgggcgtgatggagtttggatgggccctgcgacggcctatgcgacttctggattcacctaggcacgagaggggactgcccgctgccttgcgaggagtgggggtgaaacctgaggtgtggtgtgcttggttagagggggttatgcgaagggtcctgtcacggcctctttccagtatgtcgtggtggcatgtcagcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgactcaatgcactgtagttcaggtgggttggttgggcctgttcaacgtggtgtagcgttgataagtggagatttaatgttactttaattactcatcagttttactgttttgctcaatgaaatattttacaatcgcctttatgcaaatagccacaagccttccttgtgtcaccttgcacgtctgcatcgttggtgtggcttgctgagtacggtggttgtactcagccttgctattattccccattttcagaagtgtagtgcttctgagctgaagacgaagttagaagaccaaggctcagaccccagttgagttttgcctgtggagtggagctgaagccccgctaggatcgcctttttccgctactgtcgttctcttttggtgtgaggcctaagtgcctcttctgtaagtattttacgctttatttacatttggatctgtttattacttgtcgttttgtgtaccctggctggtcctggacagggatttaatacacaaaatagtctggaaatttgggctaaatttctgggcgtgacacctaccttcacgaaatgatgataacgacgagtccattgcttctcttgatgatgaaaatcaaacaaatctttttcctcgtgctggaaaacctcttggcaagcctagaagttatgtgttataaggggtttggctaaaatccaggcacatagatatgtgcctttcgattgcccagatgtcaatccataccttctgtattatctcaaattcatatacactgttagcataactctttttgcaatgagcattcattacattattttctttttgtagaatgcatgctgaggagattacaaaaacatatcggcgcggccgtatcaccccaaatattatcgagcgtacacaaaatgagaaggaggctccctccagggccaaagggccaaaaggctccctccggtggaacagcagtcaggaagggagttacaatctgttttgttcaggaggcaagggtagctcttccacggcggtcgggcaggtagtctcggcggttctgatggcttctgtggaggcctttgtggggagcagcgaagcagccgttgggcttctcgttccggctggtgagtggccaagatttgtctcttggatctcagctagtccacacagtgagctgatgttgttgctctgatttatgtttacatgtggttcggtggtggaatatgtacatgtgtttcttttgcctgttggttcccatctaggcgtgctttttttttttgaaacgtgttgtttatgtgattaattaacatgagaaggatctgttagaaactagaggaaaaaactatggcagaagaacgaagtataggagctcgagaaaacatgcatagtagtagtcccgaaccacattttcgttgatctcatagttagtctgttcatgggttcaattttttatccttcgatctacgattgcgtattgcttagttttgaggatatcattattcttgtaggtgttttaagtcctatgcgtatgatagattttggcgctcaaattttgtagtaagactgaatttgaacattttcatgttggggcatagggtcagggctagaaggtttgcattataatgatgcatatttgtttgctccgtgttagctgtcattagaaaagtggagaacattggggagtcatttcatatataactgaaaattgagaacttaggtgctaaaaaaggtggcaggtgtattgtctttttgcttgttggtacctagttttgacgcttgccgacaagcttactgattctgtgcctttttaattttagcttttatgcagcttgtgatagtttgtagtaggtgattatttcaggaaggctctgtgatttatgttataatatgttttgacacttgacaagcttattgattctgtgctttttttaattttagcttttatgcagtttgtgatagcttgtagtaggtgcttttttcaagaaggctctatgatttacgttacaatacacatagttcaaagtagataggacttttgcttttgtcaccgatggactatgttttgagtgcaagctcctgagagaagtaatcttttagttctagtgcatgcttctacttgaagtttataacacatctatgaattttttgtttatacttaattagtttgttagccattaatttggtcatccaccaaagttaattttacaacctactaaactagttattttttaattgaattataccagaaagtagttttggaacatattaaatttgtttctactaatagtacttaggtcagtaagcacattttagtcaaacagtgattagttttgttagaaactttcagtcaagagagattagttttgtctactaatttcattcattaaagatgagctttattaattaccactgagcatgtgctaaccgtggggctgatgcattttttggaaagaaaacatcccacgtctagttaagcacacacacgtttaactagcacgcacatcccaacgaggctcactggagccacgtaatggtttcggaacacagctccctccagggccaaagggccaccgcgacggtcttcagtgcgatatccaatgtgtagacgcgcgtactagtacgcagatcttttgcctcattgctgctccacgttccaccctcctgcacggatatcatgagggcacaggacacgaccctccacttgatgaccagctcgtggagctcgccgacgtcggcgccggactcccaaccttccaggatgacgtcatggaacgggcgattgccagggctcgaccgacgtagccgacgtcggcggagtccctgggcacgaagctggcgacgagttcgacggcttcaaggatggtctgcttgctgacgcgaacccccgccagattcctcgacccgccgaccagaccagggtagtcgtcggcgagccggaagaccgtcgccaccgggatgagctcccgcggcctattgctgaagatgtaccacaggccgctaccgtcggtgaagccggtgatgtagaggttgtcccggcgaatcgcgagcatgattttgttgtcgccggcgccgacaagctcgaggatgaaccacttgaagggcttcctgttgacggcctgctggtgcaagacccaaacgacggtgttgtccgggccccacattttgttgctgctgtcttgtatcagaagggtgtaaatgtacgacatgagttctccgtagtcgtctgtggccacattgaagctgatcaggtcgtaaggtccctgcatgcagtacgtagatcgagcaattaatatctataattaattaattaattaaccagcagaaaagaaaattcatcacgcaacatatcgatccatccagtggattctctaattatttattttacacaggatgcatgaatcggacgatcgagctagtagtacgtacggaatttttttgagaattaatattatttttatggaaaatcgcaaaagtggtggccaaccggggaaaatcgcgaaagtaggtccctgtcgaacggatgcaattcgatagggcacctatcgaacgacgggcagccgacaaagccctgtcgaacggctggcgttcgacacgctcacctgtcgaacggagggagttcgacagggcccaccacccggcgccgcgaggcctgtcgaaccgggggcgttcgacggggccctccaccgaccctgtcgaacaatgggcgttcgacaggccggtttaaagccccgtccaccaaggccgcgagttcgatttgtttgaggaccacatcgccagccgccgccgagagtcgccacatcgtcgccgtgagcgccggagggagcgaggggaggggatagcaggccggagaggaggccgaggaggcgccggtcgggagaaaagggttggcgacgccctccagcagtaaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcaggatgtcaggtgatatgcccattcgtctgtattatggcgatgcttctatacaaatatgtgatagcggggtggatttaactgtatatgccttccatgatactagtctgaatgcaccggagcatatgggtttgaacgacgtgttagggtggttgtataatatgtttggggtagatctagtgcacgataaatttgtcataaatgccgtgtggccagtgaggggtcaacatggatggcagtggagagtagtggaggttgcgtcaactgggagttggaggaagtttgttagtaaagtaagggagaaaggctatagcttggcaatagtggtgcagaagacaacatgtgttgatcgatcgggggagtcaagtcatgccgtggtggaagaaactccgttggaaggtggacaagctgaaaatgtttggcagactgagcaaggtcgaggggaagaagtagtagagggtaatacataaggagaggtccttgttcgtggtactaatcgtgaggccaacgactcggacgatgaagaaccggattcgcctatgcgtgttgatgcagcggaggagaatgaggcggtagtggatcagatggaagtggaaaacgaggaataccttgcgcttgtagtggaaggagaagatacaacactgtgggacaacgaaactaacatacccgatgattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacttgaagtgcatacagggtggatgtccttggagagtgcatggttacaagccacaacatgacactttatgggtagcttcgagggttgagcaacatatgtgtttgttggagaatacccgtctggtgcacaaaaacctgacagcggcatttgtggcacaaatggtatattcaaaggtggttagaaaaacatctttgtcccctttcaccataatgcatgacgttgagaaagagtacggatatgagatatcgtacgacaaggcttggagggtgtagcgcccgttccgtcgtggcgcctagcgggaaaattatctcttaaaaacactaattgcgaaatttgcttcttcgcttgtcatctagtgtccgtgccatctcaagatctcaatccccgatccatcgttgagttcaaatccgaatccgaatccaaatccttccaaatcaaattcctccgcaaaagtctattttgcctcccccggggtcgatgggcc

SEQ ID NO: 80814 - DNA, 12100 bp, Oryza sativa
aatcccttatattgtgggacggagggagtagtacttatgtactatgtgagtttttggagaattttgagcatcttgaaataacctcgatagtacccaaatcgtttggtttgaaaagaagtgatcgaactgagtgaaacatgaccaggtctgtaccgttaaatttcaatttcctgtaactctctgtctctaaaatcctgtatatacctgatgtttgaatctcctgaaaatgtagatgaagattcagtgtttcacgtaaaacgaggtggtgataacgtgtgattaattaagttttaattattacaaacttaaaaaatagattaatctaatatattagagcaactttcatatgaaaagttttcgcacgaaacgcaccgtttaacagtttaaaaaacgtgccacgagtatacaaaatttcatccaagccttgttggagaaaagaacagggcacgttgagactgaagcaagtaaatcaaattgcatgctgaccttcgaaagatcttcctaaaggtttcccttttttgtgtgtgtgtgtgtgtgtgttaccgaatcccctacttctttttaattggagtgtcactaacaacctaatgttactcctttacagataatgtcgagcatgttaatcagatcaaccttgagattgctagctgggtagaaagtgactatcaaatacagtttttcccgtcgaactattcatcttggttttgcattccttgttccagttgactatctgcagcttactatcagcaagtgatatcattatttggtaccattacttgttggtgagatatatatgttcgacatatatggtgttgagttcacacacaaacctttggtaaattggtaagcttattttttgaaaatatattatcgtttagtgatggtggtgtgcataactaataagtacaaggctaaggtgtatatatgtagtcctctcggtatatatgtatagttgatgatggtttattcaatatacaatttcctcttttttccatgtatagctggaaataagaaacataatattggttctcagtttatttgctccatgtcacgcacaatatgcttgaaagtgtattcataaacgatctgttattcaaatgtcagttctgaattgtcataagaaattcctgtaaattaactgtttagttttttttaaaaggaagacaaaagctttgacttttttatattgataaaggagtttaactgtttagttaccttgtagctttccagttgctgtccatgtccagtatattttcctaatatcttctttttagcgaacgtgaaatattttttttcactaaattgattctctctgttgtaatttaaagccgatcccattgatttgaggctcttaaatatataaatctgcctgtggctattgcgaacttatttgttctttttcctgtgccaggttcaatgaaaatgttgtgaagaaagctgtccacctgcaggttggattcctaggggggttgactgttgaggaataaagcaatccaatggatatttcaaagtaaaatggtctaatgatagttacaggttcaggaaccttatcatcagcaattgagatgggcctcagatgaggaagtatgtccccttcgttccagtcaccaaacattagctaaaaaacgtgtcccctgcactaatctagctgttattttgatcatatgtcataaactgttcaaaaaataagtccactgactgttgtccccagtctatgctgttccatgaaatctgtaatttaatcaaacgttgaagaaccggaacaataactcttatcttaattgcgtccccctggtagtactgttactgtactactaccgaagtacggattgtagttggtagcaagagcaggtcaaagatttcatcgaggaaaaatatttgacacgcctttctctaacacaagcagctactcctattcgtttggtcaaagttgaggtccaatgtgttcatcatctcggcatctcgctcgtgagaacgcaacgacaatgcgctatattctgcgctgacaggtggggcccagaaaggatgaagcgcgtccgtagactccgtacggggaagttgctacgtaccgacgccagctggactttgtactccaacaaacggcagcgatgacgccgaccgacctaccttcccgcatgtggacccgacacgtcagcctctacattcggcctttggacagcgtcctaaagatctcgttattttttatatttattttctaaaagatttaaaatataaatttccatttcaaatattttacatgaaaatactcctcccggtagaagtatatttttaaaactttgaaatgataatttatttttaaattctttttaaaaaataaatataaaagtttaaacaatccaagatctcgctacttccggcccgggccgacctgccgcttcccttgatatgacgcacacgattttactgctggccccacatgtcacaagcacagccacgaattcggaacgaaccataaaccgcacccgcggacgtgacacagccacgctgactatcgtgccccacaagaaatcctgcacgctgttaactgaaacgcttttgactgacgggtgggaccaaatttacgggcccacaggtcattcaacaaggaaggtatatatagcaatatcgcataaagtattttgcaggccacgcgcctttcgtgatctctggtataaaagtctactcctaccaattaacctcctactactagtacaccagacgacaacacacacacaaaaaaaaaaaagaagagaaaaaccgaacgaaaatcccctcgcgcagacgactactacatccttctcgtctcatcccgtcgacccgccgccgcctcaatctcgaagcctcggcgaggctagggtttctgcgtctccatgggctctaagaagcggtcgcctcagcatccggccgccgcggcgccccctcccgccgtcggcggcggcggcggcggcgaggtctccggcgatggtggcgcctcgacggcgaacgggccggtggtgccgaagccgtcggaggtggcgccgttcctgacgaaggtgtacgacatggtctcggaccccgcgaccgacaacgttatctcgtgggccgagggcggcggcagcttcgtgatctgggactcgcacgccttcgagcgcgacctccacaggcacttcaagcacagcaatttcaccagcttcatacgccagctcaacacctatgtgagattcccttgatccctgtgttcgtttgtttctgatgcgcgaattcggtgccatttccagttggttggacgaaatcggtagtgaaatctgagtttctgttcccaatttgttgtttattatcacggctagacagcaaatcttgcttgcaattataaattgggcagtagcttccgatgcactgcatatgaatttgtttgaatcgtgactgcgtgttatatgatgttactttcttctattttgtgccttttaagttgattgcgtgtattagggattatctgccattttggagttaatcacttattaaattttaactacgttggaagctgttggcgatatagttggatgcctttcttcttctagtcgaaagacacaatagaactagtttctgcggtggctttctattcaacaacaacttctagagttctagtacataaaacacgtcattgggggtggggactaatattgttaattttgagaccagtttctgttctcttaatgttttgtgaatttgatcgtatgaaagctggctgtagaaactatgccaaactcttggctttaaattacaggggaatgatatgtgttgcctatcactacttctaaaagtctatttcccccatatttgtatttagtgaacttcagaactagagaaagcatgatgttataacctaccatcatgctgtataagaagaatatgttccctcttgtttggctgaaagaaatgcatgtttggttgtgctgatattgtactgctattatcttcttctgtgtcatttgcctcaatacattgttttatttgaatttgaacttccttttcacaatcgaatttgtctgatgaaatataagattatgaatttgctcttttattgaactatatggacacttaattttgtgcttttggcaaatccatgtcctcattttgatttctggataaatcactggactcttgcacccaggatttcttctgatgtctaattacttaaatgcgaaaatcacctgacttttgctcactgggttgctttcctgtagttaggagtagttctatttaaccatctattagttgttcttggcttcatatactcagtaaaacttaaaaacaaagcctgaaaagtgaaatctccaatgggatcagtagaaacattactttatctgctttcattgatgttctctattcttttggagcatatgttttatattagctgaagttactcaagtttcctttcataatcagggatttcgtaaagttcaccctgatagatgggagtgggccaatgaaggttttattatgggccaaaaacatcttctgaagaccattaagaggaggaagaagtcttctcaggaatcacctagcgagatacagaaggcgcctgtcaaaactgcacctggtactgaaaatattgagataggaaaatatggtggccttgaaaaggaggttgaaacccttaagagggataaagctcttctcatgcagcagcttgtagatctcaggcactaccagcaaacatctaaccttgaagtgcagaatttaattgaacggcttcaagtaatggaacagaaccagcagcagatgatggcacttctagcaatcgttgtccagaatcctagttttctcaaccagcttgtgcagcaacagcagcagcagcgcagatccaactggtggagtcctgatggaagcaagaaaaggagatttcatgctcttgagcagggccctgtaactgatcaggagacctctggccgtggggcacatattgttgaatatctcccacctgtcccagaaacatcaggtcaagtaaatccagtggaaggagccatttgttcggccaactcacaaccagttccaagtcctgcagttgccacacccatggacatgcaaacgtctaacgttgctgatactctcggttcatctgaggagcctttcgctgataactctactctacatgaatgggatgataacgacatgcagcttctgtttgatgataacctagacccaatacttccaccatttgagaatgatggtcaaatgggccctcctttgagtgttcaagattatgattttccgcagttagagcaggattgtctgatggaagcacaatataactccaacaatcctcaatatggtaatgactaattactgtataccctatgtttttgttcatcattttgtggaaaacaagcgtgatgtcattttagttaactgtggagtttctatgtgcatgtttcatgccaaatgccaaacaatggatgtttacagaccacccttttagtctgttgtgctaggatttggcaaagatgacatggagccttattcaaagttcaatacttgcttctcaaatggctttgatatttccttctgttatttcacgaaagtagtgtttgacaactagagtgatatttttttttatatctggttaattggacaattttgatcacagccaaacctcttgatttagtttcctcaaccaaaacagatctaagctgtgcctgcgtcacattgattattttcccaatcagcctattctttgtttgatcatatcggtttcaattcactctgcagtacttctatacatgcctgacatcttccctttttcatcagctgatgtcattaccgaagcttgattggtggtccaggagcatacttgcagtaacattaggtgggtacagtccatttttaacatgaaaaaggaattattccttaatgtgctttgttaatggaatgcttactttgcgttgcaataccaaagtaccaaactgaaagacataccatccttgtttaattcctctagccgttgtttcttacagaactttaggctagtatttcgtgtcaggctaggactatatggtcaactaaccctgcaaccgcctccaaattgaaattcaatcgaaaaaatattgaacttaatggcttgaactgaatgcttactaaataaacatgattggtcgttaaaaaaatgccatcagccatttcttgtaaataaatacacgaagctatattttttttatttgtatgaccaatgtttgttccagtactgatccagtttcaacatctgcagttcttcggtgaccaacctccgggcgcatctgcaccattggcatcccgaaatggcgtcctcagggtgtaccgatgaattatgctaacacagaagaagatataactctaatctggttgaccatacagaactacctttcttgttcaaggcactttttggggacaggggacgccttttcgcagttctcgtcgtcttacactagcgatggttgctaccatcgaattcatttggtgtatatactgttgttcgtcttataaaacatgagcagttttgtacatttaccttgcgtatcatgatcgcagctgtgtacctctgcattgcattactcttacctttttgcacaccaggctgccggccatcttgcgtgatgccgtttatgtagaagcgcctttccggctttccgtcgtacagagtccaccggttttttttggactgctgaaggatgaaggatgcattcactgccgtttattagcggacgaccaacgattcctggacatccaaatttaaaggggaacaagcttccagcaccaaagaagcgcatctggtgtagtggtatcatagtaccctcccacggtactgaccgggttcgattccccggatgcgcattttttggttatagccctaggttctgtgtcctttaccatgttctgtgtcatctttttgccacgaacaaatgcttgacgatgacgttgcaatgctgcatagcctgaacaaacatccatgttctgaatagccgcacgcgcttcaattctcagtttatcacacatgaaatggaggtcacgactcgtccgacgagtcccgaccatcgcgcaccgcagcagcggccgctaaagcttataataggctaatagaactgagcaatagaacatgccgacctctgtaatcgcactgctagaaaaactatttttcagacgatgacatttttttctctgacgggtatgccacttagagctaaatgaccgtctgtgaaaataacaactgagcgatatcgtcgtccgcttgcaaaaaggttaaacatgttaaaaacatcatctacccaccaaaatgctaagtcagagcacttcgccctcacacctctccctcctctcccctctcacctctcctctccttctctcccgccgcgggatccagtcggagggcggtggtggcggcggctaccggcggtagcaacgcggagggtggaggacgcggcggcttcctcccagatccggtggagaccgcggcgacggcgcagagggtggtggtggcggcggctccaagcgctggcggttccccttcctccctcctagatctggccggagaagggaggggtgatggtagcggtgcagctggaggtgtatagggcgagggatggggtggtattttttttattctcctaaaatatctccgcaaacgagtggatacgacgcccgtgaaaatcaactattttcatagacttgtgcgcataggcgggccgtcctcccgtctaggaaaatgatttttgaccgcctgaaaaaatgatttcttagcgtcgagctctctcgctgcctgactcatggagagattgctgggacatgacgcaaaggcccaaggaggcggagccacgagcccacggtgaactccgacctgcgatctcacccggtcacgccgctctgtgcttctctattcacatcgtcctacctgtccatctccgtcccggttggcctcacaccactcgtgccggctcgccgccgtgcctcgtcatctctcttatcccgtggtgccccatccgcatcgcccgatggcaaaccgacggccttgatcgcccaaccggatcaaccaccgcccccgtcttaccgttacgttgatccagtcagtcgcgtggggagatctgatgggccaccggccaggccgcccaagtttttgcacctgcgaacccaccgggcgggctcctggtgggcttcgccttcggcgaaacgcccgcggccggtgcccttcttcttccgccgaggcaggaggcagcggcggcttccggcttccttcttgtggctggtcgaaccgtctccgatgataccttccacgcaagcagctagtcgatcgcgccaacgggggaaaagccattcctatcatcctgtggacgcaataatgcgccgtcagttatcaggtactgctgcctccacttgtgctgctgctctccataaatgtccaacttgacaaaacggcgactttgttgtaccctggcccattcgatctgcagtggtacacatatgatacgtacccgcagcgactgttgctcgttttcgtttttgcggccgtgtggccgtgtccaaactgggcgcagagccaaccctctccacgtcggcttgggaatatttttggtggccttgctacttgataaatatcttttgtttaaaatgtgttcataaatacttactccgacttataaaaattaaaattctaactccgaggctttatcccataaaaaagtatttctaatcacgtgaaactcaacaagtaatttaagaatgctaattatgtggattaattatcttaatttttttaatcaattatatatatataatgtatgtatgtatggggttcattatcgtggtcatttgtctatccttctaatatgtcctaaattagctagaattttagtttttaggatagaggaagtaaatagtaatatttaggttatagcttctccatcctgaccattccttatttattttttattaaatcctttatgaatacttatattcgtgaacgaggaaagtattttaggatcatgattctgaagtctgaagaaagtattttaggatcatgattctgaagtctgaagaccattttggtcaggagcctgatgaaatttcgtagcaaatttttaccactcaatacaggccaaaataaatcaaaaccaactttattaatattttaaatttaaattatagctttttaagtgtcgtttttttaccttgcttgagaattgagatatggtggggggattttcaggatcctgtggttctatatgaggagagtcccctagtcaatatcatgcgcatatgagatttgacacacaagatgcatatatatatatatatatatatatatatatatatatatatatatatatatgacactctcactacacatgctaatgaaggatccaattggcgatccatcgctgcacatgtacaatgtgttgcctatagcacatttatggacgttttattattttgctcactacctaatggaatgagtacaacactgcagtagttgtgctgtctatctaaaattaaaacatatcgtcctttcgaccggttgttggagctacattttcagctcacagcgacccgggttagtttcctgtacccgtttttgttctttacatcttctgtttatgccgctgcatctctgtcgtatatgttggtatgagtcaccacatgaatccagcaactctaaaagagatttctttttaatcaatccactaatactaaagctagctcaggcttgctgtattcactcagtcacaactttatctcctttacagatcgggaggcacaagtgggggagtttacaaaagcaaaaccattgaagaaaaatggcatgtgtcctggcccattggaaaatagaataatttcttaagagaaggtaccgtgtctgtgtgcgtatgtttttttaggacatgtggttacgcagtacctgttcatttgaagtttttcaaatgaagcaatctgttccatgccgtcaagtttcctccaatgttatagatgtctctaatataagttagctttacagtaagcagcatgtggtgaatttatgaatccaagaaattcgatttgtttttggtaatatcgcttttataataagatctttttttttttcgaaaaagacggcaggaggactgtctcttatcattaatagagaatgagagaatacagattatttacaaaataagaccaaattgttttatgatctgaaggagcacatgttttatgatctgaaggagcacaatatcatggataatttttcttgctgtgctctgggtttcacgtagttgcagaacttgtagcaaacatatcattcagacaattgaactagactctttagtctctcattacgattgcacaaaattgtgtcttgcaatttgtaatttggccaagaacgaacttaaaaaacaaacaaatccttggatggcaagaagtgaaaagagaggaagaaaaaaacacacgggacaaagctgttcgtccacgtggcagagattatgtacacgtcatctctgattggttcctaaatctgcagagttaatttaaccggcggctcgattggctatagatcgccgctctgctccgcctcggcgacgagcgcggcgagcgagcgctgcgcatcggcggcgtcccgctcggcgatgaacgggtgctcgagcagctcgccgaccgacgcgcgccgcccggccttcttctcgaggcaccgcgacacgaagtcccggaactcctccgacgcggcggccggcatctccggcgcctcgccgaagcatatggcgcacatgagcgccgcccagtcggggcgctgccccacggggagaagcgggaagtggccgaggtacagctcaaggatcgctaccccgaggctccacacgtcggcggcgtacgggtcgtagtcgccggagtaggcctccgggtcgaacctctccggggacatgtaggccgccgtcccgacgtaggacgcgcaggggtcgagccgccgccgcaggaccttgcccgcgccgaagtcggcgatcttgacctcgccgtcggcgccgaggagcaggttcgacggcttgaggtcgcggtgcacgatgcggagcgcgtgaagggcctcgagcccgagtagcgcctgcctcgccacggcggcgatggggcgctcccccatcgggcgcccgagacggcgaagcaacccagccagggaacccccgggcatgagctcgagcgccagcgcggcgggctcctccaccccaccggcggccgacgggaccaccgcgtggagcctcacgacgtgcggggcatccgccgcgagcctgagtatctcggcctcccgcgccgcggagaggtccccggcggcgaagagcttgagcgcgagcggctgctgcgcggggcaaccccgtcggtggcgcgccttgtacaccgtcccgccgttgccgtggccgaggacggagatcctctcgaagtccgagaggcggacgtcagaggaggtggacggcgcgactgcgggctgctgctgctgctgcggcgccggcggcgggcggagggcgaagtgatcgagcgggagggtgaggtgcggcaggtggcgtcgctggcggacgagagccatcggttggagaggagaggagaggagaagagaagagaggagtcgaggagagatgggagctgacgaggagggggaggggagggggagcgggcgtatatatggagtggagaggagagagcagagagggggggagtgagatggaaggcgatgtgtgggtgcgagtggaggagagtgtagtgcgggtggaggcaccgccgggtgagtgattgtgtgtgattctcggtaggatctgagttctgttttttccgtttccgtttcgcttctcctgtcatgtcctgccgtgtgtaactgcttcatctgggcgcggaagagatggccagtgtagcgcccattccgtcgtggcgcctagcgggaaaactatctcttaaaaaccctaattgcgaaatttgtttcttcgcttgttgtctagtgtccgtgccatctcagatctcaaatcctcgatctatcgtcgagttcaatcccgaatccaaatccttcccaaatcaattcctccacaaaagtctaatttgcctcccccgggttcgatgggccgaatctctctcggcccatctcccc

SEQ ID NO: 80815 - DNA, 15277 bp, Oryza sativa
tccccctctcccccggccctctcccttccctcccggcgctctctctctccctttctctctctcgctctctctctccctcctctccctccgccccgctccgcccgcgcgctgcacgcgcgagcgcgtgagccgcccgcgccgagccgagccctcctttccgctccctcgctgccgctccccacgcgtcgttcgcgcgcgcgcgcccgcggggttgccgtccgtgccgcgccttctgcgccgtccgcgtcgcccggccccgctgccctgccacgccagcgcgcgtgcccgagccgcgccactccatccgccgcgcctcccgttgcaagccgcgcgcgcgtgccgtggtggccgaccgtctggtcgccgccgccgtcaccctctgccgcgccaacccgcgcctgtcgcccgtgtcgtcgcaccgcttcaaaccgccccgccgtcatcgccgtcgtcatcgcctcggccccgccactccgcgcgcaagccgccaagggacggaggccgagccctcctccctctgccgcgacgcccccgctcccctcctcctttttcccaaatcggcaagggggcaagcccctttctccccctctttttccccttttcctcccgccggcgtcatcctccctccctcctgtcgccgttttggccgctagccggagcgccagctcgcgccttgaccgccaaagtcggtttccaaaccgacattgccgccccctataaacccaggcgccctcccttccccttttcccctcccaatcttccctgtttctcgcccgcgccattgccgtccttctggccgaccgcagccgtcgcgtgtgtgccggaggagccggtgcgcactaggacgcggaaggggactccaggcgcgtcctctccttcctcttccccggcccgaggccggagagatcactcccgcgccgtcggcctctcgtcacagcgcccctcctcatctcggtgatgcctccctccgttcttcctcctctctctatctcccccccttagtttttggtagtagcacgagtagcctccccgtagctagccggcgccgccccgaccgttgtcgtcgctcgccgtggctcgccgcccgagctccgtagcacccgctcgtcaccggcctcgctcggtgtagctccgcccaatccgacgctagcaacggattcccgtggccgcgtagatgctctcaccgctgggaattggcccctcgtgacctcgtcgccgttttcccctttgctctccgccggttgccgccgccgaaatctgccgccgacggactccctccggcgaatccaagccgttggctcgctccctctccttcttcctcgtcgtctcggtgtacgccccgtcgcccctcatcgtcgcaaggcgccccggagaaaccaccgccgcccgccttccattcacggccgggccttcgtcttcctcccgccatcccacgtggcagccacgtaggcgccacgtcggcgccagctcagccgaggtcgggtcgggccgaccccggttagcccctcccgtgcgcgcgttccaccgcgagccgtgaggctgcgcgtgggcccgccgcatccgttcctccgcagaccgcgcgcgtgcaccgcgtccttcccccgcccgcgcgcgttcgccgcatactccctccgcacggtgagccgagccgctgacaagcgggtcccacccgggaccgcgcacggtgagcccggtccaccggctctctctcctccctcccgcgcgcgcgaccgtcttgggccgccttgtgccggccggcccatttagctcggccggaccgccctaattctcttgggccacgccctagccgcccgaggaaaagtctaatttccatccctcttttctttcttttcttttctttttcaaaaaggatttaattaaatccttttcctttagaccaaaaatccaataatcttagaaattcaatatcttcccaaccgtaaatccgtttgactccgttcgacttccaaaattcctcaaatctcgagatctatctaatggcacgcttagaggtcattaatagggctttattttcaccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatattgcttgcaaaatattatgcattgataggatcgcacttaatctgtttgtcccgtctgcaaggcagattggcggacttacctaatttgttgcatttgatccttcccttgttaattgttacatcatgtccccttgtaaccacctagttgcgtctcaatattcgtgcaccctgtgcgagtatcgacggacgccttcaaacttaaatctgaataacaacttgggtaaaacttgggtttacaaaagacttggaaaacccgacacctgggtcggtgcttgcgaactaaatgaatttccaaaaccgcggaccgggggacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgtcggggtggtgtcggggaggacccctgggcttcctggcacagtatggtctgggacctaacctgttgttggtctgggacccctctcgtcggcatatggtaaacctgtgtcggcttggaaatgccttgtcatgaaagcttggaggtctcccgacgtggctgatccccacgggctgggtgatccgggttagtaatgtcgtgtgggtaaagtgtaccccctctgcagaggttaacaaattgttcgaacagccgtgcccacggtcatgggcggatgtgaggtgattcctagcgtagttttgtttgactactgattgtgaaattgctgttgtgaaaaggggttcgatgtttgaaaaaaatctgcagctgatgggatcagctaggcccgggtggccgtttgaaaagctgttggccgggtgccaaccttgcttcaatcctaaagactgatacattgcacaaactccgaccggacgagacgcactgtctcatccgtgtcgtttgagaagcactcacttagttgtttttagaaaagagttcaaataaaatcaattgcaaaaacatcagcctttctttgaagcctgcattaaacacttaattcccatggcttgctgagtactcccgtactcacccttgctctatataaataattctccccccagttgctgaagaagatgaagcggatcctgctgatgcggagttctttcaggagcaagccggctacgatgagttttagggtttctgcctagttcccaagtcacgcctgtgttgtttggtccatgtcctgcttccgtttcccttttgtaatgcagttgtgagctcgggatctgtccgcagcccaacatgactgtacctctactctataataaagagacctctgttgctgtgatattctatctccctgtgataccagcactgtttcctgggactggtatcgattaacaggttaatttggagcgtcacgggctagttccggtcgggactagttcggggcgtgacagagggcaaaacagaaagcattggagatgaggtttggaacttatgaggattcttatcacaatcttcccccactattggaggtgatgcaggcaagaaacccgggcacacacatggctattctcgatgaggtgaatgaatatggggagaatgttcttcgtcgggctttctggtcatttgggtgcatgatagaggcctttagaaattgcattcctttgctctgtgttgatggcactttcatgacaggcaagtacagaggaacaattctaaccgcgatcggagtcgacgcggatagccatgtcgttcctgttgtttttgcatttgttgaaagcgagaacacatcaagctggctatggtttttgcggcacattaaaatgtgtgttgttgaaaacagaccaaatgtgtgtgttctgcatgaccgacacgccggtttgctatcagcgatacagaagcttcaagaagatgtcacacagtccgtgccatggccagatttatatagcagatggtgcatgcgacattttggggctaatttttatagacaattcaggagtaagagattgatggacctgttcaagaagttatgcaagcagaatcaacaaagaaagtttgatgccatatgggatcaactggatcgtttgaccactacacacatggaagaggttaggaaaaaacctatagttgccagacaggaggagccggaggaacttgaacccattcctaatgaagcaccaagtattactcggcgcaggaagcgtggaagggccacgaagtgcttcacggagtgggtagaatttgagccaagggagaaatggtcgttgttgtacgatacagatggatcgaggtatggtgtgatgacaacaaatcttgctgaagtgtataactgggttatgaagaatacacgacctctaccacttgttgctatcctagagggcatcacgaggggtacacagaagtatctctgtaaaaggtattccatggctagtctgaacctcagcaaacccagtgttaagtatagccccgctattacacagtacatggatgagaaaagtaagaagggaggaatccacagagtatggcctgctgggaatagagagttgttatttgagatacgacttcgtgacaagagtggtgtcggcattgggactactgacatcacattggaatgcacgttgtggccagagtatcacgcttgcaaatgcaattgcaacaagccttacctgttacatcggccatgttcccatgttcttgctgcttccgcaaaagggggtgttgatggaaacatttttgtttctccctactttagaaaggaatcgtgggaggcaacttggcgtggtgaattgcgtggttggcgtgccgtgtgcgatttcactcgtcctcctccagggcaagccaattgggttcctgactcaaatttattagttgatactaagggtcgtcgccagtcgcgcaggatcaaaaaccttatggatgaagctgaagtgaaagatcgttctcgtcgtaagaaagcttgcattctttgcggggagaaccattcccgtaaagattgcaacatgtacaatgtagggcaagatgccacaggcgctgatgttcgtcgcgttccaaaggggaagtcgaagaagaaaaataatccttagttcgctattatccttggtggactccctactttgaagatcgttatcgttcaatttatgtttagtgcatctgtaattttaatttgaactttcttgcacttttattacccgaatctatttgtaatggccttgtaattttcattttgaactgcactgcacttttaatatcgtcatgtatttgtattggaattgtaatttaaatttcgaactgcactgcacttgtaatatcataatatatgtgtcgtgggcttgtaattttaaattgaaatgtactgaactgttcttatctgtatctatgtgtgctggtactgtaattttaaattgaaatggcatgcaaatttgttacttgaattatgttgcatacatttactgtactgttaccatacgtgcattgtactaatatggttttcgatccgcaggtatggctgatcaatatgatgggcagctgatagacaaggagatcgataggaaccatcgatcgcgacgtcttagtacaggaactttctgcaatgtgctaaagatgagaggaccggatcaatattggcgtattgatcctcgttgggtttcaaggtgtgtgaaaatatattgtttttactaatacaaggtgtttatattttcatgtattaataacttgcgctctgtcatgttgtaggctgagagtagctgggtctttgacgtttgcacggttggtcgagccttcacgtgcaaggtccgaacgaatccacattgacgcggcgcttctgagtgctcttgtggatagatggaggcctgagacccatactttccacctcacagttggagagatggtgcccactctgcaggatgtgtcttatttgttggggctgccgatagctgggccaacagttggcccaacaatggtgaatgctggatgggcggatgaccttctggccagttttggtggtgtgctgcctgttgcactggaggatctcacagatgggcacgggcctacgaaaagttggttgaatcagtttcgataggatgtcttccctgatgaccaggaggagtggattgtgcagcggcacttagtcgcttacctgttgtggttgtttggatgggtgatgttcacgggaactcacgctgactccgtggacaagcacttcatccactttgcggagcagattgcagagttacctatcgcggagattccacagtacagttgggggtcggcggtacttgcggcgacatatgccggactgtgtgatgcttgcgtgaggaacagcaagcaaagttcactccctggatgcccgttgctaattatgttgtgggcgcacgagcgcttcgacattgggaggcctcagcttgactcgtacgcaaactacagtttgcgagagatgtataggtctggtgttgatgacatcgacgatcgtcccactatgggatccttgtggacacaccgtgaggtatttttcgttaaattcgttgatgttatcattatgaatactagttcacaaactttccttatatgactaatgaaaactactacttgttacagccgcagtgggttagcgggacgacacgtcgtgtgtacactcagtttgtagctgactttgatcagcttacgcctgaccgtgttcggtggactccctacactcagcacgatgtcaatgatcgtgcaccgcacggtctcgcggatctttgcacgcgagatatgcaactctggatgacgacttgtcacctcatggtgaacgtgcacgtcgagccacacaatgtccacagggttctcaaacagttgggcatgtatcaggacttccctccgagagatggtcgtcctttggctgatagtcttcataggttagttcacatcacagttgtttaatcctacattttttaaaataaatcactgcacaacattttttctgatgtgtgaatttgttgttgtgcaggtactccagaaaggggctcgggctttcctacgagctagttattgtgaccacagttcagctgacggtacaagagtgggagcacgcagctgataacttggcacttcagacacctccagacgatgggagttattatggagcttaccttcgttggtaccgcagtgttacacgatggaggtgttttcctccacaaagagatagcaccgtcccccaccaggcagcgattactgacacttttacccctcagcctagatcagcttacaactcaatggtatgtgtttatttgtggaatttgagcaactagttcaatatttttaaaaagttagcaagtagttcagtatgtctaataaatgtgcaattggttcaactagttccttttcttacataaatgtggaactagttcagtatttataaatgatgtgcaactggttcattatttctaacaaatgtgcatcttgttaaatactcttaataaatgtgcaactggttaaataattttaattgccttgattatttgtggaacaggcggaatttgttgagcacgttcacgtggagtccgacaccctgctgcaaagactagaggcaagacctccagtcgtcaggcctgacgacgtggcgagcatccttcgcaacttccgtgcacgtgctgccgcactactacgtcgtgtctcctgtcggagcgcggcagatgtggtgtagacgtcgggccgatggccatcaccaccactaccccgacgttccagcgtggatcggagtggtccatcctcttcacgtcgcgggtacgaagcggcccacacatctcacggtcgtccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatagggacttcatatcactccgcgtgcgccagagcagggccacacacagcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacagcattcattgaggacttcttttccactgatcctccccagggggaagtagggatggattactggcacgcaacacctcaggtcacacagccgacgcaggagacggaggccggtcaggggccagacgtgacaccacagcaggtagctagagataggcacccccctgataatttgacatatcccactgaacagattaggcgtaggaagaagggaggacctagcaagcgtgcgaaaggcactgatcgtccttgacttatctatttgtattaaacttttagtcatttaagttctgtccgtattatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcatatacatataacattacaaaaatattttcctttcttacacactaaaataaattacaaattattaaaaaaaataacttattacaaataaatggagaacgcgaccctgtcgaactgtgccagttcggcggatatcctgtcgaacaggggcagttcgacagccctgcctgtcgaacgggggctgttcgacaggtcctgtcgaacggcagccttccgatctcctcgccagtcgcgctctgaccgttcgataggcgccctatcgaactgcacccgttcgacagggacctactttcgcgattttccccggttgaccactacttttgcgattttccataaaaataatattaattctcaaaaaaattcgtgaatatggagcactctgccactggagagatcgataaggaattaaggatgcaatggttcgtgctgccatagacatggtctatggaccattgacgcatcgaagctcagagctgtcaaaccggagggcccattgcatgcaaccgtgaaaagctaagagaacacacatatgttcgtctctccctcactttgatttttttttttttactactacttgaccgtgatcagttcacgtacacgtaggtccatcggctatgctccatccaaggagctaagacagaattaggttacgagaccaccgatgttgtgtgcttgtgtgcgtgctatcggtttgcctattcctatctcagacacagataggatcgatattttggaaattgcagtaattttggtttgaattaatttaaaatcttaaacaaaatttggtcacatctattctttttctaaattcattttttttgtgaaatattctaaaagtaatcaggagaaatagtttcctatcggaagagggtgacaaaatccaaaacctcgatggtttaaatcatgttggctagtgggaatcaaccatacagtttaggaatacatgaaaatgccaaacaatttgaatttgtaagttgttatccaataagtgaagaatatgttttctcttttttaaaataaactataattattgttataacattagtttttcttgttgcatagacggatattttttctagtataaatcaagttcttgtcattaataaactcccaaaaaaaaaaaggagaaaaaccaattcttgtccgagtcggatcatcgatcgaccaatctaagcatgcaacactagcaccgatatataaatgctggtgatttcggccaagttcgcattggttgatcgatccatcggtcctcacgtaggtaatttcacggaacaatctcctcgcgatcgtttacggcttgattgtccatcatgattgtatgattgtgaacggacatccaatatacttataatttggttaaaaaatatatgtgaagtcatgctgatcacataagatgcacacctagtaaccgactcaagcatctctaagagtggtcgaggtacgactacacacctagtcctcgatcagcgtgatagtgatcccaccacttctacaaatggtcgagatatgattacatacctggttctttaccagcgtgattacgatcctccgactatctctacaagtggtcgagctacgacatacacacctaatcctcaatcagcgtggtagcgatcatcaccgcttctactagtggtcgtggtagcgatatctcccccccccagcaccgctaagatggagtgagagcgggagaggggatcggaggtggtggtcgtacgatctctcttgtctcaactagttgtgctgggcctgcacgggattatattaagctccatgtggcccacttatgttgtgccagaatgtgttggttcggcccaagctgctcagggctttagccatcatacagttacgctacgctgtagttacaattattatatagtgtagttgcattataattaatactataatacttcctccatcccattataagcgcggccatgaatttatgagtccaattttaattatccgtcttatttgaaatttttttcatgattagtatttttgttgttattagatgataaaacatgactactttatgcgtgacttattattttggttattttcaaaaagttttcaaataagacagacgatcaaaattggacacgtaaattcattactacgcttataatgtgacagagggagtactatatataaatttacatttgaaaatattttacttaaataagtttgtacaaattttgttttttttagcaaaactgaaaaagaaaaactcgaatttggaaaagaaaaggaaaacgaaaaggaaaagaaaacagttctggtccgaatctgatcatcgatcaagctaagaagtatagatggccatgtgggccgcccggcatggcacggcccaggcccggccgtgcctaggccgaggcttgtcgggccggcacggcccgaccgacgcaccgggccgtgccgtgccagcccacgtgccgcactcacagcccaggcacggcccaacacgcttcgggccgtgccgggccggcccgaagacacgatgggccatcgtgcttttcctcagaataagtctaaattttctccctcctattgggctgtgacattgtatagctaaaaaaagtctattttacctccctcttctttgtgctgtggtatataaatagctaaaataagtctatttaaggttcctattctttagacattgacatttatatgtctattttcagtccctatactttgtgtaccgggtctggcctgccagcccatcgtgccgggccggcccgaccgtgccaggccagcccagcgtgctggtagggaggcccaggcacggcccgacggtcgggccgggccggcatgggcccaacccaagtcgggccgtgccgtgcttgggccgggccaaaaaggcatgccgtgggccgggccttcgggcctcgggccttatggccaactataataagaagcagcactaccaccgatatataaacgctggtgattccggcgaagttctcattggtggatcgatccatcgatcacgtaggtacgtaggtaatttcttggcgtcatcgcaacaatggcgggcgggccggggagctgcgtgatgtgcgcgtcctgttgcaccctcctgctcttactggtcgccgcgctgctgatcctctcgtacggcgtcgtcttcaacgtcggcgtcacggtggaggacgcgtccctgacacgcctcgacctcgccggcgccaacggcaccgacctggcctacggcatctcgctcaccgtcgccgtgcacaaccccaacatggccgtccgcgccgagtacacccggccgctcgccgccgagctccgcctcgccaccagggaggagctcctccacgccgtccatctcgcggacgccgggcagagggtggaggcggccgagacggacaggttcggcgtgaccgacgagggcgtggcggctcatctcggcggcgcggcgttgacggagctggtgaaggagatgggcgcgcgcgggggaggaggtgtcgtcgctggagctgaagatcaccggcgaggtgaggttccggccggtgcacgccggccggacgaggagggtggacgcgacgtgcccgctgaggctgtaccgaccggggacgaacaccacgcaggtcaaccacagggtcatcaaatgccactagactagaagccgagctaattatataggactcgtgaaaaccttgtatctcgttagctccctcggttcgttgcagtttgtaggatcgaacgcgaataaccaagcctatcaggaggggggtgaatggcaaggaaaaccaaaaccccaaaagcttttaccgaaaataaaagttaccctcaaatcgatggaaatctcgacgtagttctattgccgccggtcgaaccactcgcacgcagccggtctaaccgccgccttgtcgccggttgaaccgtctccctgccgcgggtgtgaccgccagtggttagactgcagacttgcctccggtccaaccgtcaggatccagaaaaacacgtatcgacgaaacacttgaaagtatatcaactttattgcatcaatatatgtttacaaagtgtacctaaaacactcccctctcaactcacgaactaggattgaaacctcgaagtaaaccctaatttttctctctcaaaagtcgatatccttctagcctcaacccttcccattgcgaagatctcatccatacagtattcatccaccgtatgccatcttgtatccaacttcgtcacccggtatccttgaccgtctggatctcaactcctccctgagtctagtcccgatccccaccgttgaccgaagttgacctccaagaatcctgactttagtcatcttctcacatggtatcccgaccgcactagacctctgtttttccctgaacataatcccggtcctcaccattgaccaaggctgacctcaagtcacctgcacacaatcagataaagcaaacatttctgggcacaaatatcacaacctgacccacattagtcacacgcactcacactaacatccacacatcttttcaaactaattctttgattaaatcatttgcatagccaattgttcatcacaaatattaaccatgataatgatttcacgttctcccccttgatgaacacattggcaacatcttcaaaatgcaattttgtgtttttgaaaaatgaaaacaaaaatctcaaaagtgaaaaagaaaaactctccccctttttaaaagaaagaatttctcccatcaatttgcaatcaaagcacaaaatcgactatttttaaaattgaaacaattcaattctccctctttcaagaagcatgcattttgtatatttctcctcctttaacaatgatttcatcaagaatgcaaaagagaataataaccaatgaagcacatatgcaatgatgtcatgatcgccacttggaataaccattttatattttatattttatatttctttcgagagctttgaagtgtacctaaaacaattcatgatcatgtattgcaagacaagagagataaattcattaactagttaacaaacatgcactatattataaacatgaatcaaagatattataattaagctcgaattagcaataaggattcatgatttcaaatgatttataatgcaatatattcacaagcacataggttgaaaaataaacactatacatatatacctattgcatttatcactctttctcaaattagctttagcacaaaacaaacaagataattttttaaacttttatttgagccattttactcactttttttctctcaattattccatgtacgtcacatacctggtgtacagcgttggcaacctaccctaggatacctaggaaaggtgtttgcactatgctactactgacaatatgagagatatggatagagctcttgacaatatctctcattacgaaaataaaggaggagaccaaaacttgggccctagtagaagcaaaatgccttgcacatatcaatccttagtttttttagaaaatactttctagtttccttttctttttcttttgtaacgctcttcttcctatacagtttttccctcccagtatactcaatgaaattggcgcacctaaataccgatttattataaaaaaaaaagctcgattaggtggttcagccgttgcgtacgtgcatcgtagcgcagcagatactaccatccagcatatcacgtggcatgtggcacagaagttgcgagttcgtgaatgcatatacatgcagtaggccagtataggaagaagagaagagaaacggtacagatcgatcaagatatttctgtacagaaattaaccagagtacgaaaagttagtaattttgaattgatgaatcatatatatttcgaccaaaactcacaaatttggacttacagatcaatgtatactacaggagcaattttacggtccttaaagaggtgtcacgaggcactacttttttttagtaaactagtaaggtagcccgcgcagttgcgcgggcctcttatttaaaatatcattttttgttgttattacgattttttatattatgactttgtctctcggtgaaaaaatttatggttgaaaaacttcttatgcataacaattgtcaatacaaaaggtccacacacatagaaattgtgtcgtatatatgtacacgtgcattagattaggaataagttttttttttcttatacaccgttgtacgtacacgaagaagtttagcaattgaatggtttagttttaaaggatctaagataatgggctcacggatttaaatcatgtgataatgtagagtgtttgtagcgtgtcatctggtgatttattaggagcgtctgtaaaacaaaagattgaaaagagcatatatttagatgaagcacagaaaaacacaggaatgttaattacaatttattaagacatctagatgaaataatcatt

SEQ ID NO: 80816 - DNA, 5749 bp, Oryza sativa
tcctcgccgacgccgacgccgacgccgacgaggtaagagttctcgcgatggacggtgttcgccgtcggagaagaaggagaaggcggcaaatgggaacacaaatgggagcctaatataggtaggaaagaaacacgcatcggtagaccaccgcgttcgcgggggcgcgaacggagagaggagaggagacggtggcgattggcatgtccacaaatcacgtacactgcccgatcgaactcatgggctcacggctagttcgcaagcaaacggcacggccgccgctggtcgccgtcgttccgcatccaccccgccggccgtcgtccgcgataaggatcggcggaagtgaaacaattaacgagacctatctccacgagtccacgtagagggcccaaccgagagcccagttaacgaggaaacgacatcttctcggagtgtctggctggccgggcccaaaaaaggccgtgactttcgtttgtggaacgttccacactactggacttttgggctgcacgaacgaccgagcgaacacgaccgttttgcgtcttggtggacaagaaagaaacgacccgagaccgagaggagaggcgagagagcgtggagtatttgacttggtttcttaaaggttaaagccgccgctggttttcgcgcgcccggccgcccacgttattgaggcgagacgagagcgcacactgcagaagcatgcggcatgcctgccttgcgcaggcacagctacccgctctcgcagctgcatccggcacacagattttcggctcgaatggatatccgccgtagtctccaagtcgatctgttgttccttcccccctgtacgtctcaccgtagagttggagtggcatcatggcatggctatcccgtctccatgcttcttggctcctcgcgagcgcgaaaggccgctccagcctgggaccgatccacctatataaatcggcctcgctctgctccagttcggactcagatcgcaaccaacagttgagttgaattgagctcgaattgtactcgattcaccacacagaggaatcaaatcgaagcagccatggctctcgtggagggaaacaacggcgtgtcggggggagcggtcagcttcagcgaggagcaggaggcgcttgtgctcaagtcgtgggccatcatgaagaaggattccgccaacattggactccgcttcttcttgaagtatgtactactacatgctactacttactagtgccattcttcgcagagtcagtttacggcaccaaccattggtttctgaggcattatacatttcggtgtgcgtgattggtgctactatatctctattccaggatcttcgaggtcgcgccgtcggcgagccagatgttctcgttcctgcgcaactccgacgtgccgctcgagaagaaccccaagctcaagacccacgccatgtccgtcttcgtcatggtaatactaccatcagtattgctgcagacaagagtaaatttgttgtagtagtaggcactgacagaatgtgtgcgtgtgtcgtgatcaatcgatgttgcagacatgtgaggccgccgcgcagctgcggaaagccgggaaggtcaccgtgagagacaccaccctgaagaggctcggcgccacgcacttcaagtacggcgtcggagacgcccactttgaggtagagtgatatccagttgttgctccattcgatcgacatggaactctatcgatcgtgttctgattgtggccttgtcgaacgttcgtaaacaggtgacgaggttcgcgctgcttgagacgatcaaggaggcggttccggtggacatgtggagccccgcgatgaagagcgcgtggagcgaagcctacaaccaactggtcgcggccatcaagcaggagatgaagcctgctgagtgatatatatactgctccacctccatgatcctcgctgatcaactttgttgcattgtgctcgttcaatattcctcgccccacaaaagggacttttgtcggtgtgtgtatgtccaaatgattaaatcaactgctgttttgttctatgtaagatacataactcataaataaagatggttttctacatgccgtttatgcgcttcgatctgcagcattcggaagtacaacttcggtagtttggtgtgccgttcgctggatgggttggacgttgagtggcacacccatcacgccatattcttaccttgggccttgcacccaaaagggaaagagtctaattcacctccctcatttcttgctcttggtcgaatcacatccctcaaccgtaatacggatataacccacccaccaacttcttgtaaaataaagggagcaaattgaatagatcctattcctatagatggccaaatgggccgtccggccagcatggcccaagcaagaccgggcttgggccgatgttagtcgggctgacccacgggctacaccaacggtccaggcacaacccaataagactagggccgtattcggccagccagaaggcacgacagcccatcatgcttctacatagaataaatctatttttactccctcatctctctgggctggtgtcttacatggatagaataagtcttattttgtatctgtcttcactttgggccatgtcttatatggataaattaattctattttggatccctcaattatttttttgaccgtgccgtgccgagccggcccaccgtgccaaggcatcggcccaggcacggctgtagcgcccgttccgtcgtggcgcctagcgggaaaactatatcttaaaaaccctatttgcgaaatccgtttctttgcttgttgtctagtgtccgtgccatctcagatcttaaatccctgatctatcgtcgagttcaatcccgaatccagatccttcccaaatcaaatccctccgcaaaagtctatttcgcctccctcgggtttgatgggccgaatccctctcggcccatctccccctccctccccggctctctctctctctctgtttctctctctccctctcccccgctctgcccgtgcgctgcacacgcgtgcgcgtgagccgcgccgagccgagcgccctccgccctcgctgccgcttcccgccgacgccgccgaaatcgccgcgccgcccgttgcttcccgcgcgcgcgcgcgccatggtggccgaccgcctggtcgctgccgccgtcagcatctgccgcgcctgcccacgcctgccgcccgtgacgtcgcaccgctccacaccgccccaccgtcattgccgtcgtcatcgcctcggccccgccactcccgcgctagcctccaagggacggaggcagagcctccctcctccctctgccgcgacgcccccgctccctccttcttttcccgaagaggcaaggggacaagcccccttttctctccctcttttcccctttttccctcccgccggcgtcatcctcctcccttctccctgtcgccgcttggccgcgaccgccgagcgctagccctctcctttgaccgccctaagtcggttcccaaaccaacattgccatcctataaacccgagctccccccctttttcctttcctctcccattcacctccgcgccattgccgcccctctgtttcgccgtcgccgttcgtcgttgcgcgtgtcggaggagccggcacgagcaaggacgcggaaggggacttcggccgcgccctctccttcctcctccccggcccgaggccggagagattactcccgcgccgtcggcctctcgtcacagcgcccctcctcacctcggtgatgcctccctccgttcttcctcttcgctccatctcctcccctagttttcggtggtagcacgagtagcctccccgtagctagccggcgccgccccgaccgttgccatcgctcgctgtgtgctcgccgccgtcgccgctcgagcttcgtagcacccgctcgtcgccagcctcgctcggcgtagctcgccaatccgacgctagcaacggattcccgtagccgcgtagatgctctcaccgccgggaatcggcccctcgtgacctcgtcgccgtttcccccttccctccccgctggttgccgccgccgcaatccgccgccgtcgagctccctccggcgaatccgagccgttggctcgtctcccctcgtcctgtgcaacatcccggtgtgctcgccttcgcctgtatcgccatgattcgctccgccgctcgccgccgtcgtccgcagtccgttccggccggcgtcgtcatctacctcccgccggcccgcgtggcagccacgtaggcaccacgtcggcgccacctcggccgcgaccgggtcaagtagaccccggtccgccgcttccctccgccccctcgcgcgcgcggtccaccgcgagccgtgaggctgcgcgtggcccgccgcaccgcgtcctccgcgaaccgcgcgcatgcgccgcgcctccctccccaaaccctagcacgccccgcgtgcacctcgctcacggtgagccaagtcgccgacaagtgggtcccacccgggcccacgtgggatggacccggcccaccggctctctctctcccctccccgcccacgcgcgcgccttgggctgcctcttgggccagccggcccattaagctcggccgagccgccccattctctcgggccgcgccctagccgcccgagggaagtctaatttccctccctccttcttttcttttcttttctttttcaaaaaggatttaaataaatccttttcctttagaccaaaaatccaataatcttagaaattcaatatcttcccaaccgtaagtccgtttgactccgttcaacttctaaaattcctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatctcgagcgaggcaagccacctttgaacatcttgagcctatatttgaacttaattatgttgcttgaaaaatattatgcattgataggatcgcacttaatctgcttgtcccgtctgcaaggcagattggcggacctacctaatttgttgcatttgacccccccattgtaattgttataccatgttcccttgcaccccctagttgcgcctcggtaatcgtgcactctgcacgggtaacaacggtcgccttcaaacttaaaatctgagaaacatcttgggtaaaacttgggttttacaaaagacttggaaaacccgacacctgggtcggtgcttgcgaactaaatgaatttccaaaatcgctgaccggggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtggccattctgcacggactggatgatccgggttagtaatgtcgtgtgggtaaagtgtacccccctctgcagaggttattaaaactgtttgaacagccgtgcccacggtcatgggcggatgtgaggtgattcctagcgtagttttgtttgac

SEQ ID NO: 80817 - DNA, 10879 bp, Oryza sativa
caaggtcgtttgatgtactttattatccctgtacataaatctagaataacttatatttggaatccaagtattctatgttttgagtttggaaatagtgggcatattagctgtcctgataatcctgcaattctccaaaagttataactttgtcattttattggtactcacataggttccttggagaatctgttgaaatctgtggatgaagttgaggaagaacgaattaaacaggtatcattcttaatattatacattagatgagatatcccctcttcgcatttatcagcatgcacttatgcacagaaatgccaagatacagaaactgggttgcatgacgcttttgtttcactagaacagcgcaatacaatgaccccattaaatggcattgatattttaccctttagtataatatgattatcttcttgaatgttgattgcacatactctcttgtcaaatatatcattttttatcttatgacttctcaaatggttgagcaaatcatatttggtgtggtcctttacaggctttgatatctcaatctgaacaagcaatgctttgcaaaagcctggtaatcttttttttatgttgctcaaaagtcctttctattgtcttgatgaatcatgaaatgcaatcatcttccatattatattgtgagattctatctcaaccagactcttctcattgaatttacacttcttgtaggccacattacgttctgaccttccatcctatatggttccttttaagacatcggatcttgtgtttcagaagccaaaggtagcaattgtagcatcatatatttatgaaaacaactaaaccattactaaagtttgtccctctgattcctgcttacactgttattcttgcccgcaatgcttcttcaggatgatggagccaaattcataaaactcttgcgagctttggaagcatatgcagaaggctcgtcagcagacctaatcataagaagagccgcctatctttggaacaaacttaactcatgactatgctgatgtttccagcagtgacaacatacgaacttttcaagcacaaaagttccacctgagaagataggtgccttggtgctatgtttctgtcaaatttggtgcgagcggctcgctgtgctttctggcacaaaaggtggacggtgcatgtttagacaggctgtgcataccatgaaactgataattagttagttttgtagataaaagcacgtcatggctcatgcaatctacagaacatgatattttttacactctaatgaatggtggctgctggctggaaggtggaagaatggcatgtaggtacctgaaagcttaatcattcgattatgtgcaacttcgtagaaatattatctagtgacatgtcactattcatatgcacaatgataccaagttggtcacaaaagtatgtggagtacgtgtcttttcctcttagcaggtgacgggtacctagtacgtatactcccttcgtctcagaaaaaaaggcaaaccctgaattttcgtgtccaactttgactgtccgtctcatatgaaatttttttataattcgtattttcattgttgttagatgataaaacatgattaatattttatgcgtgacttgtctttttaatttttttcataattttttcaaataagacggacggtcaaacgttagacacggcaacccgggtttgtctttttttttggacggagggagtgtacctacgcagccatctacttgcggactaaagtcaccaggcaaagcaacactccaagccaaacaagccgacgcacggcggcgtcagctcgccgcgaaaccgcgcctgcggggatgtagcacgagctggtctgcggcacctgctgcccctgcgtcgtccccggcacgccggccgccgtcacacagtaccccgtcggcgtcatccctctgctcggctgcggcgtgttctgcaaaaaccaaaaaaagacatggagatcagatcagggacgtccattccattcgatccaaagactgcaggcagaatcggtaggcaacgagcatcgatgaaacctgcaccgtaactggagtaacggtggccggagccgccgtgccgggagcggcggcgagcccgatgtcgtagttcgccgtgaggtcagtccggtagaggccgaacgaccgctcggactccggcccacccttgaggtcctcgtcgtagagcgcgaagaggtacgtgtccaccgatttgcctggcgtccgcggcgtgccgacctgcgacttgaggtgcgcgacgaggttgccgttgtacgccctggcgttgtccaccgtggcgccgccctcgtcggcgtcgcccttgtacggccacccggtctcggcgatgacgatgtccacgccgctgtaccccttggcgtccagcgccgcgcggatggcgtccagctgcgcgtcgaacatgttggtgtaggtgagccctgacccggcgtcgacgcgccccgggttcggctggaacaggcagaacgccagcgtctccggccgcgtgtcggaggcgtaggcgaagtacgggtacgggttgatcatgaacggcgcgccgttctgcttcaggaagtccagcaccgggtccaggctcccggcgaggtcggcgtggaacgcgcccgacgacggcgggtccgacgacgagagcaccgccatggaatgcacggtcgagatctgctagtcaaccgcaaactcgttcaagaaaccaccgcgatgcgtacgtagagatgctgtgatgagatacgtgccttggtggttgagccggcggggagcgcggcgaggaggttctgcatggcggggaggagctgcggcgcgagggtgggatcgccggagttgagcagctcgttgccgacggagatggcggagacgggcaccgtggtcgggatgttcgcggcagcccaggccgacgctgccgccggggaggacgcgaggttggggacgtcgccgttcgggacgccgaggaggatggagatgttggagcccgcgagcgcggcgacgaggtccggctggggctcgtagaggcggaccttgccgatggacgtcgacttcagcaggttggccgtcgacgccggcggcgggaggttgtcggctatcgtcccatagttcactccgatgaacgactgcgacgctgcaaatatcaatcaaactcgcatgagaaatccaagtttacaaaatttcagcaaaattcatttcacatacaaattcacatggccaacgctgtcgcaaacttcgtacgcgcagcatctgctaataattacttaattgtcacgttaagcatatggcagtggtgagagcacacgcaaacgtactacctccagagcagtagttggatagcaacaggacgagctgcgttgtacagctttggcctctttggggcagccattatctgtcaaatgctgccgggcgtgaagcgtgatcattgttcctctttgtttggccaatggcgagagctgttgcctgttggtcaagttcgaattattctcccccaaaataaagcctccaactattctagcggccgttaggtgatggatcttgcgcccacgagtgttggctcctatgctttggatatttgatttggtatttgctagattccttgaccaacccttttggtgtactcaatgcgaatcgttggtaaaagtcacctcaccaggccaatgtaaattgagcatggttcatatgcagctagcgcagattacagttcatgccaagttgctctgttctttttttctttttcaaaaaaaaggaagagtcaacttcgggtctctgcaatgtttagctacaaagtcaacagccatagcacaacggcttcttaccatttctaccgtttgagaataaagcgttgaaaaagtctgattaatcctataaagtatggaacaaccgggtaaattatctcccaaaagtatgaaattggttcaaataacctgtagagtggttttggccaccgggaccacgacgaacacacagtgacatgaggatgtaattgattaaatgcatttttactcctaactatagcggcttaggaaagaagtaacgtgatcggagaaagttagtgattgaactattcggctgaaattggttaacgtgtctgtcatgcaaacaataccactcggtcgcatcaccgcctaaaagaacacttacaaaccatcctcacatgtttctttagaaaataaaaaaaacttccaaacaactttgatatgttgtttttttggaacacggtataaacgtaaatattcatacacatgcgtgcacttatctctataaacatatatatatatatatatatatatatatatatatacacacacacacacacacacatacacacacacctaatatcatatctctttaactagcttaaaagtacctcccagaaactatagaatactttatgtggaacgcttttcgtactttaggggcacaataaccgatttcatacgttatgtagactgataagtgctttaggtattaaataaagagttttctctaacaaacaatatatggtgttctgtataattaaccgtcgcttttgaatgcaatcccaaaataattcctctctttatctaggcgttgggaatatgatcaggagtcgtggcagagaaactccatttctctccccactttgcccctcgtgttggcgaaatctcaatttctcggagcaaaaaagtaagatctcatcaaatcctccccacctatttattagaaaaaaaaatgtgccatcaatcgccatcttctttgctcaccattccggaagctagaaaaggttcggtaactcggcacgaatgagtaacctgcatccgtaaaaacgacgcagaatttcgtcctaccacttcgctgaactgactaaagtattctagtgcagtacgctaattcgaggaacaaagaatcacaacgaaagtgaagccattgttccactattccaaaaccgaactaagctaaccagttaataagcatccagcgagcgaaacatgatctgaagatgattcggtgataccatttcatctatctatctaccaacaaaatgcaaaaacgaaatcaaaactttcaccgcgataagaaacaacaaggtagcatgtcaatgatgtacaagaagcaacgaatcactggcacaattcgcaggagacagcttgagtgagaaagaagcgctctagcgcggaaagaacttacttgccaagtggaagaggagcgcttgcagcagcccagaggtgacagcagcatccagccacctcctcgcccccatgccaccactgccagccaagctactagcaacaagaatcctactgcttgatgcaatctcgccgcagcttctcagatgttcgagtccaattatggctactacttgggatcagtgaaatggtcgaagactcaaaggagctcgagtggcaaactggcaatgggagaggcaaagaagaagacaaggaggaaagaggccaggaaggaggaggaggaggcgagtcgtcgatgcagtctttggcccccttgcttgctgcgtaaaataagaggagagaaagcggcggggcgcgaggtgacaccgtggggtcggcagcacaggacagggacgacgacgacgacaagggttgtgtgcgggagaagccgcggtcaccgtcgcctcgcctcctttctcgcggtgcctgcctctgaccgcacgtctacacgcgcggcgcggcccgccaatgcgttttttcccctctcctttggtgcgtcaactcgccgagaaatacagccccggcatataagaggaaaaagcgaaacggtagtatttacaaatgaaaaataatttgtaaataaacttttatatacgtgttcttaacgatctaaaagcaaaggctaaaaaataagcaacaataaaaaaaatcccaaaataaactctaaatttaaagttgaaaatttaaattttagctgataagcacaagcataaagataatggtgataagcaggtgagccgtaagacttgtttagaggagattctgatagctacaatttttttttaaatcatcgcataacataattttctctagaccgtctaaattttcacttagacttttagaatttatagttgtagaaaaaaataaaatagaagatagaagctagagaacccatttttttctcaccagttagtttaatcataagctttaagaataaaaccgcagtgtggatcggcacagcgaatagtggctttgatcagggaagggaacggaggcgatacatcgttctcggttctcgggtgtacttgcttctatctttttcgtgaacgcgtaaaaaatgtgcatgtcaatatatcgtcgcgaggatggcccgtgacgagtatgtggctgtgcggttgtgccgtgagcctgactcgcgagagcagatcagcgtcgtacctggaattttggtttcgggaggtgatgggattttgctgtctgtcaacaatctgtcatggacgttaagcaggattgcatgagcgagcgagtggcgaatatgggcgagtcgtgttgtggcgcggaaacagccacacgggtggttatcgtcgtaattaatgggtatactaatcaccggtgctcatctccaattattaagccgctggcgctcgctgagtgaggtaaagcgattccatatgccataatgccacccggatcgtgatggggatgatggcaaatatgggaagaaaacagcgtttcacctcttgttcatcattgccccggttaattgcagtagtatgcacaagaagctttgacctgtgctgctgacaacctcgtatgagtgcgaatgctctcctcctcgtcggtggttactggcccgttgctctatcacaagttcacaactcacaaattaaacacaccatcgtccacaaggcagagcaaggctaccaggccaccgtgtccacgcgcggctgggtcccctttgtcacggacgcccgcggtacccacggcccacggccacgggggatcggctgcctggccatggtggacttgggcgtcctcgaattcggctgagttaagtggcagtgtctgtgaagagcatctttttcatccttgaaaaagtaacatgaggtaccaatctaatctaaccattgatttagcagggatatgatcagtctaataaaaacagatgtcctctcttcgtcgtccctgcccatccgtcgccgccgtgcatccagcccgccgccgtccccctcgagctagccgccacgccgctgctctcccgacgtttttttctctcgtgaaacagaaaatgacataaattccctcccacccatagtaccacttcaatgagaaggtacggtaccatgaggtacggacgatttctgaccgttggatgatgccagatcaatgatcaagatttggtactccataacctcaataacagtaaaaaacctcttctgtgaaattttcggggacatgggcaattggccaaatggctggctggatgactgaagccggaccgagtaggtctctgtccgttctccgagcctgcgttgacgtgttgcgtggctgtagctgtagtttaggcgatctgtttgctcggattatcgagatggcaaaatgggaaccatggtcaggccagagtcggcgtgtctcgcggcagcatccgaaaatatagagcacttcaagcactactggagaaatgatctttaccaggtcgaggaaaaaccacaattgtcccggttcataaaaaacagggactaaaaataatttttagtccggtttataagttcaatgggaagatttgatctatcaaccgggactaaagatggcaaagatggtgttggacgacacgtggctgcgccatctttagtcccggttggtgttttgtcccagttattttaaccgggagtaaagatggacatctttagttccggattcgccgtcagtttccaaccgacgttaaagatgggttccagcagtgaagcgttaaagatgggttccagcagtgaaggcaaactaggcaaagtgtgtactatggagtgatcacacgcgcaaatagcaagtgtgtggatatgtgattcacgtttatacgtaagtaatttaagcattacgcgctgacatcccatgtgtaggtatgtatatatatactcagggtaggcgacttcagacagaaactgtcaggggcaatgtacaagttgtaaatagacacatgtggttcatgatggctgagggttttgtttcctaaataaaatagggagctgagaactgtttgtatcgggctaataagagcatctccaacagtctctacatctcactcttcaagttaaattttaataattctaataaaaaaacatgctccaacaacctctccaaccggatggctaagccatccgactgaccaaaacccttcctccactagccaaatttagccactctatttggctgaccaatggtgggccccacacatccagtcttctctatccccacacggcaaccaatgaggaggcacaagaggagcatgaggaggaggcatggggaggagctcgagcacggcagccgccggcccccgctcgtcgcgaccgccgacctccgcactcgccgtcgtcatcatgtcgcgcgtgcctatatctcgtcgtcgccgccttccacctctcgcgcacctggatctcgtcggcgccaccttccacctcgccgcgcctggatctcgtcgtcgttaccatacacctcgcgcgtgcccggatatctcgtcgtcatcgcctctcgcccgcccggatcctcgtcgttgttgcctcctgcctcatgcgggcggatccccgtcgccgtcgccccccgcctcacgtgcgctggcgtcctcgcttcagagagggccagtaaggagctcgaggatgggccgatggggttgccctagcgggaaaagaggaagcaaggaagaaaagaggaagaagggcggtggaggctgacatgtgggttccattgtcatagactcaggatgaaaagtacaaatggagagtctattggagcgaggaactagtttgacttgctaaatcagataaagagttggctatatgggtgtttggagagccggattttagtagtctgttggagatgctataaggtcgacaggtcgttcatcaagtcttgcacccaatgttcatgtgaattcagtcaaaaatgtgtactcacaagtcacaacgtgctatcggaaggcattagtgtatcctctgaaactgcgtagtacgtgctctcgtgcaagcaatcatgcatagcatagtgttttcaggtgtaggtgaagtaaaggagtaaaggactcattctcatgctaatacaaagatcgtcagacctctcgaaattagatcacatttatagaaaaaactacaacgacatctacaatctcaaattagtttcatcaaaattcaccataatataaagtatatcttgatggtatattttatttggtattatagatattaattatttttctattaacttgttcaaagttaaagaactttgactaaaaataaaatcaaaacaccttataatacgaaatcaaaggagtatttttcagctacttcaacgtacggattattaacatggatcatttgctccataactctaaagatatgtttccttagaaaccttcttctattgcattgtttagatcatttattttaacctatttttaggtcttttttctcaagacatttgatttcttcctataatcaaatacgcaaaatctatttcgagaggcatctcgatttatacttaacgagcgacgcggacaattgcgtgagaagtactagtagcgttacagacatgcatgcaagtagtttttgctattaggttgtccatattttttttcttatgaaattttctcttaaattacttattcgatctataatccgattacaccgttgtgttcataacaattaaatctttacaacaagatctcacatgattatattttgatgaaaaatcacaaattacttttatgatatgtctaaattacttttagatttcactaagttacttcttagacatacaaaagtaaattcagtaaagcctagaagtaatttacatatattatagaagtaacttagaacaaaacgaatgtaactttggcatgtcatttcaagtaaatccgttgtagagataaaaacatgactctatctagaaattaaattaatcagcacaaattatggaattaactaaaaacaataataaagaaacaataataaaagtaatcacctcagagcattatgaatgtataggaagtattttaatcaaatttaaaagtaacttatatatatgataattaaatatatgataatttgttcaatgaaaaaatgtattaattaaagttactttctttttgttataagttacttttataatatatgtaaattacttttaagctttactgaatttacttttgtatgtctaagaagtaacttagcgaaatctaaaagtaatttagacatatcataaaagtaatttgtgatttttcatcaaaatataatcatgtgagatcttgttgtaaagatttaattgttacgaacacaacggtgtaatcggatcgtagatcggatgagtagtttaagagaaaattgtatttgaaatataggtggatggtgtctcttatagatggagtggtagacaaaccagctaccactagctgtgtagtcacgtctaatcaaatagataatccgccaaaataatgtagtagtaatcaaatagaccaagatcgtatatctcctattcatggcccgagcttgtgagttgtgactacgggtatgttcactttgatatcattttcaaccatattttttttggcaaagttaccaaaaaaaatatctacgtttagtttgttaccaaatttggtcaatacataagaaatcctgccaaattttggtaatattgtcatcttaccaaaattttggcattgccagaactttgtaaggtttattttggctacaatctgaacgggctctaca

SEQ ID NO: 80818 - DNA, 14164 bp, Oryza sativa
ggtggcccgatttcgccggccgacgtgggagaggtggaggtggagagagaggcgggattcgaatttcgaatcccggccatctcgggcgcgggcgcaggcgagagggagggggagtgggtgcgggaggtgcggcgcatgcgcgggcgtggccgacgtggccccgaggaggcggggatgtgggcgcggcggcggttgcgggcggcgcggcgcgggcgcgaggtgggagacgggcccgacaggtgggccccacctgtcggcgaccccgggtgagaggaggcaggcgactggctcgcccggctcaattgggcctcggccttcggccggcccagcgggaagggggagggaaagggagaatgggccggcggcccattcaaaggaaaaagagaaaagaaaaaaaagaaaaaggaaaatgaattttctagggattaaatattgcttgtgctcaattttaattggttaaaattatttctagagctctgaaaattccactaaaaatcttgttagcgtatttcgacatgtagaactcaagaaaaattccacatgccaattcctattattatttgcattaatttattaaggtttactcttgctttacactggtattttcttgagaccatttataacttcaatttaggcttgggaaagaacttcagggtgtgacaagatgataccatcatttttttggaacatgacttacaacaagcaaagaatttaaaattgatattgtctatctttgagaaattatctagcttgaaaattaattttcacaaaagtgagctattttgctttggtcaggcaaaggagtattatgagcaatattctaatatctttgattgtaagttagggttgtttccagttaaatatctcggtattccaatgcattttagaaagctttgtaataaagattggaaagttattgaacaaagaattgagaaaaaacttagcagctagaaaggaaaacaaatgtctgttgggagtagactagttttgataattttgtcatttcaagtttagctatgtttatgatatctttttttgagattccgaaagtggttcttcaaaagattgattattatagatcttgtttcttttggcaaggtgacgatcataagaaaaagtatagacttactagatgggttattatttgccaacccaaagaacagggtggtttgggggttcataatttagagattcaaaatatatgtcttttgagtaagtggttatttatgtaaagaaatgaaaatggtgtttggcaagaccttttgaagagaaagtatctttacaataagtctattacccaagttgacaggaaacaaggtgactcccatttttgtttcttaactacgagttcttggattgtgaataatggggaaaaaaagatttttgggaagataaatagctagaaaatatggcctttagagaaaagtatccatctttatatgctattgtcagaaggagaagttcttctgttgctagtgttatggcttctgttccactcaatgtttctttcaggagagctttagttggtcagaatttaacactttggcatgaattttgtgcatctattgttcatattcagttgaataatacttctgattgttttagatggaactatcatcagaatggccaattttcagttagatcaatgtacttagctttaattaacaatggttacattgatagaaataagttaatttggaaacataagatgccacttaagatcaagatctttatgtggtatttgcttaagggagttgtgttaaccaaggataatttagcaagacgaaattagaatggtaatttaagatgttgcttttgtaaaaaaaaatgagtctatccaacatttgttcattgaatgtcattttgcaaagtttatttgaagagcagttcagttttcttttggttgatatattcctactagcatatctcatattttttatgattggcttcaaggagtcataaacaaaaagatcaaactgatacttgttggagcttctgccttgtgtcgggctttgtggttgagtagaaatgatacggtttttgacaaatcacctactgttacttatatagaggttatttttaagccaacatattggcttcgtctgtggcacagttacaaaagtgtgatgaagatggagaattcctaattgttgcgtgtcgtatgcttgaaacgaggttatgcaattgtttgccaatcatgaatggagatttaccaatagactgaaataatgttattttgtgtagtttggtttccttttaattttggttggtgtgtttgctttcttttggcctgcactcttacagagtgctagtttgtaataattggctatagctcttttgagtaaaggccggaatgttattttattccattattaaaaaaaaagaacaactcccggcatcctgcacttaggcgccaaaaaagaaattaggacccgccaaaggataaaaaattgagaccacatcagttacgtctaaatttttcatcactcaaaaaaaatatttgttttacaaaaaaaaatactatcaccacaatttaacctacaagtcatggcaatagtactggtacattgcaacaagtccaaaattaacgcaacagtaatatattgtggccagagagaatacgttagttgccataaaaaaaactgttgcaaaaaatacccttattgctacagtaattttccgtgtggccatagcccgctgtttattgcaacaaaaaataaaagtataacaacaataataaattgttgtgatataatttaccaattgccacaagatgaccagacatggcaatagaataatgcatttgccacaataaaagtttgttgcaatattttcatggcaatagcataattctctcgtagtgagattgaggttctaatcacgacttaggtcaaactcaactgatgcagctataattatgaaaagaagaacaatatctagacaatcaagccgttggatgtttcatagggtggtagataccctatataatctaagtcaacattggtatttaacctaatcggctgccctctagcgatagatgttagccgactgaaggttaaataacaatattgccggagattatataggatatatgataactcgataacttacataaacaagattagagtgtcataaagatggaagcaataatcccgagaacgcaagccgccatgacaagtttacctctagctgaagatcaaaaccgatgcagctcaatccgaaagcaagaactcgtcgagatgaaacgaaagtaaaaagggtgacgatgcgccgagattattattgaacgtgtgttaattttattacatagggctcggggtctatttatacccgagattacaaaatatgtccatatcggacatgatttttatctctaacaaactctaaaataccataagtctttgcggcagacttttgcccaagcttatctctaagaaaattacataaaatatcctaattaatagatacaattatcttcttaggactcaatccgtgcatagcaatccatatgaagcacttcaacctaacccgatgacgtgcaccgagtcgtattgtcggaatcggctcaatcggctagccttgtccgacttgaactctgccgattctggtcgcagccgattcggactctgtttcctgaacgatctctatcttagattccgcttcggttttatctccatctccgatacttgaattatcaaatctggtcgttaacacggttacgtctggactatttgagaaaatgttattaacgaatacacgggagtcaaagacactacttagatctgatcgatgaacgactaccgtatctgcgcacggcgctcaggcgaaagtgtgtcttctcaaaactcaatcggaatttgcagccagaccgttgtcgtgccggaccaactattcgaattccagctcccaggtgtactgctcatttcaccgcggacagcaacgagtcgacgagacttctgcccgcgtacatggtgactccgcagtacgcgtcggtgcatggtgccctggccgtcgatgttcttcgtcgtcggtgcgaggccctgcgcgccgatgggcgggagccagtgcagctgcctcgccgtggggcttgtgtcgctcgcgcgcgcgtacgtaaatttgtcggcgcgtacgtcgtaatacgtcgtacgcgccctcgaggtacgcggccagccagcggagccggtgcgtggccgatatgattctcgacgacgacgaggggtgagcggcagcatatatacatggcgtctcaagccgacgatctcatcctgaatgtttgccgcgcgtgcgcgagcgaccgtctgccgtgccacctcgatcgagaaccaaccgtcgcgcccactgccgtgatcagcatcgatcacacgtacgacgtgtcctcgcgcccgaaccgcaccttcgaaaacgccaacgcgttccgctggccggtggcatcgtagcagcagcagcagccagcaggacgatgaggtccgagcacggcacacatatgaactgcgggtcctttcccttgccaatttcgaggcccatacggtgcagccactagcgtcccacctcgcttaccaaacataagtttcagtcctttataaactgaggccaggatgcacttgtcgagaaacaccttgtcgtcagctgagtataacatgtaccaatttgggaggggtaaagcaggcgatcgggcattccctagccccctcctcctttgcttgatgatcccctccctatgaatttcaaaccatttaaaaaaatagaagttaaaaaaatctaatacccttaaaatatattcttaaaaataataaatgtgcatagactttatatttataaatatatacagtaaactccatacataaaaaaaacatttgaatataaattttaggtatataaccttacacaaaaagaaaattggtgccaaaaaaaaggtaagtggtgaaaaaaacatttgaatataaattttaggtatataaccttacacaaaaagaaaattggtgcaaaaaaaggtaagtggtgaaaaaaaaaatctcgcctaggaaaggcgaaaaaaacatttgaatataaattttacgtatataaacttacaaaaaacaaaattggtgcaaaaaaaagtaagtggtgaacaaaaaaaatctcgcctgagaaaggcaatcgttgtcaggagatttgtgaacctccactattacgtcctagatacgtgtgggtccacttctcatttctcaaatatcagtagttctatttttttaaaaaaaatgattgacaacatatataaggatacaccatctcgtaaaaactcaagtccaaagtcaatctacataattattagaaacaaagtaaacaaattttatagcactggaaataacgtttctagacatctgcattttgccacagttgaatcctaatatctgtacggttaatttgacttccatggttctctgaagaagaaaccgtcttcttcaattcactaccaaatatgctggaatttggatcttcaacaataggagggctcatggaactaaggaacgtagagcatgcctccttgagtttgcaacaatggtgcttctccactagcaccaacatggttgacactgagtatgtatcaatgtggttgcacaacttatcttcgtagacaaactttaacctctgtaagccatacctgtctgcagcagcaagcaactgttgagccatagctacattgtcttttccatgacctatctctggccaaatgtctgtgtagatgaacccaagtagagccttgaacactcgtgctttcatgttgtcaatctgtatcgcatctatggtgcctttcttcgtcggcccgaaaagctctgccttgaagaccagtgaccgtgccgccagcaccaaccggtgcgccgcaaacatctcgccaccgaccaggaacttgacatcggtgccttctttgcttacgaggagatcaccataatgcagatgcatgttcgacggtggtacgacgacagatggcttttcctttgggatgattacatgggcagcaatggcaaagtagtcatcattgagatattccgatcgctctaattcgtctctcctaatgaagtttttgaacccccttgcactaccagaatatgttgaaaagttacggaatttggtgtgataggtgtacgacagcaccgggttcccgtatcgatcgagcaggctgaatgtagcttttgccagcacgtcctccgatcctcggtgacgatgccctcaagcgcgaggaagatggagatgcagtccttgttgctgtcgcggcatccgtttgggtagtagctgagacatgccaggtgtggcctcctgcgctgaacggacaggagctgagggggtagtggcagccggctttcaaggtgttggagtacccgttgatcttgagtacgtgataagcctgcgccgcgatggtcatgacggtggaccgcgacggcggggaagaaccgtcgccggcgctggccgcaagtgtcgtcgccgtcgttgtcgccatgcctgcagtcttgtgttggtaggccgttctctctcgtggaaaagattgatttcctactaacagactgcacgcctgcttcttgtaggacaaagtgttagaatccaattccagctgcaggttgctgggtgaagagaaagaacttcgatttgggttattggcagcttcgtctgccggaacggccggtgcctgtgcaataatctgcacgcgtccgtgtcgctcatggtcgttgctgactagcttgtagtgtgacggtttatgtttatcgttggaggatcatttcgcaatggttgttgcatatatactgtacttttcgtttgatggtacgcggctagttgatcgaaaaaagctgtcagtgccaattgccaaaccgcctactgcactgacctgcttgattcccctttcgtatccatacgtacagttcacacaaatatttccttcgcaaccaatgacagaaatactagtttgattatatcataacgttggttacgtattttgagatggcaagagtagatctgttggtaaggataagatatgaccttcgtccttcgttctagaatataaagtacttttttatatgaatacgggtattaaaaagtagataaaaataattggaggaaaattatgataggtaaagaaaataaaataggtgaaaattaaacatagaataattaagattggttgagagaaagtgaagttagaaaatagctttattttgaaacaaattacaatgctaaaatagctacaccatacgtcccagaaagaatcaaatcctggctcggtataaatctggacgtgctcactcaaattcatagttaggatttattttttactgatggtgtatattataggacagaataagcacttttctagctcgggctatgaataattagttcttttactagataatgatgaataattagttgtcactcgacatttgtcatatcggatcgatttgggggtggataaggtataagagatgagaatgacttgggttgattagcttatggttttatgcgtattattgtagtattcacattgttgcacaaacgatctacataactaaatcatcaattatacagatctaaatcatttcaaaaaaatacggatctaaacatatcttacaaattattcttatattatccaaatatatagcatgaaaaaaaatataatactcctatattatctaaacatttttcgtgctcaaaggctggtgtgtatatagttatttttttaccaaagtatatagttattttttttgtgtgtgctgcagtggagctccattgtagaccctattctttttttttaacttatgtttaggtaatggaagtatggattattcttgacacgcttcgaagtatgatctattcaaaaacgttcatgaccatttcttaatattttgtctaagttctttgttaactttataatcatgatattttattaatatattggttaatcagcttactagctcaatacaattatttgtgacacacttcgaaaggtatgatttttccaaaaaaccttgtaaatgacaattgcttaatattttcttctgatttatttattaactttataatctatgatatttatcaattattctatgtattagtttgttagttaatcagctcatcagctcaataatgtaacacctaattattttaagttttagaccgggggttactatatgggaacatttttgttagagttgcccaccaacaccactacatgaactaataaagggctttttgattgctaccaaaatacgacctaccattgttttggtagtttgaatagtacttatgcttagtttagattgaagcccatgctagatttgtcatcaatatataacattcttccctataattcacatgttggcttcatattggtagcaaaccaaatataaccaactgcaatcttactctaccaaagaattggtagggtagcaatccatataggcctaaagattaccctcgatagcttagtttcaaaacatagtacaacacggaatagatagcaaccacacgcttttttattggcacacttacgattgatatttctacaaagatacattaatagtgctaatgggcatgttcagcaagccgactgcagcggcagcgtctatgctgcttttgtgcaatactgttggtgtcggctgtggcgcaaccgcaaaatcagtagccaaacaggaccaatgcgcaagaagatgtgtttgcgtgagagggttggacttccttcttgattaaatacttgctagaaatcatgtggtttgaaagcctatacgagattttgtatataccactggtggacaaaccctttttaatcccggttcgcaacccccctataatcctggttacgaaccgggactacgaatccgggacttaaaaatgcccatttttagtcctggttgaaataaccgggactaaaccaaccgggactaaatctttagtcccggttggagttaccaaccgttctttagttccggttggtgttcttttttctttcctgctgcttgcatgatttcgagccccacaaatcattcatattatccacaaatcattcgaacaccacagatcattcacaaaatccctaaatatatcaagctgcattttctatccccaaatacatcacaaatcattcacaaaatcacaaaatcatctccacaaattcattcacacatcacacatcacacatcacacagatcagaaaaagaaatccacatcacatagatcggccgcacacatcgcacagatcaggaaaaaaccacatcgcagagatcgggcgctggccgtccgccgcctcgccggcctcccacccagacgcctcgggctccaccaccgcctggggagtgtcgcctcccgccgcccgccgcctcggctgccggtgcccgcccgctgccacctcgggctccgccgcctcgtcgcctcgccggcctcactggccgcctgcgcagccacccgccgctccgcactctccctgccgcctcgcgctgcccggcctcattggtacgaggaggaggaggaagagaagagaagggagaggaatgggagagaagggatggaggattggatgaggctgaggatggagaagggataagggaggctgtttaattaatgagaggggaggggagaggaagggggagagaccgaggcggccgggcggggcagtggtgcacggctcggttgatttttgtcccggttggtataaataaccgggactaaaaaagaattggggtctaactcgatccgataactttttgaaccgagactaaaaatgatgttaccaaccgggactaaagatcaaaaaaattttaaccgggactaaaaataatctttagtcccggtttctattcgaaccgggactattatggattttgagcgaccgagcaaagatggtttctccaccagtgtacatagggagatttttgcaaaatagaccctttcacgcattaacttctctaaagagcctaaaccaatgaagaaaatataaataaatggaacctgagatttgaagcttgctatgcataattatgtcatatcctctctctcatgtatctgtgtacatttaacttcacttcctaaatattccctccattctaaaataaattaatcttaggatagagtttaacataacatgtcatatcatactttagatatgtttattttgggaagaagggagcagtccataaccgttgcccccaagtcatcatacaatattgttgaaactctttggtaattggatgcccatagtccaactggattattcccatcagttatgtaaggaccctatttagatcgcaataatttaaaagaaatcctagttgatggtgatcagttccaaccctttgaaaggaactgtttgtgatgttccagagtttgtttatttcacaatggcatggacagcgtttacacgtaccgtcgcacacaccattacatgtgtatataaagtttgtattcttaatacacaccatattacacatgtacgtactgtaagtttaccttcttaatacgcatccagcgtagagtggccaacagacaaatatgtgaaccttagaattttttagtgaaaatacacccgtatatgtgtaattgtggactctaagattgaaaacttttagtgcgaggagtcatttttggcacactaaaaaaggagtttctcttaacagactgtctgagaaagataaaaaattgcagtggtctataatggtgccttcacggctgcatcatgtgtacatcatggaccagagagttggtgaaagataaaagatatcgtgactgagctgcggacacaacaaagaacagaacaggtcggctgtgatcttctggggtcaatgtcttctagaaggcgaagataccaaccaacattctgtggtatgccccgaaaagctgcaaaatggagcgttttgtgtgttgttgtgcttggaataatgctaccctctttcctttttttataacgcggtgatttgaagccaaagaaaggtaatcgcaaagtaacttagcgagaaaacaactatggaaattgaagggtctgtttgatccacattaagataaactgatcgtctcccaaaaccaataaaaatgttactaaaaaaaactacaagccataagccattttttatgagagcaagttttatatagtagggtgattactacatctcatgtcatctataaactaattaagatgcaacatgtacaatatgttatctccatgtacacaaactccaacattttctttaatcgattcattatttcattttctgtttgcactttttcttgaaaattatatagaggttgcctcttgcatgagaggtggctcatgctctctcttcactttctctcctccacctcatcacctaatcccatgtgacaattttagaagcaacacatgtgcccttatagtacttgccctaatacattttgttacacggtttcaacatttgttgccagagaaaattacaaatttccgttgttggtactccatttccttcacctacccaagctcatttagggatatgccggtacatgcaaatatacatttcaataaaaagaactttgcaataatttacacagatactgttgttataatttcttaattttcaattgaatcatttctttggaatgattctcacaaaactacattcagaagacccatgcttaaattgattgtagaaatgctaagaaactaagaatgatatattatcgtcttaaaatgcaatgtgtatttttggagttggacacagacattaaaaaaactagatgaataccccaccatattgctgcggaaaattaagttgtataatatatacaaaactaaaaacaatttgatacaattttgaacctaaaagtaattgagattgcatgtttttaagagagaagaaagaaaagacaatttagaccatagatctatcattcaaaggctataaatgattggggtgatgtggcttaatgagaaaagagagaaataacattaactatacttagtggggataaactatacaagtatataagatacgtgaaaaatgatttaggaaaggctgtcacttagtgaaaagaaaatgtggtgaaaaaattcaagggaagattaaaaaaaatcacctcagaagtcacttgaaattttaacattccttgcaaatacccgcatccctctcggttttgtttgaaaaacaccctagtgcgcacttgcttaaccaaattgatatgcatggttttgtaaaatgtgaggcgtctatatggtctttaccaaagtaaaatacttctaggagtatagccttaatttttttggatattgcataaatagaattgctgatgagagtttaaacgttgttgcactcaatttcggtatatgcagaaaagaaatcaatgaaacataaagaataagtctaatgcaaatactttgctaagattgactcggctagcttagcctatggtggctctacataagtgttaacaggctttattagataagcatgtacacactgggatggtttttgcacaaaattgagtaggggtggatatttgcaacaaagtgatttatgaggtggaatgtcaaacttcaagtggcttttgggatggtttctgcaactttcccaaaattaaatgaaggatgagtgcgattagctaagacgcgagcgtaagcgaagaaatagcttaattttaggaggagtaaaaatatataacttcatgttgagactgatggattatactagtcctatttaaggatgagtaaatttcataaaactacatgtactttgatcaaactattataaaactataaatttaaaaaggtatatcacataaatacatatttaggaccaaatttatcaaataactacagatttaaggtggaagatcaccaaactaccgatgtagtaataaaatgatcacaaaacgacatgttttgtaccatgttaaatacaaaactacaacatttataattctaacataacaatagtagtagggatttaaattgtaaaatctataattttgtgataactctagtattaaatctatagttttgtgatagttgatcttaaattagtagttttctaataaacgttgtgttaaatctatagttctatgatacgacgtcttgaatctatagttttattataatttaattaaagtacacataatttttgtgaaatttacactttaatgatgaattgatttccatcatccttgtgcatgaatctagccaaatcctctgcagtattgtcgatgcagtagcaatggatcagtatcgggcccacacgtcagtgtctgttactgaatgtgcagtactgtaaagtgtaaacctccttccttaaactaatcctctattcccttaaaaaaaatctacagtatattttttttccaactcgctggccgctgccttcctccggtcctccctgagctggcatttttggcaccacaacacaacccccccaccccaccactcttctccctatcgcactccacctccccgagacgcgacgcgagcacgagcagcgcggcggcccaactcccgaggtggtgtaaagccttctcctctccgctaccttcttccaagatcgcgttcctgctctctgaattcgcggtcagtccggggtggggcgcgcgagttcttgcctcagatccgcggcggctcggtttctgttgcggaattgtctaagatttgcgggggtgtttgtttgctgctgaattgccgggtgtttgtgattcgttggctgcagcttgctttcttggggggcgccgccgcggcggagttgggtttgaccggccggtgatggggaagggcggcggctgcgtccccagcaagaagcggcagccgccggccagcaccgtcgccggcgcgccgtcgtcgtcgtcggcgccgcgcgacgcccccgaggcggaggcgtcgggggaggcggccggggggcggcggaggctgcggctgtacatcgtgttctactcgatgtacgggcacgtggaggcgctggcgcggcgggcggcggcgggcgtcgcggcggtggacggggtggaggcggtgctgcggcgcgtccccgagacgctcccgccgggcgtgctggagaagatgcaggcgccggccaaggaccccgccgtcccggtcatcgcggcggcggcggacctggaggaggccgacggggtgctgttcgggttcccgacgaggtacggcgccatggccgcgcagatgaaggcgttcttcgactccacc

SEQ ID NO: 80819 - DNA, 7271 bp, Oryza sativa
  unsure (1)..(7271): unsure at all n locations
ctcgataatttgccaatccttattagagagcttcttgtggggcataggaattcctaggtatctaaatgggtaagtcccagatctacacccaaaaagcatgacatactcattctctgcaaattttgacttgccataacaaaacaattcacttttatgaaaattgatctttaaacctgcaagtttctcaaatgtactaagtacaagtttgagatttttcacttcatcaagatcatgttccataaagagaattgtgtcatcagcatattgcaaaattgagaggccgttgtcaactagatgaggtatgactccttgaaatctcccctgatccttagccctttgtattaagatagatagcatatctgccactaaattaaatagaattggtgataggggatctccttgtctcaagcctttttttgtttggaaaaagttcccaatgtgatcattgaccttaacagcaacacttcctcctctacaatttgttcaatccagttacaccatgtttgcgagaatcctttcatcctcaaggtttgttgtaaaaaaagtccagtctactttatcatatgctttctcaaagtccaattttagaatgactccactcctcttttttctatgcatctcatggattgtttcatgtaaaattactaccccttccattatatttctccctggaaggaaggccgtctgtgaaggtctaatgactttctgagctactagagctattcgattagtcattacctttgtaaagattttgaagctaacattcaacagacatataggtctgtattgctgaatttgtctagcttccttctgttttggtaacaaagtaatgataccaaaattcaagctgtggagcggcaattttccttcgtgaaattctataaaaatagccatgagatcttctttaattacctcccagaacacttgataaaactctgcagggaaaccatcaggtcccggggctttattgtgttccatttggataatagcttgttttacttcctcttcggtaaatattttagttagcatttcattctctaaatctgatacctgcgcaatgtcctctttctgtgattccaccatggaaaaattattttcctccggtggtccaaaaagattcttgtagtatttagtgatgtacttttttaaattttcatcacctttaattacaccctcctcttgttctaactgaaaaatttagtcttcctatgcttgccatttgcaatcatatgatagtattttgtattccggtccctttcaattaaatgttttgtttttgacctttggtaccatttaatttcctcctcccttaacagatgagctagtctatttttcaagtagttcttgagatctaactcatgcctaatcaatatctgcacctctgcttttttatctaactcatctgcctttgcacttaattcaaccttctcttttctatatgttccacttgtgctttttgcccaacctctcaagaactgtcttaatcaacggatcttattttgccatctttccatcatcgtagaacccttgttttcttttctccaaacttccgttactaactcatgaaagccttcccttaacaaccatccaagctcaaacctgaacaaaggttgtttggtagcacgagttttggctcccgtatcaagtagcaaaggtgtatgatctgaaaggtctctattcagagccctaactgtagctagcgggtacttttcttcccaatcggtactcaaaagcaccctatccaatttttcaaaagttggtacttgcaaagagttagcccaagtgaattttcgtcctgatagctctagctctctcaagtctaggctgtctataacagcattaaacaagaaaggccatttgtcattgtacctatcgttattcttctcactagggcttcttataatattgaaatccccccaatcaacatgggcaaagattctttactacaagagtttaccaattcaacaaggaaagcctccttatactcctcatgggcagccccatagactgctacaaggatccattggaagccatctaccttgtttcgcacgtgaaacttgacataaaaatctccttcgtctatgctagacaaattgaacacctccaagtttactcccaggaggatacctcccgatctccctctcggcctagtccaatgccataagaaatctcttcctccgcaaatatttttaaggcaagaattagagaagtcatccttgcctgtctccaaaagagctatgaagtctagcttctactaaactaaacatgacagcccattttagggttctcgttctcatcaacaccccacttcacggcttacctctttctctcagcaaacaaggaactaaataactaaaattccagaacatcgcccaaaacaacagctgcttggtgcaccgcccccaactccgctgcaaacttcctcgagttgccaaacaagccgcaccccgacaacgaacgcttctgcagatcaacggcttagccgtgcacagcctcgagtatatagcacgcgattggttccggcgtgcccacctcattgggatatgaggagtaggggtgggaggcgtggccgcgtggcgtgaggcctcgagggccttcctccaggtcaggctgagcggcggcgtcgcggccgatccgctccgagacgtggagccccgtggaggccacatcggggccaatcgcctcgtcctccgtccaagccatcgccggagcaatgcgccttttggggggaggaggcgcggcatggaaaaccctagagcgcggtgagggggggaagtatgaggaacggcgggatgggaggttcggttggggtttttcaggttttgctgcggcgcgcgctggggaaatttccctttgccggttaaattaccgctagcaccgcggtggaaaaatctccccgcatgaaaactaaaatacacatgactttgctagtttaactaaggatgagtaaaaaatttaaaagacatcatgttttcagatcaaatttatataaagtcaaacatttgatatttaaccatatattatgattttaaagttttataaaacctcactcttattcaatttaagcgtgaatttatttaaaaatatatacatatagaatatatggaatttttaattattaagttaaggttgatacttaattctttcttactattttaaaatattttttatgttatgctgaaatttatcatgatatcaatagagtagagattttatgaaacattgagacacatgtgtcagtgtcacatgtcataataccggtgtttttttttttgcaattttgaccattaaacatgatgttttccagaaattattcttaatttattgaagaagtccaatttacttttcaaactatttcattggatcacttaatcctccgtaaactattcttagcttagtttacccctaaactattaaaaattcgtaaactattcttagcttagtttacccctaaactattaaaaatggttcactctactcataatattttttttctcttttaagttgcattgtaagctgactttttttaaacctcacatggcaccatttttccaaaaaaaaaatcatgattgtttgcttgaagttttttattcatgtttaaatgtcttattgtttccaaactttgtacaattctataaatggtaaaaaaaatgttgagacgtaagttacagtgcctctatcatcctacccaatttccagtgcaaaatatgaataatatagagagagaaatgaaagagagatattgttagagagcaaagaaaaatagttcaagggtaaagtgagacaaaaaaaatagtttaagagttaactgctccaatgaaatagtccaagagagtaaaatatattttcccctggtttatttaacagtagggacggaatcttgtcccgacataaacaaggcgtcattccctggcgaagagtagttaaggcaactcttagtggagaagtaactcgagttggccggtgaccaggcaaggtgcttcattgcctcgtcatcctaatgaagtggtgctagatcattggtcttcatctttacgtcatttttgaaactcatgagcagttatacgctcgagtcaacttgcgtcatcatcggttggtcatcatcggcggcagaaggggcgcgatgctacttcttgtggcaagtttgagcatcctggtaggtgacatcgaagattggccagcgtcggagcgctacacctacttgatggttgggcattgccgatgcaaggtggcagctctgcttccgcttggagtctaggcgaggtcgaagctagatgtctttagcatccgctttgtaggtcatcttgatggcgacaatggaacttgcctttgttgtccatggtgttagcaggaggtcgctgtccatgcgaaccgcctgtctaacccctccccgaagtcgactgcctctacttccatcgttgtcctctagtggaatcaaaatgatcacggagccctcgatgaaatgtgccaacaaggtgttgatgaatttggtaccccacaggccacaggtatcgagcctagtatctacttggtacccacccgacaccgtactattttggatcaagagcatgtacaatagtaatcctctaatcagtgatatatcgtataatataaaagaaatgataagttatactaaccaaatgatgaatttacttttccaagtacatgttgtgttgagaaaaaaaaagcttgacgtggtaaattctttgactatctatatatgtttatggtgttatatttctcattaaaaacagttaatttatggtgttatattttgactaacatatgtccacgtttatatcaagaagttgttttttccttgggacggagggagtacgttgtaacttacaaatcctgcatggcactcctataaatttccaaacttacacgatacttctatagaactctctccgtactcgtaaagaaaatcgttttggacagcgacacaactttaacttcttatttctataaaaatatttattgaaaagtgatatatgtatacttttataaaagtatttttcaagacaaatctattcatataatttttacattttcaaactcaacaatgtgagagttattcatgatttatattcccaaggtttgacttaaacaatatcctaaacgacttcctttacgagtatggagggagtatacatgacatactaccttcatttttcattctcaaaaggatgacgtcctataatacgtgcaagaacattttctagaaaaaaagtattatttactccatgcttaaaaaatacattttctagagaaaacgttcttccaccatattatgtagaccacttacttggaactatgccaagtctatttttcaaaatatattgacgtaagtatattatacaagacaataatccactcaaaaatctgataaaccaaataggccccatgattgagataccacgctctaatatgccatctctctgagtaaaacaaaatggccaatttgttacggtaccatcgcaaaaatcaagttgttggaaaataccatcgtacgtgttgtttgacacgtggatctaggctccacacatcattttcacatatgaaattattttgtaactcatgtatctttgtaatggtattttcaaactatccaaaacaaaacaattaaagtagtgtctctagcgcgcgctctctctctctctctatataggatactcatatgggactccatggtgcccgggctccaaggtataaaacacacaaattctctcaaatttttaaaaattttcaaattgtgacctaggtatatgaatttgattcatacaaatacctaacaacaaaacaactcaaactcaactttatttcacaattcattattacatacctaacgaattatatgtttggatgttatatacctagaatcaaaatctaaaaaaaaagttcaaactcagttcaaacttgtttgaacttgttagtaaagaagttaatgttcatatctaaacatttaaaaaaatttcatactcattcaaattaggtatatacttaatttgaatcttgaagcccatactccatgtagcactagttaatttacccctatatatatatacacacacatatacatacacacacatttctacttatgtcgaccatcgagtgataataacgtcagtaatttagtttacttataaaaatactttagctcagtgaaactaccaaatatcagtatcaccacttaaaattactcagcatatatcacccttcatcgaaggaccctcgaacagtcagaactcaggacagtcactcacacagtcacactcctaacaacgaggactaccagcctatgacgaacaaactaggaacaaaaaggccggaagataacacgagcagccgggcagtggctccttttccgtggaaagagaaacctggacacgactacagggaccaccccgcctcatatgcacccagtccacgcaccacctttcccgtgtcctttctcacccctcccaccagcgcggtcctcctggaccgagctcacgcacccgtgcccctcctggctcaatccattagctgtagcacgacgctcagtccaccgcgccaaacctgcctagaccgagcctcctgcaccgcactctccgtccacggggcgcgtccccacccgccagcctcaccgcccctggacccgcacccacgggtaaacacgcgccgttaatggccgccgcaacggtaaacgttaccccgtgtgggaaggggaagagagcagccgcgcccggatccccacctcctcctccccctcctcctccagatcacaccaccgtcgtctccaacctcctatccattgagataggcttcgtcagggtgccccgcgagcgagcggaggtgggcttaggtctttagggtttggcggggcgctccccctcgtggtctctcgtcgtcgccttcgcctgttcggggggctagggntgcgtcgccggtggggggngggggtgcgggtgcggggggcgggcggtcgatgcggcgatcgcgggcgatcgggagggtgtagcggcggcaggggaggggggatctccttggcggtttgttcggagatggccgccgacgcgctctccatcatcccgggcgccgtgctgcgcaacctctccgacaagctctacgagaagcggaagaacgccgcgctcgaggtgagggatttcggctcgtcatagggggtctggttttggaacaatcgacgatggatttgagctggaattgtttttgttcgtggtgggctgtttgtgtatagattgaggggatcgtacagggctgcaggaatt

SEQ ID NO: 80820 - DNA, 6276 bp, Oryza sativa
tatattaaaataacgcttctgatagatattggaagatttccagatcaattggtgaaaaaactgatgcataagctagccatgatcgcaattattattattatttttacaatctgaaagaaatctgatcatttcagaagtgaaactatctctctcaaaaagaaaagaaaatacagaggagagaggttgagcttccccatcacaccacaggatgagggagttgctaagtactaaattagtatgctattctcagttgcttacctgcctcaagtaggttaactgccctctcacttcatccatgtcctcatgtccctttctcttccttgctataatctctctctctctctacgattagttaatgtcaggatcatctaccatatatgtgtcttctctcaaatttggagttattggatgcaacattagagtttcttggcaataatttggattgaaaagattcagatgttagcaacaccacatggcgacgaaatgtcaggactccttgtgaccttgtccatgaatacaagcatactatatttgcaaatgtaaactacttaaataagatgtgatgcctttagaattcatacaagagcaacaaaacatgccctacgtggattatcgccaatgatcaaactttattcttcaaccaatgaaccaaagcaacctagcatcttaattaccaactgaactataggtagttgcattacatcacatctaggctgaaactaatacgatgcttgcttcaaaacagaatatacagattatttctgaaatgctgacatgctagtgacaagcatggtatggtaacatgggagagctaatgctagtgagatatacataagatgcttgagctttctggccaaccatgcatgctaccattttgtctggttttccttcctatttttatgagctgaaagcaacagcgaagagggaggagtccgtggtaggtatgaggcatcttcagggtgagctagcagctggtttgcatggcaccaattttctcacaacaaatccccaaccaaaatgcatccaaggaagaaaagggaaaggaaataaaagtaaggaggacatgaaaattgtaccaatggttgttgattatctgatcagcctgctaacctcttctagaaatgggttcagaacctgtacttctgagagggaaaatgacaacaaattccaataattgaattggattgggttatttgttaggacaaatgcatggtgatgtttgcatctgatcagcatctgacatgcttgcactgcacgcactgacttgctctgcaaatgttggcgcagagcagcagcagatctgtgcattaacttgtggagatgtgaggagtaaaggtagtacaggcaggtgatccacatgtatgtgagtaactctgatgatctgatctctgaagcccattgcagtaatatgcagctgttctatggatcacagatccatggatccagccaactgctccatcgtgggctccattaacaagctgtttgcactttgattaccctgaactttattctatccataaaactgagattgtcttcaggaaaaaaaaaggaactaatctaattccagatactacaagacaatgaaaaacaaccggcggtttcgttaagtgttcaactgttcatacaccaaggcaaggaaccagctacagttgaatagtgccctcaaggacaagctttctagaaattttgccagacatgatccagaccacgagttacccagatgcaatcccaggtctgaattgaaaggtactaaataaaagccaacacaataatacaaaggtgtcccatgggctttgtctgagcccttaagacagaatgtacgaatcaaaagttccatatccagcatgtgtaggggaaactgagttactgttccaatgtaccctcgactccatacaattaacatttcaacatttcatgttcatatgagaacgcaggagatgccaccatccacatcaggattaaagagcgtgacaagatcatggcatggcatgttcccaaaattaattctcttctacaggaccatttccttcagtgcaatcactcttgggcgggcaaagatcatgattcttcgtcactttcattgccaaaaaccgatgacatttttgtagcaaccttaggtttcttgcttacattgccaactggagcctgtccgtgcaaaagagtagccaagttaacaattagatactgctgcaaaaaataaccgataaaacagtgtttttttcttaaaaaaacaacctaacgtttggagctcccatgacactacagtataatggagtttggtggtgcacaaagccacaaagacgacccggttgacatgtcgaaaggatagtagtatatgcattatattctcactttaggccaaataagttaatgtgtcaaaagcttctagaagagcacatatgctgagaggaaattacagtttaacaaaaaagcctaagaaagtttcaacttaacggcaaactagagcaatgaaaaaagaatggagaatatagaaaagataaaacaaattcacagagttccatgcaagcacacaactactttacttccataaatggtcatatcagtttaacaaaatatgttgttcagatgtggggtaccttggaaggagccattttggagaagccaaacttcaaggttttacgctgatcctgatttgaagggttaggcaagttcttcattgtaattctctctgatgagctctctgatggttcttgcttctgctgctgctgctttctatgagcatcagcactgaagtcccattaaggaaattgcaagttcaataaacattcagcacatttgttcatagttagcacatcattgagttatcattgttattgactaaaacatgggatggatacagttgagcaaattttgccagctccttctcttctcgttgctgctcacgtttctgcctgtcatcacggctgctgctgctgctgctttgcatttctttcatttccttgaacctctgttgtaaccacagtgaacttatcagaaatatagtcctgaacaattaatatgtaagagtgaagggggaatatatgtatgtgcacccatacttcacaaaagaaaaggcagtagaagagaagttcgctgcaccaagtaaacacattaccttcctatgattgtggtcgtatgagctcaaatgagactcaaattcatgcgccaatttgtactgcttgttacagagactgcaaaagaacaccttctgtatctccttgacctcactacgtattttctgctcgcgttctgctatgacctggattgtcatgatttgcaccaagcaggaaaaagaaccaccaaataaaaaatgcccaaaatgctcaaggatcatgagggctgatgctagcaactcttgcatgaataagatacaaatatcaatatgtaatgccaacagctagatataagatttcaaagtgcaagcatcaaccctgaagaaatagaatattaaggaatcagtgttcgattgcacacctcgcgcttctttatatgttcttcagtctcctcaagctctatgtttaatttcctcctttgcacattatcttctgatgtgaagaagtcatcttgctcttgcttccccacacccaattttgcatctctgataccagcttttattggctctgttatacctatataacattaaagagaaaagggcattgtcgtgaaggtgccagaattttagcagaaaatattaaagcgatgactgttttttttttaatcaatgatagtaactagttagaaaaatagagagaactcaacataatgatagttaaaaattttgaatagacataaagggataactaacaaaagaggttaaatcatatagttcagtcaagtcgttatgccacagacatggtgattagttatgactagtcttgtactgctcaaacagaaggtgcagagagaaagggggaaggttcagagaagaatgaggaaggagcaaggattgatcaacaaaacaaaatagaggaaaacagagtaaagtaacatcaccaagaacaaaaggttgcattgataggaactacagcaagtcattgcattgatagattttcctagtttacacctataaaactagcctgttgaaagaccagatattccaatctagtgcctcccaacagagcaaccttcacaaacaacaacgtgataattacggaaaatgaagcataacagattggcagtcaatcatctcataaaattgctcaactaaccttaacctaatgctatactccctctgtcccaaaagaagccaacctaggaggggtcgcatcctagtaccacgaatctggatagccctttggccagatccgttgtactaggaggggtcgtaagcctagaactagaatacctagaactagaacacgacagaagcaagaaccgccaacatccctttaaatctcctatcccttgccaattcagttattctccattcgtagccatgcataccataatatgttatgcatgaagaaattaaacctgaacttagcctaagacaagattttattagagatgcatgcaaatgtagtgacagttactacgctcacaaaccacaactacaaaactaaggaattcaataaggattgtggaaactggtaagcttaagatggcagagccaagtgttgaaacattaagctgttgctgacagtgtagtttgaaaagttaggggtgtactgcaatggaggtaaacaagatggagaaagcaagtgagcgaggtagagaagatgaagttttataccttgctcgttcttgccgagccccttgcccttccaccccatcttctggagcagcctgaatccgacgttggaggaggtgagctgcgtgtcaacggacgcctgctccagcccctccgtctcgaggttctccgtggggcggtggctcatgggcagccggaactcatcaaaatcatcctccagctcctcctcctcttccaccggagctccatgaggattcctgctgctgcttccgccgccgcgatctcgcctctcctgaacaacagaaatcggtcagatggatctggagcagatcggaacggagaggtgggagtggttgctactcaccatggcttcgtagacagacgcgaggtggggggagggatgctagggttttcgtcggagacgcctcgccgccgccgccgccgccgagacggagtgaggagaggggatcggaggtggttgccgtacggttgggcctgaacgggcttatattgtgctccgtgcggcccactaatattgggccgtaacgtgttggttcggcccacgttgaccacggctcccgccagaactcgactttggtggacttccaaaaaaactcgaatttggaaaatgaaaagaaaaaagaaaagaaaagcatttcttgtccgagtcgaatcagcagcagcagcagcatgtacaataacaaataaagctgagaatgtacaataactattttcagttttttttacaaattataaaagttgaatttggtattgcatgtttgtggagtgatatatttcatataaatctatgttgtcaatttttttcgaatattttgataactatttagtggttacaagagtctcagtagcaccttaggtcctggttggactcctcgtgggagcgaattttccaggatttaacggctttgtgttttcagtggtaggcgatgtacccgtcgacagcgaggcgcctgtggtgatttcgtcaatctccaagatggatttgccggctcagttttcgaagatgctcgtaggggtagggtttgcgtgtgttcataggggtgagtggatgtgcgttgtgagtatctgcgttgtactgtgtaatttaaaaaaaacgaaggggtgtcctcttgaggaatgaaaatccacatccacattagtcgcatggtgatttgagggtatgccgacacgtctgaagtggaacttggtgaagaaggtgaggtcttcatgatctcacccgagtggtttgacgccaactcaagggagaaaactttagggtaggtctctgccgtatttgataaaccaaacggagtggagtggttgtctcctaccgactggtttgaatccgagctaagaaaagagatcttgccgaaattgtcggtgatgaagtcaaggctgccaaagcgatacacctgctcttgggggaaggcgaagtcgtcgatgcctgatgtagatcccatcgcactagtcggcgagaaaacttgacgctgcccctacctagcgcgccaactgtcaaaactatatttcagcaatactaaaaggggtagcgaacaagtaggaaagtagatgggttatgagataaaaaa

SEQ ID NO: 80821 - DNA, 5097 bp, Oryza sativa
atggtaccgacgagaccgtagtcgagttggttcaactagatctcccagcgacttggctcctgtaggctccgacttcgtagctgtgatggatgtattggcggtgagattcgatgccttatgtcctgcccagggggtcccttttataccgcgggtcagttgatctccaagtaggactcggagatatcggacccctcacgatatggtaacgacccagtctcgtccgagtaggactcctcccatatgtggattctgtttctatcacgtgatagatttccttaacgtgtacaggaactatccgtatacgcgcgggtataccatatcagtatacaacgtatatccaaggatagagggtataccttatccgtaacactgacataatgtactcacaatgtttcactatgtatagattcaatgttgcagtgaattgaaacattcttttgcaacaaaatcacccacatattatggaaaccctctattaaggaaattcgttttattttttttctaccaaaaatgtttcacctagtgtattcgtgatgtttcactatgtatggattaaatgttgcagtgaattgaaacattatttcgctatttgctgaaacattgtttttatataaggtgacacccgatcttaaacgattgaaacattttcgatctacttagtgaaaaaattccaatacacttggtacaacagcgtgcaacatttaaaaatagttcaataataagctaattttttttcatcagaatatatccatgtgtggtctaattttaacgatttaattgcaacaaatttaatggtacaatcgaatcatgatttggataaataatttaaaagaaaaaaaagtttaaagtggttttgcatgcatgcatgctgacgtcagctgacgtgggcgcctgatttttttacacccggatcaggcgcccgacacctagtcccttcctaatttgatatatattgtacatattactattttataaactttattcaatttaagaaatttgacttatgataaaaaccagaaatatcttattttattggaggagtactacatttgtcacgtgaaatcaaaggctctgattctttaattttatttttgttaagtagtcgtgaggcttcggtatattgggcttctgtatcttccagttgaattaattaatggttggttaattcagtactccacaaagacagcatatatagctatacgtatatagaccagctgttcttcagtcctcatctagaattttctgccatgcatatatatggaacttaatcatccgacgtgcgtgaagtcagtcatctatataataatctacagtagaaacgttgccgccgcgcgccgccgcttggcagccggcgagtacgtcaccaagtcatcatcaccaaccaccgaagcgtgacgccgcgcctgtccggcgtaagatacgtgcaggtacgccagtagtgactgatatggtttcaactttagtacaagcttagatcggtagtacgtccaggactgaacggtatctctcacctctcacccggatcggacttttcccggctgaccagtgaccagaaatgtcaactaaactaatcgcatgcagaaaaggagggttgaagtgagcagatttactacgatagcatggtaatttaattcgtactatcttctattttgtccatttcgaaacataacgtattgtatatgcaaaggcgttctaatttgaaaacattctcaccgcgtccccactaatgcaccctccatactatacatagtagctcagatgtgtgtttgaacagttcaattcaaactcatcacgcatctttgttaactggtgtcacgccccgaactagtaccgaccggaactagcccgtgacgctccaaattaacctgttgatcgataccagtcccaggaaacagtgctggtatcacagggagacagaatatcacagcaacaacggtctctttattatagagtacggatacagtcatgttgggctacggacagatcccgagctcacaactgcattacaaaagggaaacggaagcaggacttggaccaaacaacacaggcgcgacttgggaactaggccgaaaccctaaaactcatcgtagccggcttgctcctgaaagaactcctcatcagcaggatccgcttcatcttcttcagcaactgggggggatttatttatatagagcaagggtgagtacgggagtactcagcaagccaagggaaaatagatgtttaatgcaggcttcaaggaaaggctgttgtttttgcaattgattttagttgaacacttttctaaaaacaactaagtgagtgcttctcaaacgacacggctgagacggtgcgtctcgtccggtcggagtatgtgcaatgtatcagtctttaaaatttaaaacaaggttggcacccggccaacagcttttcaaacggacacccgggccaacaactttcaaacggccacccgggcctagctgatcccatcagccgcagatttttcaaacagcgaacccctttccataacagcaatttcacaagcagtagtcaaataaaactacgctaggaatcacctcacatccgcccatgaccgtgggcacgactgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggtgaatccacatgtctctcgacatcaaggctcccctgataagctagttactcagccaggggtgtcccattccacccatgtggtcgtacttgtcttatgtttggatgaaattccaaggaatcggtccttaagtgcgagagcgggaaaaaccatacacccggtacgttccccggtccgcggttttggaaattcatttagttcgcaagcgccgacccaggtgtcgggttttccaagtcttttgtaaaactccagttttacccaagttgttactcagattttaagtttgaaggcgaccgtcgatactcgcacagagtgcacgaatatcgaggcgcaactggatggttacaaggggacatggtatagcaattaacaatggaaggatcaaatgcaacaagttaggtaggtccgccaatctgccttgcagacgggacaacatattaagtgcgatcctattaatgcataatattttgcaagcaacataattaaatttcaagtataggctcaagatgttcaaaggtggcttgccttgctaaaggtctggagcttgatcctcgaaatcctcgcactgcgggtcttcgggctccggaactacacgcgaaacgggacaactcaacaaacggcgaaaatgaagccctaataatgacctcaaagcgtgccattagatagatctcgagatttgagaaattttggaagttgaacggagtcaaacggatttatggttgggaaggtattgaatttctaagattattggatttttggtctaaaggaaaaggatttaattaaatcctttttggaaaagaaaagaaaagagggagggaaaatagacttttctcgggcggctagggcgcggcccaagagaattggggcggtccggccgagctaaatgggccggccagcccaagacggtcgcgcgcgtgggagggaggagagagagccggtggaccgggctcaccgcgcgcggtcccgggtgggacccgcttgtcagcggctcggctcaccgtgcggagggagtacgcggcgcacgcgcgcgggcgggggagggacgcggtgcacgcgcatggtctgcggaggaacggatgcggcgggcccacgcgcagcctcacggctcgcggtggaacgcgcgcacgggaggggctgaccggggtcggcccgtcccaacctcggctgagctggcgccgacgtggcgcctacgtggctgccacgtgggctggcgagaggtagacgacgacgccggccggaacggacggcggacaacagcggcgagcggcggagcgaaccatggcgataccggcgaaaacgagcacaccgggtggttgcacgagacgaggggagacgagccaacggctcggattcgccggaggaagcttgacggcggcaaatcgcggcggcggcaaccggcggtgggaaaaggggaaaacggcgacgaggtcacgaggggccgattcccggcggtgagagcatctacgcggccacgggaatccgatggtagcgtcggattgggcggagctacgccgagcgaggctggcgacgagcgggtgctacgaagctcgagcggcgacggcggcgagcacacagcgagcgatggcaacggtcggggcggcgccggctagctacggggaggctactcgtgctaccaccgaaaactaaggggaggagatggagcgaagaggaagaacggagggaggcatcaccgaggtgaggaggggcgctgtgacgagaggccgacggcgcgggagtatctctccggcctcgggccggggaggaggaaggagagggcgcggccgaagtccccttccgcgtccttgctcgtgccggctcctccgacacgcgcaacgacgaacggcgacggcgaaacagaggggcggcaatggcgcggaggtgaatgggagaggaaaggaaaaagggggggagctcgggtttataggatggcaatgttggtttgggaaccgacttagggcggtcaaaggagagggctagcgctcggcggtcgcggccaaagcggcgacagggagaagggaggaggatgaccccggcgggagggaaaaaggggaaaagagggagagaaaagggggcttgtccccttgcctcttcgggaaaagaaggagggagcgggggcgtcgcggcagagggaggagggaggctctgcctccgtcccttggaggctagcgcgggagtggcggggccgaggcgatgacgacggcaatgacggtggggcggtttggagcggtgcgacgtcacgggcgacaggcgcgggctggcgcggcagagggt

SEQ ID NO: 80822 - DNA, 45855 bp, Oryza sativa
gcaacatgtaggctgcaccctgcattttctttcataagtgatggttgatgcaatgcaaatcctagtcttgctaggagattacaggaaagctaggtgatctgatctgagcaaattcgcacagttttgccagccatttgttgcattagttagagatccatctgatccatatacgcattacgattaattgtgttacagaacgtatttaaaaatactgatcgatgcatgtgtcctactagtatatatgtacggcaagacaaaagcatgcaggatcatgagttggacaaggagcaggtgaaccgacattatttacctttttctttgcgggtgggccccacgcagcagcctatgttgctcgctgagctgttaaatttacattgtgtgtccaatgccattgttaaacatctacttccttcgtcccaaaataaaacaacttttatatatatatatatatacacaaattcatgcataaatgttaatttgtttaagtttggaaaggaataccctcaaaaaagtttagaaaggattgagaagatcgctagagtaaaatgcaaacatgagagtgcagcgagattatacaaattatatatggtggtactattgaataaactttttgttgtaattgttaaacttccatgtggaactataaagattgctttgggaaaaaaatgcgaatattaggaaggaccaaatatcaaataaatagaagggatgagtcttcgaactcaggccggctagctcaccaccatgtggagctggccggagtacccctgggcttttctctaaagattgctttggttctaaagataaatgcagaaatgtatgaaataagctctttttatgttttctaaagaagagggaaataatatcatatcattggttaaaaaatgttaagagacacaaagaaaaataaataagattagctagaatcggaataattaacatatcataattgtagttctattttagaagagagaaggaacctcacactattgtgtaacaaaactgtataatataacaagcccccttgagtaatatttaacaaatacagcatgtataccaactcaaaagaggacatgtgtataattaatataacatgatatatatagttgaagacaccatcagaaatgctaagcctagatatatactactctagctaggctctagctagctcatatatatcaattaatataaaaatattatattaaagatatatagttaatttgcaagcatatgcatgacgcaaatggcacgtttaattaatactatttgtcaaaactgcatcaagtggaaacaatagtgcacatgattccatttgaaacttagccatgtcttcatgtttggcagtgctaaccgagaacacaacaatgcatcttctacatatttcacctaataattaacacactgacaacttcatgaagctttcaccgaaaatatttgagatagatcacgtgtcacaggccggctcaataacatggtacaacttagattgggagtataattaaaatgggcatagctaggaaggcaacagcatagaacattgacaacataatgatcatgcatgtattaagacattgacccactctggcaaaatctagtctaataaaaaactcacaaggttaattagaacattcagagatggatctcatcatgtcctgatggtatacttgtaaatgcaagtcgctttaatcatacaaggatggattttaaaaaaataaactcttccaaaacttatttctaaacatgaaccttttggcatggcgagacaacaataccatgtgcaacccatcatggcgtgacagtgttgtttcacctaagtggggtggtgtgaccaaaaggtttggattggaaataagttttggaatagtttacttttgaaatgaaaaaataaaaggttcaaaagaaataataaagaatcaaaaggatgtgataagaaaataactcaaatcaattaattagttgctctttatttatgctacattgaaagaaatgagttttttttaaaggaaaacaaataaaacagatgaaaatgtgttataaatttagggaagaatttaaaagcaaagatgacgacttattttcagttagcaactactccactatagctctaggtgaattggagagctactagctagggatctttgacttttgccttctgtttggttaatttcaactttcaagtatcatcattgcgggacgttgactttctaatcctagtgagcaatcaaactttgataatcgtgtcacattaactaaatgagacccatttaagtttaacaaacaagcgttttgacatagtaaagtaattgctgattatcaatggcaaccccttctcatgtaacatccacgattttcagagctcaaggatttgtctcagcaagggatggcaattgtggagattatgggtatcccatatctacacggcgatggtattcgaactgggtacaggatacctaatgtagatagaatatcttatctgtatctcgggtttgtttcttaacttgtgtatcaaggaaacaccctgagacttagtcggttacgactgtatcttacttatattttcgtattccgttagggatatagattatcttttgtaacccggactccttccccatatataaggggggtccgggcgcctctaggggcatatgctgatttttcccgaatcatacaatcaataatacactcggcggattcatccccggacaggagtagggtattacttcttttataagaaggcctgaacctgtataaatcttttgtctccaaacccatacactttcctagcttgatagccacccccttttattattgccgaaatctagtttcgacagttggcgcgccaggtaggggtagcgtcaagcttttcgccgatcagtgcaatgggttccgtctccggcatagacgacctcgtcttctcacccgggcagacgtttcggttcggtagcctcgacttcatcaccaacaacttcggcaagatttctctcctcgactcggaatcagaccagtcgggagagaaccggctttcggtcccgtttggattcccgaacgcggctgaaagctacttcaagaccatctcaaccgagtcggcttcagaccactcggccgagatcgcatcttctccaacgataccagatcaagatgatggggcttacccaccggtcctgatgaagctccccgacgatttagcggccgtcttcaccacgacagcgtcttcatcccgtaggcctaggcggaagtcggcttcaacaccgatttcgcctagcttcagggaagtcggcgtcatcctccaaccactcggcacggtttcgacagatcagctggatgactacaacagctctcccaccgtcgactcacgtcctactgacatcgtggagtacgacgaatttagttctcgatacaacgacttcaacgacttcgacgacttcgacggaagcctagatgacaactacacccctctctactttggcgttttcatggccaataatgagacggaggagcaacgccaagcccgggagaccgaggaacgacgccgactggaggaggagcatcaagcacaagaacaagaacggctacggcgcgagcagcaggaccgtgagcggactgcgaaggaggctgaagatcgacgtcagcgagctttggaagcagggcgccgagcgcgtgatctcatcggccagcaagatgtcgaagggacaccggttttccgcacccctcaacagaatgcggttgccgcgatcacccttctcgacaccctcctcaaccaaaacgagctcaatcaatccgaccacgtcgtcaacatcttgaatcagacgaagaccatgattgcggcgacggtcccagttaactccgaaagcgtccacacgccgactggcagccgggtcccccacttccgatctcatgactaccgtcatccaagcctcagcatcactggagcaggatccaatcgcaggagcaggggccacgacgagcggtctgttcactcgcctcccgaacttcatagggagcgccgagtggaacggcctcgctcaccacctcgtcgccgccccatcgatcttcgcgacacaatcatacagcgccgagcagctcgaggctaccatcactcgccggatcgccgcgacgacgaccttgacggagttgcagccttcaccgacgacctgcgtcgagtggattggccagccggcttcaaaccgactggaatagagaagtacgacggtaccactaatccagaatcgtggcttaccgtctacggtctcgcaatccgcgcagcaggaggagataacaaggccatggcgaactatttaccggtggctttagcagattccgcccgatcttggctccatggattgccccgtggtacaattggatcttgggccgaactacgcgaccacttcatcgccaacttccaaggcaccttcgagcgtcccggcacacaatatgatctctacaacgtcattcagaagtccggagaatcccttcgggattacatccggcgattttctgaacaacgtaacaagatctccgacatcaccgacgacgtcatcatcgccgcgttcaccaaagggattcgccacgaagaactagtcggcaagtttgggcgtaagcctcccaggacagtcaagctcatgtttgaaaaagccaacgagtacgccaaagccgaagatgccgtcaccgcatcgaagcagtcgggtcccagttggaggccgaaaaatacgccggctacgggaggaggtggaagtaacaatcataaggaccgcaagcgtaagcctgaggaacttgttgcaaccgccgctcactcttctcgacagcgttcgcgcgtcaacaccttcgacaagatcatgaactcccaatgcccgcatcatccaaactccaaccacgtggccaaagagtgcttcatctacaagcagttcgcggagcagtacaccaagactgcacggaagaactctgacgaagaacaaagcacgtcgaggaagaaggacgacggcgacaccccggcaggttttcaagatcaccgtaaggagctcaaccatatcttcggcggccccctggcttatgagtctaaacggaagcagaagttgactgaacgggagatcaatgctgttcagcccgacacaccccagtatcttcgatggtcagagattgcaatcaagtttgaccgctcggatcatcctgaccgagtggtccacccggggcggtaccccctggtactagacccagtggtccgtaatgtcaagcttcgcagaaccctcattgatggtggcagtgcactcaatatcctcttcgccaagactttggatgatatgcagatccctcgctccgagttaaaaccaagcaatgcgccttttcatggagtaattccaggattatccgcaactccactcggccagatcactctcccggtcacttttggcactcgggaaaacttccgcacagagaatatcagctttgaagttgccgatttcgagacagcataccatgccatactcggacgcccggcgttagccaagttcatggccgtcccgcactacacatacatgatgatgaagatgcctggtccccgaggagtcctaaccctacggagcgacatcaagcaagctgtcacatgcgacaaggagagttgcgacatggcccaaacccgcgagatggcgtctgcccgagaggaaatccgactggctgcaaccacggtgagcgaaggagaagtgcccgctgccaagatttcaaaaagtggggaaaccgaagccgagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggaattgaccaagctgttagcagcaggcttcatcaaagaagtccttcatcccgactggctggctaacccagtcctggttcggaaaaagacagggcaatggcgcatgtgtgtcgattacactgaccttaacaaatcttgcccaaaagatcctttcgggttgcctcgcattgaccaggtagttgactcaaccgccggctgcgagcttctcagttttctggattgctactcggggtatcatcagatccgactgaaggaatccgactgcttgaagacttcattcatcacgccctttggggcatactgctacgtcaccatgccgtttggattaaaaaacgcaggagcaacttatcaacgtatgatccaaagatgcttctcaacgcagatcggccgcaacgttgaagcctatgtggatgatgtagtcgtcaagaccaagcaaaaggatgatttgatctcggatctagaagaaacctttgcaagcatccgtgctttcaggatgaaattgaaccctgaaaagtgcaccttcggagtaccgtcagggaagctgcttggctttatggtgtctcataggggcatccaagccaacccggagaaagttactgctatcctcaacatgaaaccgccaagtacccagaaagatgttcagaagctgactggatgcatggcggcgctcagccgatttgtttcacgacttggcgagcgggggatgcccttctttaagctgctgaagaaaacagatagcttccggtggggacccgaagcacagaaggccttcgaagatttcaaaaaactcctcaccgagccgccagtcttagcctcaccacacccgcaggagccgttgttactgtacgtatcagccacctcccaggttgtgagcacagtcttggtcgttgagcgcgaggaagaaggccatgtccagaaagtccagcgaccgatttactttgtcagcgaggtcctagccgactccaaaacgaggtaccctcaggttcagaagctgttatatggtattttaattactaccaggaagctatctcattactttcaaggtcactcggtaacggtggtcacatcatttccactcggcgatgtactgcacaaccgcgaagcaaatgggcggattgctaagtgggctttggagttgatgtctttggacatatcattcaagccccgcacttcaatcaagtctcaagcgttagctgattttgtcgccgagtggaccgagtgccaagaggatacccccgtggagaaaatagagcactggaccatgcattttgacgggtcaaaaagactttcaggcactggagctggagtggttttaatttccccgactggagaaagactaagttatgtactttggatacatttttcggcgtctcacaacgtcgccgagtatgaggcgctccttcatgggctacggattgcgatttccctagggataaagcgtctaattgttcgaggtgattcacagctggttgttaaccaagttatgaaagagtggtcctgcattgacgacaacatgatggcatatcgacaagaggtacgcaaactagaggataagttcgatggacttgagctcagccatgttcttcgacacaacaatgaagctgccgatagacttgcgaactttggatccaagcgcgaggcagcgccatctgatgttttcgtcgaacacctttattcgccgacagtacctcacaaagatgctactcaagttgcggacactcatgacatagctatggttgaagccgactggcgagagcccctcatacgatttttgacttctcaagaactccctcaagacaaagatgaggccgagcggatttcaaggcggagcaaactttatgttatgcatgaatccgagctatacaagagaagcccttcaggaattctgcaacgctgcgtatctttagaggaagggagacaattgctgaaagacatacattctgggatatgcggaaaccatgctgcagcgcgcaccattgttggcaaagcttaccggcagggttttttctggcctactgcagtgtccgacgccgacaaaattgtgcgcacatgtgaaggttgccaattttttgccagacaaattcatctaccagctcaagagttgcagactatcccgctgtcttggccgtttgcggtttgggggctcgacatggttggcccgtttaaaaaggcagtcggcggttacacgcacctcttcgtggccattgacaaattttccaagtggatcgaagctaagcctgttgtcacgattacagcagataatgctcgcgatttcttcatcaacattgtgcacagattcggagtacccaatcggatcatcaccgataatggcacacaattcaccggcggagttttcaaagacttttgtgaagactttggaatcaagatttgctatgcctcagttgcacacccaatgagcaatggacaggtggagcgagctaatggcatgatacttcaagggattaaagcgcgtgtctttgaccggctaaaaccctatgccggcaaatgggtgcaacaactgccatcggtactttggtccttacgaactactcccagtcgggccacaggccagtcaccttttttccttgtctacggggcagaggcaatgttgccgagtgaagtcgaatttgagtctttgcgctttcgtaatttccgtgaagaacgctacgaagaagatcgagtggatgacttgcaccgattggaagaggtccgcgaagcagctttaattcagtcagctcggtacttacaagggttgcgacgttatcataatcgcaatgttcgatctcgtgcctttctagtcggcgacctggttttacggaaaattcaaaccacgcgagatcggcacaagttatctcctctatgggaagggccatttattatctctgaagttacccggccaggttcatatcgactcaagcgcgaagacggcactctcgtcgacaactcttggaacattgaacatcttcgtcgtttctacgcttaactttatcattatattttcctattttgactgtcaaacatcaagttttctccttgaagttgtcagtcgggggctatcatcataataatggagtgtgattttttatcaattcagtttgcttacctggtttatcattgccttgtttggtttttctacttagtttgcgaggactgaaagtttttaatagcttctttgggttttaggctcaacaaagcttagcaaaaacttttaagaaatcaaaaaacttcgcaagaatcatcaagcacagcataaatacaccagtattgtacaaattgagcctccatgtattacattcaaactcagtcagaatcagtcctttcatcatcagagtcttcattactcggttggaggtcgttgttgcgaaattgctctacaacatcactcgcaattttgtcagctgcattttgcgcactgctgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatatacttccggagcaacactcagcttgtcaaatatttcggttgcgtcgagtgcactcggaccaccattattgaggaacatggcttggataattggtgcagcggcattggcgacgttatcccttgctccttcaagcctcttgatcttaccaaccaggacgtcaaactgagcttgagatttgatcttgcgatctgcaaaacacatttatgatgagcatctgttgcattataaggagagaagctcagattgttagctggcgttaccttcgacttccttcaaggatgagtccctttgcgcagccagttctgtcttgtctctctccagggcttcaatttgcttcgccatctgttccatcctggcggcttgcgctgtttgaaatccagatggttgaggatgcaattatgacagcataaatcaatggaacagatctggatgattaccttttgatgaaccacttagttcgaagtttgcgtcctggagctgggcgattcggtcccttaactctttctctgtttttttggcgcactccttggcctcatgcagctggtccctaactgcttctagagttcccaaatgaggaaccagcttttccaaagttgtagtcttggcctcattgcgaagatggattctctgcatgatggatcagggttcagttctgctaaaaagaaaacaaagttaccgaaggacgtcactcggaagacttacatttacaatacgagtggcttctccgagcgctttcttcagctggcacacttcttcatcttctttttgacggtttatgactatgccggcggcttgtgagttctcgtcccaccatttgatcaagataggaggacgagagtcgtcggtcgcctttatgcgagggatttcttctccgtcatcacctgatggtcctgatgtgtttccaagacattagacggatacactgaggttatttaaatcgccattgtttgagaagacaactaacctgaagatgtacctagctgagcgtgaggtgatctttgttctttacctgaagacccagctatcgagtcgttaccagcttctggtccttgcgaagtcgtcgtctgcgcttctacttcggggatctcttgatcagggcctgcgtccgactggtttccagtcgggggctcttgagttgttgccgtttcagttgttgccgactggtttccagtcggcggcaggtcactcggattggccctatcgcccgaagcatgggcgccagtcggctggctttcagcgatcggctggttttcagcagtcggctcggggtccttggatatattttgctctgtcatggcaggatcggggtcttttccagatggatctatatcagatggtttcctgcagagtgttctttcagtatttagcattatcttcatcggaaaacatgccgaagcggaaatcataccgagagatctaatacctggaagatgttctgatctttggcattgcacggccagccagttttttcctgggcatggtgcgctttgggggtttattaggcgagcccttatccccagatttatcatcgtcgccttcatcatcatcaagtaccagctttctcttgcgaggacctgtttgaccagtcaatttggaggtctgaggttgcggatctggtctgatcgttggccctccacctccctgagcggtgtgttggcgaggagaccggcgctgagtgactggtggatctgacttcatcaatgcatattcctgaacaagatgcttccatagttagtcaactcagcatgaagataaaattatgttctgatcacggtttgagggtttccgatgcatacctgtggaggcggattgaatgcattatatggcacaactggcagttgatgagagtagctgaccacaattgcatttgagaagattttatacatcctctccttcatgattttgaaatccagggaatccggttcttcacggttgggatcatgtttgccgtcgaactcgaatgctgtgcgggatctttccttgattggcgccagtcggcatttgatgaagtgccgagtgatctgctctccctgtaagccttgttctttaagatttaacatacgatccaacaactccaaggcttgtactgcttcatctccgattggaagagagttccaagtatcttggtacactggaggaagacaagagtacccgggaagagcaggctcgggattctgaacatagaaccagtttgcatgccatcctttgttcgaagtcttgaagggcatcgagaaatatttttggctcagagttccccttagttggaatcctgcccccccgactacacacggtttgttcttgtttggttggggcttgaggaagaagatccggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgctccaccatctccttaagattctcctccgttacgtcggatgacgcccattggccttcgaagctttctctctcttccgccatcggtttcactcaaatgtgctgatttgattcgagggatggcttgggagaggtgagggattgaggcggtggatcacgggaaggattttgatgcacttttcggaggtggatttggccggagttgtgaaccctagttcgccggcgcagctttgcactgtagcagggagtggggaaaatggcgagagttccggcggggaagacgaagcgccgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatcaaatcctttttatgcggtcatataattctttggaattattgcaatgcaaattaaaaaggtgcccgacagaaaggcgttatgctgtttttgcaagcttttttaggctacaaaagctgtttgggttaactaggaatgacttgtttttattatagttatttccttggcgtgttatatgcctgttttcatggtaaatagtcatggcctaggctatttgacttatttattaccataatctttataatacttgatgggtaatctttagagtttttatattcggatgcctgtcgagtgtgttcattcgtgaaccttttagagtgtaaaccactcggatttcttttattgtggttaaaaagcagtcggctagcatgcttatttaggcaccgcgtacgcttttgtcatataatgcacaattgtgttattattttgtctttcaactatatgtttagtttgttaactaatcacatagttgggggctacacctaattaggtgcatctattcgatgcaccatattctttatcttttcgccctttacagtccactcggcaggttttggcttgaagagtttgaagtactcggattatcatctttgagagggctacgatggtcgactgcaaaggactcgggggctactgtggagattatgggtatcccatatctacacggcgatggtattcgaactgggtacaggatacctaatgtagatagaatatcttatctgtatttcgggtttgtttcttaacttgtgtatcaaggaaacaccctgagacttagtcggttacgactgtatcttacttatattttcgtattccgttagggatatagattatcttttgtaacccggactccttccccatatataaggggggtccgggcgcctctaggggcatatgctgatttttcccgaatcatacaatcaataatacactcggcggattcatccccggataggagtagggtattacttcttttataagaaggcctgaacctgtataaatcttttgtctccaaacccatacactttcctagcttgatagccacccccttttattattgccgaaatctagtttcgacagcaatttcccccgtggggccgggtcccctacgggggcgggggcgggttcagtttttgacccgcgggggatgtggggccgggggcccgcatttttgtggggaggggacaggtgaggcatttcacccgtggggtgccgaagggtgtatattaaatctcaaaatgtaacccatagaagatctaaaagagccacaaaattttaagtaatagccttatcctctccactctccccatctcccctcccctcactctcactccatattaacttggagcgtcacaggctagttccggtcgggactagttcggggcgtgacattttttttatctattcgattgatttttctggtaggttgatttttcacatggaaacttttttttgggtgggtaattttttaaggcaacatggatttttcacgtgatggaagaagtgtgatggtgggagaagaggagaacgacgaccgcttttacagttgaaaagaaaagatgggaactgttttaatcacccggatggatgtccatccatttattacatgtcatttaaatggttatgaaaaaaatttaaaaacaattaacaagatagatcaatacgtaatatatcacttcacaaatattaaagttaaaattcaacttctacaaattgtaagaaaaataacaaacaaaactcaaattactatacgtatatttatagttaaatttgttatttttcttacaattggtagaagttgaaatttaaacttgcaagtttgtggaatgatatattacatattaatctatattattattatttttgaattttttaataaccatttagttgacatgcaataaacaggtggcgtctacagaatccatctcaaaaaagaggaatttatgttgttccatcaatattgggccacatttaggacaactctcttgaaaccggtgaagcaagcacagttaggctcttaattccgtggcccttgcctacgtttgtcgagcaaacggccggtttggcccattagcatgcccaggagacgaggaaaaaagagaacttatctgctaggctaacattatcaatttttggatatatatatatatatatatatattaaaatgcaacatacatgttatacatattgtgaaccaatctactcctaattatcttttctccctatagtaagcattcatttagttaaggttagatacattttgcagcacgaatcttgaaacacatcaacggtgtagattgtaggtacatatgaatccgagtgcaaatctgcattttcatatatatatatatatatatatatatatatatatatatatatatatatatatggaagggcaattgtattctttcccctattttaatttgtagatatgagttttgtaaaatatgttctttttgcttttttaaaccgaaactttgctcctagtctattggctatgtatatgagttcctaattcatctctctcgttttctgctctttcggcgcgcacgcttttcaaaccattaaatggtgtgtgttttgtaaaaagtttttataggaaagttgcttaaaaaaatcatattaatttatttttcaagttttttataacttaaacttaattaatcatgcgttaatctatcgctccgttttccgttttgagttaatcagcctagtcgtttcaatggcgttgcaatttccctctacttttgtataaaacagctgtgctgttgttcatttgtggcatatgtgtacttctgaatgcagcggtactaacatatgccatgacacaagggatcctctccaaactaaacaaatcaacttaaagctcatatgcacttcaatacccaatatttcatgagcatagaccttgtatacgtcaagaagggaaaaagaaccgaaaacataaccaaaaaatcatataatccccaaatcaacgcatgtaacacaatataaaaaaccattttagacaacacccactattacaggcggacttaaaaaaatatacttgtaaaaatatattaagtgtttttttacagctagctcgcatgcaaaaaaaatcaaatttttatataggtggccctcaggtcttaggttttcgtccgcaaaaatcatatctgtgtaggcaaactgttaggagcaccgcctgaaaaattgacaaccgaccacttgctaccgcactaaaaagctactatggctgtgttcgggaggtgaggttgagaattcaccttccgcgcacgcaaaatggagcgatgtattttcttacgattaattaggtatttactattttttttgaaaaatagattaatatgattctttaaagcaactttcgtatagaaactttttgcaaaatacatattgtttagcggtttgaaaagcgtacacgcggaacacgatggaggtgagttgggaaaaatgggggaagaacacaacctaagtcttaaactctcctccacggctcctctatcgagaaccactcattctctccctctcctatcttctctgtctcactagatccacacacgagctctccttatccttcacttgccaccgtttctcctcgtgtagaagcaaccacacggcttgccttggcttggcaacggcgacttcgaacacatggcattggatgagcagtgaaggggaaggggtgggtcggcattatcgaacgagggccagagcttgggaccagcgacaacaatggcgactgcggcaaggacagggtggtggtggcaaataatgggctgagctcaggatctgtggtgaacgaacatctatgtgggttgtttacaacaacgttgtggccctagatctgttggagtgaaggctagatccaccatcggggaggtcagatctggatggtggctattacctctctcgatgccgccgccagtgggcagatccaagccatcatgcttcatgtctgctgcggcgggtggcggtagatcggggtactgggatggtggttcactactagagaaatgcacttcggtgccggttgggaagaccccttagatgccggttttcccaaccagcaccatgaaggcggcactgattaccggcaccaatgtcattttaaaaaccgacaccaatatggaatcaacgagcaaaaaaaaaaaaaagccagccggctctagccgattaactcccacatgaacccacatgaataacaaacaaatgatgaacagattccacatcaacagatgaacaagagcgacacaaaatctcacaccaattatcatagcaacaaatgaactcttgcatgaacaagaacgtatctcaaacaaatcacaaagtgggagggagggggagagatggatccgctggccgccgatgccgtcgcacctccagatccgacgcgggccacctctgtcccgccaccgcacgccacctcccgctgccaaggggcgcggactgcctccgtcccgttgccgcacgccgccgcacttcgcctaccaccgccgagtggcgcggaccacctccgtcccgccgccgcatgccgcctccggttgccgaggggcacgggctgcctccttcccgccgccgcacaccgccgatcttgctgccgaggggcatgcaagacgacagtgagaaggctagatccagctgctgggaccccgtgaactccggtggtggtggaacctccctggcttcttagggatagcgacaacaacttcaacgtcgaccacatgattttcgcatgccttataattgtaagcggggcggctgggcgcccatgaaaaatcatttttttctgcctgcgaatacccatcttgtactggtgctagattagcaaacctgttttttcctttttttttttggggggggggggggttgaactatggtggcttaggtagcctacatgccaatcaaagttttaaatttagtttaactccaagggagaatgtattctatcgaatttagaaaaaaatgtcaaaattcatgatttatttaattgtttgtggaattatgtttgaaattttgtaatttaagttaccccgaaatgtttatgcattatgagatagttaaccctatactccctccggttctatattaattgacgttttgaataaggttgaggccaaacttttataactttgaccatcaataactttaaaaatatttaatttaaagaaaattgaataacatatataaatttttctttcaaagcactataataaaagtaaacatgcatttatttattgtatatattataatagaaaaataagatcaaagatatatcttgtagaccgtatcattgtccaaaacgtcaactaaaatgaaactgagggagtatagggtatcacattctaaccttggggttaacaagacacagttgcttttgtatcctggattgacgacgtacatcccttttgctttatcttttgctttttgcactttaatcaaggaggcgaagcaaagaatccgacgattagccaactactaactccaaattatctatagccaatttaatagtcgatttatacaacaattatttacaatactattaatatgtgatcccacctgtcatagaagcatatattatgtcttgaagtccgtgctacagcttctacagatctgtagcccactgcttctctctacttttttatctctttaaaatatatatgtttatagctggcttacagtctgctattgtacctcctctcagatctgagatgcattcatcctctcagatgatgcattcaggtacagcttaggacgtacatatagcatatcgatttgcggctttgcagcaaatgcaaagcaaagaaaaatactaaagcaaacatatcgatcgtacgcaaggaataatagatcgacgaaggcttctagacgacagtacgtttttacaaggcttctgctagctctagcccagaacatcgatctatcgatcatattgcatccagtttgatcgtttcaatttatgctcgccctcgcaccaacaatggcttagctaatccccatgtactcgatctctgtcggcaaacatcgtgattaaggtaaactagctacatcatatcgtgcagtttaattgcgctctctctctctccccctatgtgtgtgtgttgatgcatcaggagtgggctggagaaatcgatccatcaggcatctatatatcatgggttaattaattacagggcttgcttcaacatatatatgtattctctgctgtcgatccatttctaattaaggagcgtttaatcaactgaaagaagatcgattgagattatatgatcgatgaagctgcccgcaattcaacactaattgaagagagccgggctacgcagatcaactcaacatgccaccagcgaaggaggtaattaaatcagatcggtgatattgtttttatttttgaatgaaagttatttcacgaccacgcacgtgaattaaacaagacactttactgctattttagatttccaatttggacgcaattttttgaaacacgctttcattgtcatatttggctttagaagtgtttttttttctaacatctcatttgcaaacaatcctctcggagcaaacttcttctatttgtggaagaaataaattgcaaaaaggataattttaccaaccttagaacataacatgaggtaccatattttatactataaattttggcacatcaagtattatgtatctcaatgtataaaagaaataattttagtgtaaacttttgataataacaagtaattggtcaagaaccgtaaaatttctcacactccacctgttcaaaattcaatgctatgtttggctagttgcagagagaaaaaatattgtcgaaactagatttcggcaataataaaagggggtggctatcaagctaggaaagtgtatgggtttggagaccaaggatttatacaggttcaggccttcttataaaagaagtaataccctactcctgtccggggatgaatccgccgagtgtattattgattgtatgatttagggaaaatcaacctctgcccctagaggcgcccggaccccccttatatatgggaaggagtccgggttacaaaagataatcaatatccctaacggaatacacagatatagattaaatacagccgtgaccgactaagtctcaaggtgtttccttgttgtacaagttaagaaacaaacccgagatacaaataagatattccatacatattcggtatcctatatccagcccaaatagtatcgccgtgtagatatgggatatccataatctccacagtagcccccgagacctttgcagtcaaccatcgtagccttctcaaagatagcaatccgagtgcttcagattattcatgccaaggcccaccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcactaccacgcatcagatggcaaaagcatacgcggcgcctaaagagacattctagccgactgctttttagccataacaaaaagagtccgagtggtttacactctaaaaggttcacgaatgaacacactggacaggcatccgagtataaaactctaaagatcacccaccaagtattataaaaaattatggtaatgaataagtctaatagcctaggctatgactatttaccataatgaaaataggtatataacataccaaggaagtgactatgataaaaacaagtcattccagattaacccagacagcttttgtagcctaataaagctaacaaaaaagcggtataacacctttctgtcgggcaccttttaatttgcattgcaataattccaaagaattatatgaccgcataaaaaggattttatcagcatcgggcaacactattgtgagcataatattgccaaagcaaaatatgcctaagtccctaaggaacacaatgggccacgctgttaaaagtattgggctgaagtactgttcaggcctaggcccatttgcacctccgatacccttaacaagaaatccgagatccaagcgacgcttcgtcttccccgccggaactctcgccattttccccactccttgctacagtgcagaactgcgccggcgaactagggttcaccaatccacccaaatccaccttcaaaaagtgatcaaattccttcccgtgatccaccgcctcaattcctcacctctcccaagccatccctcgaatcaaatcagcgcatttgaggaaactcgatggcggaagagagagaaagcttcgaaagccaatgggcgccgtctgacgtaacggaagagaacctgaaggagatggtggcgcacggcgttctccctgctaaggagatcatcgggtggcggccagcgtacggtgagatttttccgacccccgatacacacgagattgtggtcttctcgcatttcttctacggcggcttcgctcttccgacctcgaaatttttccgcgggatcttgaacttctatggaatcagcttgcatcacctaaacccaaattccatagtgcacatcgccaatttcgtccatgtttgtgaagcctttttgggaatcaagcctcactttgccctgtttcgccggatcttcttcctcaaaccccaaccaaacaagagtaagccatgtgtagtcgggggggcaggattccagctgaggggaactctgagccaaaagtatttctctatgcccttcaagacttcaaacaaaggatggcatgcgaactggttttatgttcagaatcctaagcctgctcttcccgaatactcttgtcttcccccggtgtaccaagatacttggaactctcttccaatcggagatgaagctgcccaagccttggaattgttggatcgcatgttaaaactcaaagaacaaggcttgcaaggagagcagatcactcggcatttcattaaatgccgactggcgccaattaaagaaagatcccgtacagcttttgagtttgacggcaagcacgatcctaatcgcgaagaaccagactctctggatttcaaaatcatgaaggagagaatgtataaaatcttctcaaatgccattgtcgttagctactcacaccagctgccagttgtgccatataatgcattcaatccgcctccgcaggtatgtatctgaaatcatcaacttacgaccaaaatagtatcttgtcttcatgttgagttaactaaccatggaggcatctcattcaggattacgtattgatgaaatctgatcccccaattgctcagcgccgatctcctcgccagcacaccattcagggaagtggagggccgacaatcaggtcagacccacaacctcaaacctccaaaccggctggtcagacaggtcctcgcaagagaaaactggtgcttaatgacgatgagggcgatgacagcaacaaatctggggacaagggcacgcccaacaaactcccaaagcataccatgcccaggaaaaaactggctggccgtcaaatgccaaagattagaacatcttccaggtataaacttctcggtaccatcttgtttcggcatgcttcccttatagaaattatgctgagtatcgaaaggacgctttgcaggaaaccgtccgacatagatccaactggaaaagatcctgatccggctgtgacagagccaaatttatccaaagacactgagccgtctgccgaaaaccagccgactgccgaaagccagccggctggcgcccatgcttcggatgacaaagccgatccgagtgaccagccgccaactggagaccagtcggcaacagctgaaactgcaacaacacaagagcccccgactggaaaccagtcggatgtaggttccgatgaagaaatcccggaagttgaagcgcaaacgacaacttcccaagaaccagaggctggtaaggactcaatgattgggtctctaaataaagaacaaggaccacctcatgttcagccaggaacatcctcaggtaacacatcttctcaagtgatgccgatttaaataacttaagcttactcgtctaattgtcttggaaatacatcaggaacaataggcgatgacgaagaaataattcctcgcataaaggcggttgatgactcccgtcctcctatcttgctcaaatggtgggacgagaactcgcaagttgccggcatcgttataaatcgtcaaaaagaagatgaggaagtgtgccagctgaagaaagcacttggagaagccactcgcattgtgaatgtaaatcttccgggtgactgcctttaataactttgttctctctttagtagaactgaaccatgatccatcatgcagagaatccatcttcgcaatgaggctaagactacaactttggaaaagctggttcctcatttgggaactctagaagcagttagggaccagctgcatgaggccaaggagtgcgccaaaaagacagagaaggagttaagggaccgaattgcccagctccaggattcaaacttcgagctaagtggttcatcaaaaggtaatcatccagatctgttccattgatttatgctgtcataattgcatcctcaaacacttggatttcaaacagcgcaagccaccagaatggctcagatggagaaacagattgaagccttgaaaaaagacaaagcagagttggctgcagaaagggactcagccttgaaagaagttgaaggtactgccggctgatgatctgaactttcctctttttaatgcagtagattcttattataaatgtgttgtgtagaccgtaaaatcaagtctcaagctcaattggatgtcctggttggtaagatcaagaggcttgaaggagcaagagatgaagtcgccaatgtcgctgcaccactcatccaagctatgttcctcaataacagtggtccgagtgcactcgacgcaaccgaaatattcgacaagctgagtgttgctccggatgtatatttcaagaatatcaagaaagctggaagtatgggagctagcatggccttggcgatgacaaaatccttgtacccgagaattgaagttgacaccattgatggctttgcaaacgggacaagtgaagaagctgctcttgatcttatcagcagtgcacaaaatgcggctgacaaaattgcaagtgatgtcgtagagcaattccgcaacaacgacctccaaccgagtaacaatgactctgatgatgaaatgactgattctgactgatcatgaatgtaatgcatggaggctcaatttgtacaatactggtgtatttatgctgtgcttgatgattcttgccaagtttttgatttcttaaaagtttttgttaagctttgttgagcctaaaacccaaagaagctattaaaaaactttcagtcctcgcaaactgagtagaaaaaccaaacaaggcaatgataaaccaagtaagcaaactgaattgataaaaaatcacactccattattatgatgatagcccccgactgacagcggcaagaagaaaacttgatgttgacagtcaagatagggaaatacaatgataagcttaagcatagaaacgatgaagatgttcgatgttccaagagttgtcgacaagagtaccgtcttcgcgcttgagtcgataagaacctggccgggtgacttcagagataataaatggcccttcccatagaggagataacttgtgccgatctcgtgtagtttgaattttcctcaaaaccagatcaccgactaaaaaggcacgagatcgaacattgcgattatgatagcgccgcaacccttgtaaatatcgagccgaccgaatcaaagctgcttcgcggacttcttccaatcggtgcaagtcatccactcggtcctcttcgtagcgatcttcacggaaatttcgaaagcgcaaagactcgaattcaacttcacttggcaacattgcttctgccccatagacaaggaaaaaaggtgactggcctgtggcccgactgggtgtagttcgcaaagaccaaagtaccgatggcagctgttgtacccatttgccggcatagggttttagccggtcaaagacacgcgctttaatcccttgaagtatcatgccattagctcgctccacctgtccattgctcatggggtgtgccactgaggcgtagcaaatcttaattccaaagtcctcacaaaagtctttaaaaactccgccagtgaattgtgtgccattatcagtgattatccgattgggcactccaaatctatgcacaatgttgatgaagaagtctcgagcattatctgctgtgattgtgacaaccggtttagcttcaatccacttggagaatttgtcaatggccacaaagagatgcgtgtaaccgccgactgcctttttaaacgggccaaccatgtcaagcccccaaaccgcaaacggccaagacagcgggatagtctgcaactcttgagctggtagatgaatttgtctggcgaaaaattggcaaccttcgcacgtgcgcacaatcttgtcggcgtcggacactgcagtaggccagaaaaaaccctgccggtaagctttgccgacaatggtgcgtgcagcggcatggtttccgcaaatcccagaatgtatatctttcagcaattgtctcccttcctctaaagatacgcagcgttgcagaattcctgaagggcttttcttgtatagctcagattcatgcataacataaagtttgctccgccttgaaatccgctcggcttcatctttatcttgagggagttcttgagaaattaaaaatcgtatgaagggctctcgccagtcggcttcaaccatagccacgtcatgagtgtccgcatcttgaatagtatctttatgaggtacggtcggtgtgtaaaggtgttcgacgaaaacatctgagggcgccgtctcgcgctaggatccaaaattggcaagtctgtcggcggcttcattgttgtgtcgaagaacgtgactgagctcgagtccatcgaacttgtcttccaatttgcgcacctcttgtcgatatgccatcatattgtcgtcaaggcaggaccactctttcataacttggttgacaaccagctgtgaatcacctcgaactattagacgctttatccctagggaaattgcaatccgtagtccatgaaggagggcctcatactcggcgacattgtgggacgccgaaaaatgtatccaaagtacatagcttaatctttctccagttggggaaatcaaaaccactcctgctccggtgcccgaaagtcgtttggatccgtcaaaatgcatggtccaatgctccatgttctccgcgggggtatcctcctggcactcggtccattcggcgacaaaatcagctaacgcttgggacttgattgaaattcggggcttgaatgatatgtccaaagacatcaactccaaagcccacttagcaatacgtccgttcgcttcgcggttgtgcagtatatcaccgagtggaaatgatgtgaccaccgttaccgagtgaccttgaaagtagtgagatagcttcctggtagtaattagaataccatataacagcttttgaacctgagggtacctcgttttggagtcggctaggacctcgctgacaaagtaaatcggtcgctggactttctggacatggccttcttcctcgcgctcaacgaccaagactgtgctcacaacctgggaggtggctgatacgtacagtaacaacggctcctgcgggtgtggtgaggctaagactggcggctcggtgaggagttttttgaaatcttcgaaggccttctgtgcttcgggtccccaccggaagctatctgttttcttcagcagcttaaagaagggcatcccccgctcgccaagtcgtgaaacaaatcggctgagcgccgccatgcatccagtcagcttctgaacatctttctgggtacttggcggtttcatgttgaggatagcagtaactttctccgggttggcttggatgcccctatgagacaccataaagccaagcagcttccctgacggtactccgaaggtgcacttttcagggttcaatttcatcctgaaagcacggatgctcgcaaaggtttcttctagatccgagatcaaatcatccttttgcttggtcttgacgactacatcatccacataggcttcaacgttgcggccgatctgcgttgagaagcatctttggatcatacgttgataagttgctcctgcgttttttagtccgaacggcatggtgacgtagcagtatgccccaaaaggcgtgatgaatgaagtcttcaagcagtcggattccttcagttggatctgatgataccccgagtagcagtccaaaaaactgagaagctcacagccggcggttgagtcaactacctggtcaatgcgaggcaacccaaaaggatctttggggcaagacttgttgaggtcggtataatcaacacacatgcgccattgccctgttttcttccgaactagaaccgggttcgccagccaatcgggatgaagaacttctttgatgaagcctgctgctaacagcttggttaattcctccttgattgcgtccttcctgtcttgtgcgaatcggcggagtcgttgtttgatcggcttggcatcttctttgacatgtaaggagtgctcaatcacctctctaggaataccgggcatatccgatggtttccacgcaaagatatctttattattctgaagaaaggtgatgagcgcgctttcctatttacaatctaactcggcccctattacagcagttttagtagagtcagagggatctaggggaatcttcttagtcttggcttcgctttctccactttttgaagtcttggtggcaggtatttctccttcgctcgccgtggccgcagccagtcggatgtcctctcgggcagacgccatctcgcgagtttgggccatgtcgcaactctccttgtcgcatgtgacggcttgcttgatgtcgctccgtagggatagcactcctcggggaccaggcatcttcatcatcatgtaagtgtagtgcgggacggccatgaacttggctaacgccgggcgtccgagtatggcatggtaagctgtctcgaaatcggcgacttcgaagctgatattctctgtgcgaaagttttcccgagtaccaaaagtgaccgggagggtgatctggccgagtggagttgcggataatcctggaattactccgtgaaaaggcgcattgcttggtttcagctcggagcgaggaatctgcatatcatccaaggtcttggcgaaaaggatgttgagtgcgctgccaccgtcaatgagggttctgcgaagcttgacattacggaccactgggtctagtaccagggggtaccgccccgggtggaccggtgatgctgaggcttggatgacggtagtcatgagatcggaagtgggggactcggctgccagtcggcgtgtggacgctttcggagttaactgggaccgaagccgcgatcatggtcttcgtctggttcaagatgttgacgacgtggtcggaacgatttagctcgctttggttgaggagggtgtcgagaagggtgatcgcggcaaccgcattctgttgaggggtgcggaaaaccggtgtcccttcgacgtcttgttgtccaatgagatcacgcgctcggcgccctgcttccaaagctcgctgacgtcgatcttcagcctccttggcgatccgctcacggtcctgctgctcacgccgtagccgttcttgttcttgtgcttgatgctcctcctccagtcggcgacgttcttcggtctcccgggcttggcgttgctcctccgtctcgttattggccatgaaaacgccaaagtagagaggggtgtagttgtcatctaggcttccgtcgaagtcgtcgagatccgggtcgtggtagcgagagctaaactcatcgtactccacgatgtcggtggggcgcgagtcgacggtgggagagctgtaatggtcatctagctgatccgtcgaaaccgtgccgagtggttggaggatgacgccgacttccctgaagctaggcgaaatcggtgttgaaaccgacttccgcctaggcctacgggatgaagacgctgtcgcggtggagacggccgctaaatcgtcggggagcttcatcaggactggtgggtaagccccatcatcttgatctggtgtcgttggagaagatgcgatctcagccgagtggtttgaagccgactcgattgagatggtcttgaagtaggtttcagccgcgtttgggaatccaaacgggactgagatccggttctctcccgactggtccgattccgagtcaaagagagaaatcttgccgaagttgtcggtgacgaagtcgaggctgccgaaccgaaacgtctgcccgggtgggaagacgaggtcgtcgatgccggagaaaggacccattgcactgatcggcgaaaagcttgacgcctcccctacctggcgcgctaactgtcgaaactagatttcggcaataataaaagggggtggctatcaagctaggaaagtgtatgggtttggagaccaaggatttatacaggttcaggccttcttataaaagaagtaataccctactcctgtccggggatgaatccgccgagtgtattattgattgtatgatttagggaaaatcaacctctgcccctagaggcgcccggaccccccttatatatgggaaggagtccgggttacaaaagataatcaatatccctaacggaatacacagatatagattaaatacagccgtgaccgactaagtctcaaggtgtttccttgttgtacaagttaagaaacaaacccgagatacaaataagatattccatacatattcggtatcctatatccagcccaaatagtatcgccgtgtagatatgggatatccataatctccacaaatatatatagtgtaattaataactttattcgtaacattatatatatgccggtttgcactctacctttttgtggtctattacactttattctattgtaattaataaatacaccaccgagaaaactgggcgtttctttagaattttatttgtgataaaagattttagtgtgtttgtttagctatgtgtcgaaactagatttcggcaataataaaagggggtggctatcaagctggaaaagtgtatgggtttgaagacaaaggatttatacaggttcaggccttcttattcaagaagtaataccctactcctgtccggggatgaatccgccgagtgtgttattgattgtatgatttagagaaaatcaacatatgcccctagaggcacccggaccccccttatatatgggaaggagtccgtgttacaaaagacaatctatatccctaacggaatatgtagatacagataaaatacagtcgtaaccgactaagtctcaaggtgtttccttgatgtacaagttgagaaacaaacccgagatacaaataagatattctatctatattcggtatcctatattcagtccaaatatcatcgccgtgtagatatgggatatccataatctccacagtagcccccgagacctttgcagtcaaccatcatagccttctcaaagataataatctgagtgcttcaaactttttatgccaaggcctgccgagtggcgaagacgaagactgtaaagggcgaaaagataaagaatatggtgcatcgaatagatgcacctaattaggtgtagcccccaactatgtgattagttaacaaactaaacatatagttgagaataaaataatagcacattcatgcatcatacgacaaaagcatacgcggcgcctaaagaggcattcttgccgactgctttttagccataataaaaggaatccgagtggttaacactcaaaaaggttcacgaatgaacacacttgacaggcatccgaataaaaactctaaagattacccaccaagtattatataaattatggtaacgaataagtctaatagcctaggctatgactattcaccataatgaaaacaggcatataacataccaaggaaaggactatggtaaaaacaagtcattccaagttaacccagacagcttttgtagcctaaaaaagcttacaaaaacagcataacgcctttctgtcgggcaccttttaatttgcatcgcaataattccaaagaattatatgaccgcgtaaaaggattctatcagcatcgggcaacactattgtgcgcataaattgccaaagcaaaaatgcctaagtccctaaggaacacaatgggccacgctgtcaaatgtattgggctgaggtactgttcaggcctaagcccatttgcacctccaatacccttaacaaaaaatcccgtgatccaagcgtcacttcgtcttccccgccggaactctcgccattttgcccactccctgctacagtacagagctgcgccggcaaactagggttcaccaatccactcgaatccaccttcgaaaagttcatcaaaatccttcccgtgctccaccgcctcaatccctcacctctccctagccatccctcgaatcaaatcagcgcattcgagtaaaatcgatggcggaagagaaagaaagctttgaaggccaatgggcgccatccgacgtgacggaggagaacctgaaggagatggtggcgcacggcgttctccctgccaaggagatcatcgggtggcggccagcgtgcggtgaggcttttccgtcccccgatacacacgaggttgtagttttctcccatttcttctatggcggctttgctcttccgacctcgaaatttttccgcgggatattaaacttctatgaaatcagcttgcatcacctaaacccaaattccatagtccacatcgccaatttcgtccatgtttgtgaagccttcttgggaattaaaccccacttcgctctgttccgccgaatcttttttcttaagccccagccgaacaagagtaagccgtgtgtagtcggaggggcaggatttcagctgagggggacgctgagccagaagtatttctccatgcccttcaagacctcaaacaaaggatggcatgcaaactggttttatgttcagaatcctgagcctgctcttcccgagtactcttgtcttcctccagtgtatcaagatacttggaactctcttccaatcggggatgaagctgcccaagccttgaagttgatggatcgcatgctaaaactcaaagaacaaggcttacagggagagcagattactcggcatttcatcaaatgccggttggcaccaattaaagaaagatcccgtacagcattcgagtttgacggcaagcatgaccccaatcgtgaagaaccagactctctggattttaaaatcatgaaggagagaatgtataaaatcttctcaaatgctattgtcgtcagctactcacatcagctgccagttgtgccatataacgcattcaatccgcctccgcaggtatgcatctgaaatcctcaacccatgatcaaaacataatcttatcttcatgttgagttaactaaccgtggaggcatcttattcaggaatatgtattgatgaaatctgatcccccaatcactcagcgccggtctcctcgccagcacaccgttcagggaagtggagggccaacaatcagaccagatccacaacctcaaacctccaatccgactggacagacaggttttcgcaagagaaaactggtgctcgacaacgatgaaggcgacgacaacaaatctggggacaagggctcgcctaataaactcccaaagcgtaccatgcccaagaaaaaactggctggccgtcaaatgccaaagattagaacatcttccaggtataaacctctcggtaccatctccctttgacatgcttctctcacagaaattacgctgaatatcgaaaggacactttgcaggaaaccatccgacatagatccaactggaaaagatcctgatccggctgcgacagagccaaatttatccaaagatgctgagccgactgccgaaagccagccgactgccgaaagccagccaactgccgaaagccagccgactggcgcccatgcttcggatgacaaggccaatccgagtgaccagccgccgactggaaaccagtcggcagcaactgaaactgcaacaacccaagagcccccgactggaaaccagtcggatgtaggtctaaatcaagagattcctgaagctgaagcgcaggcgacaacttctcaaggaccagaggctggtaatgactcggtgattgggtctccggataaagagcaaggatcacctcacgctcagctaggcacatcctcaggtaactcatcttttcaagtgatgccgttctgaataactccagcttgttcgtctaatgtcttgggaatacatcaggtccattaggcggcgacgaagaagaaattctccgcataaaggctgctaatgactctcgtcctcctatcttactcaaatggtgggacgagaactctcaagtttccggcatcgtcataaatcgccaaaaagaagatgaggaagtgtgccagctgaagaaagcacttggagaagctactcgcattgtgaatgtaagtcttccgggtgactgcctttgataactttgttctctcgttagcaaaactaatccatgaaccaccgtgcagagaatccatcttcgcaatgaggccaagaccacaaccttagaaaagttggttcctcatttgggaactcttgaagccgttaggggccagctacacgaggccaaggagcatgccaagaaaacggagaaagagttaagggaccgaatcgctcaactccaggattcaaactacgagctgagtggttcatcaaaaggtaatctctagatctgtcccattgattcaggccgtcataaccgtatcctcaaccatttggatttcaaacagcgcaagccgccaggatggctcaaatggagaagcaaattgaagccctggagagagacaaggtagaactggctgcgcaaagggactcggccttaaaggaagttgaaggtgctgccggctgacgatctgaacttatctctttttaatgcaacaaattcttatcataaatgtgttttgcagaccgcaaaatcaaatcccaagctcaattcgacgtcctggttggtaagatcaagaggcttgaaggagcaagagatgaagtcgccaatgtcgctacaccactcgtccaagccatgttcctcaataacagtggtccgagtgcactcgacgcaaccgaaatctttgacaagctgagagttgctccggatgtgtatttcaagaacatcaagaaagctgggagtatgggagctagtatggcattagcgatgaccaaatccttgtacccgaggattgaaattgactccattgatggctttgcagacgggacaagcgaagaagcagctcttgatcttatcagtaatgctcaaaatgcggctgacaagattgcaagtgacgttgtagatcaattccgcaacaacgaccttcagccgagcaacaataactctgacgatgaaagaactgattctgactgagtatgaatgtaacaaatggaggcttaatttgtacaatactggtgtatttatgctgtgcttgatagttctagccaagtctttgatttcttaaatgcttttatcgagctttgttgagcctaaaacccaaagaagctattaaaaactttcagtcctcgcagactaagtagaaaaaaccaaacaaggcaatgatagaccaagtaagcaaattaaattgataaaaaatcacactccattattatgatgatagcccccgactgacaacgtcaagaagaaaacttgatgttgatagtcaagatagggaagtacaatgataagcttaagcgtagaaacgacgaagatgttcaatgttccaagaattgtcgacgatagtaccgtcttcgcgcttgagtcgataagaacctggtcgggtgacttcagagatgataaatggcccttcccatagaggagataacttgtgccgatctcgtgtagtttgaattttcctcaaaaccaggtcaccgactaaaaaagcacgggatcgaacattgcgattatgataatgccgcaacccttgtaagtatcgagccgaccgaattaaagctgcctcgcggacttcttccaatcggtgcaaatcatccactcggtcttcttcgtagcgttcttcacggaaatttcgaaagcgcaaagactcgaattcaacttcactcggcaacattgcttctgccccatagacaaggaagaaaggtgactggcctgtggcccgactgggtgtagttcgcaaagaccaaagtactgatggcagctgtgtcacccatttgccggcatagggttttagccggtcaaaaacacgcgctttaatcccttgaagtatcatgccattggctcgctccacctgtccattgctcatggggtgtgccactgaggcatagcaaatcttaattccaaagtcctcacaaaagtctttaaaaactccgccagtgaattgtgtgccattatcagtgatgatccgattgggcactccaaatctatgtacaatgttgatgaagaagtctcgagcgttatttgctgttattgtggcaaccggtttagcttcaatccacttggaaaatttatcaatggccacaaagagatgcgtgtaaccgccgactgcctttttaaacgagcaaaccatgtcgagcccccaaaccgcaaacggccaagacagcgggatggtctgcaactcttgagctggtagatgaatttgtctggcgaaaaattggcaaccttcgcatgtgcgcacaattttgtcggcgtcggacactgcagtaggccagaaaaaaccctgccggtaagctttgccgacaatggtgcgtgcagcagcatggtttccgcatatcccagaatgtatgtctttcagcaattgtctcccttcctctaaagatacgcagcgttgcagaattcctgaagggcttttcttgtataactcagcttcatgcataacataaagtttgctccgccttgaaatccgctcggcttcatctttgtcttgggggagttcttgagaagtcaaaaatcgtatgaggggctctcgccagtcggcttcaaccatagctacgtcatgagtgcccgcgacttgagtagtatctttgggaggtactgtcggcgtgtaaaggtgttcgacgaaaacatcagagggcaccacctcgcgcttggatccaaagttggcaagtctgtcagcggcttcattgttgtgtcgaagaacatgactgagctcgagtccatcgaacttgtcttctaatttgcgtacctcctgtcgatatgccatcatgttgtcgtcaaggcaggaccactctttcataacttggttgacaaccaactgtgaatcgcctcgaactattagacgctttatccctagggaaattgcaatccggagtccatgaaggagggcctcatactcggcgacgttgtgggatgccgaaaaatgtatccaaagcacataacttaatctttctccagttggggaaatcaaaaccactcctgctccagtgcccgaaagtctttttgacctgtcaaaatgcatggtccagtgctccatcttctccgcgggggtatcctcctggcactcggtccattcggcgacaaaatcagctaacgcttgggacttgattgaaattcggggcttgaatgatatgtccaaagacatcaactccaaagcccactttgcaatccgtccgtttgcttcgcggttgtgcagtatatcaccgagtggaaatgatgtgaccaccgttaccgagtgaccttgaaagtagtgagatagcttcctggtagtgattaaaataccatataacagcttctgaacctgagggtacctcattttggagtcggctaggacctcgctgacaaagtaaatcggtcgctggactttctggacatggccttcttcctcgcgctcaacgaccaagactgtgctcacaacctgggaggtggctgctacatacagcaacaacggctcctgcgggtgtggtgaggctaagactagcggctcggtgaggagtttcttgaaatcttcgaaggccttctgtgcttcgggtccccactggaaatcatctgttttcttcagtagcttaaagaagggcatcccccgctcgccaagtcttgaaacaaatcggctgagcgccgccatgcatccagtcagcttctgaacatctttctgggtacttggcggtttcatgttgaggatagcggtaactttctccgggttggcttggatgcccctatgagacaccataaaaccaagcagcttccctgacggtactccaaaggtgcacttttcagggtttaatttcatcctgaaagcgcggatgctcgcgaaggtttcttctagatccgagatcaaatcatccttttgcttggtcttgacgactacgtcatccacataggcttcaacgttgcgaccgatctgcgttgagaagcatctctggatcatacgttgataagttgctcctgccttttttagtccgaacggcatggtgacgtagcagtatgctccaaagggcgtgatgaatgaagttttcaaacagtcggattccttcagtcggatctgatgataccccgaatagcagtccaaaaaactgagaagctcacagccggcggtcgagtcgactacctggtcaatgcgaggcaacccaaaaggatccttagggcaagatttgttgaggtcagtataatcaacacacatgcgccattgccccgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccaagcaaatatatctttattgttctgaagaaaggtgatgagcgcgctttcctatttacaatctaactcggcgcctattacagcagttttagtaggatcagaaggatctaggggaatcttcttagtcttggcctcgctttctgcactttttgaagtcttggtagctggcacttctccttcgctcgccgtggctgcagccagtcggatatcctctcgggcagacgccatctcgcgggtttgggccatgtcgcaactctccttgtcgcatgtgacggcttgcttgatgtcgctccgtagggatagaactcctcggggaccaggcatcttcatcatcatgtaagtgtagtgcgggacggccatgaacttggctaacgccgggcgtccgagtatggcatggtatgcagtctcgaaatcggcgacttcaaagctgatattctctgtgcggaagttttcccgagtgccaaaagtgaccgggagggtgatctggccgagtggagttgcggatagtcctgggattactccgtgaaaaggcgcattgcttggttttagctcggagcgaggaatctgcatatcatccaaggtcttggcgaagaggatattgagtgcactgccaccatcgatgagggttctgcgaagcttgacattacggaccactggatctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccaccgaagatatggttaagctccttgcggtggtcttgaaatcctgccggggtgtcgccgtcgtccttcttcctcgacgtgctttgttcttcgtcggggttcttccgcgtagtcttagtgtattgatccgcgaattgcttgtagacgaaacaatctttggccacgtggttggagttaggatggtgcgggcgttgggagttcatgatcttgtcgaacgtgttgacgcgcgaacgctgtcgagaagagtgactggcggttgcaacaagttccgcaggcttacgcttgcggtctttatgattgttacttccacctcctcccgaagccggcgtatccttttttggcttccaactgggacccgactgttttgatgcggtgacggcgtcttcagctttagcgtactcgttggctttttcaaacataagcttgactgtcctgggtggcttacgcccgaacttgccgaccaattcttcgtggcgaatccctttggtgaatgcggcgatgataacgtcgtcggtgatatcggagatcttgttacgtagttcagaaaatcgccggatgtaatctcgaagggattctccggacttctgaataacgttgtagaggtcgtattgtgtgccgggacgctcgaaggtgccttggaagttggcgatgaagtggtcgcgtaattcagcccaagatccaattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccgtcgtacttctctattccagtcggcttgaagccggctggccaatccactcgacgcaggtcgtcggtgaaggctgctactccgtcaaggtcgtcgtcgtggcggtccggcgagtgatgatagcctcgagctgctcggcgctgtatgattgtgtcgcgaagatcgatggggcggcgacgaggtggtgagcgaggtcgttccactcggcactctctatgatgatcgggaggcgagtgaacggaccgctcgtcgtgacccctgctcctgcgattggatcctgcgccggtgatgctgaggcttggatgacggtagtcatgagatcagaagtgggggactcggctgccagtcggcgtgtggacgctttcggagttaactgggaccgaagccgcaatcatggtcttcgtctggttcaagatgttgacaacgtgatcagattgattgagctcgttttccctgaggagggtgtcgaggagggtgatcgcggcaaccgcattctgttggggggtgcggaaaaccggtgtcccttcaacatcttgttggccgatgagatcacgcgctcggcgccctgcttctaaagctcgctgccgtcgatcctcagcctccttcgcggtccgctcacgctcctgctgctcacgccgtagccgttcttgttcttgtgcttgatgctcctcctccagtcggcgacgctcagtctcgtgacgcgcttcgttctcccgggcttggcgttgctcctccgtctcgttattggccatgaagacgccgaagtagagaggagtgtagttgtcatctaggcttccgtcgaagtcgtcgagatccgggtcgttgtagcgagaggtaaactcgtcgtactccacgatgtcggtggggcgcgagtggacggtgggagagctgtagtggccgtccagctgatccgtcgaaaccgtgccgagtggttggaggatgacgccgacttccctgaagctaggcgaaatcggtgttgaagccgacttccgcctaggcctacgggatggagatgctgtcgtgatggagacggccgccaaatcgtcggggagcttcatcaggatcggtgggtaagccccctcgtcttgatctggtgaggttggtgaagatgcgatctcgcccgagtggtttgaagccgactcgattgagatggtcttgaagtaactttcagccgcgtttgggagtccaaacggggccgaaatctggttctctcccgactggtccgactccgagtcaaggagagagatcttgccgaagttgttggtgacgaagtcgaggctgccgaaccgaaacgtctgcccgggtgggaagacgaggtcgtcgatgccggagacaggacccattgcactgatcggcgaaaagcttgacgcggcccctacctggcgcgccaactgtcgaaactagatttcggcaataataaaagggggtggctatcaagctggaaaagtgtatgggtttgaagacaaaggatttatacaggttcaggccttcttattcaagaagtaataccctactcctgtccggggatgaatccgccgagtgtgttattgattgtatgatttggagaaaatcaacatatgcccctagaggcacccggaccccccttatatatgggaaggagtccgtgttacaaaagacaatctatatccctaacggaatatgtagatacagataaaatacagtcgtaaccgactaagtctcaaggtgtttccttgatgcacaagttgagaaacaaacccgagatacaaataagatattctatctatattcggtatcctatattcagtccaaatatcatcgccgtgtagatatgggatatccataatctccacactgtgaacttgtttcattgtgacggagggaataaatatactaatgaaaataattaaaactagctaattcagctttgcctgtattgatcgcggaatcaccgaccgagaagctctctagttctagggcaggtttgaattaattagtggtattaatgaatgattaattattgcagtggaccaggatcatagcaggcagcatcgatgaagcagcaggcagggtaattgaattgctggaggatacaagcaaggggaatgtgatgtatttccatggctggggtggactgggggcttcagccgtccttagagcagtcgccaaaagactgacgatgaggccatcgccatcgccaggaagaagaaggtgggagaagatgatccacgttgattgctcggtgtggcagagcaagagggccctgcagaaggccatcgcccaggagctgcagcttcctcggtcgctgatggccttgttcgaccagcacgacgaggaggatgatttcagtggggtggatcagggcatgagaggggtggttccacttgtcacacagacaatcttgagcgacctggtaaaccacacattcctggtgatcttccacaatgggagcggcagctacattgatctacaggagtgtggtgtccctgtaataacaggaatcttgaacaaaacggtgttgtggacctcccgaagcagctttcggattaccgacttggacatggataacgtaagcaaggaggatcgggataagcttgctgggctgagtgatgtcgctatatatgcttatccaaccgcaggcgatgaatatagttttgtaatcttatttggaatgcttttgcatcaagaggcagaggaggttgccaggtacaccggtgtccctcaatctgctggcatgagcaccgagcttgtcaagaagtgcatcatgtatcagttgatgctaagacaacaacatgtggactacacccaacactgggatacccacgcagctaactattgggtatgcagtggaatcatacaaacctcagacaccactagtagtacaagttgtcatagctcatcgccatgggagatagcccaagctctttataataacttgatcttggagtttttgaccatagacgattacaacagcaacccaacttgtgcgaaaagaatacagagagccctacgactgccttctgattttgtgggcgagtcgtccttcttctggacatgtgatgctgctggcaataacaatgtcgacgcaactacagcttgttgtagacagaaatcactggaggccaaaatgttccaacatccatctgcaagctggctacgtgtgatacatctctttgaatgtaccttcagttttgcatctccacccttcctctcttgcagcagcctaagattcctcctacttgaccattgcaaagaccaaaacagcagcaggacggactcaacgctgacgatgacaacggataccggagatactagagcttgttttcggaagctgtgggtgctggacttgagtttcacagactggtattggctcttatcggttgaggccctagatttaatggttgagctcagggagttgaatgtgaagggaatcaagcattggagcataagccatctactccatcgccttgatgatgatgacgctagtaatagtacccgaagcagcagccgcaagccttggctgctcagccttgtcaagctccaagtcacaaccgaaccaataactgaagatcaacatcagtcacaagtatggaaggaagatcaggtagcagcaacattattcccgaacctatctagctgcaaaatcgtaaagacgatcattcttgatggttgttttgagttgaagcgaattgaccctcacgtcctgccaccatcactcgagtcatttagcttctccagcagcagcaatgacaatgatgttcatgtctcagccaagatagagagcatctcctttcggggatgcacccagttgaagagtttgttattgagaggactatttcaaaggctcaagcagctggacgtgtcagaaacttgtattaaaaccctcgacctacatgcaatgcgaggcaacgggtctctcaaggagctatttctgcttggatgcaaggagcttcgtgcaatactatggccaaaacaagatgtatcattggaggttctgcacatcgacactagtagcacagaacttgatcatgctacaggtgtagaagaatcatcatcattctcacctgttgaatttaaatggtatatttcagtgagggacagaaggctccttcgctcgctaaatgatacaaaatatcccttggatgcaccatgcatcgagatctcatcccctcctgctagtgttgctactgctactactgatggttctgaattaggcggaacaataagcaagagaaggcccattgccgttagcagggctgaacaacgttggttgatgtcgaccaaaagccgacgaccagctgctgacaacaagaagttatatgcggatgtcaactccacgatccagcacttgcaactacaagcaaccatgaatggcaactggatgtggccttataaacaggagggcagcacctctcactacattagcttacaagatgataagaggatgcagacgaaaccattatcgtcgccatctttgccaggttccatctgtgaaagagcttcaggcctgcacgtgcatgacagcttgtctatcgcaagtatcacaagccattcaaatggggcacggagatggaataatctagagtggtgcagagtggagagatgccctaacattgaaggtgttgttttcactccacctagtcctgttggtggcataactttcttgtacctgaagacattctgggcaacccaactagcaagggcacgccacatctgggactggggcaaaaggggcctgctgcacaaggggccagttccattcaacctgcaagtgctacacctagattgctgccccaggttgatatatgtgttttccataaatgacaacagagcttcctatgcataccgttggttggaaacccttgagatcgtgtgttgtggtgacctcaagtatgtcctccgagtgtatgataataatcaagagcttctggtggcaactatagaattctcagagctgaagcacatccacctgcacgagctgccctctctgcaacgcatctgcgggcataggattgtggcgcccaagctcgagaccatcaaaatccgaggctgctggagcctcaccagcctaccggctgttgggcttgacagtacccgcaagcccaaggtggattgcgagaaggaatggtgggatggcctgcagtgggatgggttggagaacggacaccatccttccctctatgtgcccacccactcacgctactacaagaagaaactgcccagaggttccatgctcaggtatgtacatatgtctgtgtgcatacatgattattacttgggtatcagtccttgcgcgcacatacatacatacgtagaaacttatatagctcagtactttagttactccatcatatatatatatatatatatatatatatatatatgatcgatcttttccctttttttttaattttgtctgacttggcgtgctttcttttcttcttaaattcaggtgatcgatatatacgtccatacactacatatatgatactgtaatcatctacgtatcattccctttccctcatccagtggctcatcaagttcttcagctctatctctattatatatgtccttatttggggctagtgttcaaagtgcttgctcatttcatcatatcatttgcaacggcatcaatatctaatgcatgatgagtaagtacatctctggccggcatccagacgctcgtcatctgcttgttactagcttggattctgttcatttatgcttcttttgttttgtgtgaaaattaataaatggatgctcagctgccagctggtgtgtgagctctgcatctatctgctaagttattttctccatacatgcttgctttccgtttggccggttagtcgatctgcttgttcgaccgatccatccatcggattactacgtatgcttcatctttctggatagatgatcatacatgtatatgtgaaaactttgatctctagcactgttctggtgtggtgtgcttcctagaggtcgacgaataaatcatcagcttcagcggcatgagaagatccattgggtgatcctcatgcagtcgagttgctgttgtgcacttgtttgtgggtgcgtgtgtgttcgtgtgatttgtcagcatttatggactgacctaagtttgtactcctaattacttcacttgtatgaacagaaacaatgatgctaaggattgtgagtgtgacattgtctatgcagcaaacatatatacctgttgctctgttatttggaaggggttgtatattttgctatgcagtctgcagtccacatagacgcctagtattttctttatgaaaaatacggtacaccttttgccttttatggttagcttttactcttttccttatgagtccttttacagtacaccatgctagtgatagagacgaaatccagccgtttatttgtgtggttatttttatactaattgatttggttacttaaaaagatttcccaccaatgccaccaagggaaatccaatcggcatttttttttctatctcgtttgttcttcgtcgctgcgaggattccagtcctgactcctgaatggaggacgcttcgtgctgaggcacagactctgatgaatttatctgtagctgcaagtactatgaatgatttggtgatgcgtagaacactcccagtatatttaggccctctttgttaagacttataagccaacttataagtcgaaaagtctaagccaaaacaacaagcagcttttt

SEQ ID NO: 80823 - DNA, 5203 bp, Oryza sativa
agctaagtgcctgagccgtgaggaggaggcggctgctggtgagacctccggcgagggccggggaagaggacccgctcggcgagaggaggatgcagccactggcgacgagccccaacacagtgagatcccgcgacgtcgacgcagcagtgcgtcatggctgagctggtggcaaggagacatcaatgaaaagaggaggggcggcggtggccgaagccaggagagggagggacggcggtggccggagctaggggagggaggggcagcggcggtggtagccgaagccgagaaagggagcggaggcagtggccggagctaggggagggaggtggtagtggtcgttggcgtcgggtaggtgtccggtttctgatacctagtagaaatcacctgatatttgataggtatcgcatgatacctcataagtatcatttgatacctcgcaagtatcacattctagtggtaagaatcgtatgatacctgacaggtatcatctaatacttcgcaagtatcacatgatacatgataggaatcgcatgataccttataagtatcacatgataccgagtaagtattaagacatgatatgtcagaggtatcaggatctaatacctaaccggtatcatcccgttccaacgggtttccgttgtatagcagtcggggaatgctacgtagtactactactccactatcttaccacaacaacttctggactctgaacagtttgcgcggccaaaaaaagaagttctaaacagttccggtgacacaaacatgttcacgtatttgaagcgtcgatgagagctcgccgattcatgtttgttagctcctttttaaaatctctttcttcctttttaaatttttttaactataattactattaagtatggtcaatattttaaatttcaaaaatagactttttttaaagttggtttcaaatggctaaaaagattcagatttgaaaataattttttgagagagtttatttttaaaattaaaaagattcagatttgaaaatatttttttgtgagagtttatttttttaattaaaaactaaaaagggtaaaacaaaataaaacttctcgtcaaggctcaagccccctgttccaacttccgccggaatcaaatccatccgaacgcgcgtccgcgacggcacatctcagggtccgccccaccggccgcaccagcaattctgcaaccgacccgaccgaatccatcctccccgccagccatggctcccctgccaccgccgcgtccgcctcaccggagccaccggcgagtccccgccgcctgctgcctcttcctactcctcctcgctctcgttctcctcccctccgccgccgccaagtcatcccgccgccccatcaccgtacgtctccctacctaatccctgcctttccttggcggcccctgtccgtctcaccgttcttgtgctgcgaatcccgtggtccaggacaacgagatccgggagaagaagagcgcctgctacaccgacgtcgagaagtacgtgcgccggaattacgcttccccccgtctgtgttcggtgggggtggttttgatggggaagtttctaattgtttctctctctctctctctctctctctcggtgggacagtggattgtggggatgggcgtgcaagtcctcggcgacggagaaggagaactgcgtgctgcggtgcctctcgccggagtgctacgatctcatatacggcggcgacccggtgagtggcggcgtgagagtgagatgtgatgtttcagaggagttttttttctaaaaaaaaaatcaggattcctttgaattttattttgggtgttttgtgttgtggcagcttgaggaaggggagctggactacatccgtggccacgagtacaagtactgcatgcacaagtaagaaacagagatatatttgcaatctgttgttaagtttaggtttttggatgttgaattgggtctaccctgagtccaacttccatgggtttgccgagttagcacatgtgggttactgtagcacttatagctaatcatggactaattagactcaaaagattcgtctcgctatttcccccctaactgtgcaactagtttttttaatctatatttaatgctccatgcatgtgtccaaagattcgatgtgatgtttttgggaaaaaaaatgggaactaaactaggcctgaatatgattgaacgaacacacccatctgctcaaccttgttacaacatgctttctgtgagctataggagaaggggtcaatagttactgaataactgaatatagcaatcacagcaacattctaacaatactacttctaacaaacaaaatgattatgtttgttctacccaagtgttccccgacatattcctcaacctccacaaactccaatagagcaaaggttatgttctccacccagttatcgcttggattatgcagtctagatattgagggccaaccaccaattttggcacatccaaatgttcgatagtctgactgatcatccaccattatattttcagtccattggaacttttttttttgttatcatatactgtcatttatcagttccaccttgttactgaagagggagaatttcactttagtttgcacgtgtaaaacgaatgatatgcttcagtcctcccatgattgattagcttgctaaacataaccaaaatagcctgactaggaagagcattttgttgttttccttttctgattcagatatttctacttgaaagatcataaaacattgaattatcagcaaatgtcctgagaaaataaatctgctactccagatattattgcagttaacgttccaagagtaattgactcaaatttagatactgctattgtgccacattttgatcactgtgaatctgcaatcctgttttatgaaatttacttacgactagctgaagtgttatcttcaggtaaataaaaatacagaatacttaactaaaggaaaatcaagctgttggtgttattacaagaataattctctaatatgaggatgttttgcaaaagacattgacattagatttcatgcatttctgttatgtatatacacgctccaattttgaattgcacttagaaaattatacatctaaattggaatttgtatcaccattgcatgattactgttagacctctacccatcaagttattctgctgtttttctccttaaccgtgatgtctttcgtacaacttgtccaggtcttcccttggtgaaagcttggatggtgtcaagggttccttcagctattcatgaagtgcaaggaagtaggaagagtgttctccgagccccatgaattataatacatctgaacctacggtgtgtctttctgttccactagtcaaacaagcatacatgtatgaattctgttagtcattgtctcgttgaatccaacatatatcttcgctattcaactggactaataataaggcgagcttaagcaatattttgagcataataaattcagatttttttcacatatgagacaaatcagtttgcaacaatgttgcaaggtcttctattgcatatactaaagttttgcactactcatatcagcacaactaaccatcgctgcaatattgatacaaaaatataatcagcaacttagctcaaattatgttgattttaatgtgctctcagattatgggctgtcaacttaatggcctgctcgccacaagaggtaaagttctaaaccgtaattatgtgtggcaaatataaggtctagactaggttccaaacatatccatttcaatcaagccttaggacatattagatatggtctcaaagactaaactactgcattatactgatcagttattatgattaacaatcaaccattactaaacaacaagaacgatgaacgaacaatactgctagacaaaacaggataattgtacaatgaaaagaataacggcagtacatcaaatgttgatcacatattaaccttatgaaagcatatactctaggtggatttgccatgggggcagtgggggctcgagcccccactaccggcgctgagactatgggggccccccttaatattttctgccatacatatatacatacatgggaagggggtatggagctttgtccagtttgtttagcctcccctggtatttcttcttggatccacgatatactcacaggattaaaatgaattataacctagtccttatgcttgcataagattaaaatgtgatcaacttttgatttacttttattgttccctgttttgtctagctattttagtttttgttacttggtactggcacacataatcatggattagggcttgcctcttgggggtgagaaggtcattaaattggcagcccatcatctgagagcatgttaaaatcgacataatttgagctaagttgttgattatgttttcacatatttattgctgcaacagttagttgcattgtgtatgatatgggtagtgcaaaactttagtttgtgcaatagaagtacttgtactatcattgtagcaaattgattcgacttatatgtgaataaatttgaatttactatgcttaaaatattgcttaatctcgtgtttctttcaacattataaacatccaacatgatgaagaaataaagtaaatcaataagcaaacaaggtaaacacgtgcgaactccatactggagtgatggccgagaggcacaaaaccatcagtccatcacccacccctgcaacgaggcacgggcattccgcacacaaccatgcccgcccatgcactggtcagcaatgttggaggggtggaagacgttggccagcgacgttggcctgcggtctgcggaggagcagctggggagttggggcttcgagaggatgggagttgaggagcagcttgcggacttggggctttgagaggatgggagttaaggagcagctggggagttgccacgagtgataaagctgacactgcgacctctcaagccgatttattttggattcaacaagcacatatacatagaacaccagatataaaggtgagttgaaaaaagtttgagttagggagtacagaaatgacatatacatatgaacacaagagataaaagtgagttgaaatattttgaaatagggagtacagaaattagactgggaaaatggaagcagggaaagttagagagggggattacatttgggaggaaggaggagaagcagggacaaagcaattctcgaggaagacgatgactggttcgt

SEQ ID NO: 80824 - DNA, 7341 bp, Oryza sativa
cgtcgccggggaggatggtgcgtggatccatcgttgccggggaggaaggcgcgtggatccgtcgtcaccggggaggattccacgtggatccatcgtcgctgccgccccccgtgccgttgccgtcctccccgcctcgcaccgtcgccgatctccccgcctcacgtcgtcgtcgtcacgacctcctccgcctcgcaccgtcgccggccggaagcagcagatccggtgccatcgttgccgccgggaggaaggcgcgtggatccgtcgtcaccggggaggacggcaaccggcggtctctctctctctcctgcatctctctctccggcgggcggcgagggtagaaggggaaaaacagggggagagagccatgtccacgggctcctccctaggcacaggggtcgcggccctctgctaggagacagctccagccgaaaaagtggacgccgtgagtagggatactccagggcacccattgctgatgctctaaagctcaactcccaaagaaaaacttgcttacaaatcatggcagtgacaccgtcggtactctgtccaagaccgttagaaaccgttaatgaaggatttattgtactactactccgtagtattctactactactgtatcgccagcgtttagatgaagattcaagtaatgtaggagtacactggaaagaatcgtactcgtgtagcttcatcggggaactggccgataaatgctcgcgaaggggataacatgccgtggtggaccggcgactagtggatatgcaagcaaattccgtgtttagttaaggtggtgtttggatacagtgacttaactttagtccctctatttagacactaatttagagtattaaatatagactacttataaaactaattacataaatgaaagctaattcacgtgacaaattttttaagcctaattaatccataattagagaatgtttactgtagcatcacataggctaatcatgtattaattaggctcaatagattcgtatcgcgaattagtccaagattatggataggttttattaatagtctacgtttaatatttataattaatttccaaacatccgatgtgatagggacttaaaagttttagtcccatctaaacagggtctaagtctcaacttctaacttttcatcacatctaaaatttttctacacacataaactcccaacttttttttccaaactatcaactttcctcaaacttttaacttttttttaggaactaaacacaatcttaagctggaattcactctgggtgaactgatgaatggacaggctcaggtactagtactggaggttaagaatatcgaattccgtggtgaaacaaagactttgctcatgattttcaaaaatcaaattatggactcctcctagtttcttttgtcctgatggtcccacatccagccttacttaacctttaaagacagaggcacctgctgccaagctgccttttgcacctgcaggagctttggatataaaaaaaaaggagcaaaaggagagaattctccaactaggctccagtaagtgccacctagtaatccatcattaaagcaatcaagcctcctcctctccctaatcccatttcacaccctcaataacaccacatccagctgcttaagctaacaaatcttccattataattcaagattcccatcacctgcccagtccatttctcctctactactagtaatactcttctctcttctcacagggagtgtgtgtgcctccatgacagtgctcgctctccctgagccgagagagtaaaggctctctccttcacacacctaccgcctactctcccactcttcttcccaccccactcgtgtgcgcgccactgccgccggcgatggcgccaatgccggcgccggccgtggctctggcggttctggtgctcctctccgccgttccggggtacttctccgacgacctcaacaccgacgcgcaggcgttgcaggcgctgcggtcggcggtggggaagtcggcgctgccgtcgtggaacagcagcacgccgacgtgcaattggcagggggtgacgtgcgagagcggccgcgtcaccgagctccgcctccccggcgccggcctcatgggcaccctcccgtcgaacgtgctcggcaacctctccgcgctccgcacgctctccctccgctacaacgcgctcacgggccccatccccgacgacctctcccgcctgcccgagctccgggccatctacttccagcacaacagcttctccggcgaggtcccggcgtcggtgttcaccctcaagaacctcgtgaggctggacctcgctgggaacaagttctccggcgagatctcgccggacttcaacaagctgaaccgcctcggcacgctgttcctcgacggcaacagcttcaccggcgagatccccaagctggacctgccgacattgagccagttcaacgtgtcgtacaacaagctcaacgggtccatccctaggtcgctccggaagatgcccaaggactcgttcttgggcactgggctgtgcggtggcccgctcggcctgtgccccggcgagaccgcgctcacgccggccggatctccggaggttcaacctgctggtggaggcgcggcagacgccggcggcgcaagcagcggcacgaagaagaagctctccggtggcgccatcgccggcattgccatcgggtgtgtgttcggcgtgctgctcttgctggccctgatcttcctcctctgccggaagaagtctagctcatccacgccagcgacagcggtggagaagggtcgtgacctccagatggctccgatggacatggaaccaaagggacagaacggctcagcagccggcaacggcgcccacgtcggagcagccgcggcagcgccagccgccgccacctccgccgccgtcgcggcggcggcagcagcagcgaagaccggcggcgcgacgggcgggtccaagaagctcatcttcttcggccccatggcggcggccccgccgttcgacctggaggacctgctccgcgcgtcggcggaggtgctgggcaagggcgcgttcgggacggcgtacaaggcggtgatggagagcggctccgccgtggccgtgaagcgcctcaaggacgtggaccttccggagccggagttccgggagcgcatcgccgccatcggcgccgtgcagcacgagcttgtcgtcccactccgcgcctactacttcagcaaggacgagaagctcctcgtctacgactacatgtccatgggcagcctctccgccctcctccacggtaaaaaaaattcccccatcctttttttacgcttctgtcggcgaaccgaatccacactatcaaaccatgcgtttttttgagcgatctcgccgttacaccctggcgatattcctccggtctccagtttccaccggtggccgcagtggcgcaccgcgagagtcgtcgcctcgttgggctctcgcgtaaggtgtcgcgtccctctcgtgtgtgcatctcgttttcgtggcgtctgtctcgtcggggtcgcggctcgcgactgtggctgctccgcctcggcaccaatcaatggtggtctcacctactccgatccagtagtgatcctccggtttttcttctcatggtgtggccgtgtgtcgccgagccaagctgagctggttcgacggggcgctgccaaaagccaagtgtacttcgtcctatgggtgagccgcgattagttagtttaccagcaaacaaacactgcttcagtgtttgccagaggggtgagcgtgagatctaatcttagtttaagcccacaacgtgacagccatgactggccccccggcacgtctcggcattcgaactcgcagttgaaacaggtatagcaacttgcggctgttcatttgaaatctctgaactggtgccagtaaagtaagcagagtgccagagtttagtgtaggagggagttgtggtagattggtggtaaatttgggggcaagtggcgcatgtgagccggtgccccgggttgcagtccgggtagggtggtttgatggaccatgtgacgtttggttggcgccactgttcctcgcgattccccttttgcgcgccaataatttagcctcctcctctcctctcctctcctctcctctatctcgcgtacagatttgaagaattattcattcccggacagcgtagacagatcatagatgtacacgcgcactgttgcacacacacttgagacgtgaagctgaagctaccgcgctgtggtcgcgtgcaccgtgcagtgaacattcttaattgtccgccgtcgtgaaaacggagtaaaattcatggggaattcgctgtggatgacgcggtttttttctggtgtatctcatgggggttgcagggaaccgtgcttccggcaggacgccgctggactgggagacgaggtcggcgatcgcgctggcggcggcgcgcggcgtggcgcacatccactcgacggggccgacggcgtcgcacggcaacatcaagtcgtccaacgtgctgctcaccaagaactacgaggcgcgggtgtcggaccacggcctccccacgctggtcggcccgtcattctcgccgacgagggtgtccggctaccgtgccccggaggtgaccgacattcgccgggtctcgcagaaggccgacgtgtacagcttcggcgtgctgctcctcgagctgctcaccggcaaggcgccgacgcacgccgtcgtcaacgaggagggactcgacctgccgcgctgggtgcagtccgtcgtccgggaggagtggaccgccgaggtgttcgaccaggagctcctcaggtaccagaacgtcgaggaggagatggtgcagctcctccagctcgccatcgactgctcggcgcagcaccccgacaggcggccgtccatgtccgaggtggccgcgaggatcgacgagatccgccgctccagcctcggcgaccgtccggccaccgacagcgccggcgagggcgaggagccttcactataaccgaccagccgacattgccgtctggatcaccgtacatcgatctcagcctcagcgaacggaaattaagttggagaattgcttagttctttgcatggatcttgctcccccaggctacttttggttcatcagcaacttgtgcatgtttttttcattactttttctttcttcttcctttcttttttttcccttcttttttttgggcctttctctcacgggctttgattctattctatagcacatgtcactgtactctttgattcttggaaaggaacacttgataatgcgttgtatctatgacgaataccatcaccagctgtatggtttgctatttaaaatacgaaatgatttcatttcagctgcaggtagctaggctttcgttgccatgctttgcttcccgtctcttcttatcctggttgttagggggaggtaatggttgttggggtggctgcttccgacagagtaattaaccatcttttggttggcgaaattgccatctgatagctctctgcttgcaaatggcgtttagctagcttgctggtttagtaggttggaaaaaagattgtgtgttctttatctaggagtgatgcccaagttaacacgacgacagaaagagacccatgctcatgcaatcctgtgtttgtacgcagtttacatgacagtgacaagttttttttgtttttaaattttgagcctccactcaacggtgcagcagccccgcagtgccaccagatgcaagattagtttagcttttgcaaatgcaaatgatactcaaaatgtagagccgaatgttagcactaatgtggcacaataaattagtacgtggggactgactgaacgaatacagcagtaggctgatctttcttcattgtttagttggtactgtgaataatggaccctagaagagttataccacacggtacctcatcatacccgttaaaaatggcaccgacgatacacttatacataagccctcgtctgaaatgaattgtatttttcggaggactttttgtgaaaattaaactaatttctgtaaaaattctgcgtttcaaaggagctatgagattacatggataggctgaatctgatcatattggagaaagaaagttagcatcagcgaatagagtaagtttatagtaatacgggaaaaaattcttatatcattaaatagcacaaactctcagtctaaatcatctgataaatgtggattttattcgttggtccatcttaccataggatgctgttgctgctacaatttgttgacagggaaattaatttattattgttaatgcccccatgataatatatagacctaacgcatgcgtcgttagcctgttacattccgagtttcaacgctgacaatttgtcaaattgataatgagcaccttcagaaaaagaaactgataatggacggctcagattgcctgtcttcgatttcctgtacccgtgaagcagtatattactccgtacacggattggccagctgatgaaactgggctagcgggctgtctaatgtcaaaccagctggcacactagttgctggcttcaattcgttcattgtagctgccaattaataacatctaatgaggaattaaagacgcatgtagtacgccattaaccaatagtccccagtggcccactacaagtacgaaccgaaccgtttgtaaatgtttcactcctcatctcagatcagcattggtaattttggtagttttgtactgcacctgtaacctgtaaaagtagtaactagccaagccaacctgagcagcatcagccagcaagaagtgaagaacatattggctgtacaatgtgtgctatactacactgttccatgaactgtcggccggcggccattgcagcatgcggcctggcttacagcctgaaagcgaccagctctgccttttggctctggagtctggacaccagcttgctgggtcatgcctcgtcggaatcatcagattctcctgctgctacagccggactgatactattaatttattcctaatcccggttggttgtcctcgtcgatgttctatttgtgtttaagtttagctttgtctgtcaatgataacaaggttcttttggaaagaggaaataaaaaaaaaagataaggactcttttggatggaggacttttatgggaattgaagtaattcatatgaaaatcctgtaacatacatgcattccaaatgagtctttgagtgtttatgtgtgtttcattacgatctgatttagaggaggaactttttccataataatgtgggagttgaactatttatgtgaaatttctacgacattctattgaattactaaagttggccttaggcctcagcatatgctgctgatcatttttgttaggacaacatccatcagagttg

SEQ ID NO: 80825 - DNA, 8652 bp, Oryza sativa
ttcttcacaaatggattaattaagctgctaatcatatcatctttatattagtgcttgctatcatggatagtagtgattgattctttaaagtggactggattagaccacttccttttccattcataagattatctagttcttgggataagaaatgacatatactaggtgttttagatgttgaactgaaccttgaatgctgttgtttctactcagttcaaatttgaacatacccctcatcagtggactgtttttttttttttgggttagtgctgagtgcttgcaaccactttgttggttggtgatatagcatatgttctgtattggcagtaatttaggcactaactgtttctcttcttctctttttttcccctttttggttcaatatcataggtttaattttttaattgttccttcactccaattttcagcatgatgcttgctgttgcactcaatctgtctctgttcagtgagcgtgtgcgtttacctctaggacagatttataagtcaaatatagtaggtgaggatatctgagattgaaaggggttccaataaatatcagtcaaattgcacctatcttgacaaatttcaagtaattcgccctgggggcatcagcaagttaatgtcacatactaagatgtccttgtcatggtgcgttaccaattgtttggtagttccaaattgtggaaacgaggtcttattcttgtggctgttcaaaatccttacgcactacttcctcaataattaatagccatgattctgtactgtgagactattaacaacaaaggtagtgtggtcatggatgcatttatgaatagcaggatattgaagatgatttgtacaaaaagagatcttgatttaatgcacagcatgcatagcatcttgttctctagctgatcaggatctgctgtactccggctcaactcaggtgctgtcctaagcatttggatatgaaattcataaccaattgatggaggtagtgggtacaacacaatatttagtagtatctgtgaaaattttggatttatcattttcaaacccagttgggaattcagttcttgcctcgatcaaaatatttaatccacttcttacacgccaagtgtgaggaaaatagccattcacttgtttcaacccttcttgattttgagataaaaatgatgatcttcatcatggcatttggacatgtataagaattagaagatgtgtcacagttatagtactgttctttctgctcttttgccaggctatggttccttttattggtttatatgtctataccacccaacattttttttcaaagaagcattttaggttaatatttattttataatgaaagtttattgtggtggttttattactgctgagaaatggagaataccaacaaaaattctagagggagggagaggtatataggctttaatttggtggatctaagttaaaggcccagatatgatagttgtttatatattgattttctgaaagaaccacatctcaatcctgtcacttagggagatttcaaataagttggcactaattcaacagaatataatatcccaaatttagattccgtttgcagaagataattttaattcacttcacaatttgcacagggcaatcagctagtttactaagaataacatgtatactgctattttgcttctcagtttaagttggttttgaagtctatcttcaccctgctattgctgaccatgcttctctgttcattttagttggacggcaatcacccagatagtgcaccatggaatgctctttgtcccgattggctacaccttcgggtcaggcatgttcaagatggatgagatcagaggaggcagcccctatggcgctggcgtcttcgctggtgatggcagcagacagcccagcgagacggagctcgccctagccgagcaccagggcaagtacatggcctccatagtgaagaagcttgcccaggcttgagcctagaagaagttgaatcctcccacgacgccactgtgcagtccaaactccacacgatcgtccagtcgccattgatttccccctattggtttttcttcttctatatgtaatgtgcacagcctgatgatcctcagatcgtcgtcgtatttgttcgtcacagatttatctgtaaattgttgacataaaacattgtttggtgtccagttgaacactaagtgtgccatacggtgttgatcgaaataacatacatcacttgccatagatttgttatgcagaactctgtttctgtatccagaactttgtttctgtatcatgaatgaagggaatgcacatgcttgtacagtttgtactgatgaatatcagtctgaatttctgatactgcacagtggagtggcgtcaggctatagcttgcaggttccaactggcggattcgaaggctgagccgccacctccagcgccgacgatcaccggccggcgaccagcagggtgctcgtcgtgacgttggcgcgaggcagtgttgcttcccttcagaaagcgtattcggagaatacgccgtgttgcctggagccttgaaggggtttatgtggcgaaaatacgtctcttcgcatagaaagcgtattgggagaatgcgtattatggctggtaggtggattcaaaattttgaaatttgcctttctgcagggggggaaaccgcagcagcagcggggagagtttggtcgcctgaggtttttgcctcgccacgccggagtggctcgccgccgccgccgccgtggtggaaggagtccgttccggctcgtctcgccgtcgcacccccctccgctggtacgagattctcagattccaccccctcccctcccatccccgtcccctggcggagctccgatcgcacgcgattgagggcggtgaattagttcgaggtagcgatcacaaggtaggggacgctcgctcttcgattagggtgcttctcctccgggccggcgactgggctcaccgacgagttctgcacccttagggttctaatgttgtgttcctaggagtttgattaggctttgggggggggggggggggcgctcgcttgtgcaggtgtagcgttggtgttccctggtgacccaaaatctgctgggtaattgatgcgatacctcctctgttatgccattagcgtgttgatttctggagtggaaggggggatgatgggtctctgatatggacttgtagaattgtgctacatatgtctgaacaaaaagttctttgaacttggtggatttttccagaatgatttctggctgaaaactatcaaattggaaagattgtgcagtttggatagattttcctgggtctatacctttttcatctttatttattacacagggaaatcctataaggatgatcgatatttttgtttattccactatctgtttcagtgtcatcattgtacaggaaaagggcactgtctattgtatgtttacagcgtttagttgacatgtcgcacctacttttacaattttcatgcttctatgatagtcttggtatctaatttttctggtcatatctcctcacctgtgcataatttccaaatcttgttcatcataaaataaatgaattgatatggagtagtgaattctttgttgttgcaattgacttcaacagagcaaaacggaaccaatgatggacactctagagcttgcaagtgcaataccagaagctggagatgaggcatttcagattcaccgcttgaagcgatctgcatatgctgctgtgctgagagcgttctatgctcaaccagaccttctctcaggggtacttatttcatggatactttctttgtttgtacaagttcaattgcaaaatatcagtaaacaaatcatacataatatcagtaaacaggttcaattgtacaagttctatgctcaaccagactttctttgttttatcactcatcttgcattctgcattttttttaacgattgttttgttacaatgaattacctagaattacatagcttgatcagtgaatccaatctgagtaggttcacgtagccatgcgtcataattggataacacggcaccatggaataatatttgctttgaccattaccatatgtatattcttgttgttcattatcttcaactcacaggccaaggaaggtagtcttgcaaaactgagaagtgaattcacaatatttgacaccgagcacagagaatatctaatgaaggctatctcaggaagtcagtctttgaggtgcgcaaatcaagtgttgtttcacagaatataaaatatatgctgatagaatgatcagtgagcttacctgctctacctttccagattcccaatatctcttttatatttgatagtattgaactcatatttctacggttgttttagtgttggaaatttcagatctccttgactgtgcaaacatttctcatactgtgacaagtaccacaaaacaaatcaactgatattgtgctgcatttcttgttgcagtgttggtttgaacaaagcaagcatttgtaatattgaagttacaaaggattctctagatcttgtacccatgataacagatgctcaagatactgcatttcagattcactgcttggagcgatcagcatatgcttctgtgttaagagctttctttgctcagtcagaactcctctcacgggtataccgtatatgtgtcatccacttatttctataagttagagtatgatatatcactatacaatgcagcttccattttatagaactttcagttcttagttttgggagaggtgtatgatgccacattttcttggtgctggagaaataggctcacattattgctcattccatactatctttcttttgcgcatttatagtcattatactcttatggtgaattattttgatttattgtaactggcattgcttcatctttattttttttatttttttgccttacagtcacaggccaagcttctcactgaactgaggaaaaaacttagaatatcagatgcggagcttagagaagttctcatgaatgtcacttcaaacgagtatatcaagtctttgcggtgagcatatctacttattgcctcccaggaaacaaaattcatgttgatcaatcagatgtctgtatttctttgcacttagcaggaattgtagtttggcaaataactctggtcttaaggatcctacttttgatgcacgtgccatggttcctgataagctcgtcaaagatggacaaagcttcacctcattcacaaactgcatcagtttgtctcaggaatcacaaatatcaccgcgttcaatgctatctgtgaggtgattatgtttttgttttttattatttcacataagttaagattgctctgaaattaactaactgttggattttcagttttctgaacaattttcacttatgaaacaggagtgttgacatattacgtagctctcacaggaccaaaaagggtccctgtctttatccccatgcaatagttcctgctaagaagtactctggaaatgagtacacattatcatacttaaaatcctctccagctgaacaattgccagttgcagtttcctctgtgcaggtggtatgtatcggttctttcttagtagctaacatcttaaactacaatatgagtggtattctggatttatggaattttttggctcttctttttcctgctagtaattattatctccagatgatgtcatgatgagcttaatttcattaaaaaaatatccacagtattcagaaggtaaccacaattgccaattggtaatatgcccattcaaactattgtggttatgtacttatgtggaactgtaaattatgaaaaaccttcccttttaatacctctgtggtttagtaaacagcttttgccacttctctgcctgtttttatggtaaaaactcagttaaagattttctttaaataaatcacttggcactgatgaaggttcgcttctaataatctagcattctagccctatgtgttgattataatttttgacagaaacgtagcacagatgatccgcttgatactaagacattaccttgtgaagtgaagactggctgcactctatctcccatccaattaaagcacatccaagcaaatgctggtcatgttcctttgtgtattcatcaagacatgaaagcatcaatgaaaaggaaaactgaagtgccagaagtgacaggatctaagagcttgactgtcatcgtgtcaactgctggaaacatagaacatgattttgacatcatgaagcttgacctaactgccaacctcctgagcaaggtacatgtatcatcctgagtattaaacattggacttggctctagatggtgaactccccctaaattatgatatctgactgcttactaactcttttaaatattcttttttccggtgatgtttcttagaaattaaattttctttgataatattataccacttcctgtttagcattttctccctctctttgtgcttttatgccgtttatttttaagttatatcaaggtatcaagctatttggttaaggtgtggctttattccattacttgtgtttttttccctctctttcatgtataccattcgaccttgtttgatctgcaatgtttgctactttaagaaagaagataaggagctctttgtattataatgagctttagattcacattctcattttacaggttgaacaactgtttagagaaaagccaaacccagatgatttagagacagcaaaggcgatactcaaggtgagaaccctcttgacttggataactcagtatgtaagcattggatttcatccaatctccgcttgttctaagcattatgtacttcaatgccatttaaacttgaaccaggaacaagaaaaggtccttttagatgcagtccttaagctttctgaagtatcatatgttggtgagtcgctttttgtatacttttttgttttctcatagcttagaatgttagttcttttaagaaaatattttagtatatcaactacactactttagggggttctgcagactcttttcctttttttaaccaaaaaaaatattgcatcaccatcataatatattcctaccaatgaactactggatgagtcctcttagaagttaccaaaactcttagatatatatttagttattgtgatccgtatttggcataatagaatgtgctatgagactgcaaatataacaatatttttccacctgaaaatattgaatttgatgattgacccttatgaagaacggcatccatcaaatccctctgaaaacactggattcaccatttctattttttctatcttcatcaaatccctctgaaaacattgaatagcaccgatttagaactgacatccttctctttgtcccatctactccgtagaggagtgtttcagcaccaactgccagccagatgagttcaaccagcactatgagtatgagagcgacgacgagatgccgcagaagacagcgagcacaaacgacgccgagacgccaccaaaaccggtgagcccaagcgacaaggaggcgcctccgcagccagtgccaggacgtggtggtggcgccaccagcaagggtaaggcgaagccccgcgactccggccggagctccggcggtggcagcggatcaggcggccggctcgacgcagcggacgaccaacccacctccgcctccacgtgcacatcatcaagcacactgtcgccgcgatcagaacgagagggggaagccaaagcccagcgcgcgcgcgggagggtgtttgaaccaccggccaagcgggcccggcgcccctccgtgaggctctcacggtcggaatggctctggtggtgaatgcgcgcgcgactgtgttcagctggaagcccccgcaatgtgaattcgcttgacaacaacatcatgactgaccatcaccaactctgctactgcaaaatttgacagttttttgctggagacctctcacctctgatcaggtaaagtatagctctcgcctctgtccggcctcttaagctttaagcacaaagtggtacatagaacatagttaatgtaactagctagtcctttcttccatgcacatataggtccatcggtagtcactttcaattatcaaaacacattttgagacagtttcatgttcccactaggttatacagtacctaaaaacatttcattactcactatctgctatgcacttgtggcatatttttttgtgctttgccatggattggaaacagtgataaaattgatggttttgatagtgtactgaattaggctgcattctcaggcagctttaagatgttgcctgctagtagcatagtactatccctgcactgcagttctggaaagtggtcgctggctgtgcccatgtgagtgaagatggtggtaatgcctgtgccttgtctatcccatgcaattctccctattcgagctgtagatatcatgccattaggtacagagactcgagtgaacagcattagatctgaaaaacttgcattggccttttataactgctcgcagctaccactggtcccggtcacaagtacttcatgttttttgttggtctgtccagctccagcatggttaaactgtacattcatcacggttttgtgatggctgagtggcttactcatgcaagatctagttatgcagagacagggattggtcttaactcttaaacaaagtgtatcatcatgatgtgatcgtcgtctaatcaataa

SEQ ID NO: 80826 - DNA, 1930 bp, Oryza sativa
  unsure (1)..(1930): unsure at all n locations
tacttttcccaacccccagagttcgagtatgtgtcagatgaaggtttctccgaggagtaggcttcgtccgtgccgtcgaggatgcctgtggagtggtgttcccgctgcagttctagtcaaggcttagctcctgttgtctttctttctttccgctgcatttatgtaagacttttatgatgtttgtaagacgtggatctgaatgtcaacattgtcgtttgtgtaccccggctggtcctggacggggattttaatgcacattctgcttgaaattctattcgggaatttctgggcgtgacaatagatctcttgatgcttttgaaatttttggacaaaacctcccccccccctctttttggatgagcaagaagaagacctcaaatcgtgagctagtgtgggggggtatatataggctgcaggctaataggtgccagttcttgttaaaaaccggcagctatattaaaaaattgacacctatactttgcatcataaccagcacctataatcctccccgacctatatgatgcaaaccggcacctataggtgttatttgtgctggtttttgaagccttattggtgtcgttttactaaataaccggcaccttttatataggtgccggtttttttgcatggctgccacctattaaatttttggaccgctagcaggaggatttttaatgccggttttagacaaaaaccggcaccaatgtcccttccaactaaaaccgaccacaattaaccgttatatgtgccggttttttggtctaatggcaggaagcgccttataggtgctagtttttagctaaccggcacctttgtggccgatacctatgggtgtttttgtagtagtgtgtgatggtggtggtggacctcgacggcggaggaccgtcacggatgctggacgtgagagccgccgccgccgccatcgtcgtcgtcgtcatgcctgcgtactccagcccgtggcctgcgttttgttggaattaatgaatgggccttagcccactcgaagattaattctttggaaaatcacaaaaagcccacctcatgggatggcatgcatgtggagtttagtaccaccttgcttattctaggagagggggacctccttaaaagggaggatgccctcctagccacttgaagcatgtgtggtggcagagaagaggggaaacacgcgcgcgctcgctcgcctcgccgggccgggccgggccggcggcgcgcgtgcacgacgtacgcgtcgaatggtccgaaaaattggctcctcacccttgcgcagatgcagcctccttttgcagttttgttttgctgcaaattcggattcggttttgttttggaaacgttccgaaaaatccggtgcgtgcaaacggcgtggnagtccggataagttcgcgcgacttatccggtttggttacgtgcagtagagatcgtgcgggcgccctgatcaagcgacccttctctatataaaccaacctgccgtcttcacgcaacatacgcgaaatcaatctagggtttgcctcctactctgtactgcgccgtcgctcgtagactactccatccctctcgccggcgtgcaccggcgatcgggagagcaggtctccggaacctctgccttcgacgtcttgcaccgggagaaggcggcaataaggtttttgggaagcgcttcgcgcgacggctcgccttcctcttcgctcgcgtgtttcgtgccttcgtagacacctgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatttcaacaatccaaaaaccttattgta

SEQ ID NO: 80827 - DNA, 3233 bp, Oryza sativa
gtatttttgagacggatgtagtaccctttaactaggacatatatttggatcattcatgcatatttctggaagtgatcaaattttgagggcaatttttaccatccttaaagtaaatgttggaaggtaatatacattttatagtgtaaaatttgatgcgttcaaatactactacctcgatgtattaaaaatttttatgtaaaattttgataaataatgatactttcttaatgagcataaaatatcttatttcttgaactgaaataggagtgtttcgatcaggaaacagccccaacaatttgagtcttaatttcaccgttttgtacacaattaaagtaaattaagtaaaagaatcaacaaaatgttcatcacctttgacatctgtcatagaattgcaccggagaaagatgcaatgtttctgagagaaaaccgttgcattttccaggtgctctctctcatcattattgctaactttcaagtgtatttggtctctagaaagatgcaatgtatgtaaaaaattgaatattagggaaggacctattatcaaataattagaaggggtgaagcttataaacccagatcgttcggcccaccaccttgtggagctagctgaaaaaccctaggcgtttcttaagatgcaatgtatgtaagctactactacagtagcagcagctactatcatcatcatcatcatctcatcatatgcaaattaaaggtcatcattattaaatgtataattaattattttaaaagtgtgcatctgtttttcattacatgtcactgttaagatgtcgactagcgagtaccatgtaatgccagtccaaactaacctaatagttcacgacaaacatttttctcatagtttgactcccttgctgatcagctccatgattcaagccgaagcaactcccttatccatggaaatgtctatatctttgacatattatcattaatttccattcattgcatagctaagctaaagtcctaaattcctagctggaactctgaacagctataccaaagttttgtcgacgaacatcatcaatttccgacagaaatgatcggtgaagattaattacagtctcactgtctccgattgcatcacatccttgacagctgctggactgtcatctttaactacagattccttgagaatttcctcgtcgcagctgctggactgaagaatgaactgaatattagctttgcttctagaagtgatagtagtggttagcaatcgtattttctcagaatcagtcagcagctagaatcattaattgttagtcaatgaagagtatctttactttaaaaatgatgaaaagcgtcttgctcttacgtagctagctagccattctccatttattttagtactcagaaaaaataaaattaaccaagtgtttgaattgaggatagattcagttttttgactattggcccggtccatgcttacccatttgacatgttagtggtgccagttatgtactgcagcctctgatgctgatcgagtgataggctcatagcaaacatagttgacgaaaacacatgaatgaccatatgagttgtctaggacaaaatattctgacaattgactaatatattaccccaatttgtccaaaacagttttgacatagtacactcggagagttttattttccttgtgcatgaggtgcaagaacgaaaagttcctcgtatttcgtactcctacatgataatatatactccctccgttttaaaatgtttgacaccattgactttttagtatgtgtttgaccattcgtcttattcaaaaaatttaagtaattatttattctttttatatcatttgattcatcattaaatatattttcatatacacatatagttttacatatttcacaaatttttttgaataaggcgaatggttaaatatgtgctaaaaagttaatggtgtcaaatattttgaaacggatggagtatatcacagcaaaacatcctgtcatagatcgattctcaaggtctaaactctagcaagatgctaaaattctaatcaacacttagtcacaaatgcatgtcattaagggtgtgttcgtctttaccacctcttcccaacttttactcaatcattttccatgcgcacgcttctcaaactactaaatacatttcttttgcaaaaagtttctataggaaaattgctttaaaaattaatattaatcaacttttaactttatttcagctaatatttaattaattatacactaaattaatattaaacaattcgaatgatatttatagttcaaactccgaaattttgatcgagtggttgttgaaaacaactaatcttactgtgtttttccccattagctgagtagctttttcggcccctgcagttttaattagtattcctcccagccattgattttgaagacaatattgaaaacctcaaaaagtcttttagctagttctacaatttatgtgctttgtcttgcacatgtattgagaaaggctagacttccaatcaattattctctaaggctccatttggtgttgcattggatactattctctagacatctcgttgggtacaattgttttgaacttgttattgttatgatgcaaaggataataatattttgtctagccttaatttgtctgtggaacaatactacaaacaattattgtctttattttcccaacaacttaaaaatatgagcacgaggcaacataacaaccacaaactgagtgtaccccttttacttctcacctagaatatataaagttcaactttctaaaaattgaagttagcaagttaaaataatgtgactatctataaaaacaatatcgattggtacatttattttcaaaatattactagccacatcgtcgtgctttgtgcgactattgattatgtttaagaacttatgtatatagtttattagttcagcttagcttttaaaaaggttttgacataagttaatttatttatagaatatcgattggcctagtcaactattgtcttttttaagttatatatgtttataagaggaattggagcctcctgttttaattcttcattatctttggcccctctctatttgtatcagtgtctaagatgagacactagaaacatacagaaattctcatatgtttagccatttgtgtttttttattaatgcatgtatcttttgacctaatgatcattggttatctaaactcttgatccgacggtcaatatgtttttgtgatgtagcacatccttatgc

SEQ ID NO: 80828 - DNA, 973 bp, Oryza sativa
atataaagagctttccataatccacacgggttataaattatgaggcccgccagtatagacctcgaaaggggcaataacgaaattttctcttcccatatttacaatcaaaacaaaaaatcgactatttttaaaatcgaaacaattctcgtgagccaatgagggtgaaacgaaacaaagttggcgcataactcacgggaataatttgttctagcttggacattaacacatcaaccaacaggatgaataaaatcattagtagaaactagtcaagcttttttcctgcaataattttcaaaattccactcaattatacagttaccatgaccgtaacccagaaaacctagccgacagtttcgatgctcttcgtcgtgaaaggaaacattttagtagccaaattaaaaacaatcttgcaagcaattgatcagaatttcaacgaaggaaattgcatagtctagtatgttgttttgcctatctattgcgccagccggcgatcttcggttcagtcagtgtcattgcaattcgtctacgcgcatggtcaagatgttcacatcacagcagtcagaaaattatgttcaacaggggaattaatcaatttggcggcaaagtttgcaaactaatgataagatcaacgtcatgcttaattagttggagcacgtgcaaacgtgcacaattaattactttgggatcaaacctcacaacgacaggaaatgtctgtgtttgaaatgggggaaagaagcctccaaaattacagattgacatatgatttgtcatagttttacaagtttcgagtttaatgggactggctttaatttgaagggatttagaagactctgaaaggtgtgtgctttgaagctgacttttcccttccactccagtaaaatgtgatttgattacgttagtagttaaaataacactacgatagtgaagacaactttgacatatattattagtcagacattgttatggagtagta

SEQ ID NO: 80829 - DNA, 40678 bp, Oryza sativa
  unsure (1)..(40678): unsure at all n locations
acagcgagcagtgttgtgaacagcaattgcatccttcagtttctgaaactgcaagcaagaacagtttctgataagtggaaaacacacataaaagcagatataaacccttaatgtttcactacagaacactctctataccatcagaaaaagagaggaaatgtacttcagggaaaagaattatcaccaaggaaaacttgagtttctgaaattaacagtgactggccaaaacaataacgtgatattataaaatgagccttatatacataagctgcaggtggacaatttattgcattacaactggggctgttcaatccgggttcactggatcaaggaacatggttgaggagcatgagcggtgggttagcatgccgactgctggtacacacatggccagctaacccatgtcccatgagagggttgttcaaaaagtaaaaatgcctttttgaaccgactattatgaagaattgaagattaagtgattaactacttgaaaggtgaagcaaattaacttatgaacgcactggtgcatccttaccttcgccaaggaacatgagaacgcctccaattgcccgtcagctccacggtaaaaatggaagtaaggaaggactttcacattcaaccgtttgcacataggtttattttcatcaaaatttacttttaagaacaagatatcaggattctccacagctgttctgcagagctgcaaaacaataaagaacacattagtttaagcaacatgctctaaggaagtcctcgcaatataacagtcagctgggtgagatggaaatgttaaaactattttatccatgaaaacaagtaggacaagggcaaaaaaagatgcatgggatgagattataatgttccccattatcattatcgacgtccctaaaattgtctctctgagaacaaggccttcctaaaacattcaaaatacatcatgataaaacaccttgaagtgtgatgtagcagtccaaagggaaggttatttgttagccctagttgaatggccagagcaacatgagttgcctcgtgatggtaatgaagtagcctttttccttcagctagctagcacaacccaatcatggttctgagcaaaagaacctagttactaaagcacaatgcaccaagcttgccacactaacgtcatgcacagatgttaagttgttaacagccatcgatttcaacaataatccatcagttccatgctagtaactaaacacagaaagggcaatatgaaacctttatctggatgcaaagaaggaagagacctaattctgaaatagggcaaatgctctagagatatgataagatgacagttttggggaatactgttacacatgtaatatatggtgctcacaagtttcaagcacttcaggtattggcctttttattgtcacctggtcagcatatgggcagcataagcttctacaagaaggaccagagacctcttatttgggtatctgcagaagcattcaagttcagagggctaaaatagcctcccagtaaattaaaaaaaaaaaggaaaaacacaccatatgcaactcccattaggccgctgtatgtgctgctcttctatatggtccaaatgatacaaaaccaagtgcatggatgcaattatacaacctatgcatgtttgttgattataacttggaggccatatgactccagtttgggttcccttctgttcattagaggcattacacggtttacaaggaaagaaaaaaagggtattgaactattgattactcctaaacatttcttctgtatatggtaattggtaaataatgttgcattacccctacacctacactgttgaagcaatactaacaagatggtctaacctgcagaatataagtcagagaatagaagaagagctagatatagcagaagctagcatgccctggaaacaagccaaacatagttccccccaaaagcacaacatatattcgactatttgcagatgaattcccacattcgagcgctttcaccaataccaactagggaaacacatcaataagcatgagcatgggtgacaaccgcggatgaataggtaatttgtactctataaaacaagaccaaaagttcaaagcatgaaagatataaaaactgaataaagaagagtgagttcagctaatcatgtatgttcacaattcagaaaatcaatactaccctttttggatgactccatcctaattttgacatctcatgagaagaccaagccacatgattctttcacgcacttctttagagcttaagagtaccaatctaaacccatataatgctaaacatcaattattaatctaactatgcaaggaaatttgataaagctcacatgagaaatttcagaattgtatcaaggagaagatcaaaacggcaaatagttatactcatggcagcagtaggaaatgagaaatacccttgggaagagtgccctgcaagaaccacaccaagttccataaaactccacaattacaagcctgtcgcctgcatccctcagtgcatccaagaactcttgtgtagagtggatgtcaatcatatttggaccagcattcttctcccaccattttggttgctcacttttgtctgagacggctgcatgggcctagagcaagatcaaccaaaacgatcaaaacatcagcggcaaacttgtccaataccatacgaactccaaagcacgtaaactcaagataaactagtaggacatccacaaaaatctcaagcaaggacaaattgacacgttttgaaagttcaatagttagttcataccactcacagttgccaaaacatatataaaatcctggcagaaaaggagaaagatgttaattgttaatgtgattcctatcggctaaataaaacaagcacaatacaatatataacaataacgtataaacataaatgcaaagcttatgcatgttttgtcgtgaataaagtaatcgtggagcaaagtctaatctaaaatccacaaaagaatgatgtaagaacccatttcgaggtgaaaaactgcggtcttcaaaataccaagttgccatgcattttccatcataacatgtaccatttcaattgacatcaagcaacagagatactgtacaaagacccagcaatggcacttatggtatgctaggtgatgaagcatgcatgatttcgagagacttgtttggctcaatttcaagttttgaacccctcaaaagacataaaagctagtagtagtagtaagcctttccttccccaatccacaccaaacgcaaagccgtttgtggtgctatagcgatctacagggtcgcgtagaatcaacaaattgacctccgaaaaaccctacacaattagcgcgacgaacagaagagaggagaaagggggacagcacacgtaccttgaggcggcggtggcgcgggggcgagggggcggccaagcgcggcgggcgcgggttggcgcgcgagaggaggcagtgaggcgacggggacgtggaggaggaggcagaggagcacgcgggcgtggaggcggtgacgacgaggcgccggggcagggggaggagggcctccgccatgcgctccggctccgctccgggaccgtgccaacagcgagcgagcggctagagcgcggccgccgccgatgactcggattgcggcggaggcggcggcgggagcatccgagggcggcgaggagcggtggttgccgcgggaggggcgaaggtgtggtggtgggagatggatggatggatggatggattttctcttcgtcgcggcggatgaaggatggaggatggatgggggagagcactggactacgacctgacacagtgggtcccacactccagtgccacggacgtttctactactattccaaatataaacgcacaagatcgtggcttttttccttttcaattacagtttggtctcctcttttttttttctaacaaatatttacaagtgaactcttttttttcctatctccttatacacagctcaaacaacttttgttgggattgaaggaaaaaaaaaagttcaacggagcttctactatggtctaaattagtaagaaccttaaatctcacttaacacctattcttcgctgtcgacactctcatcgtccttcctttggcgtgggcactgtcacaccttcagtcctcctccagacatcctatatatatacctatacaattgatccagttattgtcagaaatgtttaaattgttatgtccgttggatgccagataaacatttgtgatttgttgagatgcaggctgcagcagatcgatccaacgctatatcagtacgtatgcatcatatgattccatctgctggacctctcaatgcttgatgcaacgccggttccccttcctccgattcccccactgtagaggttcccaccgcatccccgcctagcgcctgctcgcctccttcaggtgtcacaagaaacggaaaccgcccggctggcttcccgctcccgtttatccatctctgtcttttatgatttgtagtttggattattcgattttgttttcttcacttcttatcttctctgcaatatataagtacatcccagtgtttggtggtaatcatgtactctacgtcgtatgaagaaagcaattcggatcctctgcattagaggtactaatgcagaggatgaacagtaccacgcattagaatcacagtgttttgaatcctgtagctacagtaaatcgacactgttcatggcattagctaactgttcccctcacatgaacagtgctcttctgcattacggcagacgatccggatcctgaagaaaagcagtacaaaggttggcggtgctcctcctccgaacaatgaagttgttgtgggatccatcccctctgccaatttgaaggcagatccacttgatctccatcgtttccagtgcaggttaatccccaatcaagttaaatctatctctaatcaatattgtgactgatgcaggttgagcactcaaactaatttctttgcaatcaattgtcaatttccaacagatttttgtatcccaatttgctcctccttttttccccatactacactattgcactagcagattaattatcctatttcgcatgactgactccttgattttagtcgcaggtatttcttccatgggaaattttcttccttggtatgcacacaagaaatcattttctattgctaaactatacaattcgtattatgctcctttgttttccaatttttctgttctgtgattattcatgttaccttgcctgtatccaatagctttatatttcatattgcttctcattttatattgtgccagggaaaactgagcagtaaacttgcttcactgaatcattgcagataattcatacctgcgagcaagtttcaatgatgcattgatttataagcagcgcattttgtggacatgatctaataactcgcattaagcaacgagatgaagaattgctgcaggtaattcatggaagtaaaaaaaaatatggaaagttagttgatcctatagacaggcatgtgatttcacagagaactttaagatttagagaagcattgatttagataaagatatttttttttatcatatgcagcatggagtgactcgtagcaatttttttgtgcgatccttccagcttcagcagttttctatgtaaccagcaattgtaagtgccacatatatcctatagggtcctgtctccttggattttcattacaacaatgtcacttgagttcataattttagtaatgatagcatgatctcaacaacctcaaattaacttagtattaatttagtatttatacacctcatgtctatctatactaatataaaaaggaggagttcacccctccaacactacaggtgaaataaatccatctaatctcaaccgtccatctgcatctcatctaatcgccaatcccatcccaccgattccgtccccccaccacgcacggtgactccgtcccccacacgcaatgactccgccccccgcgcgcgattcccctcgctcctcgctcctctctccgtgcgcattctctctcctcctcgcttcgcccgaatcccggctgccgctgcattactctgctactatccccaccggtgacactcctcctcgctcctcctgctgccgccgccgccttcgaccgctgccctggccggtgccgagttctcaagccgccgcgggagccgaggtcttcccctttcgccgctgctttccaccactgcccctgtcggagccaacgtcttccccacccccatccgccgcggccagagccgacgtcttccccacccccatccgcgcggccggagccgacgtcttccccacccccatccgccgcggccggagccgtccccagtcgccgccggagccaaggtcttccccatccggcgccgacgccccagtcccctgttggaaattggcaaacctagcactcaaacctcaccactcagctctgtgtatcactcccacgttctgaagaaacgagagttttcagactgctacagtaactgatgaaactgaagacgaacagaggaaacagagtttggcgctgcgtaaaacctggccgcattttctcggttctcttctattatttatactccgaactccaggagtttgttacaactgaaaaaagatccacaaaactcgcttaaatcctaatgaatcgcgccatcccacgatcgatcacgaccgagtttgcaactaagaaataacatacgaaataacataaaaaacagttagcggctacttctacgttctgaactcatcgtgaacacagcacgagtcaagctcgattatttcgtaaatttgaaaaactaaattgacccagctacaagattacattcaacaaacaccccctaatattgtggctgtatctcaagcattccaagtctgccttgcagctcctgaaacttaactcttccaagtgactttgtcagaatatcagcaacttgttcttcagttctcacgtactccacttcaatctccttcttctcaacataacctcggatgaaatggaaccgcgtgtcaatgtgcttacttctgtcattcagtaaaggatttttgcacaaggaaattgctgatttgttgtccaccttcagaacaacacacttcttctcatcacctgtgatttctgaaatcaaacgagcaagccaaattccttggcaggctgctgtggttacagctatatactcagcttcacaggatgataatgccaccaccttctgtttctgtgactgccatgtgatgatattttcacccaatgcaaacaccactcctgtagtgctcttcctatcatcaacatctccacccatatcactatcacaatagcctgtcagtggcacaatattactctgctttcttccataccagcagccccatccaactgtaccggcaacatatcttagcaaatgttttgcagcagcgaggtgatctgtagcaggcttctccatgaaacgactcaaatacccaactgcataagctaaatctagcctggtgttcgctaggtatctcaaacttccaatgagacttctatactgtgtagcatctacaagagaattggtactttctttactcaacctcaatcttgcctccattggaacctgacacggattgcatccatccatgccatttttcttcaagatattcagagcatatgcagactggtttaaagcaattccagtcgctgtttgcttcacctgaatccccagatagaaactcagcaaccccaaatcactcatcttgaattctttttgcatttcaaccttgaaaccttggatgactgaaacctgtgagcctataatgaccagatcatccacatacacccccacaatcagtgtagagtgctcactgtttctcttgtatactgctggatcagaagtgctcccttcaaaacccatcttaattagtgtggcatctaacttagcataccatgctcttggagcttgacgaagaccatacagagctttgtgcagacgatacaccttagcttcttcaccagtcacttcaaagcccaatggctgtgagacatacacctcctcttccaaatcaccattgagaaatgcagatttaacatccatatgatgcacctgccatccctcttgagcagccagtgctagtaacgacctaacggtttcaatccttgccactggagcaaacacttcctcaaaatcaatgccatgttgttgcacataacccttagctaccaatctggccttgtacttcacaatgctgccaacaagatcacgcttgatcttgtacacccatttcagacctatcggtcgatgttcagcaggcagtggaactagactccacgtcttgttttcctcgatgctcttcacctcatcaatcatagccttgcgccagcaggcctgcacttcagcttccgtgaagcttactggctcatcggccgccagaaggcacagcccggagtactgaaactctcggacaggactggtagtctcgttgatgtttgcaagtgtgcgatagcgtcgtggcgcctcgttagatggttgcgacgcatcagtcggcggagtggcaaactccactcagcttgtctgcgtggtgctgattggtgtggagggagacgccggcgagtgcacacccggcgatgactcccacaccggtgtaacagcatcttgtggctcgtctgcgtcagggcgtgctccagagcactgttcatcatctaggacagagtgaaaagtgtacgagatagaaaatatatcagcagggtcagcttcatcatcaccggtcccggttgccgcccagtcccacttcgcttcttcgtcgaacaccacatctctgctcacatgaacgcggttagtcaccaggtcgaacaccctgtaagccttacttccgtcctcataaccaaggaacaccatcgccttgcttctgtcctccagcttcgacaagtgtggtctcacattcttcacatacgccacacagccaaaagtgcgaaaataatgcacattcgggcgcctgccataccaagcttcatagggtgtcaggccgtcgagcgccctcgtcggcgaccggttcaggatgtgcactgcggtgacgacgacctcaccccaaaaacgaccaggcatctcctttgccttcaacagactccgcgccattgccacgatcgtctgatttcgccgttcaacaacaccattctgctgcggtgaatagggcaacggtgaggtgacgtcgcacgccacgccctgcgcagtactcaccaaattcaaccgaggtgaattcacccccccccccggtctgtacgaagaactttcagttttctcccacattcaagtttcaccttcgcctggatgtccctgatggccgccggagcttggtctttggttcccagtaggacaacccacatatatcttgacatatcatcaacaagcaacagtaaatggcgtttaccacctggcgtggctgggctgattggtccacagagatcaccatggacgagttcgagcggctccgttgctcggtatttcgcctccgacgggaacggcgcacgccgctgcttcgcgatctgacagcaatcgcaaatgcgatccacctgttcgatgtcaggcagaccacgcaccatagcgccctgagccagccgacgcaaggagtcgaaattgagatgcccgtagcgtgcatgccacaaccacggcacctcttcacagctcgccaccaagcatacaggctgagccaccttcaaatccaacaggtacgagcgcccttcagtcctcgtcaccttcgcaactagagcgcgcgccctgtcccggatcgtcatcacaccatcgtcaatgtggattgcgcagccgttctcatcaagctggccaagactgatcaagttgctcttgagttttgggatgtaatacaccccagacacgatacggtgtgccccgttgtagcattccagggtcacgtcgccgaagccgcaaatgtcgatgacggagccgtcgccgaagcgcacgacaccgcgcaccgtgtcatcgaggtcggtgaagaattctcggtgacccgacatgtgattgcttgcgccggtgtctaggaaccagcgatccggggacaactgttcatggcggccaacatgcagttgggcgtgcggttcatccagcacgatcgtccctggcgcggccgtggtgaccatcgcactcgcggtcgccagcagcagaacaggctcctcctgagcctcagcaacatgcgcctcttggcgacgctcacgccgtggtttgcggcactccttggcatagtgaccataattatcacaattgaaacaacgtaccgatgatctatcacgcgacgccgccggcgcgccaccatccttgccggagctgccctcaccggagcacccttgtcctccgcgcttgccgcgccactgcttctttgagctggacgatgagccagcaccctttttaccaggagaggtgtcctgcggctccttcttcttcatgcgagcagtccattcctgctcggtgagcagcaccaagccacccagtgcctcagctcgccagacgcactgacaggcttataggattcgatggcggcaaggcgcccgaccagctcctccagtggcatggtcttgagatcaagcatctgctcaatcgacaaagcaagctgatgatagtggaatggtacaactcgcaacagtttcttcaacatgtgttcgtcggtaagggtgccacccatgtcacggatatcgatgacgagtgcatgcagacgaagggcgaaatcctccaccgtctcgccgtccttgaactggatggcctcatactgagaccgcaacgcctgctcgcgcgcttcccggacacgatccacgccgacgcgcatcgtcttgatcgcgtcccacacctccttggctgtatccttcttggacaaagggcgcagcatctccttggggactgcctgaagaagagcagccatcgcttgccggtcctccctgaactcggcgtagcctggatcaacagccgcccacaggccttgcgcctgcaaattcacacgcatcaacaacgcccagtcggcatagttggttctcgtcagcacggggtaacgcagtggcacgcatgtctctcgcggtgcctgctgcatcacaatctgcccgtcattgccggcgcctgagctgccgcttccgccggcggctccacgccgccccggcggggtgtaccgtggatttccgtcttcactcgacatggccacataatcggcaatgaaccgctctgataccacttgttggaaattggcaaacctagcactcaaacctcaccactcagctctgtgtatcactcccacgttctgaagaaacgagagttttcagactgctacagtaactgacgaaactgaagacgaacagaggaaacagagtttggcgctgagtaaaacctggccgcattttctcggttctcttctattatttatactccgaactccaggagtttgttacaactgaaaaaagatccacaaaactcgctccaatcctactgaatcgcaccatcccacgatcgatcacgaccgagtttgcagctaagaaataacagacgaaataacagaaaaaacagttagcgactacttctacgttctgaactcctcgtgaacacagcacgagtcaagctcgattatttcgtaaatttgaaaaactaaattgacccacctacaagattacattcaacatccccttccccatcgccatccgcagcggccagagccgacgccatccccatccagcgtcgtcgtcgttgccgaagttcaccgctgccgcaagtcgccccgccgaggtggttcccacagtaactttcaattatcatctgtttaggtctgtttatgtttagattatgtgcatgtgtgcatccagcaatagaactactgttcagggctagaaggaattcagttacaaaaagatcctcaatgatctgaaaaagattctgttacaatggtactgcagtcccaagatccagagcttggctaggtatgatgcacttggcaatgcttaactggttctcaattttctgcttcacgggtatgttgataacataattaaatggttgtaggtcattcagctttaaggcgatcagtgtaagaatgttggtatccaaccgggtggcatccgctttgcaaaaaatgtctatgtaaatgtaatctcatttttttatgcatggacattatgtctttttttatgcatggacataggtttaatctctatgtagattaagaagtattattgtctgaaaatatttggtagctgcctgaaatattatttgatggttatgttaataggatgtacagaaattatacttctcttatctggaattgcaacttcaactgtcatgacgttcaccatgcctaagatgttgctgactaagcttatgtcctaatctaggttctgaaattgtagctagaagtttgaagaaatagtattttgtgcaaatacaactgatgagcaactcagacaagaacccatatcaggtttgttttctcgagaaattgcatataggaaaggggtgagattagcagtaatgtttctttattcttctaattgcatatgcccgattgcaagcggtgttgtcacaagcaggaaatggtaagaactaagagaagtgtgtgtatatatgtacatacattatcagttactttaaaggtcagcaggtcacaaccagaaaattgattttctcaatgttcttgcaagaacatttaaaattttgcttcacattgtaaatttgatgtgtgattgagcttccagggtcatcagcttcaagtgattgagctgatatactgcatactgagattctgcggactaaagatagtatattctttcatcatacaatttatcgagcttcatttatttggctaatatttcttatggaacacacatgctgatttcagtctttccaatttgttctgccctttttggtacggaatttctgttacagcttaaatgatccttggaacacctggcaagttctttcctatggtcctatttaacaagaatcaatcacatattttgtgcaaatagaacatgtgttggcaatggcaagttcattggtctacttattacttaacagtaatcagtgaaatactctcagcaaaatttaagtctgaatttgttatatgttgaacactgaaggacaggggcggagccaggattaaaagccaccggggtcatcaacttaaagcgtttgacagaatggaaaagaagaagattaaagaagacatgcaaaatgagtttattgttagcacaagattaattgagtattagttattttaaatttggaaaatgtattaatatgatttttttaaaaacatttaaagaattttttttgaaaaaatatacaccgtttagcagtctaaaaagcgtatacatgaaaaagagagcagaattccggtatataaatgaacaccgctataattttgatttaactaaaagactaggtagatcattctgttctctcgattaatgcaaaatcttttttaaagttgttcttgtgttttttatcgatcaccagcaacgaatgaatgataattggaataggctaagagcgtttcctttcatcatacaaagaggtataaatctgaaattagctagtactaactgcttaacagacgaagcaaaagcacaacgaagaaacaattaataacaatgaggcttaggaaacaaaagaaaactgactcggactttatgcatgctaataaaagaatcattaatcaactaggatcgtaacaccaccaagtgaattgttttagtttcacgtactacgtgccagctgaagacgatggctggggtcatttaccatctgatgccggggtcacagctggtagaaattgagcatcaccgtgcattcgctggatgtcatcggtgtcagatgaccccggtcgttagactgtggatccgcccctgctgaaggacatgtacagcgagttagcaagctaattcagaactaaagtatagttgattactagaatgtactactttatttgatcagaataggttaattattcatttgctctttttagtattttactggagtataaaggtctgtgctattcttggttagcattaaagttgaaagcttagatactttcttgttttccttggagttgtggggttgtgtgagaacgatgtagatgttaaaatgaattgtttttctgattttccaactgtagacctgaactttaagttgctcatgcatgatagccatgggcaaacccgacatgcacattatgcagccaagaagaatgcatgctgactgccacagcgaaggagctagagaagtgctgccggaatcaaatagtttactttggttgttacatgaagatctgcttagccattttttctctgcttaaaaatatgtggcagtgtacgatgccgtgtgagataaaaatgtaagtgacaatttttggtaatttatttatcaaatattatgtcacatggatttcacgtgcaagtgcatgtttctctagaaatacacacggcgcatgttttttaatagatctatcaaaattgtcagtctactatagtctatgaaactctttatttacctttagaatttgtatggagtacacggcataaaaagttacatttattattctattatatatatatataatatcaaaacatgtcttgcacgtgcacgataactagtatataaaaaaaagaccaaatgaaagaaactgtgggcccacgcgagaaatcctaaccacagcaaattcctccacgcaaatcatccgcgctattaatcgcatcgctgccccactcgcacccgctccatcaccattcatgggttccccaaaatcacgcccgtgcctcctctctaagccgttgtcatcgccaatctctcgcctcacaccccatgcaatccctagctgtcccctctcccaccaccatgtctaccgccgtcgtccctaaagggagaagcaccatctccgtcgaccttacatcatcgacgattttaaagccggcccgccgcccgcatccttcggtccttcccccattgctcggcgccgcaacacagtaacagcaacaacagctgccgccggacccaaaatcagcgttgtccctgttttggtgttgtccgtctcgccattccgcggcttcgttggtcacgccgccgttgcacgaacgcaagagcgtgagggtccttctgcggcggttcgccatcagccgtctcgctgttttttatccaccatcacaatctggaggcctcactattttgccacatttgcaatctgaagcgtgcaaatgacataaacaacaaatcaggtttctaatctccctttctcaatctcacttgctatgctttttaatgccaacagatcacgctttcgtgggctcttataagagagcttccaaataatttacttaattttactggaagctctgatattcttttgtatggaaattgccaaatattttaggctccttttatattgtctttctttgcagatttgattaatatgcaactctgaagctggtttgcacttaaggaattagtaattgaagggaagaactttgccctctaattcatggctcactgctttcgaaacagctaaatcaatggcttgtacttgctagaatttagactccacattgcaaattgcaatgatgaactttgaaatttcctggttcactgttttctcctgtacttaaattgaaattatgaactttgttctttattaactctttcagcctctataagttggaacaccagtaattaaaatgttgattaagtttatttttgtcaatatttaaataaatatttgatttggtgtatttaccttctcttctctagatagcaccagtttcaattaaaaattagctgcaataatgtgctctgaattgatgtggaagctaggcaaaccaattgagtgttagattgttaatcaggttgttgatgtcgcttgcggtcactgtcatccctagcgtagcgtcttttgtcgcccagggttatgtaacaccacgattactatgttgccaacatacacacaattgttttcagcccagatatgttctctttcattgttccttcaatttatttaacccctttcaggatggatgtgtgtgcaagaaggataggaattcaggatggtagttggcgatctcatgcaggtatgaatctattatgttttactatcactttgtcaatcattgcaagcactctttttatctgaagctttggagacggagtattagagtttgtttcagtatctaaaaattttctcctaactatcaacacagtttatctgaagcttttatcgtacaagactcagctcgatcacttattccattttatgtgccatggaatattaagattgacagaaaaaaaatagcttgcatggagcaattcccctgccaatgcatctcacagtttaatttcttattgaatgttgactatccctaccaatccatcacacaattccttataactgaatgctactccattcaattaatttcatttgttgaactccttaccaatgatcaatctgttcataactaggattaatgggtgcaaagatattgcctagaccatctttaagaatttattgccttcttcgttcaaatttggtaatatatctctccccatgttggggaatcatgtgtcttttgtaccgactacacaaaggttcttaaactggccggattgtccatttcacttcagaagcttattacgttactttcttggctatatttcctgccatcgcattttacatttacaagtaggaatgaagtgatcaccagctagatagctaccttcttgatcactacgacgtgcatgcttcaaggatatgcataaatccaaggttattctcatcttacaaatctctctcgatattttccctagggatatagatattcgaaaacatcgagcattgggatcattttatacaagaaaatgtcgaggagatctagaagctattgtaagttagaaggtgtgttgtttcattaaatatatcatatgtgtatttctgaatatatcttctttgttttgtttttccaatctggcactcctccgctactattctaggtaaccagtccacaacctgcaatattattttgatgtgtaaaatttttattatgcatcataatctccatatcagcgcactgtcagattacctatataaaatgagatgtaagatgtcacaaacgcattgttaatttatttcatttatttgcttcttctttcagcaacttttacaggctagaagcagttctacaacagatggatttgccttaggtatttttttatactagagcacaaacctgaatttctctaccttttacagttctagatggagacatgaaatttctttaatggtaaaatatattggttgggtttgattagtgtatattgttagtcatcattgtattttattagcgaaagtattaatattaccatgtttcctacaattgatgctctacttgtgatccttatttgcctatgaagatttattgtgtcttggtgtttttgtgagatggactcaaagattctgctgttcgaaacgtgctaaatatttagacgttttatatttgcttttataattgttcaaagtacaaaaaaagggtaattctgaatatgttcatatacgttcaaccttattgtatcaagataagaggtcaaactgcataaattatctgacagaagccttagacaagatgagaatacaagtaatcggttgtttctgttgaagtagtatgcctttggcccttgccatgggcatggaaatgcaaggaattatgggcctgtgccctgtagtctgtacctgcttaagggcactacatttggctatgccctggtttcttgagatgtaagaatttttttctaccaccagttgtggtgaagccaattacatggattttgttcttagtcaggttagctgattgctaattgaagctttgttgtgttgctttctatctacattaaagagtgtagttttataaattgggatatgactctacaatttagtgttcaaataattccttatgaaaatatagaatgtttgtattttgtttctagattcagatgtaatatcgatggagacctaagctagaacctaaaccaaagcttttctaaagagctccaattaaccataattgtttcccttatttacaggctttcaactgagtgaattcaacgttgtagtgttcaagaataaattagaagggaaaatcatttattctgtattactctctctattttgtttaccttaccataataattatggatccttttggtcaggttcttgaatgattactggccattttttttactgaactactgtggactgccatgtctttttttgttgaactactgtcggctgaccatgttttcttagaaacatagaaatattgttccaaatggattatattatatacataggccgtgtttagttccttgtcaaaattttttttgacgtatacagacacacatttgaagtattaaacgtagactaataacaaaagaaattacagatttcgtatgtaaactgcgagacgaatctattaagcataattaatccgtcattagcaaatgtttattgtagcaccatattgtcaaattatggcgcaattaggttcaaaagattcgtctcgcaatttacattcaaactgtgcaatttaggtttttttcgtccacatttaatgctccatacatatgtccaaacatttgatgtgatgaaatttttggaagtttgaagggaactaaacacagccatattcgtgctttttgaaacaacagggtgttacaactaataattaagactgcacactttctcaaaacatgttaatagggcaatgcatgatggtggaaggcacttaatgtggaggccactcatcaaaatatgatctccgaacatcgtgctaggtaccttttgtaattaaagctcttgatcatttgtaaaacttgtcatttgaagaaccgcgggataatagatcaggcattaaggaatttatccttaaatttatctccgtgctattttcatgaacttatccatcttgcctcccaaaatgaactttatgtaatagatatctaccgattgtttttcaatcattctagcgccttgaagtgagtgcattggaaaccgtggaagtgaaaatgaaactcagtttatgtctttgttttgaaattgaaatgaaaattgtgcatgcctttttcactatcattttagatgaaaacagaaacagcctatgtctatgtcacatggctctcgagaatataatttgacacaattgggaaattgtaaatgtaaatcgtgaaaacgtgtattgcatgtgcatgattactagtattgataatattgcagatttggtgaattattcatgaatcccattttctcatatggtggtacttcaggttagccagtcagtttgcataatttagttcctgaaatttttatgtatctcggtgacttttgtttgtttctttttagatgttctgatgatctttagacttccatctaggacacgtataaataataggaattgtaccaaatatttttatattagcatcgtccaccaatgtcctaccctttgatcaacaataagtgggttctgttatacctgtcattcagcaatggtaatagtaataacataacatatgaaaattttcaattgttgccgctgcaagaataacaaatttgctcttttggtttaaccttatccctatcctatcggttcatcatgcttagataagttcctattttctgcaaagcaccattttggggctttatatattaattaggaattgatatcggtgctctcaaaatgccatgcgtgtttgtttctttgttatctattcattccttgcgaaagttgtacattcggaataccttctatattgcctcactttcccttcttttcttattactttcattagctcactaagtgtgagttgatcattaaaatttgtgtcaaatacatttatcccgcagcaacgcgcggtgtatcatctagtttttatggtaaccgacaccatccctctcctcaatctccggtgtgctttccttcaaaacccaaattgggttgtactgcagtcttaagctcacgtttccacgttgatgtcatcatcgatcgaccgcctctcgagcctccaccgctctgtccatccttttttttgcccaagcttagtcattgtgtcgttgtcccaagcttggtcaatgtgtcggcaatgtcgccaaccgcctccccatcctcttccaccctgtgcccaagctccggccaagctgcgtcaagggtcccttgcatggagttctattgtggtgtttgaaaccgagaatttaaatatggttaacttatatgtattagaaatattttatttaattaaagtggtattttttttctcttatatttcaacatacattttatgtggtggaaaattagtgagtcggatgagtggatcgatatgtgggctaatatgggtcgggttgcgccaattttttcttgaaatcaatcggtatatgcaggtacttgaggtcaactttaatcaattgcatattggaaccaaactcaaagggagttgtggtctaatatgatcaagaatggtatgtcatgaggtgtgatgtaatcatgtaaatgtacatgatggacggataccacgtaggagactgttgcaattcggtggcaaaatgaatgagaaaaagagaagagagaggaaggtggtctaagccaccaaggcccagctaagccggcttccctctccctctccactagctggtccaattcgccgttatatcactgaatttagatcaaattactacaaaaggcttacttcagagttgggcatgatagacagtggtggagccagcaccaccgtgaagccgggacgactagtagcattttctggtgaccaactgatatttatacgcgtcgatgactaacggcaatggagattgcatatgaaaatcagattgaaaaacatagcatatacaggaatttaatggcacagagcgttcgaaggatgggtctttccacaatgggctggataggtggggaatggggttgggccttaactgatgatcgaaggttgcacagtacatcttgatacacatcgctataaactcgttttcctgattttatcattatattcctttgaaccttttggatcaaatcatagtgctatgcaatcatcgtaatacggaaaacatatattgttcccattaaacggaaaacagtcaccaggaatgtcatacgaagtacccaaaaaaaaggacgcctaaaaccacagtattaaactgcagcaagatttatttcacctctagaaatgcaatattttcaaccaccgtcaccaccacagacacaggcaaaatgggaaaaatacaagatacagttttccgagatgtggcactccagcagggtacagaattttacatagtcaatagaccctgaggagaaagcagcatagagaacagaatctaagaaacggagaatccacagtgctttcttcacaatcggctgaatttatacaggtttggttcacaaactgaccacacgaatccatccgaacgctgtccactcttcagactagaatcaggaacttctgcgacaactccagatctccaggattatttgcttaaacgatatttacactaatgtgtgtgatacacgtgccatccatcgttgagtcctgcaaacacaggttgaacattcaagtttctaaaatcaaaatttagatcagtatttgcatatgcttctgatgagactacagtcagaaatagcaaccaacaagcaacaaccaggcaagcaacatatgattctgaccccaaataaaaacatccacaagctagctactttctgcatgttatccacagttctgtacctatcaattgttcggttccaagcagacatgcggggcgcagatgaggatggggatgttcaggatcttgtcataatatagtcgtcagcttgtaactgacagttcataacaaaaccaacagatatctcatgatattaaaaagccatgcggctaaggcatctatttctacataggtttctgagaattattgccaacatcagttctctactgtcctaactcaaatgctcagtttgaaattggatggtcaagcgatggcaagaatgaatgcgatataaatttcccaacaggatattaatgtttctattgacagtcaactgaacgctggatcttgattttcattttgaatgggcataccgaacacccaaaagaacagttctctactgccttatcctacatgaacccctgctaatgaccaaatggaataatccaaatcccatcaggatatgctactattttggcctcaatagctggcacaccaatcattgtgctctcacaaaaaagaaaaaaaaagagaaagaaaatcataactgtcactgaatttgaaacaaattgatgcgtacagtacgaatatatatttctgaacaaattggaattatatgtactaatagatatgatgcttaaagtttaccacattataacatgatattgtcagatgccatattgccacttaatagctgaaactgacgtgtacgaagttgatttgataaaaaaaagggtcagataatggcaacaggaggactacattatactagctaatgaatgagataattctacagcagtagtactgtataatagtacaggataatgaattttcagcatgaaacttaaacccatccagttgtagatgacttctacggataagtacaagagtctttttgctattggtcagagacaattaacaaagtagttggtttcaatggctcatatggctacacggtttagcccaaaaactatggtcacatgacgtctctatctctcttgggaacgtcaattttctggacaccccttgaagcacaaggcaaattaagctcgttgagtttgaccatgcaattccttcttgaggacgcattctaatcgatcccaatgcaagcaaacacatcaccagagccaaaattggctccaaattgatcacaagttctcaccaaattcatccaccacacaactaattccttggtttgtcactaatacatcatgtagaaattgggaatttgaaaaatgaaacaaacaagaacagcaattcacaaagtaaaggagcagcaatcaagaaggaagaagatgattggggaggcaactcacatactagtaggacggctgcggcgggacgggggtgtaataccggccggcctcctcgtcgatgctgtcggcggggcggtggaagacggcgtggaggaggacgatgacgacgccgacgagcagcgaggtgaggatgttgacggtggcgccggtgaggaggaggaggacgagggtgagcacggagagcaccgcgagaacggcgccctccccgacggcgcggccgcagagcgcgagcggctcgtcgcggaggaagtagaggaagagccaggcgaccatgcaggcgaggaagacgatgagggagaccgggtgccagagcagggagaggaacaccacggcgagcaccacgatggcgtagttcatggagaagtggcccaggttggcgcgcgcgcggcggtacgcgccgccgagcccgcgcggcacggacgccgcccgcgggtcggcgagctcccgccacggccgccgctccgccagcgccgtcgcgccgcgcgccttggcgcgggagatgaagtcgagcggggaggaggaggaggagcccgggggcggcccgtccgaggacgaggaggtcgggatggtgccatacttcgacatggcgcggaggcggaggcggcggacggtggccggcgccggcgagacgcggcgagggaggcgaagtggacttgacgtggaggagagggagggagtcttgactctggaaggggcgaagcgaccgcccaattaatggagaggaatggcatgggtggggcccaccgcgacagctaggtggacacgtggcggtggaggttacggcaagatcgtggccgttggtttcgattcgggcctagtgaagttttggttaggcaatagaaggcccagaatgaatgggctttttcctggtaactaaattggcccacacgtcaggcataggtccgttgcggcccaactagtatgggccgcacattaggcgagatccagtttcggcccatgtagtacgggccgccatgccattccggcctgatataaacggggctccagtttggcctggtcgcattctggcccatgttgtgatcttctgtttatcacctgctacgtgatgtgtgttgtgttgcctgcttgattttgcaagttttgctcggcaaattgagctgagattcaagttgagaaaaacttgcagtaccaattgttcatttgtttctatttactctctccgtttcacaacatgatatcttttggtctctttatctctggactaaattcactaacattcatataaaatatatatgaagatccatacatgaatctgtttaatacataaaatgtcttataatataaaacaaagtactccctccatttcgaaatgtttgacgctgttgactttttagcacatgtttaaccgttcgtcttattcaaaaaaaataagtaattattaattctttttctatcatttgattcattgctaaatatatttttatgtaggcatataattttacatatttcacaaaattttttgaataagacgaacggtaaaacatgtgctaaaaaattaatggtgtcaaacatttcgaaacggagggagtaagtaagtagtgatttactatgaggtgctatgctcatccaatgttgctcttcacaacgtcaatggaacccgcatccgaagaaagggatagtcactagacgattaaatctctatgtttgagttttagtttgcaatcttgctagagaggctgaaaattttggatagcatatgatctgatcctgtaagacataaccttccaaaatctgtattatggtatcttttgacgtggagcaggtctacgtacacatagaactcatttcacgcttatgttcttacttcatgtacaatatgaaataaaccatatatactacagttgtaatgtgtttgtttatatgctagctcggacctatatatctacgttattaacaaatagactatgcactacttaaaaaaacagccacgagagtctttttactactcggtcggggtccagtggccgactgcctgcagagattcattatcgtagatggcagattgaggacgtcacctacgataatggattttcacaagcaacatcataagccagccgcctatgaaacatagccactataaggccttctccccgagacacacacattttatccaaactctttcttctaaaacaagtaaaatgatgaaaggggaaggcttttaactcaaaatttttcgtggagttcgctatccttagaccctttgatttgtaaaagtagggaatttgtaggattttaatcctacttcccccatactaatacatcgtgagggttgctatggacaatattaatgtccgttatcagtgcaagctcatgatgtcctaatcttttcctcaagaacgtaacatatttattctggtatagattagttactataagcttctttactaagtaaccccctaccccactactaaggaatcctagcatcaagcatcaaatgctagctaatggtttccccaaaattatttgtttttgtttaagggaagtgcatggggactaatgatttcatcacttggcgccacatactaaattagttaaaaaaaacaaagctcctttggacctaacaaacttttggcgttggtttgaccactctgtataatgatatctttgatgcaaagttttgaacagaaccatgcaaattaagatatatgaaaagaggagaagaacctcagcatcagggcattgtgtaatcatactctctgccacctctaaacagagtgattaatttagaaactcgttgaaccactttaatggcatgggcttttggtttgggtactctctggtcacatcattgcttacagccagcactgtggatatactattaattactagctcactaattttaatttactccaaagtgctgtgtggtgatgctatcaattatgccatcagcggctacacatgtgtttatctgctctctgacgtgtcgacactcgactccaagaaaattaggagtagcacatgtagcctagtggttacgagagtctcagtaacatttaaggtcgttggttcgactctctatggaagcgaattttctaggatttaatggcattgtgctttcagtggtaggcgacgtacccgtcgaagcgaggcgtctgtggtgacttcgtcaatcttaaggatttgccaggccagtcttcgaagatgctcataggggtagggtttgcgtgcgtgcgttcataggagtgagtgcgcgtgcattgtaagtgtctacgttgtactgtgtaattctaaaaaaaaagagtgctccctccgtctcaaaatacaagaacctagataggagcggatgggacgtttcctaatactatgaatctgctcctatccgctcctatctaggttcttatattttgggacggagggagcattagggtctgtttggttggagggactaatgattagtccctccactttagccccttttagtccctaaagtcccaaacaagggtgactaaaagaaataaaagggattaaaagtacattagttcattagtcctcgtgggaggagcttgactaaaagggactaaaagtacattagttcattagtccttgtgggaggagcttgcagggactaaaatgttttctttccacctcttgtcccgctgcctccacatagccctatccttttctcatctccctcctttcctcctctcgaccccgcaccgccgccgccgcgccgctaccctgcgcaagccaccgcaccagcttcgcacaagagccaccactgccccgcgcaagccccagcggcgtagtgcaagccgccgctgcccgcgcaagccaccgctagtcgggcaacagccatcagccatggcaggcaacgaggaagagccggtggatatcttgtccccgtcacacacacatcaccttcgactacggcttctcgcaggctgtcaggccacgccggatctggcgtcggcttccactttcgggggagtggatccaggggcctagatctgaactcccaggccgacgccttccccgactttgcctcctaccaccaaatcctgcaatcggatggccatgacttacctccgattcgccctggcagtagatccaccggcgccctgtcgcgccctcctttcctaggggtgagacgcgacataagtcgtggaggaagaggaggacgaggccgcgccaggtccttgaccattggcgcgggatccgccagggggatgcggggattcgttcccccggctcagcttccagcgatggaggtgtcataggccatggggactatttggacagttatgtgatgaatcaattttgggactgggttgccgatggtttgtggagtttgaaacaaatgtaatttctggtttattggtcttgtggaacatgtaatttgtattaataagcacttgcagtaatttgaggaacttgtaatttgtattttgggactgcttcgatctatcaattttgttcatgttctagcgtgatgtttcaaacctgtttgcaagctgattcctgtcattgccgatcactgatgcagtgcaaatatgtgatctgatcagcaaatgtgtgttccgattcctgtccttgccgattgcatggttaggggtaatatggtctttgtacagtacaattaatgatttttttagtccctacatccagacaaacagggactaaaatttttagtcctaggactagaggatccaaacacccttcccttcaaaacgcagaatagaaaaaacacaggaatatgaaaaacgtaggaattgaaattgtatatttttctaatcctacaggaattgaaaacacaggaaatggagagaatagccctttgattataccacaggatacactcaacaaaggaaagtttcacaagaggtctaacctcttgcttattttcctatggaattgatcataggaatgcaatcctatggaagttttcctatcctcttccaatgaatcaaatggctctataggaaaaaatccttaggaaaatgaatcctccaaaattcctttgctaatcctccatttcaaaggggcccttagtatcacaatataaaaataaggggaaacatccactacaaatttggacgtggacagttaaacttatctatctagattcgtagtactataatatttcttttcgtatttagtgtccagttatgttttttaatttgatactagtttgaatttgctagtatattatatgacggaaggattagtttttccatttgttgacactcgaactgaaaccttactggtgtgtttagttcacgtcaaaattagaagtttggttgaaattggaacgatgtgatggaaaaattggaagtttatgtgtgtaggaaagttttgatgtgatgaaaaagttgaaaatttgaagaaaaattttggagctaaactcagcctctgaggattttgactggcaagagacaagatggattttgtttttcttgtttgagagtgagaagtgagaaggaaaggaatcttcaacttcctttgcatccccaccaccgaggtcccatctcagatacccgaaatcgttaggttcatgagtttctctatagttattcgaggacataaacgactgaattaactattataaatttgaatatgagttttataaaaatattacaaagaaaaaaatgtatatagaaatcttttacgcgaaatgtactatttaggagcttggaaagcatatatgccaacgaaaatctaaaattcagaatgaaaataaaatacaatgcctgtagatattagatgagcaaatttaatgaagctatcacaaagaactctgaagttgcaaaatagcgttacaaaggaaaaatgccattgggaatgacactgacgagagtctctctacctgtttacgttaattaaaaaaagaacttaccattcatataatggttataaaggcagagtatctctacctttttacttaaataaatggtgttatgtttttccatccaaaactgctgttattgcatttttttacagagagaaattaagttccacgaaagcaaacactaccgttgctttctctgttatatagtatgctacagtacgatccttttttttttgttttacatttgctacgattctattctatacgatgtgaaatctactctatactttgatatgtaataaataatttgttttcctgaatttattaagacaaattgagcatgatgttgaaaattcaactaacacagagagagacaggatccggccggccttctagtttttttttttttgagaaacacagtacaaacgcagacgctcacaacatgcgcatactcacccctatgaacgcacacacgtacaccctacccctatgagcacctctatgagcacctccggaagactgggccgacatatcttgagattgacgaagtcaccacaggcgcctcgctgtcgatgggtacgtcacctaccactgaaagaataattagccgtaaatgcgagcacccgtgtcaaatctaggatttgaacccaggtgggctggttccaccacaagaaacctaaccagttgagctatgctcacttcaccnnnnnnnnnnnnnnnnnnnnnnnnnnnnaccagaaaggaggaacatgaagatgtataatgtgccagcaagttgaggataggaatcatgtattttttttaaccgccccatgttaggtttgactggagcatgagttctaaacgtctattccgatcggctacttccttattctttgtgagcacatctttcgaactactaaatattgtgtttcatacttatgtataaaagtttctttaagaaaatcatattaacttaattttcaagtttgaaataattaatacccaattaactcgttttgtgtgttaccgaatagatgagtccaaaacgctccttcaaatgcagccttatagatgtcataggtttataaaatgggctagtgtacttttaggtagtcgtgtcaagatgattaagcaaaagttgagggtgagagtaggactggttctaattgcgagcttttactggggttgtggctaactaagaatggtttttttaggttgcttacaaattgttaatttgatgcagcgctaagggctcttcaggcagcctattcgacaatgcacaatataaaaggttgatggataatatgattcagcttcgccatgtggatatgctacccgacgatctagaaattggattgtggtgtttggtgtgtctagaaatttgatagtggtgtgtctttgtttttcgctggtccatttgttccaaggttttcggctatgagggtatgttagctcatctgatctttggctgcctgtgtggaaggttggagctaaaaacggtaaagctggtatccccagctatgtgttctttagctattgttctagtgtactccctccataaaaaaatccaacgtagaaaggaatgtcacccctcctattagtacaacgaatctggacgaggaggggtcatatcccctcctagattgattttttttaggacggagggagtaagactctgtatgttgttttggctttttaaaaagagggtactgtctgaaaacaacaattcaaccaatttaaatagtaggccaaaatagaatcaataaaacattgagtgaatttcaccttagaccgcctcttcttaataaggttctatttattttgtattttcacattaggccagcttttttcccctttggatttctccttagactacctcttttacttattttagttaggctttgcgtgccacccggttttctctctaggcacactcctcttatctatagcaccttaccgatgttcaccatctatatggattaagggagtataagttgaaacttcagtaatgaaatagagctcgacctgatatacacttagaataaaagaactaaatatacgttgtttggagtcttcaaaaaattaataatgattttaatttgaaatccctatagctatcactacaaaccaacaagtagagaaagaagagaggggggggggtgtcctagttggtttgtggcttggtgatgtagttttcgttgccttggaagggaaaaattgacgaaaatggtactcatactttacagttcaaattctttctaataaaatctagcagcttgacttttgtgccatggtattttacaacccatttagttcactgcaatggtactgagcagaaaatatttgtaatgtagacctatataacaaattagataaaatatttatttccttggaaaataaatatttttcctccttattgcacgaaaaacgaaaccatcgaattaagttaggatcgtataatgtatatctaagtcaaggttaactaactttataggaaaagcatagcaattaatattttttaacaccaaacatatattataaaagcatgtttaactgagaatttaatgaaattaatttagtattgtaaattaataactgtgttcttttatatgcttgatcaaacttaaaaaaaagttttacttagcacacaggaccaaaggacctcacacgaagggggaatctatttctgtgtgccactagctgtgggctattgtagatatcctgcccccctttatcattttctgggattgcatgcccatttgtacaatattatacagagtatttgcatttgtttgcatatgaggctgcaatgtgcatatgccctttttttggcgcatcgctgcctaggagtgctttctcacgtgctgtctggatacatccccttccatgcatgcatctaaagtcttggacctggaatcttgtgaaaatttctattatacttaagtttgacacaaaattaattagtagttggtgcttactctatcctaaaatatagcaacttaggacaagatataatgcatactagtactaatataatgtccagattcgtagtattatgatgtgttctaatcataggttgctatattttgaaactgatcgatgtagtaataatatatgcaagaccatcatgcacacccgcttaaaatataattagtcaataatatcaactaacatcctttgcatttcataatcttttcactggtgttagttacttaatttatttttattattacgagaaaggtgtatacgcacccacaccacaagtgaatatgagcaaacatatactcgaagggatatggaccagtgacaaattcctagccccactaaaattttattaaaaaacatccgcgtgcatgtaatatttaggcaaggaattgtagggaaggaaatgctaacagatgtatgggaggcaacataatcaaatattacacaaacaaacgacacaatctattttaagtaaatgaagacaacataaacgcacaacctacaaatatttcaaatattacacaatctatttcaacgaagacaacatacgacacacaaacgcacccaatctattttaacgtttcttcatgggtatctgtccacctaatctatattaagtaaatgaagtaattaaatacataatataagttataaacattatacttataaattattttaaaaaaaactaaagtgggtcattaactaatatatacatacgggtgataattggcctagctaagtccatcataacacatgagaaacataatctctccctctcttgctagctagataggacccaaaaacaactacatgatagctaactacccaacaatcatcacactatcaacatggggctaaactaatttctccaaaaagaaagagaaacataattgaaaaagccgtgtgagagactaaagggcctatttgttgttagcaaaacaacactacaatcaaattttgataatgcatgaattggagttatcaaaatttgacaacgtaaaagaaatggagataatatttgctttgaagccatatcaaaccttgggttggcattaaagagtcggagttttaagagttaacatttttttcataatggaattcatttgggcttttgctttaaagaagttacgaccaattattatagagactgtaggatgaacagctgcgaattaaaataattagtataccatcataaatttccattgtagctgtttctatcagcgacttactagttgcatgtactccttgtgttacttaaacaagaaggtagaatcttcgaaatcatagtctgattatattgtcgatcaaattccactcccagcatctccaatgattaatgttgaaccaaagcggaatgtatcatccaagagtaactaagtggtaaatcagtcgtttgtccatatcatgccgccaccattgcgatgaaatccaaccggttatgataccgccataaggatgcctcaccaattaagatggaacttccaacgcgacgccttcaagaaggttgcaacactaatttagaacatcgtcttcatcgctattccagaaatatgtgctgtcgccggccacctagctacatccaaaatatgtataattcattggcttcccaaattttaataggattgctttaggcaacaaacaaaacaggttccaatttcagagtataaagtattggatatgggacttacacgtcactctatttcttgccttcatgttctttgttcactattggttgactacatctatatatatcgaagtaattaaatatatatataggttttgtatctatagatacacattcatatatatgcactcgatatatatagacgcacatcttctcttccaaaagctggaatactcgatcctcacagtcacacagctagcaacgccggcggccatgcaaccactcgctgccggcggcggcgtctcttggccgttgtacgccgccaccgtcgcggcggcgctgctcgtcaccgccatcgtcctgcggctcgccgcgcggtcgacggcggccgcctgcaaggcacgtccccccgccgggtctctcggctggccgctcgtcggcgagacgctgcagttcatctccgccgcctactcctcccgccccgagtccttcgtcgagaagcgctgccgccggtgagcaccaccgccgccgccatggcaccggcagcgcgcgtacgtagtagctgcgtctgtggtgctgaaaatttctcttgttcttgttgattgattgattccgtaggtacgggaaggtgttcaggtcgcacctgtgggggtcgccggcggtggtgagcgcggacgccgaggcgagccgcgcggtgctgcagagcgacgcgtcggcgttcgtgccgtggtacccgaggtcgctgatggagctgatgggggagtcgtccatcctggtgctcggcggcgccctccagcgccgggtgcacggcctcgccggcgccttcttcaagtcgccggagctcaaggcccgggtcaccgccgacatgcgcagccgcctcgccgccgccatggacgcgtggcgcgccaccgccgccaccggcgccggcgcggccgtgcgcgtccaggacgaggccaagttggtacgtacgtggcatgacacgcgctgctacctacctagctatagctaagctaggctaacccaagagaatatgaggagtagcttgcattggagtggatcgtttgtccgtttataagtgtcttttttcttcaactaatagtgaaattcataggaatttcttcctagagaaacttcaacccctatagaaatggggatcagagcctagttatcatgtttatggtttacctagttcattattagtaatatctacggaagtactagatatcccagtatatataggattctacaacatatggaccgagctcctaacttgatgaaaaagtcttagcctagctagaaatatatccctttatgcaaaaaaaatatctcgataatattgcgtacaataatgcaaactatattaattttcttataaaatttctagtgtgtaagatgattgtatgtgggaaatatgtattctctatattatcttttttttgtttttatatatagtaataaattttattgtctacgtacgtggcacatcttattgacttcgattcaaaaagtcaaaaaataatgccatgcttatactgtacacttaattggcatttttccgtcgaatgtggaattatagaactccttgttctttaatttatttgttctgatgttgactggctaacttaatcattttttttttgttccatcgcttcatagattgtttttgaaatcttagtgagggcactgatagggttagagcaaggtcaggaaatgaattacctcaggcagcagttccacatattcattgccggcctgatctccctgcccatcaagcttccagggactcagctctacagatccctcaaggtaaacacatatattagtcaattcggcatgcgagttgctccaaatttctgaacaataatacccacatgacaacctctcaatttatgtttcttttttttttgtatatatacatctaggctaagaagaggatgacaagtttgatacaaaatatcattcaagagaaaaggaggaggatctttgaaggcaaggatctctgcgctgtttcgcgcgacttgatcgatgtgctgatgagcaacgggagcgacgagctcagcctcaccgacgagctgatatccgacaatatgatcgacttcatgatccccgcagaggactccgtgccagtgctcatcacacttgccatcaagtacctcagcgaatgcccattggctttgcagcaactagaggtacggtatatatatgctctaaaatgatttctacttttaattgtaactaaattcgggtgtttgagaagagaggtgccagggatgggatccgggtttgaaattccggttcaaaatttcaagaatttccttgtgggaagtgcctccggcaaaaaaaaagtttcaaatttgtttgaatttagcaaaaggttgctcaagttcagtgaaaatctattcacttttaattttttggttcaaaaattcttaagctgatccccttcctgaaatttttttgtattatgaaatgcaaatataaacatataatcatgtagatatcattgtcaatcgatctcttgcatgatcatgacttgaaccatctagtgcgtgcatgattagtatagtagtgctatttgtcaatttgacaagctgtgatatgatatcaatgtccaggaggcccaactgactgtttgttgcctagctctctggcgtgcaaccttaattagataacaaattctgatatgccggcagcaccagggcatttgatgtagactcctacctaaaaacacaagcactattctgttgacccatgcacatcatcaagtcataagaaagtcttaattatattccaagttgaatgtacgataaggtttacaaaaggaaatactccccttgttttcaaataaccgaaactggacattatttatttttcaagcttttggctactcttttttttggcaaaaaaattccaaatactaaaattgtgtttttattaaagtttatatgcatcctaaatataagcataaaactttcatttattttagtctatatcctttagtttaggagcaattattagttgaagttgaaatagtaatacatttatttaaaaacagagaaagtactatatccggattaataacacttgtcattttgaaaaaaacacggtctttaaaaaataactttgagcactattttctattataatatttataaaatcttcaataaatatatgattttattaaagtatttttaatactaatatatatatatatatatcatatttataagataaatattttacaaattattcacactaaaaaaattttaaattttgacatcagccttgtgcaaaaaagacaagtattatcaactgagggagcagtacattactagaaattaatgtgctagcaataaatggaatatgtccattgatttttaacctgtagatatttttttgaagattttactgtcctaaagaaaatgagtagaacaaggaagatgtactcatctttgtacttaatgcaggaggagaacatggagctgaagaggcagaaatcagacgtgggcgaaaccctagagtggacagactacatgtcactgacgttcacgcagcatgtaattaatcaaaacatattacatatgttggatattccaagattcaccctaccgtatgtgtctgacatgtgtgtctagaatccacatatggactgacatgtccagaccaagtcctgattccttaagctaatgcataatccctctgtaaaaaaagcaaacaaacttctagcttggcaaagcggaacaaaggagagagagagaaactaaaatacctaatattttagtttaaaagaagccttacattaatagattaatagtatagtagtattgatgggttgatagataagaagtattgaagagatgtaagccacgtataatttgatttatttgaaacaaaatttaaactccatgaattaatttattttaggacatgggtataatcttctagagtatatatacaaccaaactccgtcatatatacatatatatgccaatatgaatgcattcttaaaacagaatgcatttttacttgtcgtccatcatgcataattgcgaagttatgaactatgtatattttgtgtgcaggtaatcacggagaccctacggataggcaacatcatcagcgggataatgaggaaggcagtaagggatgtggaggtgaaggggcagggtgacgtggtgatccccaaggggtggtgtgtcctcgtttacttccgttctgtccacctagacgccaacatctacgacgacccctatgccttcaacccatggagatggaaagagagggacatggcggccgcgactgccaacagtggtagcggcttcactccctttgggggcgggcaaaggctatgcccggggctagacttggcaggctccagacctccatctttctccaccacctcgtcactaatttcacgtatgtcaactatacctacctaagtacgtatgcattctcgcttcaatttgatcacgttaacacgttgttttggatagatttttttttattacacggaagacacaccacacgcgtgtgcgagcacgcacactaacacttattcaaaaatagagaccaaaaaattcttagcctcactatattcctcttgaaagagtaagtgcgtatacataatatttgtgaataccattatggtcaaagtcatgcacccactactccagcatcacactgctagtaattctccaccgttttggacattgacgtagtcttagaaatgcatattgcataatgaaatttctgaaattttggaagtttgggactgttggtcctgctagataagatattcatttgaccataaagaattggtttttaaatttagcaaaatatgtccaaattttaatatttggggtctcgaactttcgaaatgccagttttatcagtccccttcccctcgatttttttttaaacaaaaagagagatccacaacactaaaccccggtttctacatatatcatagtgtctttataagatatgttaaaaaatatatgcatagggaatgaactggtgcttactgttgcttgaatggatggatctctgttgtaggtgggtggcacagggggacgtcgtcgtcaacttcccaacagtgcggctcaaacgaggaatgcccatcaaggtcacgcccaagacataacatgcaaatcagtccagatcatttgaaggtgagaggagagtgaactatacacgtgtatgtacaacaaagagagaacaaatgacagtttagataaaaggaaaccagaagctacagttcagtaaatcctgtttctttttctctgtttttcttcacccctttgtgtggctatgtaaagtcgaccagtctctgttcgaagtttcccaccagtttggtgaaagagttgaaaggctaaaagcaacagcatgtagatcaacaaacatgtgtaaatacttgctgaatcagtgctttcttcgagtatttcgagcatgtggctaacttgatgtgatttgtgaagtttcctctgatgtccttgccgccgttcatccattggtgatacagtgactgaacacaaagctaccaagatcagaaatattagaggggctgggaaagcaggtacatatcagattagcaccaaatcaacaggatcgcagaatcagatataaatgagtagaatagaacagaattgcataggaatttggagatgaataactagtgacgaaatgtactgtgcttagcttcatgcaatctgaaattaaccaaacagaattacacataagtgatggactgcaagagtgaatgataatagattcaccagtcactagatgcatgcattgcagatttaatttacagatgagaactccgaactttggagctcaaaaagaaaaaaagaactccaaactctaagcactatagggggttcacaaacacgaaaaagccaaaacagagaaataacaggaccgcagactcgagttagctttgtacaattttgtcgcctacctccaggttaaatataaatttaaactatatgcacgacttctaaacatggtacaactcgctaacttacaacatggcgactttagcaatctatggacaagggggtacaacaacaggacagcacagtatacattatgcaacttccaggctggggcacctatacagaacacacgcaggaggcttggccatctatcaattcagttaactataggtaagcaattaaaaatatcattgcccttcaaaattcgcattctaaatcatatctccagcggttgatatgaataaactctacaaagaagcagccaaacagaatgtggacctcatgacaccgttcttccatagcaaatggaagctaggtaaagattcttcgaccatttctcctgcagatatattaaatcattatagttgcacaagtatggctgttcagtagaatttagacagaaaatcaaattaccttcacatgctggctggggaaagcagatgtcctcagggtttcctgtgtttcatcagcaggctttcttctgggaatgctcaagataaatgccgcctggtcccatgtagctgctgttgcagttatgcgaaaaccattgtcccaacgccgatgtattccctcacttggatacaggaagtcaagctccacaacctacaaaagaaaattgtgttgtcaaccgaaggaactgaatttctacccctattgtatatcatatcactgttgaacctaagctatcctattgaagattcagaaagggaaagcacatacatgtgtatacatgttttaggttagtaaaaggcctgattagaaagacagaaatacctgatctgtaaagccagcattccgggacatgaccactgcccaccggcttcctgcagtggccatagcagtgacatagaaaccctccttccacttcttgtttatccacttgaagggaaatgagtcgcttactttgtaggattgttgggcatattgcgtccctgctcaaaatcagttacaatctataaggacatgctagtgtaataacaacaggggaacgtatcctgtgcacacaaactttccatgtacacaccaactaataaatttcaccaaaaaatctagaaaaaaatgtatatgtacttcgaatagcattacacttatgtgtaaaggcctggtttagttccccaaatttttttcccaaaaacatcacatcaaatctttggacacatgcatggagcattaaatatagattaaaaaaaactaattgcacagttaggggggaaatcgcaggacaaatcttttgagcctaattagtccatg

SEQ ID NO: 80830 - DNA, 3631 bp, Oryza sativa
ggggggtcttgagaccccactaccgccccagggtccatggagacccccctaagcccccactaaaatttttcacgagatgtggtggctggagcttcgtcaggttggctggagggaaggctggaggttgaagacgatgttatttcgtgatttgggcttgtttcgaagagcagcccacgaccacgagcgcagtcttcaagttttgtctagcccactccaagcaaaggcccacggtggcagattccagtcggcccatttggctactccccctcccggcctcccgcctccccaattccccaatcccactggccacctcctcctctcctaaatccctaaccctaggcgaataggcgcaggcggcgggcggcggccgagcaggcggtggcgtccggcgaggggccagacgggaggcgtgccaggcggtgccccggtggtccagtgcatgcccggagcaggtggcgacctccggtgagctgcaagctggcgagcgccgagcggcaaggtgccgtggcggcgtccagtgagccggcgatgggccagacaggaggcaggccaggcggaggcggtggtccagcactccagcgcctgcgccgccacgccgccgggaaggtggcaagccgctcgctggcgaggtgccgcgagggcgcaaggcgccgaggcaggcaggcagcaggtcagcggcacagtggccggcaaggcagcaacgagtcaacgacgcagtcgcagcctactgtgactgtgattgaagatttgaagttagaaatcggtaaactagtaacctctaatactaatagatagtctaaaattgtgtcttaatgaggttgtgcacttgtgcttgaaacttataattattttctatacatttttagattgtcaacatgtcaaaaagaacattgctcacgtattattttagtttaagcaacacaaatggcagtgatcctccatccagtaaagtgatcctccatccagtaatgagtgtttaagttagccaaagaaacccaagtcagggttttttcaatcggatgaaaaaatcatccaacaatttgaagatatgaaagcgcgtcagatgttagtacctcaacagaaattagtggtatgctctatgcctccattcctccctaaatctctaaattatttgaatccaaaataagtatgtttcgattattcgttaatttgcctttttctttgtataaattactactcatgaagaataatagacgattgggtgtgacacgtcatctattcgatattagtttggtatggacaaaattctcgacatatcattaattcaatgtgtaccttgaactgacatttagccaatttacatgtgagacatgtttcgatttatgctggcgtaatttgttcagcccccactactatttttttctggatccgcccctgtggaaaggtgaagtgcaaccgctgcagaagtcttaaactttaaggctattatcaggtcatcagatttgcatatctgccgtttggtttttttgtaccttgttagcaattatataatacgatcagaacgcaatgtgccaacatgtacaaggtcaagatgttattgctagttgtaagcccaagttgatgcaagcatgacttctacaactcgaccagctattatctgcaagttgattaagttatccttgggctaaaataaattggctaatcataacattggcatgtgattagcttaggtaactaatcagatccaagttgagtaatttgttgttgctgcaaattagctagttgtgtgctagctagcattatatatcatgctggcagcactaccaagttttctaggttccgtttgtaattattaatcaagttggccaatgttagtttataaatttagtcaaccgattaattggtgattagcccatgtggttttggaagattcaagtcactgaatctaggcaaaagaaaaaaaaacatctgaatttcaaacacgttcagtcccccgggcagcaatgttcaccatcagagaggtacaggacccatcaaatcagactcttctgctttctttcggaagtggttagatgagttaagaccatgatgatgatgtaattctgaaaagctagatcacaagctaaaatataccaatccttcttttgttctgctctagtaattaagacttttaggttctctgatttaagtcattagaggtttagatttattagtgtgaagggaaatttcttaaaactacatcttgtaattcattaaaactaatagtgtacatttcataacactgtgtaaaaaaaaagatttgaagggagagacgtcctcctaacactcttttatgaagaaactatgagtatgtttggaattgaacacgggaccctcctaacactcctttatgaagaaattatgagtatatttgggattaaacacgggaccttggggttgaaaccacaccccatatcactgcactatcaagtgtatctctcgtaacattgtgtgttgtcgatagttttacccaaaaaaaactgcaattttgttcacttgatgaatctaagcctacctgtcaggcatgcatttggaactcacacagcccaaatagagcccacctgtagacacatattttttttatataatagatttttattaatccggtttctacatccaccaaagatatacaaaaccgaaaggatacaagaacatttacactcacacctcaataaagagaagagcacacaaccaaaaaagaaaaaaaaaactaacgacctaggcacgcccttgcctttttgcttcctgacatactctcttgaaatgactagatttgatgagtggaagtcgtctagtcgccgccgccccaagtgcgacgtcgctacaaacctccattggtgccatcttcatccgtttcaggtgagctaacgctgcgcgctgccagttagcccactttcgtccgtcgtaattcgttgtttagtcagatttagccaaccggacataagtcgacgggatcggtttccacttcgccggattactaggcctccgccgctcataaggccgccgtcgtcgtcgggggatgctcttctaccttccgaactcccagctcaccgctgtccctagggctgccgccaccgacaaggtcgacctccgtctgctcctcgccgaaagacttccgccggtgctcagatcgatgctatcctaggccgccgctgcccctagggctgccaccggggtcgacctccgcctgctcctcgccgagacatagtgggttaaagttataaattattaataaaatcgttttgatatggttgtagcaaatgcctaactaaaattgcagcaaagtcgtaataggtttaaccaaataatgaagaggacgttaaatatgttgtaatcgttttccttatttaataatatcgaaccatgtttcgttatacatttcaactgcatgttcgtttaccaggtgctatatattacgaaacaggctaatactacctccgttttttaatagatgacgctgttgactttttctcacatgtttgactattcgtcttattcaaaaaatttatggtaaatatataagatataaatcacacttaaagtatcatgagtgataaaacagctcataacaaaataaattataattacgtaaattttttgaataagacgaatggtcaaacatgtgagaaaa

SEQ ID NO: 80831 - DNA, 36750 bp, Oryza sativa
tgtataactcagcttcatgcataacataaagtttgctccgccttgaaatccgctcggcttcatctttgtcttgggggagttcttgagaagtcaaaaatcgtatgaggggctctcgccagtcggcttcaaccatagctacgtcatgagtgcccgcgacttgagtagtatctttgggaggtactgtcggcgtataaaggtgttcgacgaaaacatcagagggcgccacctcgcgcttggatccaaagttggcaagtctgtcagcggcttcattgttgtgtcgaagaacgtgactgagctcgagtccatcgaacttgtcttccaatttgcgtacctcttgtcgatatgccatcatattgtcgtcaaggcaggaccactctttcataacctggttgacaaccaactgtgaatcacctcgaactattagacgctttatccctagggaaattgcaatccgcagtccgtgaaggagggcctcatactcggcgacgttgtgggatgccgaaaaatgtatccaaagcacataacttaatctttctccagttggggaaatcaaaaccactcctgctccagtgcccgaaagtctttttgacctgtcaaaatgcatggtccagtgctccatcttctccgcgggggtatcctcctggcactcggtccattcggcgacaaaatcagctaacgcttgggacttgattgaaattcggggcttgaatgatatgtccaaagacatcaactccaaagcccattttgcaatccgtccgtttgcttcgcggttgtgcagtatatcaccgagtggaaatgatgtgaccaccgttaccgagtgaccttgaaagtagtgagatagcttcctggtagtgattagaataccatataacagcttctgaacctgagggtacctcgttttggagtcggctaggacttcgctgacaaagtaaatcggtcgctggactttctggacatggccttcttcctcgcgctcaacgaccaagactgagctcacaacctgggaggtggctgatacatacagcaacaacggctcctgcggatgtggtgaagctaggactggtggttcggtgaggagtttcttgaaatcttcgaaggccttctgtgcttcgggtccccactggaaatcatctgttttcttcagtagcttaaagaagggcatcccccgctcgccaagtcttgaaacaaatcggctgagcgccgccatgcatccagtcagcttctgaacatctttctgggtacttggcggtttcatgttgaggatagcggtaactttctccgggttggcttggatgcccctatgagacaccataaaaccaagcagcttccctgacggtactccaaaggtgcacttttcagggtttaatttcatcctgaaagcgcggatgctcgcgaaggtttcttctagatccgagatcaaatcatccttttgcttggtcttgacgactacgtcatccacataggcttcaacgttgcgaccgatctgcgttgagaagcatctctggatcatacgttgataagttgctcctgccttttttagtccgaacggcatggtgacgtagcagtatgctccaaagggcgtgatgaatgaagttttcaaacagtcggattccttcagtcggatctgatgataccccgaatagcagtccaaaaaactgagaagctcacagccggcggtcgagtcgactacctggtcaatgcgaggcaacccaaaaggatccttagggcaagatttgttgaggtcagtataatcaacacacatgcgccattgccccgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccaagcaaatatatctttattgttctgaagaaaggtgatgagcgcgctttcctatttacaatctaactcggcgcctattacagcagttttagtaggatcagaaggatctaggggaatcttcttagtcttggcctcgctttctgcactttttgaagtcttggtagctggcacttctccttcgctcgccgtggctgcagccagtcggatatcctctcgggcagacgccatctcgcgggtttgggccatgtcgcaactctccttgtcgcatgtgacggcttgcttgatgtcgctccgtagggatagaactcctcggggaccaggcatcttcatcatcatgtaagtgtagtgcgggacggccatgaacttggctaacgccgggcgtccgagtatggcatggtatgcagtctcgaaatcggcgacttcaaagctgatattctctgtgcggaagttttcccgagtgccaaaagtgaccgggagggtgatctggccgagtggagttgcggatagtcctgggattactccgtgaaaaggcgcattgcttggttttagctcggagcgaggaatctgcatatcatccaaggtcttggcgaagaggatattgagtgcactgccaccatcgatgagggttctgcgaagcttgacattacggaccactggatctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccaccgaagatatggttaagctccttgcggtggtcttgaaatcctgccggggtgtcgccgtcgtccttcttcctcgacgtgctttgttcttcgtcggggttcttccgcgtagtcttagtgtattgatccgcgaattgcttgtagacgaaacaatctttggccacgtggttggagttaggatggtgcgggcgttgggagttcatgatcttgtcgaacgtgttgacgcgcgaacgctgtcgagaagagtgactggcggttgcaacaagttccgcaggcttacgcttgcggtctttatgattgttacttccacctcctcccgaagccggcgtatccttttttggcttccaactgggacccgactgttttgatgcggtgacggcgtcttcagctttagcgtactcgttggctttttcaaacataagcttgactgtcctgggtggcttacgcccgaacttgccgaccaattcttcgtggcgaatccctttggtgaatgcggcgatgataacgtcgtcggtgatatcggagatcttgttacgtagttcagaaaatcgccggatgtaatctcgaagggattctccggacttctgaataacgttgtagaggtcgtattgtgtgccgggacgctcgaaggtgccttggaagttggcgatgaagtggtcgcgtaattcagcccaagatccaattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccgtcgtacttctctattccagtcggcttgaagccggctggccaatccactcgacgcaggtcgtcggtgaaggctgctactccgtcaaggtcgtcgtcgtggcggtccggcgagtgatgatagcctcgagctgctcggcgctgtatgattgtgtcgcgaagatcgatggggcggcgacgaggtggtgagcgaggtcgttccactcggcactctctatgatgatcgggaggcgagtgaacggaccgctcgtcgtgacccctgctcctgcgattggatcctgcgccggtgatgctgaggcttggatgacggtagtcatgagatcagaagtgggggactcggctgccagtcggcgtgtggacgctttcggagttaactgggaccgaagccgcaatcatggtcttcgtctggttcaagatgttgacaacgtgatcagattgattgagctcgttttccctgaggagggtgtcgaggagggtgatcgcggcaaccgcattctgttggggggtgcggaaaaccggtgtcccttcaacatcttgttggccgatgagatcacgcgctcggcgccctgcttctaaagctcgctgccgtcgatcctcagcctccttcgcggtccgctcacgctcctgctgctcacgccgtagccgttcttgttcttgtgcttgatgctcctcctccagtcggcgacgctcagtctcgtgacgcgcttcgttctcccgggcttggcgttgctcctccgtctcgttattggccatgaagacgccgaagtagagaggagtgtagttgtcatctaggcttccgtcgaagtcgtcgagatccgggtcgttgtagcgagaggtaaactcgtcgtactccacgatgtcggtggggcgcgagtggacggtgggagagctgtagtggccgtccagctgatccgtcgaaaccgtgccgagtggttggaggatgacgccgacttccctgaagctaggcgaaatcggtgttgaagccgacttccgcctaggcctacgggatggagatgctgtcgtgatggagacggccgccaaatcgtcggggagcttcatcaggatcggtgggtaagccccctcgtcttgatctggtgaggttggtgaagatgcgatctcgcccgagtggtttgaagccgactcgattgagatggtcttgaagtaactttcagccgcgtttgggagtccaaacggggccgaaatctggttctctcccgactggtccgactccgagtcaaggagagagatcttgccgaagttgttggtgacgaagtcgaggctgccgaaccgaaacgtctgcccgggtgggaagacgaggtcgtcgatgccggagacaggacccattgcactgatcggcgaaaagcttgacgcggcccctacctggcgcgccaactgtcgaaactagatttcggcaataataaaagggggtggctatcaagctggaaaagtgtatgggtttgaagacaaaggatttatacaggttcaggccttcttattcaagaagtaataccctactcctgtccggggatgaatccgccgagtgtgttattgattgtatgatttggagaaaatcaacatatgcccctagaggcacccggaccccccttatatatgggaaggagtccgtgttacaaaagacaatctatatccctaacggaatatgtagatacagataaaatacagtcgtaaccgactaagtctcaaggtgtttccttgatgcacaagttgagaaacaaacccgagatacaaataagatattctatctatattcggtatcctatattcagtccaaatatcatcgccgtgtagatatgggatatccataatctccacactgtgaacttgtttcattgtgacggagggaataaatatactaatgaaaataattaaaactagctaattcagctttgcctgtattgatcgcggaatcaccgaccgagaagctctctagttctagggcaggtttgaattaattagtggtattaatgaatgattaattattgcagtggaccaggatcatagcaggcagcatcgatgaagcagcaggcagggtaattgaattgctggaggatacaagcaaggggaatgtgatgtatttccatggctggggtggactgggggcttcagccgtccttagagcagtcgccaaaagactgacgatgaggccatcgccatcgccaggaagaagaaggtgggagaagatgatccacgttgattgctcggtgtggcagagcaagagggccctgcagaaggccatcgcccaggagctgcagcttcctcggtcgctgatggccttgttcgaccagcacgacgaggaggatgatttcagtggggtggatcagggcatgagaggggtggttccacttgtcacacagacaatcttgagcgacctggtaaaccacacattcctggtgatcttccacaatgggagcggcagctacattgatctacaggagtgtggtgtccctgtaataacaggaatcttgaacaaaacggtgttgtggacctcccgaagcagctttcggattaccgacttggacatggataacgtaagcaaggaggatcgggataagcttgctgggctgagtgatgtcgctatatatgcttatccaaccgcaggcgatgaatatagttttgtaatcttatttggaatgcttttgcatcaagaggcagaggaggttgccaggtacaccggtgtccctcaatctgctggcatgagcaccgagcttgtcaagaagtgcatcatgtatcagttgatgctaagacaacaacatgtggactacacccaacactgggatacccacgcagctaactattgggtatgcagtggaatcatacaaacctcagacaccactagtagtacaagttgtcatagctcatcgccatgggagatagcccaagctctttataataacttgatcttggagtttttgaccatagacgattacaacagcaacccaacttgtgcgaaaagaatacagagagccctacgactgccttctgattttgtgggcgagtcgtccttcttctggacatgtgatgctgctggcaataacaatgtcgacgcaactacagcttgttgtagacagaaatcactggaggccaaaatgttccaacatccatctgcaagctggctacgtgtgatacatctctttgaatgtaccttcagttttgcatctccacccttcctctcttgcagcagcctaagattcctcctacttgaccattgcaaagaccaaaacagcagcaggacggactcaacgctgacgatgacaacggataccggagatactagagcttgttttcggaagctgtgggtgctggacttgagtttcacagactggtattggctcttatcggttgaggccctagatttaatggttgagctcagggagttgaatgtgaagggaatcaagcattggagcataagccatctactccatcgccttgatgatgatgacgctagtaatagtacccgaagcagcagccgcaagccttggctgctcagccttgtcaagctccaagtcacaaccgaaccaataactgaagatcaacatcagtcacaagtatggaaggaagatcaggtagcagcaacattattcccgaacctatctagctgcaaaatcgtaaagacgatcattcttgatggttgttttgagttgaagcgaattgaccctcacgtcctgccaccatcactcgagtcatttagcttctccagcagcagcaatgacaatgatgttcatgtctcagccaagatagagagcatctcctttcggggatgcacccagttgaagagtttgttattgagaggactatttcaaaggctcaagcagctggacgtgtcagaaacttgtattaaaaccctcgacctacatgcaatgcgaggcaacgggtctctcaaggagctatttctgcttggatgcaaggagcttcgtgcaatactatggccaaaacaagatgtatcattggaggttctgcacatcgacactagtagcacagaacttgatcatgctacaggtgtagaagaatcatcatcattctcacctgttgaatttaaatggtatatttcagtgagggacagaaggctccttcgctcgctaaatgatacaaaatatcccttggatgcaccatgcatcgagatctcatcccctcctgctagtgttgctactgctactactgatggttctgaattaggcggaacaataagcaagagaaggcccattgccattagcagggctgaacaacgttggttgatgtcaaccaaaagccgacgaccaactgctgaccacaagaagttatatgcggatgtcgactccacgatccagcacttgcaactacaagcaaccatgaacggcaactggatgtggccatgtaaatcggagggcagcacctctcactacattagcttacaagatgataagaggatgcagacgaaaccattgtcgtcgccatctttgccaggttccatctgtgaaagagcttcaggcctgcacgtgcatgacagcttgtctgtcgcaagtatcacaagccattcaaatgaggcacggagatggtataacctagagtggtgcagagtggagagatgccctaacattgaaggcgttgtattcactccacctagtactggtagtaacagcattttctggtacctaaagacattctgggcatcccaactagcaagggcgcgccacatctgggactggagcacaacgggccagatacattttgagcctgcagattcgtcattctggttgaaagtgctacacctaaattgctgccccaggttgatatatgtgcttcccttatatgacaacagtccttcctatgcatactgtgcgttggaaacccttgagatcgtgtgttgtggtgacctcaaggatgtcttccgagtggatgataataatcaagagcttctaaaaactataaaatttcaagagctgaagcacatccacctgcacgagctgccctctctgcaacgcatctgcgggcataggattgtggcccccaagctcgagaccatcaaaatccgaggctgctggagcctcacccgcctaccggctgttggtcttgacagtacccgcaagcccaaggtggattgcgagaaggaatggtgggatggcctgcagtgggatgggttggagaacggacaccatccttccctctatgtgcccacccactcacgctactacaagaagaaactgcccagaggttccatgctcaggtatgtacatatgtctgtgtgcatacatgattgttacttgggtatcattccttgcgcgcacatacatacatacgtagaaacttatatagctcagtactttagttactccatcatatatatatatatatatatatgatcgagcttttcccttttttttttaattttgtctgacttggcgtgctttcttttcttcttaaattcaggtgatcgatatatacgtccatacactacatatttgatactgtaatcatctacgtatcattccctttccctcatccagtggctcatcaagttcttcagctctatctctattatatatgtccttatttggggctagtgttcaaagtgcttgctcatttcatcatatcatttgcaacggcatcaatatctaatgcatgatgagtaagtacatctctggccggcatccagacgctcgtcatctgcttgttactagcttggattctgttcatttatgcttcttttgttttgtgtgaaaattaataaatggatgctcagctgccagctggtgtgtgagctctgcatctatctgctaagttattttctccatacatgcttgctttccgtttggccggttagtcgatctgcttgttcgaccgatccatccatcggattactacgtatgcttcatctttctggatagatgatcatacatgtatatgtgaaaactttgatctctagcactgttctggtgtggtgtgcttcctagaggtcgacgaataaatcatcagcttcagcggcatgagaagatccattgggtgatcctcatgcagtcgagttgctgttgtgcacttgtttgtgggtgcgtgtgtgttcgtgtgatttgtcagcatttatggactgacctaagtttgtactcctaattacttcacttgtatgaacagaaacaatgatgctaaggattgtgagtgtgacattgtctatgcagcaaacatatatacctgttgctctgttatttggaaggggttgtatattttgctatgcagtctgcagtccacatagacgcctagtattttctttatgaaaaatacggtacaccttttgccttttatggttagcttttactcttttccttatgagtccttttacagtacaccatgctagtgatagagacgaaatccagccgtttatttgtgtggttatttttatactaattgatttggttacttaaaaagatttcccaccaatgccaccaagggaaatccaatcggcatttttttttctatctcgtttgttcttcgtcgctgcgaggattccagtcctgactcctgaatggaggacgcttcgtgctgaggcacagactctgatgaatttatctgtagctgcaagtactatgaatgatttggtgatgcgtagaacactcccagtatatttaggccctctttgttaagacttataagccaacttataagtcgaaaagtctaagccaaaacaaacaagcagcttttttatttggcttttttgaagccataagccactctaacactattaagccaaaagctaggttggagaagcttttttggcttatatgagatagatgtatgactccaccactaaacttaggacattaaatccactggcttataaatcatataagccaataagctgacttaaaagtctaggccaataagcctaagcctaaacaaagagggccttaacatttcactagatttggtggatcatgcatataatgtttaatggtccttagtaatctctctattatgtgctactactaataatttattagttgatcaactagcaccacacaatttctaatctattgtgaaaggcaaacgttcagtgtggtttcatcatgtatgcgagattaggaattgagtggtttggcattgctattgttgcattctgatctgttgattactaatgcttgcactaatataagcacggagatctgaatgtgcttttttgtcttcgatgaagcgtacatacttggccactctggtggatcagttttaattaaattttgtgggagggagcacggggcggcgacggcatcccgatcgggtcgattgggatttggggattcatcgaacgaatcggtaggggtaggggtagattacgttgagttagtgatccaaattaatttgcacttaataaaggtcatcttctaccggagcgaagcggaggcccagtagaagccagaggctgggccggaacgtaggcggaacgtcgtcattccttttagggttccaccttatatatatacctcttgtaagccgccgtgcgacgttgtaacctcaccccgatatagtgaagatattttgctggccgacgctcgtggttttttctctcctgttttgagaggattttccgcgttaaatctcgtgtcttctgtgattgatctattgtttttatatcgtttgcttgcttatcgtttcctaacggttcagtgcactaatcttaaagtgaaccaaacaaataacatataagccattgttttatttttcccataattccttcatactactgcgtactaatctgtactacttgtggaaatttcattagtataggatgaatcttttctttattttttgagggtaagtataggatggatccaaactgttggattagccctctaacccactaatataaggtagtatggtgtgctctaaagaaactcttttttacatgtgcaaagggagaagcacaatattttctcaatcctcaggtcgactgatctggtcaatgaattaagatgtatttcaacttgattagcagtcaccattagtaattgggttttgtacttgtgcagtgatataatactctgttttgtagtgaaaaccttctgccatgttgcagtataaggatatacagatgacatgcagtaagcattggggcatgctattctgtgtatccccaggtgttgtgctgggcctctatgatacacacattaggaccattttggtagacaatctgcaccttttaaaatacagtccttaaccagcaaaacacaagaacgccctgtccttttccaattcattgcttacacaaggaaacccctaagcagattttcagttctcattttttttccattttatccatgccgaagttcaattcttccttcgtgcgactgcaaagttccatcgttgcccttctccccgccaccgccgcctcctctctctcgccaccgtttcctcctctgctcccccgccttccttccaccgctgtcatctccgcctctcgtgcgttgccttcgtccccgcctcctccgttgctcgatctcacggcggagccacctctcttccttgttcttccaactcatgcacatggtttgaaattttggtaattttcggcccccaccggcaagcacaaatcttccccgaatttttggctttttgtcaaatatttgcaaaatttgtcaaaatttgttcaaattcagtcaaaatatgttaaaaatttaaataatttcggtccgaaaatcacgaaagtctcaaattctcggcaaccaccgaaatttctatggcaaccgaacttgcaaaccctgctcgtgcacaacaacagcacaacggatgagggtccatttcgtcatcgccatccccgaccaggttggaatctgagaagacggaggaggctatggacaaggcgacagatggggaaaggatccacaccaccggcctctcttcgccatggcggccgaacacacccaagaatcctcctctcgacattctaaatctcaaaaattcttcaacttaccatggtgatgggaggttgattatcctgttgctgtttcagataacccagtgatatggggctggtaagcatcatcttggcatcgacgaacctggcatcgttgtgcatcaccaaggttcactctcctgcattgtgaattttgttctcatgttttattttctctgaagttgatactcctgctggctctgaactctgaattttgttttacagtaccatcctctttgtacctgcaataaactgacatcgtgatgaatcagatggatgttggatctcgtgcttgtgaattttgttcaccgtaagttcaaatagagtacaaatagttttgatagctcacacataagggaaacagagtacacctttcttcggttaaatgacactgcaagctgtgaattttgatactccagctccagagatgtttcagatatgaggtcttcttaacatgaggtaaatttcttacaggaaatccattgatgattctctagttgtgaattgtagttctactccagcagaaattagcttattgtttcaagatgcatctttctcagcttagtcttgttcgtagattaagaaattcagaccaagtcaacctcctgataaccacactggattctgatgtcctggcgagccacatccaacgtgtggtgatccaaggcggtgacattatgtcgatgacactccaggcactctacagttaggaaaagtctttgttttggggtagaaatttgccatttgagcatgacaaatttgaattccatcaagaaattctagcgtagagccggtagaatcattgtcaacatgacaaatttgtatcgtgtcagtaaaattggtattgtgtctgtaatgccaattggaataatggattacaatgttttctttgttctgatggatcatgctttgttcagatggagtctaaatgtcagtttgattaacagatgttttctttgttctaaatgacaatatgaatgtctaaacaagtgccaattgccattgcattgctctgaatgacagattagattgttcatctgaacaatctgaacttttctataatgacagttggaacaatgacaatctgaatttttcgtgatgaaaattggaataatctgaattatacttagagagaatcccttatatgccactaaaaagtggtctgaacctttatatgcctctgaaaattggctcttctcttatatgccattggtccaaaattacgcacccttttatgccactcccgtcagttgaccgtgcgttgaccgttaactcttaaggaaaaaagccgtatttacccttctgagtatagggcatgcctaacaactcagagaggacaaatatgtctttttttacttgagagttaacggtcaacacacggtcaaccgacggaagtggcatgagagggtgtgcaaatttggaccaatggtgtagacccccgtttttatagcaggaatcactcgtgtgaatagtaccatttccctagatcaagtagtctggtactcacgattacattgctgaaatatcaagtgcgcatacatagattgtctagcgcgaattattacatcataggcccgcaggcatagtctagaacataggaccaaacggtccggaatacatcccaaaaggagaaatagataagcagcggaatcaaggcagcggcgacgccattgccacaggcgacgaccgtaactaagacctactaagcgccaccatcttcttcaccctcctggtagtaagcatatgggtcatccgagacttcatcaccggcttctgatggaatttgtaaatagcaagagtgagtaccaaccgtactcagcaagccaccacaacaacgatgcatatgatagaggatattcaatgaaaggctaatggtttatttgcataaagccaattttgcaattcttttcacaagcctaagacctagcataactgatcaaattttatctccgtagttcattatacagcgacggttctgtccaccatccattgtgttcccaaggatagcttcccgccactagttgtcatagttttctggggtctaccccttctcgcctctcgagaagttgatccaccagtctaaaaatcattatgcatatcccacccatcattttaagtgtttagagtctagccaagtgtaatacatgtcccggtgctcaataaccgcgagcacggctattcgaatagattggtttacttacactgtagtggatgtacactttacccgtactacgcgacttgcccaacacatgagcctacatcccaacgaatgagacttgccacggcaaagcctttcaacaacctcactttggcaatacccgctccatgaacttgagtcctcatgcactctaggcgtcataaatttctagcagtgagaggagttctggcgctccctagggggaaaactcacgaaagcctaacattgcatcctgtagttgaacccaatccatgctgtcctcttttgggtatctccttgtagtcttgtagtcttgacaagtcagtctctggccatccgtatcgggtatccgccagcagactgcttgttcgtccacacacctaagtgaaaccactatgcaggggtactgcctccgcttggctatctactccactaggtctatacccattcgagaagtacggctgtactaggatcgtttcatgcttaacttcatggctcggtacttaactgaccagggacggcactagcctttatcggacaccacccaagtcctccagccgccccagtcgaaaacatttgtttagtttaattttctttcacaaatcatctcatcattatcatggcaatgtggcgctcatgtctccacatgccgtatgtcaattaccttccctaattaaggtaattgcccaagcataaagcattttgataaatatgaatatgcatggatctaaattagcatgggctaagcatttgtcaaatattgactaaagacacacgatatcatggattacaaaggttatatggataatcaatatcaaaggtatggcatataacaaagtaggacattcacatataaatagcatgcaaactttatttaaatcaaaataagttcgcaataggtccaacatgctcaaagattagtgataacttgccttgctcacagatttgatgtccctgttctgcagttaactcaaccactccctcggaatctatatgtacgtgcgaaagattcgatttgaattcaactagaattcaaattaaatcaccaaaattcaacagtacaaaaataaatagcaaaagttattccatcagctagatcttgattttatatgaatttaggttcaagtttcattcaaatccgagctaaaatgagtgagttatacttgtttaaagattcaaatttgaattaattccaataattgtgaaatgatactgttcataattgatttatttttagtcatggcattatccataagatacattggctgacacgtgggaccagcccaggttgactagggccaaaccggctgttttaattaccagtgggtccagcttgtcatggagagtaaacttaatattggttttaattaaatttctaatcatccggacccacgcgtcatggacaggtataatcatcattggaagagaattactgtgcgctaagtagatgtgggtcccacatgtcataatctctctctcttgttcttttcctttttccccatcgtcttctacctcgcgccggccatcgagcagagcagaggcgcagcgcgtgcggcccagcccggacgagggcgacccggcggcggtcaggggaggcgcggaggagggtccggcgacctcccgccggcggccacagcacagggcggcgcggcatggccgccatggccgagctctagggtgcaaggggactcggcaaatggcgaggtctctaaccaattagtttggcgcaagagcttgtacagcttatggtgattccgttttgctagctaggtgggaaggagagtgctcgaggtgacctacccacggcgagcccgccgatggcgaagcggcggccgggacggcacgccgaagggcgctaatcgccaaaactggtgggggatttagcttctactccgtactagactaggaggagctataggagtgaggttttaccgagagacagcgggatggcgaagttcggcggcgcgcagctcagtgcggacgaaacaggggcggctagcggcgacgcttgcaggtgttcgatgcgtggttcccgacgttgatccaaggcagcagaggaagtagaggcggcccgagccacggttcccgcggtcagctacgccggcttcggctccaaccggtgatgatgaagcatgcacacaaggtgttcgatgaaatgtattcgaggaaaaggcagatagggatgaagtttttatgggggcttggcttggggataggccaggatggcgtggaggataggatcggcagctggtgcactcaatggctgtctagattccttctccattaaggttctgtctatactgtgtgttctagccggccctagctggagaggaaggctccgttcttacccgccggcatccgcatggtggcggacgtggccatggcgatgcgtgcacatgggagctaaggtagtagttggctagggctaggggtgacgcgcgatggcgacggcgcgttcgtggcggctcagcttttgcgcgtggattcggcggctcggtcgggctaggtctctggtcgaccacctggtggcccatgaacagtagcaaaagaaaaggaaggagaagataaaggaagagagtaagggggctaatctgtaaaagtgacttggataggaatttgaatgaaatgtagctctatatattttgtatttgagaattcaaatgtttgatttgaatatttattttgttattcattagttcccaaatgaatttgctttccattatattatccaaaaattatccaatataacttctaggctttgatattccttaaaaattaattaaatattccaatgtgacctttaataatacattagcacattggtcgagtttatttgtatggcaaagtattgcatatagataagtttaatctatttaattaattcttactccatgaaggcactgtgagacttggtgcaatatcggtctaaatattgaatcgagtactcatataagccctttttatatatagaactcaatttatttacatgactaattattttatgcgagtaaattttattccatgagagcctcaatgcaagttataaatatcaacttaattattccagtgaaacactccattatatgtagggttcataataaatatcataattttataactattacttagttgtatagctttagcttaattttcatttgcgacattttatagtttggcaagcaataatgaccgtaacatccatcatgatgcacaacaaaagaaccaacaacatcggcatgatgcaaatttatttaaaagtttttgaaagtactcaattttgagtttcgttttatttgtcgaattttcagggtgttacaaatggcatataagggaagagtcaattttcagtggcatataagggattagaccaattttcagtggcatataagggattatctcttatacttaatatttgaactagaaaaatgcccgtgcgctgcaataggaaaaaacatgagaaatttaagaaaaggttaagaaatatttatattatgtaattaattaaaatataaaatcgcaactatacatgtatacatgtatacgatgttgaagaaaaaaggctcgtaaaaatcaaggtaaatgtggaaaataaaattttccaaataaactatagctggatttaatttttattaaactctccacgattaattacactatgtgaaattttttcagtattttcagagcaccattgctaattttaataattaaaacattattttagcatttattttaatgaaaaccctcctttctccctgggccattttgagcccattctttctttagcccgtagccgagccggcccattaacctgacttctcctccctttcacctttgcctgcaagcgcgcatccagcccatcaagcaaccacaaagtttaatcagcgtcccttctcctctcactgtcgcatgggtcccagtgctacaggtcgtcccctacctccgttcgattccacagcttcccaacaccgccggaaactgtcccctccgtgaaatctgtccgcatccatagagctaatccaaaattgattgaggggttttgatgcttatctcctctttccgttttttctagaattagagcaaaatcgcatcgtatcaacctcggaattaagccatatagcaaaccctagagttgtccgtttcgcgtacggggaggaaattggaccgctcccaggacaatgtacgaaaaaagttggcaaaaacatcttaaagttttataataggtaaagatatactgaaactactggttatatatatgagaaatctgaaaataatgaagttatattcaaatatctgatgcttcatgagcatcatgtgcttttgaatatactgaagctaaactgaaaataccatgtacttttggactcctttcaaacatcaatcaaggtctctcaatagtcaatactccagtccaattactccaaggtttctgagtacttcaattcaggaaatcgaatcaagatttccatgtactccaattcagaaaaaatcaatcaaagcttctgactttctgagtactctaattccaaaaaagaaaaatcagtactcggcacatatactctttattctgtacgtacattcagaaagagtatcagagtactctaaatcagaaagatatttcttgtgctagttctttcattgtgtgtgtaaaatcgactacaattccagccaacgatcgagattcttgaggttatcggcgcaacctttctttattcttgagcttcttgattagatgcatcgctagaggttcgtcgtcgtcgcccgggagaggcacgccatttccgctgggcttcgtcgctgtggactgatgaggtttcgtcaccgtacgttgcctaggagagctaccgtcaatattagggttcgtcgctgtcgaggtccgttcatcgccatcaccagcgattgcgtaaaggcagttgagatcgagcccggccacgagccgcgcggcatcacggcgtagggttcgccgccattacgggttgggaaaggcgcggctgcgtcgtcagggcaaaccagacattttggaagatggggagagtatatcagttgctccgttatttggaaggggttgtatattttgctttgcagtttgcagtccacacagagcctactatcttctttattatcaaaaacacagtacaccttttgcctttgaatttcatgtttgacttgagaatgtgaatttaattgcccttaaattaactttcgaatagatttcagcactggccttttgagaagaagaaaaggaaaacccaataaaataccggtaagatgatattttagaaaagtttttttaattatttcaaattttgtttttctgttatagattcgaaaattttaaggtgttgcatagcagcatgcaatttgatgtcgcatggcatcgataggttcaagccttctttaggcaaagcattggtatcgatatcgttcatttttcatcaatcttaaatatatcttattcaagctcggttatattacattttgtcatgagcccctgcgcataatctaatgggatatcagtgggttatcggagggcgaggacatggaagcttggtcgaacatcgacccgtggcggcagcaacaggagatgagaaaacagagaatcggagatgagaattgtagattgaatttgcttgctttattcatccgaatgctacctcttaataggcttacaattggtaaccaaattactataagaaatagctaacaaactggtaattaaggaaaagagctaacaaactttatctaatttgcaagcggatagaactgttgccgtccggcgcggctgatcaggcgcgacgcgctgcgctccctgctgccgcgtcctgctgagccggcgtgcctctgcgacgatacgtacgtaatcctgaccatgacacatttatgtttggtttgcatttcaaatatcatcgtggcattaccactcatattactagtgatctaattagggagactaaccaacgggagactcggagagctacgaaccaatgattaagcacaacttctatacgtaatggatttgatgtgcttttatctgattaaatactatacttaatgcctataaatatatatatactatatacttaatgaatagtatatagaaatatatacttaatgaaattaatactatatacttaatttggaggcccaaaaattgtgggccctattcaatgggccacctcgacctgttaaatatgtgatccgaattttgggctcacaatatattcggattagtttataggattagtttcctattaggagtcctaaatttcttctatatatatcccttgtaagctgcacgaggagggtgcgacagcccaatgtatcccctgcgtttgtatccaatttctctacagtgatcattgtccgacgcggagtgggtgttttctgtgcgaggagaaaaaggcaatgcagcagccgtcgtccacgcctacgcagccgcacgcgtcgaggaagcagcagtcggtgtcatctgatgtccataccgagccatctaccagcacgtccattcagcagccttgcctcggttctgttcacgtgaatttatttcacggttggaaattgctgcgtgcacacgcccttcgtaccagggaatcaattcagtggcaatgctccggttctgttcaggtgaattcaaattcacattcaattgctatgttcacaaagccaagtctaccaggaggttctatacggagatcaaatacttcgttttatttaatgcacctagagcgtttcgcgtttttgctagggtttcacaatttataccagcagattcaggattttattcccaaggcgagtttgaagtttaatctaccgctcctggattgagatgcaatattctcgttatggcaagtgaagatgcaagttggcgtagccatcgaggaggagaagcaagtattgctgtacaccggagaggaaaaaaaaaggcaacacattcaagtcgtcgagagggagcctcgctcctgtctagatcacaaggtgatcaaattgtccggcgaattttgctaccatcatgcctaacacaccggaaggttaataaggagatctaagtactttgttttatgcacagcgttttgcgtttctgttaggattccagaaattaataccagcagattcaggatgttattcccatggcgagtttgaagtttgtgcatcagtttcgcgtctctgctgggttccacgatgtcataccagcagattcaggatttgttcccaatggcgagtttgaagtatggtctacctcttctggatcaagggtgttatggattatagtccaagtgactatttggcgcacattgattttatcatcatgaggttgtttagaggttgaagatttttatgctacaagggaaattcgtctcaaggtggagattgttaaatatgtgatctgaattttgggcccacaatatattcggattagttatgtaataggactctactttataggattagtttcctattaggactcctagatttctcctatatatatcacttgtaagccgcacggagagggtgcgacagcccaatgtatcccctgcgtttgtatccgattcctctataatgatcattgccggtcggtgcccgtggttttttcccgcaagggttttccatgtctccgttgtgcatctattttcataacacgaccgatagcccggccttaatttaccgtatcgatgattcgttctctaaaggaagttacagtgatgaggcggtttctactggtatttttatatataaaagggcattttatctttaggataaacagggatacaattgctttcgctcagaatagcttgggtcaccctggaggcctggactgacaggcatattagcttagatgaagcaaacaacactcctttcgctttatatctttttctttatgcatgctctttaattaaggagggcccagcagcgatcagtggcagtccaagcaacgaatctgatgattattgatggagcgcacagcttgggagatagtatatcgatttgggacacttttgccgaaaagcacattaccaaagcaaacgaccaagcatgtaatgcacgcattctatgtaggcttctgctagctccatcagctctccccaaacatcatcttgcattcagttcttcgatcgtttcattttgtatgctcccatgatgcgtgcaagcatggcttagtttgttcactcccggccgcccagttttctcaacatcgtgatcaaggtaagctacatgaatgcagcttgctttctcaacatccatagttttatatatgtacaaataatcaacacagtgatatataagagtcttatatatctctctggagttttggttttcaacgagctagcaagggacattcttgaatgcatgtttcaatatactccagctaatttgtatttagttttatatcatcaatttatattcatatagaatcattgattaattaaattaaaagaacatattctagattttgtaacgtacgtgcgattcaaagaacatcgactgatcaagatatgatggagctgctcgcctagactgtaattcaacaattgaagatccagctagctagcaagagatccaggcaacagatcgactcatcatgccagcggatgaggtatatatttcactccgtgccaatgtgccattatatttttttctcttttcattttgaatggaaattattcagcgaccatgcatgcaaaatttggcattccctctgtttcatattataagactttctagcattgctcacattcatatatataaatgctaatgaatatatgtctagatttattagcatatatatgaatattggcaatgttagaaagtcttataatatgaaacggagaaaagtatatattagctaggcaggcatgtatgcatccaatttggatgctattaatttgttcaaacacactttcattaattcattacatatatatggggtatattttaatttagacccaggagtgtcattaatttattcagtttggtggtcttctctataacttcactggttttcaaatagaagtccggcaaaatctttttgtattttcgattacatatatatgacttatagtacataactcaaaatatatttactagcttatatagccacacacccccacgcaggccatatataacaaacttgcccatatctaactccacgacccaaactaaactttcagctgcatggacacacatgcacacttgctaattactacctccgtattttaatttatgacgccgttgacttttttatccatcgtttgaccatttgtcttattcaaaaaaaattatgtaattatcatttattttattgtgacttgattcatcatcaaatgttctttaagtataatatctactgacacacttcacgccacgagactcactttacttgacacatctactgcatgcaggcacttacatacaactcatggctttcactgatatcacactaattaactcacacatgcacgcactgtcgtgctcctagcacacacgcacacgagacttagtatatataactcaaaccaaaagatcacttaaacaacaacgagattaaaccttaacactagctaattaactatactatagtacgtatcattaatttgaaagttttccacccaaaaactgtcaaaagttgtaaagacactccctgtatatgtagtaccgaatttaactagctagctcaacgctcagagaaaacgatatataattggtgtatctctacgtaccaaaaaacagcaagcatatatacagtagaaggcgaagcttagctaggtttgtctgattaattatattattaattagtacttattaattgcagtggacgaggatcgtagcaggcagcatcgatgaagcagcaaagaagataatcgatttcctggacgatacgagcaacaacagaagtacggtgatctattttgaggcctgcagaggattggggtcatcggccgtcctcaaagaggtggccaaacgactgagatcgtcgtcaccggagaagctgaagctgaagctgaggttggacaagatcatccacgtcgattgctctctgtggcagagcaagagggccctgcagaaggccatcgcccaggagctggagcttcctcggtcggtgatggccatgtttgatcagcgtgacaaggaggatgatctcgacggcgtggaccacggtgccagaggagtgataccgcacatagatgtgcaggagtgcggtgttcctataaatatgggactctcaggcaaaagggtactgtggacatcccaggtcaggtttgggccttggatgatcacaggcgatgtgcacatggttgccggaccgagcgatgtcgctatgtttgctgatcctatggatgatcaacccctgctgcatgaagaggctgaggaggttgctaggtccactggtgtcccaaaacctggcatgagccctgagattgtcaaggagtgcatcatgtactacaaggtggtgaggctgttagatggaaaccatggcattgactgggccacccacgcggctaactactgggtatgcagcgggatcatacgatccgttggtaatacgtcagcatgggagattgcccaagctttgcataccaacctgagattggattgggatgatagtctgaataataataaggaaaaactagatccactacaagtgccttgtgattctgtaaaggcatcattcttctgggctacatctcacagcaacaaggaagcaactacaagctgtaaagaatcactggaggccagaatgttccaacattcatctgtagacaggctgcgtgtgataaatctctcccagtgtacattcagttttacatctccacccttcctcggttgtagcagcctaagattcctcctacttgaccgttgcaaagacaaagacaagctctgctcaggctcatcaccaaatagtactagtgctggagacactgaaaaggagactagtattagcagtggagcatgtttccagaagctatgggtgcttgacctgagttacacagactggtattggctgctatcagtagaggcacaagatctaatggttgagcttagggagctaaatgtgaagggggtcaagcattggagcataagccatctactccgtgatgacaacaattctagtactggtgtcggaagcagcaccaagccccttgggctactcaaccttgtcaagctccaagtcgcgaccgaaccaataactgaagttcaacatcagtcacaagtattgcagcaagatcaagtagcagtaacattattcccgaacctgtctagctgcaaaatcatcaagacaatcattctggatggttgttttgagttgacgcgaattgaccctcatgacctaccgccatcactcgagtcatttagcttctctagcagcagcaatgacaatgatgttgatgtcacagccaagatagagagcatctccttccgaggatgcacccagttgaagagtgtgcttttgagaggagtgtttgagaggctcaagcaactcgacgtctcaggcacttgtattaaaaccctcgacctacgttcaatgcgaggcaactggtctctcaaggagctcctactgcttggatgcaaggagcttcgtgcaatactatggccaaaacaagatgtatcattggaggttctgcacatcgacactagtagcacagaacttgatcatgctacaggtgtagaagaatcatcatcattctcacctgttgaatttaaatggtatatttcagtgagggacagaaggctccttcgctcgctaaatgatacaaaatatcccttggatgcaccatgcatcgagatctcatcccctcctgctagtgttgctactgctactactgatggttctgaattaggcggaacaataagcaagagaaggcccattgccgttagcagggctgaacaacgttggttgatgtcgaccaaaagccgacgaccagctgctgacaacaagaagttatatgcggatgtcaactccacgatccagcacttgcaactacaagcaaccatgaatggcaactggatgtggccttataaacaggagggcagcacctctcactacattagcttacaagatgataagaggatgcagacgaaaccattatcgtcgccatctttgccaggttccatctgtgaaagagcttcaggcctgcacgtgcatgacagcttgtctatcgcaagtatcacaagccattcaaatggggcacggagatggaataatctagagtggtgcagagtggagagatgccctaacattgaaggtgttgttttcactccacctagtcctgttggtggcataactttcttgtacctgaagacattctgggcaacccaactagcaagggcacgccacatctgggactggggcaaaaggggcctgctgcacaaggggccagttccattcaacctgcaagtgctacacctagattgctgccccaggttgatatatgtgttttccataaatgacaacagagcttcctatgcataccgttggttggaaacccttgagatcgtgtgttgtggtgacctcaagtatgtcctccgagtgtatgataataatcaagagcttctggtggcaactatagaattctcagagctgaagcacatccacctgcacgagctgccctctctgcaacgcatctgcgggcataggattgtggcgcccaagctcgagaccatcaaaatccgaggctgctggagcctcaccagcctaccggctgttgggcttgacagtacccgcaagcccaaggtggattgcgagaaggaatggtgggatggcctgcagtgggatgggttggagaacggacaccatccttccctctatgtgcccacccactcacgctactacaagaagaaactgcccagaggttccatgctcaggtatgtacatatgtctgtgtgcatacatgattattacttgggtatcagtccttgcgcgcacatacatacatacgtagaaacttatatagctcagtactttagttactccatcatatatatatatatatatatatatatatatatatgatcgatcttttccctttttttttaattttgtctgacttggcgtgctttcttttcttcttaaattcaggtgatcgatatatacgtccatacactacatatatgatactgtaatcatctacgtatcattccctttccctcatccagtggctcatcaagttcttcagctctatctctattatatatgtccttatttggggctagtgttcaaagtgcttgctcatttcatcatatcatttgcaacggcatcaatatctaatgcatgatgagtaagtacatctccggccggcatccagacgctcgtcatctgcttgttactagcttggattctgttcatttctgcttcttttgttctgtgtgaaaattaataaatggatgctcagctgccagctggtgtgtgagctctgcatctatctgctaagttattttctccatacatgcttgctttccgtttggccggttagtcgatctgcttgttcgaccgatccatccatcggattactacgtatgcttcatctttctggatagatgatcatacatgtatatgtgaaaactttgatctctagcaccgttctggtgtggtgtgcttcctagaggtcgacgaataaatcatcagcttcagcggcatgagaagatccattgggtgatcctcgtgcagccgagttgctgttgtgcacttgtttgtgggtgtgtgtgtgttcgtgtgatttgtcagcatatgtggactgaccgagtttgtactcctaattacttcacttgtatgaacagaaacaatgatgatgattgtgagtgtgacatatattttctatgctgcaaatgtatgtattagttgctctgtcattttgaaggtattgtatattttgctctgcactccacagtcaacacatgatatgcctgtgtaaattttctttaacaaacactccttatcaaatccgcatttcttttgttagtttattctctgcttcaaaatgtgcaaagggagaagcacaagattttttttaagcctcaggtctgactgatttgatcaatgaattaagatgcatttcaaccaaattagcagtcaccattagtaattgtgttttgtacttgtgcagtgatatgatactctgttttgaagtgaaaccttctgcaatattgcagtggagagtggcatgcagtaagatttggggtgtatcccaggtgttagtgtttgctgggcctgtatgaatacacacattaggcccattttggcagacagctgcacctattaaaaatacaatccataactagcgaaatacaagagcaaaaatacagtcctttttccaattcagtgcttactcaagaaaacctcaaactagatttccagtcttcatttttccctgtttatcctaattttgtagctacaattaattcaagatacaggagattaaagaacttggacttaaaaaataatggtgacacagtagcaccttaatttccttctagtttcagaagggacaatttcctttgattcaactatatccaaaacaggcttcaaattacatccagttctacatccttgctttgcaggaaacattggatcttgctagagaagccattagttatacgagtagaagcagcaggtcgagaagcttggcaacatgtaggctgcaccctgcattttctttcataagtgatggttgatgcaatgcaaatcctagtcttgctaggagattacaggaaagctaggtgatctgatctgagcaaattcgcacagttttgccagccatttgttgcattagttagagatccatctgatccatatacgcattacgattaattgtgttacagaacgtatttaaaaatactgatcgatgcatgtgtcctactagtatatatgtacggcaagacaaaagcatgcaggatcatgagttggacaaggagcaggtgaaccgacattatttacctttttctttgcgggtgggccccacgcagcagcctatgttgctcgctgagctgttaaatttacattgtgtgtccaatgccattgttaaacatctacttccttcgtcccaaaataaaacaacttttatatatatatatatatacacaaattcatgcataaatgttaatttgtttaagtttggaaaggaataccctcaaaaaagtttagaaaggattgagaagatcgctagagtaaaatgcaaacatgagagtgcagcgagattatacaaattatatatggtggtactattgaataaactttttgttgtaattgttaaacttccatgtggaactataaagattgctttgggaaaaaaatgcgaatattaggaaggaccaaatatcaaataaatagaagggatgagtcttcgaactcaggccggctagctcaccaccatgtggagctggccggagtacccctgggcttttctctaaagattgctttggttctaaagataaatgcagaaatgtatgaaataagctctttttatgttttctaaagaagagggaaataatatcatatcattggttaaaaaatgttaagagacacaaagaaaaataaataagattagctagaatcggaataattaacatatcataattgtagttctattttagaagagagaaggaacctcacactattgtgtaacaaaactgtacaaaataacaagcccccttgagtaatatttaacaaatacagcatgtataccaactcaaaagaggacatgtgtataattaatataacatgatatatatagttgaagacaccatcagaaatgctaagcctagatatatactactctagctaggctctagctagctcatacatatcaattaatataaaaatattatattaaagatatatagttaatttgcaagcatatgcatgacgcaaatggcacgtttaattaatactatttgtcaaaactgcatcaagtggaaacaatagcgcacatgattccatttgaaacttagccatgtcttcatgtttggcagtgctaaccgagaacacaacaatgcatcttctacatatttcacctaatagttaacacactgacaacttcatgaagctttcaccgaaaatatttgagatagatcacgtgtcacaggccggctcaataacatggtacaacttagattgggagtataattaaaatgggcatagctaggaaggcaacagcatagaacattgacaacataatgatcatgcatgtattaagacattgacccactctggcaaaatctagtctaataaaaaactcacaaggttaattagaacattcagagatggatctcatcatgtcctgatggtatacttgtaaatgcaagtcgctttaatcatacaaggatggattttaaaaaaataaactcttccaaaacttatttctaaacatgaaccttttggcatggcgagacaacaataccatgtgcaacccatcatggcgtgacagtgttgtttcacctaagtggggtggtgtgaccaaaaggtttggattagaaataagttttggaatagtttacttttgaaatgaaaaaataaaaggttcaaaagaaataataaagaatcaaaaggatgtgataagaaaataactcaaatcaattaattagttgctctttatttatgctacattgaaagaaatgagtttttttttaaaggaaaacaaataaaacagatgaaaatgtgttataaatttagggaagaatttaaaagcaaagatgacgacttattttcagttagcaactactccactatagctctaggtgaattggagagctactagctagggatctttgacttttgccttctgtttggttaatttcaactttcaagtatcatcattgcgggacgttgactttctaatcctagtgagcaatcaaactttgataatcgtgtcacattaactaaatgagacccatttaagtttaacaaacaagcgttttgacatagtaaagtaattgctgattatcaatggcaaccccttctcatgtaacatccacgattttcggagctcaaggatttgtctcagctagggatggcaatttcccccgtggggccgggtcccctacgggggcgggggcgggttcagtttttgacccgcgggggaggtggggccgggggcccgcatttttgtggggaggggacaggtgaggcatttcacccgtggggtgccgaagggtgtatattaaatctcaaaatgtagcccatagaagatctaaaagagccacaaaattttaagtaatagccttatcctctccactctccccatctcccctcccctcactctcactacacaggcggaggcggcggcggcgccaccgcgccgaagaagaacaatgtccaagggcatttcggtactttcaatgctctttttctctctgttttcaccggaaataataaaataatgcatcaggtgtctagcagctaattaccatatttttgcaatgtccacaagaagatacatgttctttgggtgtctcacagcaaatgtcacaaactttgagtatcctatagcaaaatttgcatttgatttagtacaaacctaagggcttattctgaatgcaggaatgcaaattcatagtaccaattcctccaaactgaatgaatgaagtactcaaatcctataggaattgaatcctcaaattgttctctacaatttgtagaagccctaaaataacttaggccgtgtttagttcggtgccaatttttttttacgtatacggacacatatttgaagtattaaacgtagactaataacaaaacaaattatagattccgactgtaaactgcgagacgaatcttttgagcctaattaatctgtcattagcaaatgtgggttactgtagcacttatggctaatcatggcgtaattaggctcaaaagattcgtctcgcaatttacatgcaaactgtacaattagtttttttttccatatttaatactccatgcatgtggccaaacatttgatgtgacggaaaagttggaagttaatttgaagaaaaaagttagaatcgaaacacatgcttagtatgaaagagtgagaatgaactaaccgtacaagtaaatttgcaagtcaagtcaccacaaaaattaacctctagcaatcattgatctgatccaacatggaaaaggtgaagacaaccatgtgtggttgacttttttaacatatgacagatgataaaatttggtcaaaagttagcagcaaacgtacccacatccatatatgcatgcatgcatcacatcttgcaaaggtgagattctatctgtctctcgatctgcatgaatccatggatacatgtctgattgatctgatcatgcatcacagttgagaagaagctaagctaggtccaccaatactgttaagtgactagttaagcaaacaagatggtgatgtgcattgcccaactaatgcaatcacaaaagaaatttcatgtacatatgaacatatgatgtcaaagttataccttcaccaattagttgatgcgtcaaatggtattggattacgtatacgtatcttggcaaataatagttgcaaattggaataatacgacgacatagtatgaatctatgattaaacgtacatcgaatgaagaagcatcaacctgaatgaatgattagttgaagaagcgtgtagatcgaagatttgtctaatcaagtggcttaattatttgtccatatatacaacactacaatacaaacagatactacactggaacagcaactagacaaaaattaagttcatctctccctcaaaatgcatttaatttatacatttatatgatgttgaaattgctggacgattatgctaatacaaaaggttgatacaattaattgattttgagtgttgtttgctgcttcactcggggacaacacggtagatgacgacgaagcacggcagtatggcccttgggttcgccacgaacagctcctccaggttgccgtacacgctgctcgccgcctcgtcgccggccaccgagtcgaacgctccctcctcctcctccgcaccgccatcgtcgtcgttccggcggacacggccggcgattacgcggcacaccagcattgcccggcacccgcccgcctgctgcgccgccgccgccgccgcgccgcagtcgtgcgcgcggccgctgctcgccgtggtgcgcacgccgagcgggtgcgcgcccgcccacggcgcgaacccgtgccggatcgccgcgcacacgccgcaggcgtcgtcgtcgtcgcagagcgaggtggcgccgttgaggccgagcgggcaggcgagggcggcggggtggaagcggaggagctcgttgccgtcggcggcggcgcgggcggcggtggcgcggcagcgggtgcggacggcgtcgcggtaggcctcgaagcgcgccacggtgcgcgccgcgttgtgcaccttgaggatgcggtcgatctggcagatcggacggtcgcgcttctgccagctcgacttgaagattatctccacgatgtttcgccccgagtcctccggccccagctccgacactgcatatgcattgcatgcactccaaaattaatcactcgctaatcctccagggagcaagctaattaattggatctaccgtaatgtaatgtaattagtggagagattaaccacgcacagctagctagctaagtgcattaaatgcagtgagtgcatcagcatgtgcaagctaagctcacagttatcatagcagacagtgtgcaatcaaggcactgaaattcaggagatcagtacttcatctcggccgcatcaacaacaataatggcattgcaaatagtgcagcactgtcatgtgataggacacttcaattgacctaaacagttcaagaggatgatgtacatgttcatgcaagcacatcgatcacttaactaaccttagtggctgccatggcccatggcagtttaaagctgtataatcagctatgcatgttctgcatctatttggaagcttgagattctgctaagtagcttgttcgtaccagaaaaaagatcattttctaaacaaatatcgaacgaggggagtagcaagctattgagaatttaaagtttgattcctggcttctggtgtttaatttattttctgaattctataactatatattcttaaacttgggtgaaaatctgatgtgtttcgaaagctgagaaattctataaggagctatagctgccctagaaacttcataaaaaaaataaaggcatcaaaggacaagcaagtactccctctgtctcattttaagtgcagttttgagttttttcgtccaacatttgattgtccttcttatttgaaagtttttttttattattagtacttttattgatattagatgataaaacatgaatattactttatgcatgacttatttttttaatttttttatattttttttaaaataagacaaacagttaaatattggatatcgaaactcataactacacttaaaatggaaccgaaggagtaaacgacacctgaacaatctgaaactttgtgttcctttcagagtactaatttcacaaattgtgagtgtgttcgtgtttgtgagggtacacaaaagtgcatgcagatcctgtgtgctaccaactaatataataaattggcagattggatggatactttgcccaactactgtagttgtagaagcactgggatctcactctgcagttctttctagtactcctacattgattctattgcttctggtgcattgtcttaatcaggcactgtactgtcattgctgttaattaatgatctttataataactaatcatgtgcatgcagtatcctacatgcattgagatgccatcagtagtcagaaagcttctacccatctaccttcaacaaatggagatgcagatgcgactgcaagcatgcaaaagatggctaggcacagataccttttgatgtatttttgccatccaatcttaactaaaataattaaccaaagatgattaatgtgcacaagacagtagcttccttgtaacccacaaaagacaaaggaaaagaggaaaagaaagatggggttaatagctttgatgagcagcatcttccttctcctttctgtttgtctcctctcctctcatctcatctcatctcacatggtttgatgtgccaagaaactagtaaactaataacactgtcactccactaagattataataataattatcacaatattggtgtctatgtggaaatatccatcatcattttgtcatgagtaaaccaatcatattgactgggcaatatatagtacccacacacgcagatctcaatgcctcctcattagtgttactaacttggattagctaggagtactatcttaacttgttctacaccccaaaagcattgactactattcacacaacatgaacctcagtttgtcatttttcgttagaatggagatggttgatatcaatatcgtttacggtttatgtaaagttgatgaaatttgtagaaattttcatcaaaatttagttaattaccagcatggcgaatggcttggtggtgctccaagctgtcggccttgttgaacacctccccacactgcgagcatgcgcacagctcccgtggcctcggatacctcctaattaacaccagattattattcgctaatcaagttaattatgagcttaattaagtaattaatcggattaggaggagaccttgacatgggctcgacgttgatggcgcggcactcgtagcaaccggagaggccacggagggaggcgtggtggccgccgccgccgccggaggaggaggtggcggcgcggtgggcgcggcgggaggagcgggtgagcggggtggtgtcgcggtcgagggacgcggcggcggtggacgccgcggaggcggagctggcggcgtcgaccacgtcgcggatggcgcagagcgacgcgccgcacgcgccggcgccgtggctgcggagccgcgacaacgcggacgacggcgcggcggggtcgtgcacgcgcgccgccgccgtcgcgctccggcagctcagcaggctcttcagctgctcccacgacgacgacaccggcgcggc

SEQ ID NO: 80832 - DNA, 8421 bp, Oryza sativa
aaacgagatagaaattgtaatcgtttctaggcaaagagaggaacttaacaattatgtatacaaagttacatacctcccttcagtatcatatgcttcagagtcactcccatgcttacccttgtgaatgttctttatatggatggaaaacagaggagaaggcatccacccctgcatttgaaagaaagtaaacataagttcatctgtacatgttggcccctccataaaaaaacacatcaaatccaaagcctgaagtgaagatagatatgtcttcccacttacaaaagtcactacaattcaattttcactagcctagtgacacctcttcacatttacaaaagaaggtggtgtaacattcagaccaacatataaaattcagaacgccctaaaaaacattatacaatttctttacatcataatcgagaagattagtccagattttttttttgacgtaagattagtccagatatgatcacacagtttggcaatacagcaaaaggcacggcatatatgttggtaaaaagtattgaaaataaggagcacgtggagtacagagggcaaactttaccggttgagtaggatagctgaggacgaggttgatgagtatggcaccagcaatcgacacgggatacccgcaacctatcgctctcagccctgtgaaaaacaaaaaacaaaacataccatatactcaaagtctcatactacatctgcactgcacaagcaatcgttgatttggaagcataattctgacttaacacgcgaccctaaaatctcttaatctcttctgttgcgtcaagcttaattacaaccttagaaggcaaactgtttgcctgtccgaaacgggacacagatatagcagcagcagagagagatggactgatcgcgacgtggagagttcatccacagcaagacacacgggcggatcactcactcgctcgctcactcactcaccttggaaggtctcccaggggtagatgatgccgtcgccgttgcggtcgaagaacgcggcgtgctgctggagcacgctcatgccgcgggcgtcgcgcccacgggtcccctgcgggtggctcgggtccaccgccgcgagagccctcgcgagatctgcgcgcacgcgaacccagaaagaaaaaaaaacagcagcagttagctggctacggttacgacatcaggtttaggatcagttactggagcggtagtaatttttctgcactgtaacagatgatgcagtaccagtaaagcactagcggtgctactgctctcatgtatactttctgagaaatttcagaaattttacgttacttgacaaagtacattgagatatcaagattttataatacttaaaaattttagtacatcgaaatacgtagtatctagagaaattaaatggtaaaattacacattctttctgttggtacttaaaccatatgatctctcaagtctcaactgatgtacgtcgagctgccgtcacgcacaaccgcgtgctttgcagccaactccggcctctcactctcttatcaggttatcagtgttcagtgaccactgaccaaagacatcaaagacgatcgagaaagaaaaagaaagatagaaagaaagaacagtttttttttcgatccctgcatggtagaaatagaatcgcttacatggcttgggaagctgctcctgcaggttggggttgagcttccgctcccccgtaacagccgcgtgcggcgctaccgtctccaaggacgggtcagacgacggcggcgacgacgacgaagacgacgccatggttattcggggggcgagtttgtaggatctgcagatcgaaagaacgaacgaacagaagaaaaacgaaaacaaaacgctcttagttggggatcgaactagaactctcagggcaatgcgaacagaaggaatccaagactgctttgcaacacaaggcacaagcaaaaaagatgcaggattcgatggatggattacctttggcgcaaagagagatgggggcgccgggtggggaggcaagcaataagtagtagggtcgccattaggaggaacgcccccacaccgtatttaaaatgctcgcgaacggcagcatcaccaagctagccgaaatcctccgccttcgccttcgcatctggagttctggacagagtccgaaatataggttaacacgtggaaggcaacggattgctcgctgagtcatgctactcctagaaacggaacgaacaaaatcggcgcggctgtaaaactgtgtgctgcaagggtctgaaaagctactttcagtgctgcagttggtaggaacaacaacaacagagtactgcacgtatcttatgaccatggaaatgagtgggattaatgaccgtgattagagtgtgatccctgaagccagcgagagagtgctagctatctcctggtggttaggttttgagttttgacaatttgcaacatgccacgggccacacagcaacgtgacctcgcgtgacatcgtgatcggagagtgctagacgcgatcttctcttgtactaggactgcttattttttgcactactggcgtgtgcacgatggattgaatgctcacattgccctgctaacggatctggcgcgtgcgacgcatgaagagctggatttttcacaatttagtccttttaaaaaatcttatttcataaataaacccatgaaaaaacttatccgaaaaataatcctttttaagacgccagaatacgacggcgccagtcctcctgccaccgtggcggggcagcgctgaggtggggggagcgcgccaatgtggttggcgcccctccctccccccattttttcctctctctagtgtagaggagagatatgtacaacttattattattattattttcacacttagaagcacacaataaccaaccatacaaaaattaaactcaaatagatgaaatatgtgacttataaaattttctaaagctataccgaaaagaccccccctcccccgcgttctccctgcttttcgttgttttggtttttcctgtagtccccaaagaaagtagattaaatttcgaacactcttagacttttttacatttttcacatcctataaacaataaaaaaagttagggttcgtgtttctttttgttacattcgggtgtcatttcttgaaacagtcgtaactttctcatacggacttggaatcaggcaaataatatatccacggatatcttaaaaaaaaagttacatccgattctcccccgctttgctgggttcgaggaaattaaaacctccaaattccacttgcaagattatgttttcgaggcgagaagcttttcggtagagctttgaaaaattctataggtcacatacttcgtctatttgagtttattttttttatggttggttcttatgtgctcctaagtgtgaaaaaaatatataataaataaaaaaggggggcgccagctacattggcgcgctccccctgccacctcagcgccgccccgccacggtggtaggaggactgcgccagctactttgacgccccaaaatgaccattttcgggataagttttttcaagggtctatttgcgaaataagtttttcaaaaagttcaaattgtggaaaatccagcatgaagagggtgtttggttgcttaccaaagtttgcctcaatttaccacaagtatgataaggatgttttactgagtttagtgcagtgtttggttctaactacgagttagtcatatcaaactttccttgaacttgatcccacatttggatcatagacataataatatatggtaaaaaggttaaggtgtggcttcttgatcacagctttaacaacttaaccacaaatatttggctggcttaggtagtgttggacaaccaaccaaacagtccccaaatcctcccaagccggtgcgaatcagagaaacttctccccggctcccattactcgtttagcactcttcgcacacaatttcaaccgtaaatccagaatacgcgatccgaacaagcagagcgactgcctgtatttttacaagctttctcgagagggtgagtgtgcactgtgtctgcgtacatgtcaacgtctcttgcaggatactggcatgggagatagagcaagccagccgccagcatggcacgcgtcttgcgtcttgcgtcttggcgtgctttgcaatggtacacacgtgctggccagtggaaaggctaggcgcgcgtgacgctcgcacctgtaattcgatctaaacaaatcgaaaatattttaataccatcatatggattctgaagccaccgaaatgtggagattttgagatccacgtagtactccgcctcagctgatactccgtttctttcgcccgtttttccacgtaccactcgcacgcaccaacatcatggctctgttgaagagagtatccacgatatatggaagagcgggtgctctgaagtcggaaagctacgcggaatggcagatggtcagatacagataggcattgatcgcaatggccaggaagcaaacgacgacgcaaatcatgcagcgcgtcaagtgaagatccaatcgcccttggctgtttctgcccccgcatgcagcgatgcaaacggagtgtgccatgctgcagtacacgggattacaggaaacattttttttgctcctttggttcagaaaaaaagggaagaataagaacatttaccccaactgtccagtggtgcccacgggtggctggtagcgatgggtcgcagcccggccggccttaccgaaaaggagaaaagaccgtacgacaatgggctttgtggtccagctcgttgggctcggcacggatggcccatcgttgcttggagcaagtgccagtaagcctctaagcaaaggttcaagtttgccggcctatttttaaaattggtttttgacaccttactaaaattttgataagttttctcaaagggtcaaattattaaaattaaggaacaaaccgaacattctattgttattgacaccttactaaaatttggtatttccataaacgttctctcatactagcattactaaattttgataaggctacaaactaaacgcttctaacgctatcaacatttggtactataaaaatgcgccaacttttgacaataccaaattttggtaaggttaattttgacatcaaattaaacaattgctctgagttaaaaacttctaaatgtaattatggtgtatttgtatctattatattattaaaacagctttgaaaggaggcaccacgttcgatgtgggggctagaaattcccacattaatcagagaaaaagaaaaaaagaaaagaagagtccaagtagaaatacaatctaaaaatagctgaaattcagaattaaaaataagcaatattgaaggaagtttccatataagaacccaatacgagattaattaatattcgaaataaaaataaaataaaatccaaaattagaaaaaaaaagagagtccaagtagaaatacaatttaaaaatagctgaaattcggaattaaaaataaggaatattgaaaaaagttttcatataagaacccgatacgagattaattaaaattcggaataaaaataaaataatatccaaaattagataaagtaaaagagatttcaagtaggaatacaattttgaaacaactgaaattgaaaataaaaaataaaaatattaaaagaacacaattcgatattaattaattttttttaaaaaaatctgaaattagaaaaaagaaaaataaggttccaattaggaatacaatttataaataactaaaatttgtgataaaaataaagactattgatagaaaagaccatctaaaacacatgacgagataaattaagtaacaggcatataaaggagtagtggtggtggttgatacgacataaaaaaaattgttaatgaaacaccaaatagaatcctaatgacgattaaaaggaggggcgatagggaggccgtaaagcaaacgatcaaggcgattgccgggacttctagaaagtaaaaaaaataaaccccattgataatcatattcgatttttaaaatctcaatgacaataaaaaggagaagcagcgagcggggtgtataggagtatagttgcagagctgccgatggttgacgggacttctagaaaataaaaaatgaattccaacgatagttatgttcgatttttagaatcccaatgacaataaagagtaggcggcggacgggccgtagaggagcatagtagcatcgtttgacaagacttctaaaaattataaaaaaacgaaacccaacaagacaataaactctaaaaactacaaggttcaatttttgaaggttcggaacttctaaaaagtaaaaaaaaacaatgatagtcatattcgattttaaaatctcaatgacaataaagaagggaggcagcgggcgagccatagagaagtacaatggcaaagtcaatgacggtttagcgggacttctagaaagtaaaaatgaacccaaacgataattatgttcgatttctaaaatctcaatgacaataaagagaagagacagtaaacgggtcatagaggagtataatggcaacgtttgacgggacatctagaaattataaaaacgaaactcaacgtgaaaataaactctaaaacctataagatccaatgtttaaaggttctaaggagaatgaatagaaatagtggtagatcgagcaagcaaataaagaaggagatgacataaggggtagtatctggtgtgacttttaaaaaactatataattagaaacatggggatgataaggtttggtctttcaaactcttaagacaatgagatagctatttaataatttttttagtaaaatcataaaaaatatataattttgtttgggtgctagccgcacaattgcgcgggccacccagctagtttgaactacacgtaacactataaccggtatgtaaaattgtatatataagaaaatgaaatgaggtgatagctcgcgcacatgtgtattgcaagttgaagatttgattcttcctgcgcacgctgctatttctttccacttacggtgccgccacccggcctcctcactatcctctttccctcgctttacccccgttaccaatactggcccaccgtcccatggcttcgctgtcgcctctcgtccacccttgttcgccacccatgtaacgctccgctttttgtgaggcgttaaaaactaattcggcaaaaatcctatatgcgaaaattccattctctgtgtgagagtctaagtcgtgccgtggatcttaattcaaatccgtccttgatccctctcgtcgccgtcaaaaaaatcgcctcctcagaattcctcttccaaatttaagttcccaaaatcaaactcaaacatccaatctattcccctgaaccctcgccaaaaactttaccgattccaagaaaatattgaaccctcaccttgaatccctccctatccattgatcgatctatccacttatctaacctatctatccatctatccctctacctatcgatctacgtatccaactgtctatttatctattgatctatctaactacctttgaatccttgccaaatatttgccccgactccaaaaataaccaaatccccatttgaaattcaaaccccaagctccaaaccctccaaatcagttctctcggtaaaagtctattttgcctccctcttggtcaactgggccgtttttctctttccggtccatctctccctctcggtccgtctctctctcgcacgtgtgtcgcgcgtgttcaggagcaggagagagcgtcgccgtctccttcctctctcgctcgattctctctctctctctctctctctctctctctctctctctctccccggggccgctttgccgccgccgccgttcgaaatccggccgcgccctcgcgttcgcacgcgcgcgctcgcgcgtggccgaccgcccggtcgccgccgcgtcaaccctggccgcctgcgccgcgcagccgcccatgccgccctgccgctcgccccacctccgtgcgctcgcgtccaagacgcggaggcagcgcctctctctccctcacgcgcgttttcctcctccctctgctcgctcaaatcgggaaggaaccgcgctcccttttccccctcctttttccactttgcccgacaccgcccgtgaccgccagctcctctccttgaccgcctaggtcggtttcctccccaaaccgacatcaccaccgcctataaaacccaactcgagcccctccctttcctcctcgtttccttgcccaacctccaccgcgccattgccgccggaccatctctgccgctcgccgacctcgcctccctccgccgtcgcacgtgctggtgaagctggtgtgtgcgacgacacgtgacgcgggactacgggcaccctctccttccccttccccggcccgagtccggagagctcgccccgcgccgtcggtcgcccatcacagggcccgtctcgactcggtagtg

SEQ ID NO: 80833 - DNA, 37032 bp, Oryza sativa
aaaagtcaacggcgtcatctattaaaaaacggagggagtattttttttcaatatttactgggttgtcccacttgagaacagatagcacctggacctgggaagagatcggtggcacctgctgggtcagatttgctggctttcggcatgtgccataaaccgtatttcaagctacacacttgaaacactagtgcagcaatatgatattttaataagtagcttaacctcattgatggggtcgagttaaaacaatggtggattcgtcctctttttcttcttcttcaggttagctgtcctggaacagttgttcgtatttgtactttgatctgaaccctctttcttgggatttgctttttgtaatctaaagcttgctgattcatcataaagaatgcagcaccattttcacatgtatccctaaacaattgtagaagtataaagtaatagcatgcaaactgctgacgaagttcacaaactgcgtagtgtggacttacgtccaacaaaaaatgtacacatccgtccaaaaacatcaccatccagctacctactgtaccatccgatttggttcgatgcagccagtacatatccatgtacgaattgcacaactcagctgcaaggatcgaatttttgagtgctttcgtttcgtcgtcagatgagcacactatctaacaaagtgtcactgtcgtcgaacctactgaatcttcagacaggtcttgctgaggtctgctcgaagagttgtttgaactattcttttataagatcgcatatttctgggagaaagagttgtttgaactcttcttcagatcgcatatttctggtcgagagagaaaaaaaagataccagaagataacaacagatctcccgagatcaatgccgtgatgtcaacatggaaccagactacacctgaaaaggcactgaaaaagaaattgaaacgcgtgtgcagagccaaacgtgcaaatatttgctgggtgctcagtactcgcctcaactacaccttatctcccgaatgcaacaaggagcacgtggacgccttattcggaacagcaatgcccataggttcagacttcagactgtttcagtagttcacacggccggttggcctgtatataaatcacgagaggatcgatcggaagtcaagaggagataggagacagcgaaagcaaattcaacgggcaagaagtacgtgtatttgccttcgagttcttcaggattcagagtttcagacgacaccaaggcccaagctaacattaggcgatggacgagcaaaaccagtggctcacggagccggcaagtacatccagtccttccatgtaagctctgaaatcttcgagcaaagcgtatgacgaaatgattattgcattgttaatgtcaggagcctgaagagttaacctacatgtatcatcaagaagagcacgccaggatgcaagagcaattcgctgggacgccgctcgtcgagcaaccagttcgatttgatcagttctacccagcatccatggcgccaaaccagttccatccgtctcactgctccagcttcccggccttcggtggctcgtcggcattgccaagcttggcgttcggagcggtggcgacgaccaagaaggagcaggtgcagcagccgtcgccttcgtcctcgaacgtcctctccttcgccggtcaggttcagggtagtaccaccacgctcgacttctccggaaggggatggcagcaagacgacggcgtcggcgtgttccagcagccgccggagaggaggagcaggccgcccgcgaacgcgcaggagcacgtcatcgcggagcggaagcggcgggagaagctgcagcagcagttcgtggcgttggccaccattgtccccggcctcaagaaggtgtgtgtacatgtgccccgatcatggcgtgcattgattccttggcaaatgcggcattaacacggttgtccatttctctctcagacagacaagatctccctcctggggagcaccatcgactacgtgaagcagctggaggagaaggtgaaggccctggaggaaggctcgcggagaacggccgagcccaccaccgccttcgagagcaagtgccgcatcaccgtcgacgacgacgatggcggcagcgcctcctccggtaccgacgatgggtccagctccagctccagcccgaccgtggaggcgagcatccatggcaacaccgtcctcctgaaaatctgctgcaaggagaggagagggttgctggtgatgatcctctccgagctcgagaagcagggactgtccatcataaacaccagcgtcgtgccgttcacggattcctgcctcaacatcaccatcactgcaaaggcaaggctagctttacctgtctactactcctagatcatttgggtttcgcatctgtgtaaatgtggctgtaaaattgtaattagatggttgttgttatagctggttttgacaggtttcagttttgtgcagatcgaagagggtttttcgacagcggttgagcttgtaaagaacctgaccgtggctgtcagaggtttcaaatgaaggcagaaaaaaaaaaggaaactggtgtacagaggacaagtgactagtataagtattatgcagtggcggatccaggaaaaaattatagcggggctaaaccaaaatgatcaagagcaactaagagagatttagggttggttttaggacttttttagcctttttagccttttaagcattttaacaacctcaaacaaagtctatattagcccctcatatatgaatatatagattataattttagggggtattatgggggctctaatggtatattagggggtaggggggtctaaagaccctccgcccccacgctgtctccgcccctggtattatgtacgtaaaaaatgtacaattggcattatatgaagagaccaaagatgtattgattcattcgaagaagtacgtagcgtataaattgttcggatctcatgttagatgattagtgcgtggctgaccgctccataaactctgctgagtgggagttggaggagttctctagcattaggctgcgttcgtttgttcgggttaggaacccatctcctccgcacagaaaacggagtgttccattagcacgtaattaattaagtattaactttctttcaaagttggatcaatatgattttttaaacaactttcggatagaaacttttttaaaaaacgcaccgtttagtagtttgaaaagcgtgtatgcgaaatacaagggagaggggttgtgaacacagaccaaagaacacagccttaggagctttagggacagtggaaagcaatgaaggtaggaggggcataaataacgccagagaaagagaaaatggtagaatgggaggaaccataaggggggaatgagactcccctataactttataactttatgcagtttacagttgcgatactgacatgtgggccatacattggtaaggtccacatgtcagtgccataactgtaaactacacaaagtcaggggatccgtttccacacgggggagataggctagctttaagggaaaagaaaaatagagtcggaggggtggaggtcttgggctagctagcgggcctcgccgatgcaaggcagagggtcgcagagtgcctctgactgcatgtggctagcggcaaatcaagaaagtgaagaaggtggtggagaagataaaagaggaaattagggagcttcgtgtatcgctatatttgatctaatggtaaagaattcgtaagattagaggcctgcctggaaacattgaaaaaaattataagtgtaaaaactttacacttgtattttcaagtgccccaagaaaataatccttgtgatctttccagctgtattgtaaatacacctcgatttttttttcttgtttgggtaaacgctacccctgaaaactcagcactgtcatgaactgatgaattgaacaacatgctgcatctgggcatgttggtatacacaccattatccatgttagagtactatattgcagaacacattcatatcaaagtaatatattgcaaactacatgcatgtcaaaataataacgtggaatactagcagttttcctttcggtatatatgacaagaattgagcaccaaattctaaactcctgccgaatacataggagaagaaagaaacacaacggtttaactattataaggatgacaagttctcttgtagtttgtgtcacttggccatttgttcaataattgttctagcaagactattttcatgttatgaactattataaggatgacaagttctcttgtagtttgtgttgcttggccatttgttcaaccagtacaacatgctttcctcattacaaaatggccatgtgttgcagatgtgaaatcttcatatattcattgtgtaggatcgtaaagggcatttcccaccccaaaaactagacattgaggtgaggggctccccacttatatcttaggtcatttgcccttttacaaccaaaagctagccattgaggtgaggggctcccccacttatatcttaggtcctttgccctttcacaaccaatatcggactattcaacagtctcccccttcacacattggtgtccctcagcccttcaccgccccttcaccgtatacgggccccacacccacggtccatcaggtatacggactccgcaggcacccacggtccatcaggccttcacacactgtgtccatcgggccagagatgttaacctagccaggctctgatactaattgtaggatcgtaaagagcatttcccaccccaaaagctagccattgaggtgaggggctccccccacttatatcttaggtcctttgcccttccacaaccaatgtgagactattcaacacattgcagcgcacccacgaactgttaacctgcaaattttagtgttaaaagtgaatgaaagtcgggcaaaaaaatatgaactgcaaaggaagcagaaagcagaaagttacaatcatccagtcaggctacaagcgattagcattttaatttttcaacaactcatgaaggaccaagatccaattagcaatatttgatatgtactataaataaatatctcatattaaggagcctaaatttgagcattagctcagttttagcataggcaatgttagcatcacagggttgtcatcacatgccgcctatctctacgactcatggagtcctagcctctagcctaacaccgtgtctatgctatttattactacctttatcttgctatgaactaaaactaaggtactctatctaagcagagcgatgcacacacaacaatgagaatatatcttacttaaataaaaaaataacaactaaaggagatcatgaatacacttataaaagaagcattcgtcgaggtacaagatcggagagagtgacaacatctccggaactcccctcactcaattcctactctactagagcaatgcctaagtatctacatatgtgaaagcaacaagctctctccaacaaggatgagccacgtcacctgaataacaatagccctaggatgatagtgggaagaaaagtggaccgttagatcatcgggataatacaccaatcagctatcaggatagttccagatgaaaggtcatataacagtgttagtcaaagtagcttagtcaaacaaatatttaaaaaaaccatccggaagatagcagaaaaaggcagggataaaaaaccatcgagattctctcatataaaaatgagaagaagactacccaaattaaatctacttatagtttatcattaaattattatatgatttatatattgcacaactttttcactgaagaaaactctctggtttacacaactcttacatctgatcggagggcaacaaaaacctaactaccaactaaggtacaataaccttctaaagtcttaaacttaacacattataacagaaaaaggcaaggataaaaaaccatcgagattctctcatataaaaatgagaagaagactatccaaattaaatctacttatagtttatcattaaattattatatgatttatatattgcacaactttttcactgaagaaaactctctggtttacataactcttacatctgatcggagggcaacaaaaacctaactaccaactaaggtacaataaccttctaaatttttaaacttaacacattataatgcgtcaaaccttttataatttgaaaataaaaggatggtttgaatataatatgttcattattcctctgcaactcaaatcaatattttgaatggtgccactttctatcactaatacttttggttagtatgaatcatgaataccatgcatatgttcttctactaaggtaagtgccacgtttacatgccaaatttctttatggacaaattatagatcttttatagtaattgtattataaatttgtacaaggagtagtaaaagtataacagctaaaatatagaacacattatgtaaaactttaggaccatcaatatgtgttgttagacttcttaaagcatttaatcaccagcataattttgaaataaatcataaagcatttaatctactgaacataaatcttatgttcaatctattctataactaggtggtgtttttggaatatatgaagcacaggttctacctcctagcaacaactatcaaactattatacctcttgtcaggtgatatattattaataaactatttactttcattcttttatttcataatgttcagcacttatactttacgaatttatggaagacaaattccatctcattgcccacaattatcaaactattatacttctatccaactaacataatatggaaatgaaataaaatatttgactgctatccttctaaatcatacactttagtatggacattatgtctatatttttataaattacacctatcattgcacgactactcaacctttctatatatgtactattcatatatttaaattatcatcagatatttctttcagctttaccattttaataatcaatctatttacatgtatacaggtgcaacaatatgctccagtaacaagttcttcatatgaacgaagaaatattaccaatcaacttatgatagactttagcaagctatatataccttaatattttgttatgaacactactgttagtacatgtcttccaaattatattatacatggttgtccaactacaaatgcataatgatgggacatcaagtttatatatattcacaatctgcagttcatacaatgatttcaggcttataattacttcaggcacatatttgttttgatggtctgctggtgctgggtgtgtgtattaattattattacctgatgcgtgtatattgctgacctacaggattaaaatttgcgtggactacaaaggcagttcatcttaaccgcttatctctatagtgtatcatgctcacttgcagaggtgcttccatgaggagcataatacttcaacatattaatgatttcaggctttgacaattgctcttcctgttgctacacacttcaacagtgttttaatatggtcaatggtcatggctatgctactgttcggagtcacctatgtgattctaaggtttcataaagtttcataaattatttgtgattcaaggcaacaaagtatcattgtcattaacagaaactcaacttatcgtttcatcttgcagaacatcgtcatcttacaagggctataagcatcaggaatcttctaaacatgattggtttgggcaaatgaaaaatacaaaattggactcagaggtattgcctccaaatagttgttactacttggactcagaggtattgcctccaaatagttgttactacttttaactagctatacaagaccaagttttgatgtcttctaagctttcctgtatatatgttactgttgtgcttgttagggaatcttggaaaactaaactctatagttatgcctaggggaaaacagcgtgggggcggggcctctttagacccctacccctaatataccattatagcccccataatacacctaaaattctaatccatatgtttatagatgaggggctaatatagactttgtttgaggttgttagaaggcctaaaaggctaaggcccaaaaaaatcctaatccaaccctaaatgtctcttagttactcttggtaattttggtttaacccccgctaatcctaacccaaccttaaatgtctcttaattactcttgttaattttggtttaaaccccgctataatttttatgctggctccgccactggttatgcccaaatgcttgtagtgcctaatcagcttagatggccctatacttgatcttgaacatctacactttttcagacaaccaattttactatttgttttgctttttaatagttgacatagttagccggtaagcaatccatccatgatcccagagtgctttatcttttcccatgctgtcattctcgatttattctactgccagctgccatttgacatgttattgctttatcttttcccatgctgtcatcctcaatttattctactgccaactgcccttcgacatgttattggtggtgcacttgctatagcattacattggtgatgaagtgatgaaccagggggttaaaatccaagttgtgatgtggcgatgaatcaacgatgagaattggacaagaacccaagcagacaagtaagatatgaaagtgatgcaagtaattatgatagcaatcatgtccgatcaggcttctcaatataatccttttaggaaagggatgagattggcagcattttttttactcttttgattgagattttgctaccacaaacaacaattcctaatattgaattgtgccaccacatgcattggatggttctaaaggaatatttggccatgtttttttaggaaaagagaaatattgttctaaatggattatattgtattaactccatctaagaatataagagattttgcccatgtcatttgaataaccatgggataatagatctggcattaaggaatttatccttaaatttatctccatgatattctcatgaacttctgcatcttgcctcacaaaatgaggttgtaatagacatctctcaattgttttttaatctttatggcgtgttgaaataaatgaattggaaaccatggaagtgaaaatgaaactcaatttatgtttctgtttaatttcacgtggctctcgagaatatattttgacacaattgagaaattttgcattgaaagaatgtaaattgtgaaaacgtgcattgcacgtgcacgattactagttatataaatatgaatgggcagtaacaaggtcatttcaatgcctactcttactaacaggttatgcaagcactcagagtcatgcgaagcgcgactaggtggctagtataagtgagttgtactctacttgttggtgcaaaatggaagagaggagtggacgagctatttatagcgttagatgacttgagagagtggatgttcttaagggaatattctcctccaactcctttcaagcctccatatgtcctccaaccatcattagatgttggtttcttgccttgggaactgtgccaccgtcgtcgccacatggaagctgggcgcgaggggagccacccctggttcggccaaaccttggccaagctatctcgcaccaccttcacatgggtcactgcccggtgggccctcatgacggtacacagtggttggcctcaaatatgttgattttactctggtttgtgcccccccccaaaaaaaaaaaatccattaactcgtatctgattgtctggaggtgtattttgtcgcatgttgggtgtgttttctcaataattcacctgcatacgaatattcaccaagacttgtagaaatggttagtaataaccacaacctctaagtttggtaggtattccatttttattttctttcatttgcttttatgcatgaagtgacggtcaaatttggtatttaaggaccgtcaacaaggcgctcctcagctatgttatttgttgttgccatgtctttgcccttgaggttgacatggttggatgtactagaggtaaagcctatccttcaacatattgacatgttacactaagttaatatatgtcataaaataagtattttaagatcaaaatatcaaatagagaaaaaggtatgtcctaccttcatacaattgatccaagcactcaaacaatgggaaacttttgttctcatgcctcttcaacttctgatcttcctatatatttatagaagggtcaagattactgatgcacaagattaaattctgaattcaaaataagtacaatctagcctcgatgatcgcttcccatttttcaaatgtggttttaatcatcgacacattttggtcccaagaaaagccaccacgactttgaatggatttaattgctttgaagtctttcttcggttgggtttatttgtcctgtatttgagcctctcggtaaatttagcttcttggaataacttgttgaaatccatcactattttattcaagccctctatacaccaactattttgccctcgataatgagagacgttgtactccataagtagatccaccaatgcattctcatatttcaatgttcaccttgctctttgagccatctgatctataacagatcacaagaaatgttgaacgaagatattgttcatgatataataacatattcaaataatctagaacatcaacacattcaaaataattcaaaacatcaagatatattcaaataatgtggaacatatccaaacatgtttgctttattacaaataataaaaagttcaacatgaaaagaaaatcacactacgcttgagatgttcaagtgttatgagaattcaagaagctcttctttgcaccctacgctctctcattcttcggtggtcagcccacatattctttgcaatcttgtcccttagcttatttcccaagtgtctttgactattcattggtgctacatcatctccatataagtccactcatgtactggaacaagtttcttctgaactaaccacttatcatcacctttttggctcctgattatgttatggaggactattgcaactgcaaggattatcacttgggttgcgattggataaaatgttgcaacttctaggattggaaatcacatcttcaggattccaataacacgctctatgtggttgcgtaacttgaggccggagttgaaggctgagtggattgagctcgatatttacccccaaaaaatgtgacatctctagcccacattaccttttcgtcggaatgggccgaaaacgcctggaaatataataggttacggcccatccaagcagcgttttgagtttatccttggaaaaaaattatgggcctgtaacttataccggttttgggccaaatacaggccttccaagcaggcccttggagtaagacatttttttaggactagtaatgcacgtgcaaggcacgtttttacaatgtatattttaaaaagtaaaagtatggggaaaaacagtgccatattcatacacttaactccagaaacatgacacactgaattcagatacattccatgtagttcataaaaaaaagatacattccatgttcaaccttaaatggtaataggagtatattccatgttcagacactaaacccacacaaatcttacatcgactggtgaatttctaaacttccagtacttgagctataagaaattcataacattaattagctcacagcaaattaaaacattgaacaatatttagatgtttgtcgaagttcagattcttaattcagatactcctacatcataaggacaagtcgaaaactaatatgccaaatgctcagaaaataatataagaaatgttcaaacactaacctggcaaatgttcgacatctatagtgcacacgtttgaggtatatataaagaatttgtcatcagcacgacagaaaattagaactttttttttggaggacacaacatgagatgtgattgacaattttttgctcccaggaaatttgtactgaaattgttaaaaataaaagtgttccacatttctaaaggctgtcaggaattattaactcagtacataaccaatagttcacagggaaactatgcatgtttatgttgaatagaaacaatacattacactacacaggatgccatataatgcgaggccaatttcagaatgttgtcaaccaagttcttgagcaatgcaagcccaagttcagaccatgtaaaactaaattcaaattcatatataaagttgtatggcacacaaagaccataaagcctcctgattttggttggagcaacaacaaacatggttgggtagagttcagcgagcagacaaaatgaacttgttacagtaatcgcttcagtaaaatgttcaggttggggttatagcacattttgtgcttcaaaataaaatatattttttatctttaacaaaagttcatctgtttggagaatatatttgtccttggatctacccaaaacaaaatttgaagcattaggacaaaatcaccaaaacttgtcaaatcaccagcagctgctagctaggagcatataagccttggtaatgaaaaagtaaacactcaaattcctagcccagaaaaaggaagaagttattcctattcagaatcagagttgttccatgcctttacccttgcatacactaagctgagtttctctaataagtttatagtacacaaaaatatatgcatgtacccttatctgaccagtgaccaataagtagtaaccatagtaaaaatagtaaaaacttaaagcaaagaaataattctgcatatattaatattacctttttgttgtgcctatggagtatattaattcatatatatcaaccaaaggccaatcaatgaaaaataaaataacaaaatccccttgaccttcctcatagagcatcttaaagccaaaagccatctgacaagggcctataaaaatgccttccatcctgttcacctatcttcagcatatctgtataagcttgtatcatggccgttttatagtatgcctagctaaagaaatcaaatggtggattgcagtatcacattaaatcagaaattaagatttgctttttattaggctaagaaaaataaaatataaacatttcatgttcccaggaataatcaatgaaaccaacttttcaacttcaaccgcatccttgagtagcaaaaatgttgtatcctccatttttgtgcaaattagctttctttgccagaggtaaaaaagaatggtttgttataacaaggaaaattgaaccaaatgggagaaagaattaaaaccggcaaatacccattatactgatcagctgcacactggctcttgcctagcacccgtccggccagccaccgcctgatgcatcaccgtctaaccagtcatgcattgatctaaattagacaacagaaaaaaggaaggtaacacacatgaactgctatatcacagagtactcaggttagataatcactttgtgaatgactgaacatatatataatttattcatggatgaaggctcacaataatctgtgctcaagaactaaagtactaaacaaatgaatctatgaattctcaaaagtgagtcgatccccttaatctgatcgaacttgaacaattctcaaacctgtacaataaaatttctgtataaaataatctggaagagattcagcatggcaactacaagtctacaatgttagtctgtatggagcaacaccaatcaccttgataggatatagcctgcaatgatgcacatatggatcgataagaaccgaatcacaccattaagaggagagatttaatatatgtgcatacccttcagctgaataagaaaatccacacagaagactaatggggattcagaagagtcaatttgagtgtctcactcgatctcaggagcagaagaaattttgacttacagctagaagtacctgcggtctactatgcccctcgtgtcagcggcaagaccggaggtgcgaccgaaggctggaccagcggagagcaatggagcagcggcgctggcggaaggctggaccaccggtcagcgacggggctgtggcaccaacgaaaccctagaccagcgggcccgattgcggtggcgacgacggagccgccccggaggcagcgacacctacggagccctcggccgctggtgcgctgattgcaacggcgtggggctacctggcttataaaggagggaacgcgaacctcggcgctagtccggcggtgcagtggtgcgtcctcgctgttccgttgcgaggatgagggaggtccggcattgcgatggtgcatcgtcgctggcctggcggtgcgggacgcgtcggccctggcccggcggtccgtcgtcgctgggccgtcgcgaggagaggatgagggaggatgcgcgcggggagcgaggcacggagagagtaggcagagtcatcgcggtggggattttcacggcggagtcagcgcgtgggggcaaaatcgccggtgggttttgcgtggaggagatagagctacggtgtacagcggacggatgagattagatgagacgtggatgaacggtaaagattgattcggatgatttcacctgtaggattgcaaggagacaactcctgctttttatattagtatagaaatatggtatgcatgggtgattacctgcagatgaagatcctttaccataaatacaaagtattgtgtgtatggtaaaatgattttttaagtgcaaaatgagtcttatgctttagtgttttgcatcaaaattatatttgaacggccgagattacccacaatgccacacccgctatatctatttggatctcgtttccactcaagtacaagaacaagcggttgacatgttgaactccacaaatgaattttgtggtccattgatgtggaagagcacgtattgatgtgtccccgttggcaagtgcatatatggtagaactctgaaattgatcaaaagatatagtagttctaaaaatatagcaacctaatataatatagaagaaatatgagtaccatgagccgtcatgtactaaattttatattttaggatgaaaggggttataattcataatagtactgtaggagcacagacgttgttgaccgatgttcagcaagttacctacctctccaccgaattagccaactctgtcttctaccaaattatttgatgcttatatcagtggtatatttatgtcccagttacaactcctttaactcctacccataggtttggatgagggcagttcatagttcatacatgtcttgcaatatgggcctcatctggtcaaacagtagatgggcctcatacgtgtcttgcaatatgggcctcatctaggatggacgcgctgcacaaggaaacaaacacggccctccgacaggtgagcgtccggcactccggcccacgagaagtgctgaaatgatcgcgctacgcttccttgatacgcgcggtccgtgcgcgtgcggtgttgcggtttggcagaaaatattttgtgccacgaacggaggagcctatccctgcagaccaatgcgcaggtaaaaacgttcgatgggcgagcccgagtttgtcgatcaatgaaaaaagcacgataggtttgacccaaattaataacgccataggtgtaaaattaaattaatgatatggtttgaccttcggtttcgatttgcatgtagatttcttctctggattagcaactgggttttagcacaatcgattgacctgtcgatgatcccccgggtaatcaggggtcctggggctttgggcctgtgtgtgtccgtgctcctgctccaagcgtactacgtccaaaacctaagcactcccggaagacaaggaggaagtaactcgagatgtcccgagcttatatatcgtagctagctagtggtgtttgacgaaccgtccatcgatcgtggctgcgtctgtatttgtaaactgcagggtacgcgtcatatactcttacctagctagttactccagttattagtcccaccaactagaccaagttcggcagttcgctcgtttataattgttgagctggtactattaggcgcggagagaacaaaataattgcaatgtcgtttatcttaagtttacaatatatgtactcttatactggttaatggaacgttggctatacttaactagtactcctccattagaggacaaatggccatgctggtcaccattttagtagttgtacgtgctgtggtaggtactccaggttatttagcagctacggctaccagagtagagatcgaccaggcgctgctacagtaacgacaaaattaagcacgaaataaggaaaaagataagctactttactaggaacaacgaagatctctagactgcacgaggcgcctcaccttcactagtgtagtcactactatactctgatcgcaagacctgccctctgttaatgcgcgcattgctttgtgctcaacgacgcacctcgcctcaagctaagttagcactccatcaaatcacgcaacgaggttacgattttcacggatactgtgcaggagcggaacgctggaacgagacgaacgggaagtgcaagaaaaataattcagaaaaaacgcaacagtgcagttctatagtactactactactactactactgctgctgctgctgctgctgctgctgctgcagaagtagacttgtagtgggctgccactttaagttttgtagagcccaacccatccccacatcgccgcaccacgcttcctcctcggcggccgcgccgaatgagcggtcggtcgcggcactgatcggcgacaaatatttcgcaccgttttggggggccgaatcatgggcaccgcatcatgatccaccatgaatagaatcgcctcgtctcccggctgcccgctgttccagcttgctcgcttccacagcccccccacacacaccgacctgccaatttacgcatcatggatgtcccgcttcgatcgagcgagcgagcgaaggtggcgaccacgacgctgccagtacagtgcgaatatacgcgagtgcgcggttcacagggtcaggagttcactgtgtgccgcgcgggtgcgacacagcgacatcgtgatcccagaatccggggtttgctcgatcgtgggtccgattgctcgtgaggctggcccggctgtttgtttgttgttgcgcgcacggtcgtaaccccatgcttgcgcagcacttcacgtccggttttttcttcttttttttttgccgtcgcgtgggttaaattaaacaaagacgttgcttagctttggctgggatgagaaccgcagccggagcgtgaggagaaagttttctccaacttttctctctctctcttttttttttttacagcacggacgatctgcgtgccgtgctggattgctggtagcgcggtataggacaagacagaaaaaaacgcctacggtaccgtgcttctcctacccaagcccaccggcaaaaaatccggttcaccagtgccgtgcactagtttaccatgtttgatgtactgtagctgaccggtggaacccacttccagaacaggcgctactagtgttttgctccgcgttcttccatgatacggaaagctgcgtagtttatcctttgcatctactgtactgcagatattgcacggttttcctgaaatcgcagaatcacagtagtgcagtacgcgggccctatatgtcagtgttaaaaacggttttaggaagggttgatatgattatcagtccagctcttaattgcagacattgctaaactctacattcagcgtactacttccccttccctcgatggaaaaatctctccatatacacttgttatccttttggctggttagttggtgtggatcagccgccgtagatttccccaaaagacattgttaagctaggcatttaaaattgatgcactcctctttaagcatgtgtgaggccaggcactcgtgaattttatacgtacatagcgacacatgtgcatgttcgtagtcgtagtagctatcttttctattgccatacgatcgcaccgattggaactatctgatgagggcatatgtaacggtaaaagctacactatcatataagcgacactagatttttctcaatttattgccgagaggttagtcgcttccactttagctcacctcattttttttttctgaaccacatttttccgtgttattggcgcgcgctctctctctcttcatcgtaaaaaactacttgtagtcaatgcctacaaggtttccttcaatcacccgaatggatttctctcagtattcttagtcgattcctaatacttaagtatagctacgagctaaataatcatcggtgcataaccttaattttaaaggtgtacccatatgatggtagctttaaacctaaaagtaaccattgatgatggattctatgtccgtttgccatagaggctagagaagagggagagagagcaaaatcaatgttagcacaagcattgacctatgccaccatgtaaggttccacgttagaaagttgttgtgagcctatgacaagcattttttctttggccatggagtcgatataagaagtagagacatgcatttatttatttgttttttcttgaaaaatcaaggctttgatattctctagctccatggctccattaaagagccaccgctcatcatataataatctagcatcgggttgtctaaaaagtctaaaacttaagctttttggaatataaagagtgaatagcagttttaattttggaccaccatttgtctcaacttttcactttggaccaggtaatttatttttgtcctaatatagaccatcccatatatattttttagcacatcaatgaccccaagcacattaatttcatacttccagtgcgccagtaaactccattactcatgcgcaagccatatctttactggaggagtggtttgacaaggctagataatagagttggcgtggtccaaaggaaaaaaaaatgtaacattaactaatccaagtgaaaacaacagttaaagatatggtctaaagtgaattttagctatataggtcgcccaaactgtaattctcaaaaattagaataaaatcccacaagatttattttacaaataaaagtcgtacattaatcagaatagattggataaattggggtgtagtgggtttggataaagtgtaaactttgataacatatgaagttgaggttaaattatctggtataaatccagtgctgtaatgtactagggggggggggggctcacttctccccttcctcctccccttcttttcctactacagtataccaaaaaaaatttaaaaaaaacaaaaagttagaaaatttatctataaaaaatttgaattcaaatttaaatttgaatcgggtatgtaaacttttgacttataaactttgtgtctataaactttagatgtatagaaatactatatatagaaaatatttgaattcaaattcaattttgaatcggatataattcaaatttgaatcgggtatataaactttagatgtatagaaatactatatatgaaaaatatttgaattcaaattcaaatttgaatcggatataattcaaattcaaatttgaatcggatatataaactttaggtgtatagaaatactatatataaaaaaacaattgaatttaaattcaaatttgaatcggatatataaacttttggtctgaggtgtataaactttagttgtataaatgtaataaaataggaaaataacgcggtgtcaaaaaaagtaaggtagagggagggggaggcctacccgatcgctctgggctagcatttccggtactacagtgcatttctcgtttccctgtacagctcattcttccattcagtaaggtggtgacaggcaatactgggccacaatcatcctcgggccttcactaaatcctcctacatgtacacaaatatgagtttgtttttgtacatccctgtaccaccaatgattcggtgaacccgtgccccatgcgttgtttctgtaccacgcgagaaaccgatgttggctcagctactcacctctctctttctcacttttgatgaaagtgtgaaacacacacaaagagatgatgaactgacggagaatgaaaatgaacacttgtatttcacgctgcaaaccagcgcgcacaacataaacacttgggggctgttcactttgatgaaaaaaaaaccttattaaattttggtattattaaaattttggtatagttgccaaaattttcgcaacttaccaaaattttggtatgatttcttatatagttgtcaaattttggcaacaaactaaatatagcaactttttgataattttatcaaaatttggtaagattgaaaataacatcacagtgaacaggctcttgtatttcacttttggcaccacaccacatacaccaccactccgtcctgttcggctgcacgacccggccaagacggtctgcaaccatgtcttcaccctcatgcgaggcaaatattactgcatgaagagctccactaactgacgcgcatacaggcaagattttctccaattaatcctgcttgactgctcttatctgatgaccacgcacaacacctgctagttgatccactcttcacgccatgcatccgtgcttcacttggccacagtgtcaagccaacgtgcacctacgggctgccggcatgcactctaatcaaactaacttatgcacacacgtacactacggaataactcacacagtaaacaacaagattaagtctaacaaccgaaacagaaagaacacgcccatatatcccacgccgcccaccgaaactcggacacccactccgccaccgccaccgcctcatccatggcactggctggctccatggccgccgccgccgccacctccacccttctcctcctcctcctcctcctcctcctcgccaccgccacccatggcgccgcggccgacacagtctcgtcccccgcctcccctgaagcggccgcactcctcaacctctccgccgcgctcggtgatccctcgggctacctctccacgcactggacgcacgacaccgcgttctgctcgtggccgcgcctctcctgcgacgccgacggctcccgcgtcctctcgctcgacctctccggcctcaacctctccggcccgatccccgccgcggcgctctcctccctctcgcacctccagtcactcaacctctccaacaacatcctcaactccaccttcccggagggcctcatcgccagcctcaagaaccttcgcgttctcgatttctacaacaacaacctcaccggcgctctcccggccgcgctccccaacctcaccaaccttgttcacctccacctcggcggcaatttcttcttcggcagcatccccaggtcgtacgggcagtggagccggatcaagtacctggctctctccggcaatgagctcaccggggagataccgccggagctcggcaacctgacgacgctcagggaactgtacctcggctacttcaacagcttcaccggcgggataccgccggagctcgggaggctgaaggagctcgtgcggctcgacatggcgaactgcgggatctccggtgtggtcccgccggaggtggcgaacctgacgtcgctcgacactctgtttcttcagatcaacgctctctccgggcggctgccgccggagattggcgcaatgggggcgctgaaatcgctcgacctgtcgaacaacctgttcgtcggggagatccccgcgagcttcgcgtcgctcaagaacctgacgctgctgaacctcttccggaatcgcctcgccggcgagattcccgagtttgtcggcgacctgccgaacctcgaggtgctgcagctgtgggagaacaacttcaccggtggagtgccggctcagctcggcgtggcagccaccaggctgaggatcgtcgatgtgagcacgaacaggctaaccggcgttctaccaacagagctctgcgccggcaagcggctggagacgttcattgcgctggggaactcactgttcggcagcattcccgacgggctcgccgggtgcccgtcgttgacgaggcttcgtcttggagagaattatctgaacgggacgataccggcgaagatgtttacattgcagaacctgacgcagatcgagctgcacgataatttgctctccggcgagctccggctggacgccggcgtggtgtcaccatcaataggagagctgagcttgtataacaatcggttgtccggtccggtgccggtggggatcggtggtctcgtcgggctgcagaagttgctggtcgccgggaaccggttgtccggcgaactccctcgtgagattgggaagctgcaacagctttcaaaggcggacttatctgggaacctgatctccggggagatacctccggcgatcgccggatgccggctgctcaccttcctcgacctctctggcaacaggctctccggcagaatcccgccggcgctcgccgggctacgaatcctcaactatctcaatctgtcccacaacgcgctcgacggggagattccacctgctatcgccggaatgcagagcctaacagccgtcgacttctccgacaacaatctctccggcgaggtcccggcgaccggccagttcgcctacttcaacgccacgtcgttcgccggtaacccaggcctctgcggcgccttcctctccccgtgccgctcccacggcgtcgccacgacgtcgaccttcggctccctctcgtcggcgtcgaagctgctcctcgtgctcggcctcctcgcgctgtccatcgtgttcgccggcgcggcggtgctgaaggcgcggtcgctgaagcggtccgccgaggcgcgcgcgtggcggctcacggcgttccagcgcctcgacttcgccgtggacgacgtgctggactgcctcaaggaggagaacgtgatcggcaagggcgggtcagggatcgtgtacaagggcgcgatgcccggcggcgcggtggtggccgtgaagcggctcccggccatggggcgctccggcgcggcgcacgacgactacggcttctcggcggagatacagacgctggggcgcatccggcaccgacacatcgtgcgcctgctcgggttcgccgccaaccgggagacgaacctgctggtgtacgagtacatgccgaacggcagcctcggcgaggtgctccacggcaagaagggcggccacctgcagtgggcgacgcggtacaagatcgccgtggaggccgccaagggcctctgctacctgcaccacgactgctcgccgccgatcctgcaccgcgacgtcaagtccaacaacatcctcctcgacgccgagttcgaggcgcacgtcgccgacttcggcctcgccaagttcctccgcggcaatgccggtggctccgagtgcatgtccgcgatcgccggctcctacggctacattgctcccggtatgtatgagtgtaccccctctgccccctacaaattttcagctcattctgttgactgtacccggttgctactagtactactatccaccatcatttccagtgttgaaaaaatcatgcatcacaaagtgcagaaaaggcccaaaattgctagtactagtcctgtcctgctcatggcaaatgttacaatggggccttcatatttttcaaactcactatcacattgaaatttggaagaaaatggttggttttggtatgctctgatttgttttttactgtgcccccacactatcgagttgtacatatgctggatgttgtgcctctcgtcactttgtcgttttaatgaatcatcattgggaattgatggcctgcgatcttatgtggtctgagctgtgtgtttgccctgtgcatccgcagagtacgcctacacgctcaaggtggacgagaagagcgacgtgtacagcttcggggtagtgctactggagctcatcgctgggcggaagccggtgggagagttcggcgacggcgtggacatcgtgcactgggtgcggatggtgaccgggtcgagcaaggagggcgtcacgaagatcgccgacccacggctctcgacggtgcccctccacgagctgacgcacgtcttctacgtcgccatgctgtgcgtcgccgagcagagcgtcgagcggccgacgatgcgggaggtcgtgcagatcttgaccgacctgcccggtacggcggcggcgacggccatggacgcgccgtcgcacgggtcggggaaagagcaagaccggagcgcggagatgcagcagcaggacgggtcacgcgagtccccgccacagcaggatctccttagcatctagaagcgtgcgtgcatgtccccgttgtaccggtactccgtagcatcatcccctgtacgtcttggcgtactcctggactgtgctggtgtcctggactgtgctggtgtccgggtccgagtccaagtagaggcaaatctccaatatttgcggtagtattgttagctagattaagattatattgttacataatggtggttgataaaatctactactagtagtatgtaatctgtctcctctcgtgtacaaagcaactactcctactccagtccagtatatgcctctccaaccaattggattgagatcgtatcgatctcgcaacaaaaaaaacacggacacacatggcctattggccagtgcgtcatactgtcatccctggccgctactggaagcactggtcaatactactagtacacccgtatggtgctgtccctacccctgctaaaaaatgtcgcaatacagatcacccgtggagacgtacgtacctttggtcgctgctgtatccccagcgtgctgtgccgatgggcgacatgcacacgcaggcactcccagctcgtcgtcgtggttcgggttgggaaggggataggacacgcacggttttgctcctgccgcgcggtgctcaggcgttcctggctccagcagcaagcagcaagcgcggggcgcgcggagacgtagtacgggcagagcggcgactggggagtgcgtgcacgtgagtggtcaattccatcgcggtagtacactgatgcactgccatgctcctctcgcctgaagatggcaggcggggcagcgagccggccaggacaatgcatgcacggcgccattgcccaccaccttgctgtcatcacccaagcaaagctttttgtgacagtgtaagtggttcgtttgattttggagccctgccatgccttcggcactgtgccgcgcatcataggatatgctgcagattgctgcggcctaatgatactgttggagctagcgttcacgcagggatgaatgagaatcgatcgagagctcccatgctcattttagtaccttctgataaaaaaagcgtgcgtggtggaagtgggactgatcagagtgcggtttggcgtgggcgatggacttggcttcgctggctgtgactactgactcaacacgtagtcgggagctttcgctgcatgcagagattggcgaggctgctgtgatggccgtgaccgcgaggcgcgagagtgcgcgctgccgctgttgctatcctgcggggattggggagagatgtccgtgctgtgtgagggtgtatggtcagatcatttgtcaattgtcacaggtcacaccacggttgtaatcggcgaagccactaggagaatcttctcgatcattttgtcgtggaaatctgagcatctatcggctcatcccttttgatccactgttcattatcttttctcgactatgatgtacatccctcgtttttcaatatagagtactctctctgcctcattataagtttatttttgctagtactatttattctaaagaaaattcatatttaaaataattattgtataggagtttataaagtagaaaataattactccctccgccctaaaatatagttatctttttggagttcaaattttatcccataatacttgccacttgttagtattatctgtcacatcagttatctccaattcaaattttcacccattctgtccccaccaaatctcttgtttctattcaaataagaggtaatatattctttacttttcaaatcttaatttgtgctaaacgacctagaaagacaagtattatgagacggaggaagtacattgagagtagataaattagggaataattatattgagatttatgggttctagtccttttattttttgttggtacgggtgggatgggtgaaaaatgaatttatcttgggacgaaggagtatctgtaagattttcttttcaaatatagttatctctaacatttaaattatacttctaagtttactatgttcatctgaaaaaattatcccaaaatatatcgattcctaccttcatatttactctcggtccacgaatcaagatgttttatcccttaataaataaatagttcttactcgattataactaaccaccaataccattttttattaataacgggtactatatatttttctcaccactaaatcttaatttgactcgggatgtttcatcgggatactttacacgaaaagatacgacaatcctctcgctagaaaaagactgcgtaatctgatttaaagacaaactttttcacctatgtctcatatttaacatcattgagttctatttagaaaatagaatataattgtataaatataaaaactatctaagaggagagggtatcaaattttaagttatagatatccacatgtcacaatcttcatgccaacttgaaatgcatcccggtggaactcacggctagccgttgtatattccatcgagattagttgtgtacactagactaaggacatgtcatttaattattattattattattattattattattattattattattattattattattattattattattattattattattattattattacattttgcaaatcatgccatatatacttatcctaccagttcatggcatactctcgtgtcatgccacactttgcttagagaggagtatttttacccggcatctacatccaatcgaatatatgcagttttacataattttaaatgattgttcatttaaaatttctataggattgttcattctaaaggaatttagaatgataggatatgattaatcatatccttatttgtttcaaaaaccttcgtagaaataattttataagattaaaattcttacgtttttcttacaaatcagattgacctaggagtaagtgtttgcaaaccaaggatgtacgtatatactagcaaagtggcaaaattatcaaagcttatgcaacgcaaaggtctactcgtacccgtggacgtatgcccagcccggagagtccatgcatgtaagacgatgtgatatgggatcaacatgcatgtatgcaatgagtcgtcggctcgccaagttaattatcatcacatggggagaaggggcaaacatgcacgtacgggtaaagggtgaaaaggaccgtgatggcgatgagattcttgtagtcctgacgcggaagagaagcggcaaggaaaagatgaatggatcgatggaccggaccggacgggggcttgtgcctgtggcgctagctagccgcatcgcgtggctttgccatctgtgtgtgttctcccctcgtgtagtcgagtcgtttcgctgtctgccagccctagctagctaggcagcgcgtacgacgacgccgtgaccgtgaataggcgtgaagcaccgcagcacagcacctgaggcgaacggtacagctagctagcgttggagtaagagtatcctaaattcgtccgtgtctaggactttggcgtgttagacgtacgggtcaaatacaaatatagtgataagatatatatcttagggatataattctagagataaatattctagagataaatctactcttacttgtattatgcttcaagtctctatcctttatatactcctatatatacccatgagaggtcgacgtaatagattagaaaataatataaaataacaattagatttttctacatggcgtacgtttacgcatgcatagtactctatctgtcaaaaaaaaatcaacttctggagttagaattttgttccaaaaaaatcaacttcttctatcctactgactttcagcacattaaacgagaaattttataccttaaataccctctacctatctatcaccaatactactactttctttaataatgaggaacactttttttaataatgaggaacactttcctttatactctctacctatctatcaccaatactactacttttttttaataatgagaaatactttttttaataatgaggaacactttgggtatttttactcctcgctaattttacattgggatgctaggattcgtctttttttagaacggagagggagtatattctaaccgaaactcctaatgggctatcgatcgcccctagtcacccccctcctccacgtggttttcttttctggcaccgcattactttcctattttagtaaatttatgcacctaaagtttatacacctcaagtttatacatctaaagtttagagacccaaagtttataaatcaaaagtttatatgtccgattcaaatttaaatttgaattcaaatattttttatatatagtatttctatacatctaaagtttatacacctaaagtttatagacccaaagtttatatacccgattcaaatttgaatttgaattatatcggattcaaatttgaatttgaattcaaatatttttatatatagtatttctatacatctaaagtttatacacctaaagtttatagacccaaagtttataagtcaaaagtttacatacccgattcaaatttgaatttgaattcaaatatttttatatatagtatttctatacatctaaagtttatacacctaaagtttataagtcaaaagtttacatacccgattcaattttgaatttgaattcaaatattagtttataaacccaaagtttataactcaaaagtttacatacccgattcaattttgaatttgaattcaaatattagtttatagacccaaagtttataagtcaagagtttacatacccatttcaaatttgaatttgaattcaaatattttttttatatatagtatttctatacataaatttttcaactttgcttttttattttttaaaaatttatggtgtagtaggaagagatgaaggagaggaggaaggaagagagtagcgtatagggggatggggggtgatcgcccggagcagtcacccgcccattagccacaccctattctaacaccatatgcgtacgtttacaagatgatgtataattacttcatcttgaggaagtatcaaagttgtggtggagtggattatttcacttaaaagggttaaaattctgatatccacgtgcccataatgttaaaaaattgaagtttagtacacgataagaatttactcgtggtggtctcttgatcatgtattaagtattaaggtggtattttcatgaacgtgtatatatgtataggtctttaattaatgtaacaaaaacgaactacacgaatattcttcttatgtttttgtatataggatttaagggccctgattcaaatgattgaagcttttcaaatcctatgaaattcctatggaatggcacattgcatgtggattttaaaggaaatttagcaagaggtctaacttcttgaaaaatttcctttgagtctacctctttcatccgattcctgcgtttttcatgcgctccaatcaaatgaccatttctatgtttttcctgtgttttgcaatcctctgttttacacttcaattcctgtcagaatccttttgttttactattcctccgttttttctaacctgcgattcaaaggggtcctaaatggttctatgaagtgggtccccatgttcgaaaagttaccgattctttgggaaagctggcgagaccaagccgttacggccccatggggccgttcctggcgaatgttaagctccctggctaaatttaacacgtcccatcccatcaccacacattgcatgaggctgttttcttgagagctcacctgaacagtcgaatctactgtatgcagcttttgtaacacctttctcctcacgaccgactccgtgctattgggtgttggccaccacggatccatcggcgatcgagtctccattcgtacgccagaccgagcccatgatctacacgtactactattactaccaccagaccctgtgtagtttccgcacaaaaaaaatttacaccttatcacacctttctcctcacgatagactctgtgctgttgggtgttgccaccacggatccatcggcgatcgagtctccgttcgtacgccagaccgagcccatgatctacacgtactactattactaccaccaggccctgtgtacttcccgtgcaaaaattttacatcttgtcacatcgaacgtttagacacttacatgaaatattaaatataggctaaaaaaataactaattacagagattacaactaatttgcgagatgaatcttttaagcctaattgcttcatgatttaataatgtagtgctacagtaaacatttgctaatgatggattaattaggcttaataaattcatctcgtagtttacggacggattttgtaattgttttttttgttagtgtccgaacatcctatacgatatcctatataatatctgatgtgacacgttaaaactttgagcattgctccagtccagcatattgtacctcgaggtaccagtaccttcaggtaccaatttaaatccaaccgttcattcacggagggtaagattgaaaatctcacacgctaaacagctcatgatcgtgatgctccttctctctgactgagtgactgtgtcaacgaagactccaagagcaactgagcaagtccaaaccaagagcaaggacgtggtgggagcgcgacaaggggtggtcggcgccggtggtgccgggggcgtcggcggcggggtgttggacggcagcgtgttgggcgccggcggtgtctgcacggcggcgaggtaacgaggagcaggaggggtggtcggcaccggtggtgttggacggcggcgcctgcgtcgaaggctgctacgcggcggcgaaggcgacgaggacctgcgtcgcttgccgatgtgcttgaatccagcagcgagattaggggaagggccgcggtagacgtatgtcaccggcgagcttgggggaagtggtgcacggaggctcgtcggccccctccacctccactccggctagcctgtccatccctggtgagagccatcgatcgatgcaggcatgcagcatcttttggagagagaaaagacaggaggaagatgaagaagatacacgcgaaattacttaactacccttgcttctttagtactccatccattccaaaatataaggcataaccaccctaacccaaagaccaagaaataattattattattatcttgtagtttggatcatcctaataaatacaatgcatgcatccaatagaattagaaagcatgagagtgaaggatctaaaaaagtaatattttattggagaagtggtcatagttaattctctacatgtatgcatgccttataatatggaacatctaaaaaaagtggttgtgacttatattatggaatggagggagtacctttctatgctctataaaatcacgtggacagtactactaggtacaactctttctcacccgttagatcaaacgaaatcgatggttcaaattacatgtacgggcaggtaccaagtacctgctggaccgtaaaaattctctaaaactttagtgtcttaacaccccatgtatcggtggccggggcccgggagccccagagcgcgcgaccaatgatgcgcacgagtacacaacagcgaaagcgaagcatgcatgccacgcgcgcgccggcgagcacccaccaccgcagtgatccctcgtcgaattcactctgatccagccgctgccgcacccgccgacccgcgggcgctgctgcctgcacaccagcacgtaaaagcgcgcacggctcgatcgtcgcgatggcctttccctccagtctcgtgcgtgcgtctggccgaaagaggagagatatatcgaccacggcagcgacgcacgcagcgtgctgcttgcatcggcgcacgatgcaccgtctcgtggttgccgctcagcgggagccacactcggatgcgtgtattacgtatgtgtcgctgtgcgcgtctcgtgtgttgctgtgcggtccgcggtggcgtggaccacacgctccacgcgcgcgcaggccatgggcgctagtataccatctttctgttctgttccgctcttccaggtggctagtggcaaagcctgtttgtcttggacccattttcgaaacgctccagatcatcagtgtgagtttgtgaccgtgacgtcccagagtggccacgtcaatatatagtactccctccggcccattttaaacaccactacgagttttcatatctaactttaattgttcgtcttatttaaaacttttctattaatatttctattgtattatatgataataaaacatgaatagtacttgatgtttttttttaaaaataagacaaacgattaaaattggacattgaaactcatatgcgcttaaaatgagacggaggccgcacacaaaaatcttgttggaagtccatatgcatgtacgtaatattcacgaggatttgaaccctagtgggttgagtctaggagtgggtattcggtctgaccaaaaatttcggtttcggtcttcgatcttttggtcatttcactctttggaaagtgaagaccgaatttcaaggcaaaatgtcagaaccgacaaattcggtctctgtcttttcggtctcggtctcggtcctaaccgaaattcaacaatattttcatatatgcaaacaaataatgaaaaatttcaacacaaaaatcacaaaaaatttcgtaagcacgtattagtaaagactcttattaggttgcatgcctaaaagaagtagggatgtgaaaaatagagtttaatcctattgaacttagtgggttttaggttgcatttagatatttttgctaattcggtctattcggttaaccgaggagactaaccgaattgagagaacaaatttcggtttttcactgcctaggatcgaattgatgaccgaatttttggtctcggtctttttctacctacccctaattgagtcatgcacccacgagtccatgacttcatcaccacaccgctggtgcttcctaatagtactactattagtatatctctcctccatgtgtctgccttctttgtgaccccatcgatcgatcgatcgatagctttagagtgtgtttaagaaggaggggattgaggagattggaaagatacgtaaaatgaggtgatccattagcacatgattaattgagtattaattattttaaactttaaaaatggattaatatgattatttaaagcaactttcctatagaaatattttgcaaaaaacacaccgtttagtagttcgggaagcgtgcgcgcgaaaaacaaaactatttttctctctttctcatgcgctcgaacgcagcctaatagttgtgcttcagaaaagtttgtttgaaaaaactagcactactgctactttagcaggactgtgcgtttattggtacggggtgactggatgattgccgatttgccttaaacttcctagtttcctacttctgttgtcgatgagcgattaaccttggccactgaggcactgtaaattgccctagctagatcaggctttcggtttcaaccaataagtttgtcactgcatgcgttcttggcgactcattggtccgttgctaccttttgtcatttcgatagcctttttcatgtcaccgaagagtcaaaggcagtgatcaaacgctgatgatctgatccacatccaagtaaatactacaggtagtagaactcttgcagtagatcagccaaacctacaggtaattttcactgattagtgattacaactctacgcactgatctagctcgactttagttggcaactgtttcctcaagcttctgtacaattaatgaaactaaaatgtgatcctatagcacgatatgactaaacaaagtcaaacgacaaaacggtatgggctggtttggtttgtgctttgtggcctaaatttagccttaattaccaatattggtaattttaatagtgtttagtatcattttgtttgatgctaaattttgacatgcttagaaaaatataccatttcaatagcaaacttaagctattttggctttaatccaaacacaatattgccttgtcaaaattagtgatgctaaaacttgccaaaattcagacattgtttgttattttttataagactctttttgtctgttgggctttctttcaaagccgggtcaatataattaatctgtttcaaaaaacaaaaacttgccaaaattttacattgataaaaattggtagatcaattttggccataaaccaaaccttccctgtatacgctcaaggaatattgctcgatcttcgcgtagtaaacacatcattcgttcctaccaagagtgttcggttaaccgccctatcatcctcttctcattgtcactcgacacaaggcgcacatatacgcacactcgcacatgcaacgcatgaatgttactagcttagtacctttcaacctgtacgcctgcagtaacaataatcttagccaaaaactaaatcccaaaacgagataagagcctggtcatggccacaccgacgacgtccatcccctgaaacggccaactgatagcgtccaaattaagcacacacatgtaaggattactgcactggctagacatgccacaccaccagagacagagacgcaaggatggcgactgtaccagcagcagcagctagctagctagctgcaggcctgagcttagcattcatggcatgaacaataaaatggaacaagtgaggcacacggactgtgcacagcgtgcaaggcaaatgtacttaacagagatggacaccggcccgggtcacagtgtaactgcccagatttcttcttggtgatgtacgagagatgtgtttgttgtgctgcatgactgcatctctccctgtgcatggctaatgggtgccattttccatgtgcatatgcctcaataatgaatgcaggtgcaattccatggggtccatgagatggtactatatatccgatgttatgtttaatttctctctcccggtcttcctcttttccctgtttacctgcaacacctttccctttcctgcgatttgtttacttgcaattagttgggcaatttgtttattttattactcctacctgtgcacttgcttgtgtaccaggcaaggagtggcctggctggctagccgggtcacttttttaggtgctgatgtgaaattggctggtgtcttggcatgaaggagacaaggacatcagacattccatgacttcataccttcccaaacttccaaacaaataccccaatcagtgtccgtctgtgttctaagcaggcaggcacctttttttgctggtcatgtggcttatctgtttgattagtataaacaaatgcagtcttgatcgagtactggggagtagctttctcacgaactttggctggaggatgaaccgtgggtcctcatgttagtggggctcatctgtcattggaatgtaatggcaatgggctctctcatctctcttcacattagcccagaaaccttagctagaagctcgtgcatcagtggctgcagctccaggtttatgataagtttccagagagaatatacttcaaatcacactgtccgaagtctgataattcacacaacattttgaaaggaaaagttaacggagtctgggggaatagaactagctactgtgtactgctttacatgccctgtttatctcttctcctactgctactctgtattcggtcgatcgatccattcatcatactgttaccttcagaaaaaaatgaaaagtgagtagtcgttgtactgctactgttttgagattccgaatcaaataattccaaaatggacagcataagtccattgagtcctcgatctcacagcagcttaaagaattatagcagtgtactatattggctctactatttttatatgttctccgagggacctgttttgcgcgtctgtgcagtcatatgaatgcattcgaatgccacattttctgccatcaagcaaagctgtaaggcccaacccggccaattatttcacgtccacggtacacacatcgcaatctttcttcttggaagatatctgcaagaaaacttttagtctgaatcaatcaatcagtagccattcttacccagccaaaggccatggcttcagctcaatgctgtccctctgaagcttgcataaagaaaaattacagtaaacaagaggacatcgcttgcaagattagtactaaaaacgaatcaaacgggccccgtatcaaactgaatcgcctctcatggaatacagttccgttgcgtggatgcacgaaagtaagaacaaattaatggcttgctcattccgtcatgtagtacgattgtacgaacgtacaaaccggcagctaattgacaagggaaaaacatcacctacattatatacacatacataatcacgcggggacagctgtcgctaacatgaacagctggtgaacagacatagcatgatgttcaggaaagagtggttcttcagtcttcaccgatgtgtaaagaactatagctagagactaaagacaaagagagacatacatacctatacatatatactctcttcttgtccattgcaatgctagacacacgtacggacacaacatagtttacgtcgaaatcatccatctcggagacgaagctccgggcatttctgcttggtccaagaggtgatcatcgacagtgctctcgttcatccattggctgcttcctgacttgtgatcaggacccgtccaagacgatgcagcagatgcaatgatccaggcaacggtgaaatgccaatgccatgagcgttgccgcaggctatcttgcaatacacactcgatgcccctgtcgtcgcttgcacacatacgcaacaaggtactataatttgaggtttgacaagcagctttcagctccatttccctggagaaacaggaaaaattggtagcaatgtcagctcatgcatgatggtggaatataaatccagcaactttgaattcaacatg

SEQ ID NO: 80834 - DNA, 16701 bp, Oryza sativa
caagcaatgtcaaattttattgcaacaaaacatatggtgtatagctgaccattatattttggttcgtttagctactgatccttattatgtggttatattaaactgttgtgattcgtgggtctgagagcattatctgaaatcccttgcaacatatgagttctctgcaagtgttcaacattttaaaaagaatggtacaatcatccagctgcttcgatatggggttcccgaaggttcagatttcaggatgctggaatcacatcatagaaaaagaccgcaacatcacaataacaattaataatagggcaatttgatccacgaaggttactagcgaaatgaccatactgaagaatgctgttattgtttacagtgaaagatgcagtcagcaataaccttatataggccgtgtttagtttcccccctattcccaactttctatcacatcatattacatcaaaaacttaaaacttttaattttttttctaaactcccaactttcttcaaacttccaacttttttcaggaactaaacacacccataaactgtcataacatatatcagattttggagctaattagaccaactttgagccaacgccatccacagcattaatcctaatttgcctatgtggatctcacttggcgcaacaccttcaactagacaaacagtacttcataaacatatataattactggcctagaaggtaaacagcctactacttggaacattacagcagtgactattaagttaacatcagcactaacatactattggacaagctgttggttagctcagtggggaaacacaagcactggtttcttcagcattcctcatcagaatctccatcaaagtactggcaccgagtgctactttgacctttctcgtagcctccttcagatgggtgcttgagctcattaacaccttggtttttgcatgcattgcaacaaccttcaggaacagaaaacatcaataataacagtggtcggaaaagaagagagcaatttgatttgatgtgaaccgtgtatcacgcagtggataacaataatactactactggtaaaaactaacgaaactaaggttcaatatatttagttaagaggaaaatagggactcaactcctcatcaagatccaaaaccaatgtgaaaaccatgtataactagactaaatgcaactaatactgctaacagacatgccttttctttcaaatacaaccaacaagagtaccaatttttgtgaggacataaaagtgatgatatggaaaattatatcctgatcatcctaatagcttacactatagggcctgcctacatctccaaatcaagtactcacaacgtacacctagttttatgttttcgaggcacggtttccaatagtgaggtaaacttcattgtatttacaatttctgctatgttaatcatgtatggatttggcttgcacaaaccatttagatgtattcagtacttcagtacacaagtcttactagttatttccgactatcttcttcatcatcagaaagacgaatcgcatattcaagtggggactttctattacttgctctaaggttagtgtagatatgatcaatacaaatcagatatacaacatgcatgagaaaacaacttaatactatttattcacatcgcaattatcatactcaagtatttatttgagcaatatgtcagtgaaacattcagtagcaaatcctacatgtattgtgcatcttaaaagatttttctattcttaaacgaggaaatcatatttcctttaccagcatcaagtggcaactgaaacccacaatagtgttataaatgtgtaatgataatcccaaatgaaagattcatggttcacatttttcactaatttaatccaaacagtggagtaattataagatgatgctttgctttagataaaaaaaaagaacggaataaaaagaagaccggtccctgctgaagttttggctaaagatgtgacacagagtacagtgttagattataaaagaacatgccatgagtacagtgttgtttgaacaataaagtttaagtagaaacaggcaagaacacataccatcatcagttgcctcaagtggagtgcaaaaataatacttgacgccatgcatcagctttgtttcagcaaaataaagcctagaggtccagcattcctcatccttattcttcatctcaacagtgaaattatagtggcaataaaccttcctatattccataacactaaagcagtggtgcaatatttcaccaaacttgtaatcaacttcctaaaaaaatcttaaaataagaaagagcgataacaatgataataagatgaaatatactagtaggttttatgcaaggtcgcaaacctcaaaagcatccttttctgcaatatagtttctgaacgctaagaatgcttcctcggtcaaatattgaagtccattcgcaattgtttctttccgagaacgttgcttcaccgggctcaccctactaaaaaaggcctttgctttcttgtctagcagatcgatgtactcatcagacatgcaatattccactggtttgtttaagctgtgtttcattccaaaaatagtctgttattgtaacaatcataaagtttagcacgctacaaatatcaaaccagaaacatatatacaaaacataacacttatttctgaacaaataatcattttttttggcttggaaatcaaagaaaaaatcatttataataatattagataatgatgacaaggagttcaatattttataatatatacttaaaatcgtaaataaaaaaacataactatcatttacaaatattaaattgtccgattatcagaataacaaaaacaatccaaatttccaaagatatattcgactcaagaatgagaaggaagagcatgaccagacatcttatggttacatttatagtatcaatagtttcttgcaagccattggagtcaagttaccagagcaaatagttgaaagttgaatggataattttttttatacatataaaagatcatgcaattaaaactatgttaacacattttacatgttcttgcatgagaatacatctagaccatgggtcaacataaatatagaagaaaattgtgttccaagagataaatcaaaaggactgtaatgtaactatagggaaattaccaaggaagacgtggcatttcagcctgttcttgttgtgatggtatttctgacaagtggccaacatcattagggtttggagtggcatattctttatcagtgtgttgaaaaggaccggcgtcacttggatgtagcactccctcaggctcctcgtcctcctcaaactcaatattcaacttcttgcatctgaaagaatcaataactttgtagaaatggtatcgaaaattgaaaagggaagcatctacttagtatttttcagaaacaaaatcgaccatgtcttgtaattatgacgacatagtttgtattggtgtgaaaaaagagcaattaatggggttaacgatatacttcatagaaacttcaactgtacctacaagaacaagacaacttgtcgtctttgtaaaacaacatagaaagtaatgatggatgaataaacagcgcagaagatgggagaacttagtgtgatattagcaaataagtccacatttgttggagaaggaatactacataaccagaaaatacaacataaataaacaagcaactttgtggtgcaaatacttgcaaaaggggtcttatacaatagagctattaaattttttttgtgtaaaagggtaaacaagtagtgtattagaaaccgcaccactgcatatataatttatgtacaaaagggtaaacaagtagtgtattagagaccgcaccgctggatatataatttacgaatgtatcgtgctacactgcgtccttgctcctccagctcagctttctttgccatctggtacatgattgaataattctgctgtgaggactgatgggttcctgcagatgattgggctctgaacctgaatagagaaacaacgttagcaattgagaatgcatttgtttgttaagcgcttgtaattaaaaaaaggaggaatgaatttcaattagaatagaaaaacgattacaagataatcattaatcagaacacatgtgaccagaagtcgaaacaatcagatcccaactgtttgtctcataaattaagaccttaaaaagaaccaccaaactgacgagtaatgacagaaagtatgacaagcaagattgatgaaacgcagaagtcccttctgtctcaatacccttggccaatgaactccagcggtttgtgggagagatctcatcggcatccatggtatactgacaagtcagtggcaatgaatgtgggtggggtgtcatggctgctagccaggtcaatgggtagggtgattcaagtggaaggggattgttggatcaggaagagagctcgtctggccatggtgtgccagcgcccagcagttagcgaggaggactgctaggtaggtccaaggggagaatatcaaggaaggaagcacaggatgagctcgactctcagcttagtcagcacataagacaatcattgtctctaattactactactatatgaggataaacttttggatactctatagttggccataaggcccgaggcccgaaggcccggcccacggcacgcctttttggcccgacccaagcacggcacggcccgacttgggtcgggcccgtgccggcccgacccgactgtcgggctgtgcctgggcctccccaccagcacgctgggctggcccggcacggtcgggccggcccggcacgatgggctggcaggccaggcccggtacacaaagtatagggactaaaaatagacatataaatgtcaatgtctaaagaatagggaccttaaatagacttattttagctatttatataccacagcacaaagaagagggaggtaaaatagacttttttttagctatacaatgtcacagcccaataggagggagaaaatttagacttattctgaggaaaagcacgatggcccatcgtgccttcgggccgtgcctgggctgtgagtgcggcacgtgggctggcacggcacggcccggtgcgtcgatcgggccgtgccggcccgacaagcctcggcccaggcacggccgggcctgggccgtgccgtgccgggcggcccacatggccatctataggatactcatggcacgcttttcaaactgctaaacggtacgtttcgtgcgaaaactttctatatgaaagttgctctaaaatatcaaattaatccatttttcaagtttgtaataattaaaactcaattaatcacacgttattactacctcgttttacgtgaaacacttaatctttatcttcatcttcatcttcaggagattcaaacaccacctatgtctacattgctactaatttggtttccagggacttattccaagtccctgtcacattggatgtttggacactaatttggagtattaaacatacactaattacaaaacccattccataagcttggactaattcgcgagacgaatcttttgagtctaattacgccatgattttgacaatgtgatgctacagtaaacttttgataattatggattaattaggcttaaaaaaatcgtctcgcgaattagctctcatttatgaaattagtttttttattagtctatgtttaatactctaaattagtgtccaaacatccgatgtgacatgggctaaaaagttttagccccatctaaacacccctaatgcaaaaggagagagtttctgtccaccagcacagagaaaactattcctgaagaaccaggacagaaaacccagaacacccatgtcttgtgtcttctctaccgctgcttccttgctgaaccgatagatgctgcccgtccatgccaaaacatctccctcccacaatctcccattaaagtccaattagaaattatgtatttggaagatgccatcctatttaatttagagttcattgtaatgataacaaaataataatactatataagacattttattagcaccacgtaaaaacattttctttagtttgtaaggtattccctcaatttcgtaatacagggcccgcctataattattcttttgcagttttttcaacatgtaatgccttataccaaagcttgttttaatgctatattatcaccattttatccctcaagtggtactactgttagttgttattgttgtggctaagcagtactactatagaaaagatagcaatgtcattttatccttttgtgttgtactgttgttagcttttaaaatttcttgatctatgtacccagctgatattgccatatattatgaaatggagggagtagaggatagaaacctagaacggtactttccattaattcagtctgttgctcttaagatgaaataaagttggtaataggcaaatagcaaaattagccaaaagcgcacatgatgaccttttaagaacatattccatgttctgcacattatgcacaagtcaaaatatgaagaataaacacatggaacaaatccttacaattgagacatctgatgaggtaacttgtcttgttcatgaaagccgacagtatcagccttgaccctaagcaaataccacacatcttaataaagttagcatgttgctgattcaaatcaatttaaaaagcatagcacgatattcaataatgaaaaggatgcttagtttgacagtaatatccacaatgttttcagcaggttatattatttgttcttttaccctaaaaagcatacagtttttttaataagttaaaagtattgtcctgacccctgatatatgagcacaattaatgcgagaaaaaaaacacttaagcctacagtaacaataagtcaacatgttagatgcagctcatggattggcaataccaaacaacaaagaatgcataattggactatgggagcagatgtaagcatgaataaaaatgagatgaatggtgcaggtgtacaatgcgcaattaccactgcaatctattctagcttagacatgggtacatgttaatctgttttggtatacaagcaagtgattgccaaagttaataaatgactggaatactcatgccgccataggagcaataaaaatgaggggacaagacatgacgcggtacattacttattgatgctctcttagataaatgcctgtgtaatgggactatgggagctggactaaactatcgggaacacgaggcaatcagtgtgacggttgtgagatacgaaggctgtgtttagatccaaacttacaacttttttcatcacatcaacttgtcatacacacaacttttcagtcacattgtaacaattttaacccaaactttcaactttggaaggaactaaacacagtcgaaacaatgaaggcaaaaccatgaaactaaaacatttagtatcctatatatctataattctatatatgaagttcatcctcactaactgtagttaatgttatttttctcatctctcattaagccacatcactttaattatttgtaatccttggatgattgatctatggtccaaattatctccctcattttctcctcttatgaaatcatatcacctcagttttgcctttagatgattaatctatattatctcccttatttcccttctctcattgagccacatcatcatagttttgcttttaaatgatcaatctatacataattcaaattgttataatcacatcatcttaactgtttattgtttttttttcaatagtcagtcaaagatgaaaattatataaagtcatctagctatcttacatgttatttctactattatcatacaaaattcccacaacaatgcgcagtagttattaataagatcatgccatcaagcacagcattttcgaaagtaaaaggcatagaaggtttcacacataaacaagattataacgcaagattgaaagcataggaaactgcaagcaacgttatcaaacatctaccacttccagcaggacaaaataaactaaggaagacatcatacatggttgaatcttcctcctttgactggcagatttctgcaggtggttgggatggtgtggtatcagcaccagagtcagacatttgttccactcgactgaacaaattttttaagaatgcatggtactagcaagcaaatttttttaattaaaaaaatgcgatatttttttattaaccaatatataaataattgatatagtgtactatgcagattgaaaagatactagttagtataactagagaaggcgattggatatactaattaacatagctattgtgaggtagaaatagtcatgagagccgattgctcatctggtgccttggtagaagaaactaagattatgcagaagtgtcctcaacatgcaagatttgcaagcgcagcagcgatgtgattgtagcccgtcgtacctctggttgtctaagcgccgcggcctcctccgatcctcctcatcatcagaaggtcgcaattgaatcagtggctccagaaccggagaagcgctcttccgggttctgctcggtggatggagctcctcggcttcgcgccgccggagaatgcgtatcatgctcgagacctctgttcttgggaagcggtgtgggcgtcggatttcttggtccaacatcggccgccgcgcccgtggatttgggggagaagggctcctgcgccaactgggctcggcatcatcgccggcgtccatggagtggaggggtgtccgacttgcgagaggtgagtagggctagcgttggcaattcgatcaagaggatggggagcttagtgccgtcggaaagggtttttggacacgaataaaaaaacttatttcatagctcgcctggaaaccgcaagactaatcttgtaaaaaaaactaattagccagattatctcgtgtaatcgaatgtacatgtgaacgtgagaacgtctatgtaatcgaatcgaatccaggatctgcttggaggagcttttgtggcaactatagcttttgctagtatcagaagcatctcagatagtttagaagctatatagttataaaagaaaataaataaaactaaaaatcttaagctctccaaacatgacctcgatccgtgtaggattccgcatccaactcccactattttaaacaaccggaaaaaaaagtacttcatttatctttacctatctatatatctatacctcccacaatgttagatttatacttcaagaatcagcgtcacagaaaaacacagagtaacaccagaaaaattaatagtaggacacttagctccacggagattactaacagacggaccatactgagaatactgttattgtttcacaacgtaagcttaaacgtgcaatgagcaaatacccttatatatacgactttgcaactggcatagcacatatctacagattttagagagctaatcgaaccagctttgtcgataagataatatagctaagtgacactaaatatgaaaccctgcccagtcaaagcctcagacctttgtgccatcaacatcagaagcaaaaacctggccataatcgcccttgtcatcctcatccagatagtcagaccttgcattgagagctagcatctggcaaacaagccagaagagagcagcatcaagggccaggaaagcggctcctccaaagaggccagtcttcgcagtagggcactgggtatccaggtcatggtggatgttgttgcttcggtgaagaccctcggtgaccgttgcccagagcaacattgcaaacgccagagctgagacaagcctgatttcacaagaatagatgatgaaaatgtatcaatggagttagcaggaaaacaaaatgcaatgtcgagattctcaaatatcagcagaattaagctagtcccactaaaaattttgaatacaggtaattcttttgatctgaaaaaaaaatgtgtcattggcacagcttagcattaatctatggaactgtacacgactaatagaactactaacacctttagggtccatctaaggcaatgattccacaaaacaaatatgtattttttttattaattaataattttgtagctaatcataatcaaatgaaggctcgatgaggtggatccgcatcaatgccagatactactgcttcaaatgcacatgaaattgttagctgcagatctgagaatcacttactcagcaataacgaagaacgcagataagctggcgcttcgaaataatgctccgcgaggaacagacttgctcttgtatggatagaagatagcggcatgccctacgatggtggttaacacaagtgacaccacggagaggcttcccattgcaatagttgggtcacttgggaacttgcagatgacaacatcctttcctttgataggagttccataaggaggctgcatcaaagaccaaataaaattcacaacaagtaacaattttcaaaagttcataaagagtggcagttgatgaaagatatagcgcagcagaagatgtgttactaccctgcactacagttaaagtgtatcgggaaattgcaccaagtggtcatcatagtgtctattgacaaaaccacagataagccttccataataattattattatttcttaaacggtactagtagaaacctttcaaagatgtgtacaagacaaaacatcattaacaggaacgagtattttagtcagtgaagtgatgcaccttcttgttttctgcgatgacaccaagtaagaaggagagaaggccaaagaaagagacagtgagagcaatccgttgagccgaagtgagagccatcgcacctgcatatgccaatttgagatcagacaaaatcagtaacacaaaaatggagttttaacagcatggcatcgagtaatttaatttcttcgcacgacaatgacacatctcgatccaggcaagcgaagctatcacaattcaaaagactaaaacaacatatttaatttttcaaaagtccccttgcgtcctcccattcgcttcatctactgacgcacgcaatcttaacaatccctctcaatcaggacgacacctcttctcctagcccgaattgggagggaatggagttagatcgaactcccaatccatcgcatcggccgatctattcctcctagcccactcccctaccagcatcaccccaccaccaccagccaagacccaacaagttcactaaaacagtggggattttccctcccggtggtgacgacagatcgtcaccaaactgagcacgacgaatctggggaaggggacgatggaggaggagagagattaccaaccaacaacggcagcagcaaggcgaggcgggcggaggagcaggaaaccctaggaggaggaggggatcgagcagatgggaaatcgcgtgctccactggaatcccttcttctctccgcgagctcggcgaaaggtagttaagttggtcaactcaactcctaactaaccgataggcttccccgatttatacggaagagatggtggttgggcctagtgggcccaaactaataacaacctgggcctagttgactaaagtgggcttgtaaggcccacaaccatagtaacagaaattgcatcgtccaaaaaggtctagaatatgcctcgtcacgcaataataacagctctaatcgcgaaaagatttgagcagccaatctatatctacatacaagctaattgttgacagttttgcttagtagtagttgcatggaaattgcaagtcgctgagaattctcaaggagcagttgatcgaatggatattatgccttcgaacgacatgatcgaagggttggtagagatgcaacggggttcggagttttaaactgctgacgttttgagacactcaatctgcaccgcgcagctttgatcgaacggttggtagagacccggtcgggttcggaaaaaaaggattgattaccagaccacttcagtcttcagataaaactccctcaatccaagatcaatacaccaccttcaacattgctggtttggtttcaggatttcatttacatgaaaagatgacagtgtaacacatactgcagagatatgttgcatctcatctcgtctgatctgatcaagacgatcacaagttcaccacgagatcgagagactaaccgaaaaaagaaaaaagaagaagacttcattgagccgtctcctgctcctcgcactctcctccctcctcgagctccatctggtgacacagacaacgcatgcaatccctttgggtcgccgaggatctgagaattttctgtcagctgcaagctgaagtcaatctgccacttcatttttcaaaatttcaggattaaaagagaaatgattgttagtcgtggacagcagctgcagaagtgccaattattctattcttcctttttttttaatttcctttttaagacagatggaattcagcggaggggatgatgtgcaaatttcagtaaaacagctgatcatctgggaggccgacgaggatcgtttgagggtaactagcatgtaatcaggacgtaacttgtacaattctatcatacatatgtggcttgcgggtttgatccccgcaaaaacatgtgtgaagttttcctctccctctcatgcacgaatttataagcacatctaacggggtttttttttataaaactggcgaatgttctacagcaattccgaagattttaatgacaataaaacaaatcaacaaaataatgatattacctttccttgagaaaaccatgagaaactttagttttttgttaatagaacttttgttggatccccgcttctgacatattcccaattgcataagttcatggaaaaaacaatctgactaaatggggaaaaaatgcacagccatgttactagcaaaagggaaaatcagggagttaattttaactccgctgggaacaatgacagccatgtgtgatcatcaacgtgataggtaacgattggagttagaaaagagtaccgtagattagtaatacctccgtcccaaaataagtacagccatagatatccgtgtccaacgtttgaccgtccgttttatttaaaaaatttgtgaaaaatttaaaaatatttagtcacacataaagtattattcatgttttatcatctaatagcaataaaaatactaatcataaaaaaatttaaataagacgaacggtcaaacgttgaacgtgaatagtgtaaaactacacttattttgggacggagagagtactaggttagccttgtgaatatgtatgcctaggaagaggacatgtcaaatcagaaaatcatcttcttgtacttctactactactacagtactacaatctacaccaaacaaaagaatttctaactaaattcgtcgtaattaagcaaaagttccggattgctactctagtttgagtgagtaggatcatgtgggtttaattatttttaattgcatttgtattattgtatatatcacttgtttttgcttttaagtgtcactattatacgtgaactgtttttatactttttatgccaccgcataagcgtaatatacacacaacacttcagcacaggtcatatgaaagagagcaaatcaagtagagttaattacgcgatatataaattaattagcacatgagcctgatctcgaatcctcgtcgaatctagggcagagtgggcaaatcattatgttacttaggtgctacaacattcttctcttttgctacctagcttgaaatgaaagaaggccagtgaagaaaaggtgttaggagtatcttgtttaattagttcctaagtacaaggttcacaggctgataggaatacaaaattagtatagtaatagtatacattattattttcgccttgtcattgatcccgaatcctggttagaatctcaatcttatgggctcaactattatcaaacttaagctacacctgacaacctttttccacaagaactaaacaaaaagttcgatttgcatctctcgctgttgttcgagtctggagacgggtgcacgcgtttatgaattcatcgtgccttatcttgataaaggggaagtgcttcacgtaatcacgttttagttttgtttatatcttgaggacagaggaaaaggatggctagaaaatcacaccgagagatgtttacggtttacccactagaactttggcaatttctttggatgagcatgaatttcagttcaattttctcaccattgaaggccatgcacaaatacacacacaataaagacacacaggaggtgggaaatcaaacataagtgctatacaatgcttaaggcctactttggaaccaaggaattttatggaaaattttcgtatgtagtcctttgaattatagggatatattccaaaaaatcgtataggatttctttgagtcctccgctttttaccagacaatcaatcaaagttaatgtttttcattttctttcagaagtccaaggtaaatatttctttatctatcctcttttatgtattctaataaagtgtgtaatttagaattcctatgattttctatcctaggccccctttgattcaaaggaaattcataggaattttagaggattttattcctataggaatttttcctacaaagccctttgaatcaaaggaataaaccttatggaatcctatgaaattccaatggaatgtctctttccatacaagttttggaggaattttaacaagaggtagaacctaatggaaaaaatcctttgagtcttttatctctcttcaaattcctgtgtttttcctgtggtccaatcaaacgatcattcctatgtttttcctgtgttttgcaatcctctgttttacacttacatttctgtcagaatcctatgtttttcctattcctctattttttcattcatgtgattcaaaggggccctaaattcacatgtttctatttcctgtaggattgagctaaccatgacactctatttcctgcatttccatattcttgtttctttttcaatccaacaatcccaaaggaacctaaaccagaatcttttttgaaacaaacaatgcttaaacgagaatcaaaccataaccaaattgagaagggcacccatcctaactactcttattaaactcagggtttatttgggagcttaaaattccgagaagcaactggttggtagctagcttctgagaatctgaagaagaagaagctgagaagattctaagaagcaactggttggtatttagcttctgagaatttaaagaagttgaggcttctagtccattttttgaattctacaatacaaattcttaaaatctggacgaaaagttatattgtttgggtgaagttctgatcctggcagaagctgtaggtaccagaaactctcgttcaagctcttagattcttactctctccgtcccaaaatatagcgatctaagatgtgatgagacccatcctaggactatgaacctggacataaggtatattgtaggatgggtatcctaggttgctatattttgggacctattataggttgctatattttgagaggtagtattaaactcaaggagataaatggggcaggtaaagaaatgggtttttgcacagcatgtgggagtgaggcacaaccaactgcacagtgcacacatacctatggccccattgggttaagagctgagctcgctctcactgttcaaagtttttagagctccctttcggaccaaagccaaaggctggtcaaacaagctacaattgccacccttgtgactgaatgaatgccatcatctcttctgcactgccttctctctgtaattaccaccatagagtatagtagtaagccactgtaagagcagatacaatagcaagctataagccagttataaccatatatcgagaagaaaagagaagagagagaagaaaacgggatacagatttatagccagctgtaacacaaactctaagacgttatgtgtgtatgaaaggtatgaccgggtattaatgatgtatatttttatagttaactattatatgaataggctattagattagctatagataatttggagccagtagttggctatactattaaatttgctctaacaacaactactagctggagttgtactagggtagtagtaagagccaatcatcttcttgagtgagataaagagagagaggggaaaaaaaggagagcagatgatcatatctgtccagcattttatgtggtgattaaaaagaagggaaatgctgagcctatcaatgatgctggcttggttggtgtgttggtaggctttggaaaagagaagcttattggagtattactagtattttttttagaagcaaaagagggagattatatattactgtacccaatggggttgggtgtgagtgttactgctggtcagttactacttccacagccattgaagtcttttgttgactgcttttatcctgcatcgttagctttgcttgttgctccggcctacgagcactctactccttttcttttttctttattttaattttttttctttggggtttgcagaacagaacggaaaccaaacctgcgttgaattgaatggcgacgttccaaggcgttgttgcgtttgtgtctggattctgcagagcggatatgacttttcagctggaacattttacttcttcccctgcttctgcttcctgcatgcatgagcaaaagattctgaaatctgaacaaccaagttactactgtacttatgttagttcaaatcagagaatttcattctatatatggagtttatcctgaagctgaaacgctgaatatgaaatgaacctccttgttatcctg

SEQ ID NO: 80835 - DNA, 91105 bp, Oryza sativa
ttctgattgatatatttgatcttttatctaatgctagcaagccaagtgttcctgataatactggttagtgtacatttaatctcttaattactgtcatcttcattagtgttcctgataatacttgcttattattgtcatcttcaatattttcaagtccattaaattaatttattttttcttacacattttgaagattttaatccttctgaagatgacaagaataagttgaatgatggcagcataataaatgaagctaacatttgtgaaaccccaaaggtaattatatattttttcattttctatattctgttttttcaattttcatcatttaaaatttgacctaaaacttttatgtacagatccattccacttgtgatgacaatgcaattctaaatgaacagtccccaatgctgtgcaaagatactaaaactcccgaaagatcatgttctgaaaaggtatctaaatagaaatactttgcaatgaactacaattttaatcctaattttccagtttattaacatttcattaatatgaaattttaaattccaaatttgtaggataaaaattctgatgttgatggtataatgagaaagctttgtaagcctggtatgtcttttcccttttcaattatgattatttctttgttatttttttgatagtaattctgctttttgattcatatctgtttcttaagaaaaaaatttatattactgatttaattttttatgcaggaatgatttctagtcctccaaagataactaaagcaagatttgttggtttcaatgaaagaaaacccatctattttgatcatgagaagccacagtttcaaatctgggattcagatgatgataacattaatcaagaagataatttgaggtctgaagtaacaccaagacatggactcaaatcaagcaaaattgttcctgattcttactccccagcatgccctactgaattgaacaaaaccaaggttagttctctcattctttgaattgtggtctgacatcaaaactttgtttgtttatatgatatatgtggtcttagatatgttctaaaattgattggccaaaattcaattctgatcttgaggtcttaactagaaatactttgcagtaaacaacaaattcatatttgattatttatatatttttttgtcatcctcatgagttatattcacattccctgttactgagatttctattataactcactttgtttgaaattttcactttctattaacaaaatataactattataagtttttactatgatactaactgtattgacatgtcacagttttcattgaactttataatcaaattcagatagcaaacatgtcacatggtataatttattctgatctttttttgtctttacaatttgccatatagtgcaaatctatttaatcatcttgttgtactattacagattattccattggacctgtcacaaaatttatatgatttatctcaaaaccaagaaaacaattcagaaaacgaggtaaattttaaaattgtactcaaataatttttcattcctttttaaaatttttatttttgctttttaacttcacaggaccagttgataatggtaactttggaagattcagaaacacaatctcaacacaatgaaaaggaaaatttgcctgttcaacaacagtacactaagacaacagaaaacaaaaaggtatgcatgtcatggttaaaaaaatttattatatgtttatgatatgcaatttttgtttgtttaatttataaatctaaatttattaatatttaatatctgttttctcaattatttttttcttttaggattcacctgaagtagtttttcttggggaaaggcaatcgacagaaaattgtcttgatatcacatcaaagactaatgtattgtacaacaaaatcaacactttcatagtcaatccagataagaaattgaagatgtgcactgccagtccagaaagggttcttttatgcaatgttgacagaaatgttggacagtgtagttccagtcaaaaacctcagcatgatctcaggagaattctacaaccagcaagatattctactgatccatatagtcctgagaagcaatctttttgtgtcacagcttatgatagacaactatataatgctgtttgcaagataagcaaaagttcatttcaagagtaagtatttcatcttataaattaataatatgtaatagattatttaaaattgatcgtacaatgtttaacgatttttttctttttgacaatgcagtaaggttgttgttgacattgacggtgtgcactgcaaattttttacttttggtgattctttcaagcctggtggtgaactctcaaattttgtaacgtcagttttctgtcgtacatgtttcgactatcccatccctcaaaatccaaaaaaattacttcttctcatcaattggcgtaagttaaagatttctcaataaattttaacatatgccaatatcttttttgtaacttgatattctgttagtttttgaaatattaagttcatagccatagctgttgtttcataggttcacagtttttctgtttttctaatgttaggatgatcttcttaaggaacgctctgcaactaacttctctgttgttaaaaagtgttttgatggagcatcccttgcaagacctgttcacagctgtgacttggttagtattttttaatctaaattaaattttttataatattcaatcttgtcattatttttttctttttcagcttttttttccaattgtcaagaatcggcactggtttgtgtttgcaattgatctgaaagctcagaggtttgtttttttggattcaatgtatgatgaggacagtatatatcatcaacagattaggccaaaactggtatgataagttatagttatttaagttcttatgattttgcttatctttttttttgaattttttccattctcatatgttttatttacatacaaatttgtaattattacttgaaattgattgttcgtagatatcaaactttagtcttgcctggaacctttatgtcaaagatcatccaatagatttcaacaactacacagtcatttatcctccagtgcccaagcaaacaaacaggtataaactcatcttaaaaagtctcatttacatatttctattactgaaattacagtattcttttcatgtaattttaattcaaaataactgtaatttcattttaagtttaattttgtccaaaatacatgtcttcacatgttgtttagcacaaattaagatttggcaagtaaagactagattcatttttataatagaatgtgtatcagctggtcattggattttgattcttctgatttatgtcatctaaaatgtcaattacatgatttttgtattgatattacagtttttttctatatatttatgattcaaactcactgtaatttttttaattgttctgatatccttacaattagatgctaacatgttctacaatgatctccaatacggaatacaatgggtaaaaatgtaatttggttgtttttgtgatgtgtcaacttaccaaaattcatttattttgtagaacaaatttaatactagtggctcattaacagagtttgaatgattgttgtttagtatagggaattgtttacctcctagttcactgacctttcagcatatggctgacctgcatgttagtttacatatacttgctttatgggctttcattgcttattttctgagattaattgataatgattatgactcttctgatttatgccatcttgaatgccatttacatatttttactattgatattacagtgtttttctttataattattgttctaattcattgtaaatttaatatgtcactgcactattatgaattatgagttgtctattttcattttatgaaatcaatgacattgaagaaaaaatatgtactgaaattttcagatatcttttgtttggtatttttcaactgccattgattgatatgatttttatgaattgtaaaatttttgatgtcagacatcatttgagatgttttatgattttattttcttttttttgtagatttgactatggtatttttactctcaagttcacggaggtttggggccctagagtgctgcttccaaatatcttttcgcaaagagatattcctaatatcagaatacagttactcaacaaaatgttgtttcacccacacaattcaattctttgttcagacctttacaaactactggatgatcacttctgaaggtaacaactttcagtgaacaaatagctaattcaaaattgataactttttaaaatttaattaaatttgagatttttttttgtaggtgtgctgaagatctgattcaacaggacaacaaatttgtctttacatgcaagcaatagagtatagcagtgcaggatatcaattctcataaaactgtaactagaatatatttgtctagacaatttttttttgtaatctcagtactgatactagactatagcggtatatgatatatagtactgtaactagaatatagcagtacatgatataattttcagcacaaattcatggtggtgaaatatacaagttctgatatttgtgctgtcagcactacataaattctgtttgttctagttttcatcttctactcttttcttttcatcacacatcacttgcttgtgttgatttctgatttcttcttgacccttttgctcaactgttgtacttcgtcttgatgacttttgcttatttctgtattctcctttttgtttggttttcttttctttgaagtagcttccttcttctcttcttctccactctgtaaatgagccaaaaattaatcactcataatatcttaaaatatgaaaaacagaattcatttgtttttgcagattaccttttgtggtttacttggaatttttcttttccttttccttgccaaatcaaactcaatatgcttgaagggacatgttggaaaagtatgttctgtcctaccgcagtgactgcagtgatttgtttctttgtcctctatttgctctctaattgttttatatctttgcttaggcctcccttttgaatttgctatatctggatcttcaatgtaatcttcttcatttctgatatctccatgaatgtgtgtgttttctgatttttcattcacttctgctgttggactaaaactattgttctcttcatgtccctgttgtttatctgctccttcaaattcatgagagaacatagtattcaacttttcatcaatcttttctgattcttccatcaagaatttgtatgcttcaactgttttcgcaccttttgatgcaatttcagcaaatttccttgacaggatattaaatctgagaactgatgattctgaaacaggtatgatttccttccctataattatttctgttgatttatgattctttctccatctatgcatgatatatttctccggtatttctttgatgctaaggtgaagcataatcttcaatatatgagagcatagtatgccatctttctggaacattgcacaaatacatgtgtattcttctgtatccaagtccatcatcacaaggtattttctctttctgatttgcttgctgatcacattttctgcctcaaacactgcataacacttgaactttttaatctcttcaacttgtaattctaatgtcttcctgagctgagcctgaaatcttttgaatattttgttgttatataatttcactgcttggtactcaatggagtagtttgaccaaaaactagtcggcctttttgttcttgattcatgatcgtcatgctattctaaattttgaatagtgtccataaccctttcatattctgtcaagaaacttctgatgctatattgggggccaacatttttcttgaatctcgagttagttccttcacttaatgctgttgattgaatgaaaggacagaaatctgttttgaaatatactggaataaacctttttctgatatgccacatgtgtgctagaaaatttatctcttgcagattgaattcttgaatcatatcctgccaaagaacctcaaattcctcttcagtcaaacagttatgtatgatatcactgtatattgcataaagaccttgattctttttgaataaggatctagatcttttcaaagcttttgaaattatatggaaaaaacaatttcgatgcttagcttctctgaaaatatttttgatagctgctctcatagcaccatcttggtctgtaattattgtctttggttgcttcccattcatacatttcagaaatgttgtgaacaaccattcaaaagtctctgttgtctcatcatgtaaaaatgcacaaccaaacaatatcgtatttccatgaccagaaactcccacaaaaggtgcaaatggtaggttatatctgttggtcaaaaaagtagtgtcaaaacttatacaatcaccaaatttgtgataccaatctctggatctaccatctgtccaaaagaaatttctcactttcctattttcatccaaatcaaattcataaaagaaatttggatctttttcttgttttttcttcagatatgtcaaacactgcatcatatcattgctgcttgtttctctgttgatttctgttctgacattgctgatatccttcttagtgtaaggtaatgaagttaaaccacctctaagaactgacagaataactatcatgttccttgtgggaatgtgacattctttcaaagttcgaataagcacccgctcttctgttgataaatacttgtgtgaccttagaaatctgactttgtttggagggctcagctcatgattatgatccaaatctaaccttgttataatccattccaaatttctttctgagattaccataacacatttgcactctgttccaataacttcatttgtttttctctctccagtagcagtctcatctactgtttctggctttgtattgcaatctgctttgacatatttgtagcacttgaatgttactctaataacttctctatttcttttcttacttgtagttctagcactatgaacattgacaattgaaaatccagccatgtatgcatagaagttgaaatagttatgtgcctcaataattgatttgaacttctgatctaattcaggtatgtactttctatctatgattgcgttattccctttcaatgcttcttgttgttcttcttctaaaaattgttcaatgtcttcctcagttagcaattcatcattcataacatcatcatcaacaccattaccactgatgttaccaatatcacttgattgttctaaaattggttcctatcacaagatttaaacaaaatataaaacttttttcacatttatttagaataatgttttacttttcattttatagaaaaacttatatttgtaagaagttcatacctgaactgattcttgcaaattgaaaatatctagtgaccatgcatgttgtgactgattgtcaacattgctgtaaccaatttcacttgtttgctctaaacttttatcctgtgaaaaaacaaaatgcaaaaaaataaataaataaaaggtttctcattttttaaatttaatagacaaaagttttagtattttttttaaaaatattatacaacaattacatacctgcacagattcttgcaaatttaaaatatccatcaagcatctttgttctgattgatattcaacgtgtgaattcaaactttcgtcaaccttttgataatcttgtccaattccagtctctattgtatcatttttttgttccttcaaccttaattaaacagtttttgaaagattttcaaaaaatatacttaattgaacacataaatacataaatgaacaacaaatcagtacttttgttttcaaaaaaaaatttaccttcaattcattgcaacgttttggttgtgatgaaataatatgttccattagactagtgtatgatataaatgaatcctatttgataaaaaaaacaaaaaatcaatgtagtcttgattgtcaaagaaaataaaagaaattatatcaaacttaaggttgtcaaagtaaaaatacttactgcaatgtagtcttggtccaacagagatagaacattgttttcataatcaacctttgcattgttagctccattttctgcagaaattttgaaaattctaatcataaaagaaattatatgaaagaaatagtgctattctacaattcttgttacctgaattaatttcttgcatattcatacaaatatgattgaatatgaaagaaatatgattgaattttttcaacttgttacctgaattaatttcttgcatattcatacaacttatagttcctttgtcattgttttctataatacctgcaatatttgataccagtattataggttagtgtaacttttaattaatcaaaaaaattctcttaaaaataatataaatattactgcaaattttttacttttctctgattcattcaaagcactacatccaatgtctgcttctgaatttttggtcttgtcaagtttagcttctgtttctgagaagtctttactgttacctgaaaataaatatgaggaaaatatctatttttttttgttttactattactcatacctgcaatttgcttcataatttttcccttacctgtttttgtaatgtccatgttttcttgcactctataagatagtgttgtattgtaattctcctcaagcaatgctaaacctgttttcaatcatataaactattaaatttgtttcacaaaataattaatgcagtatgaaagttgtcaaacaattttatacatttatttatatttacatgtctgatttgttgtgttcttcttctcaatcttacttcctatatctgacaagtgccccttgttccctgtttttttaaaaaaaattgttgtcaatccatagttgtataacatttacaattttgatgaaaatatgattgagtgcttgtaacatattcattaattacctgattttatgttgtctctgttttcttgcattttatatgattgagttgtgttgtaattcttctctaggaatgctagacctgtttaaaatgaaagactcacatttgttagaatccagttaaactctttctatgaattttttttctaaaaaaataatttgaatttaatggacttctttttgtatacctgaatttgactgaaccaaagcagtacaagttccatcttcgaaaattcctgcaaaagattataaaacaaattacaagcataattttttacttttaattattcttctaattattcttataattacctggtaattgcttcattgtcttaaatctctgtgcttttttgtcggtatctgtttcaaaacctttcgaaaccaaaattttttattttttgatcaagattagtgaaaaaaaagtacttaatatgaaatttacatagcaatacacttacctctcgatgtctttacttcttgtaattgcttttcatcagccttctttagatcatttgatattttcaaaatcttctcttctgttcctgaagatagaagcattcctcttcatgaatttttttttttggccagatgatgataaatattttttttgattaagcaaatcaattttctgtacgtcatcaggcaagaaaattaatcatgctaagttaaaagaatgattaaaattcttgtcctgatgatgtgcagagaattgaggtgtttttttacttatctgatggccacatttgtttttatgtcttttttttcatttttctaaatgaatcttttgtggttcaagtaatattagtatgaagttttggacttcttttgcaaacctgattttgaattaacagaatcagtactagttccagcttcaatttttcctgcaaaagtttataattaagatcagatacataatttttctctcgtcctattgtttaatttgataaatagataatattataaaatttagcataatatacctgctaattgcttcattatcttcagaccctgtgattttttgcctgaatctgtttcaatacaaaaaaagtaattttatagaagattagtgcaaaaaaaacagaactaaacatgaataatacagagtaatgcatttaccacttgatgttttccctgcttcgaattgcttttcatccgccgtctttaggacatttgatattttcaatttcttctcttttgagaagcattacccttaatgaatttttttttggccagatgatgataaatatttttttgattaagcaaatcaattttctgcacatcatcaggcaagaaaattaatcatgctaagttaaaataatgattaaaattcttgtccagatgatgtgcagagaattggggtgtttttttacttatctggtggccacttttgtatttatgtcttttttttgtaatgattttgattctcctgatctatatgatctacaatgtcagttacatgatttcaatattgaaaatacagtttttttctatgtaattatggtacaaattcactgtaatttttatatttcaaagtttttgtttgtctaagctttggtttgtaatggaattgtttgaatctggattgatatgtttttgaacattgaagtacataagctcattaacaacatgaatacaaaatgttgccagattgacaacaatttctggtggactgaattttttgatgtatttacttgttctgtttcttagtacaaaaggacatgaactacattgaatttcacttgttttaatttcagaatgaaatagtgggcaatgaattttttaaacaatgaaagtttgacatgaaatgctttagtgttctataatgaaattttgacatgacatgctttagtgttctgttcattcagattttttcagaggtgacaagtgtctgctattcagattttttcagagcaaatcttcttctatttgaatgacatgagctgcattagaataaactagttttaattacaaagtgaatttttactttttttgaatttatgtctaagctatgttatgaaatagattctttgaatctgaaatgattttgaacattggagtacatcatctcattataaacatgaatacaaaaatgtttgctagattgacaacaatttctggttgtaaaatgttttttacatgatttcaatattgaaattacagttttttccatgtaattatggttcaaattcattgtaatttttatatttcatagttttagttaagtctaaactatgttatgaaatggagtgctttataaggtgtagttatgtcatgtatcttgtttgatgatttgaaagtgtttatgtttttcaaattttttacaaaaaggcatataaagtgtgatcttgttcaattagacaatctgatttctagattttcagcagatcctgtttttattcttgttcatccagagaatcttttttgttcaaacatgatttctgattctgttttatttgcattgtagtataaaatctgaatttcctacatcattcagaattttagttcctatttttagtgtactgtttattcagaattttcagaatgtacaagtctctgctgttaatatagaaattttcagaaggaacaagtatttgcttgttctgtttcttagtacaaaagaacatgaactacattaaatttcactagttttaatttcagaatgaaatagtaggcaatgaatattttaagcaatgaaagtttgacatgaaatgctttagtgttctgtaatgaaattttgacatgacatgctttagtgttttgttcattcagattttttcaaaggtggcatgttttctgtttcagagcaaatcttcttctgtttgaatgacatgaactgcattagaataaactagttttaattacaaactgaatagttcacactgaattttttacaatcatgtttattgctggtgaattttaattttctgaaagtttgagatgacttgctttcgtgacagtggagagaattacttgtgacagtgatttgagtttccttattcatgtaaaatttttgaatgagatgtgtttatgagttgcatgaatttgctgatgttctacccaagagattctgtttatcctcctaaaattgtaatgattctgtttatcctcctaaaattttctcttctgttctaatactgtgatgttcatttaacaggaatttagaagtttcgagagaggcactgtctacaatgtgtgaacatgtgtatattcagaagtcaatatatgtgaatatttgaatgtctcaaggaaaactctccaaaatttcatattcttcaaaagatcagagttaaagtttatctagaatggtcagaagaacaaaattcaagatcaagattcagatccagattcaaaacaacaagatatttcaaaggaggaatcaaaaggtgcacttacctgttgatttttcctgctcttcacctttttccttctccaaatcgctcaaacttgtgattcctttctgtgtgtactgtaaatttgcttctctatcgtcaattttctcgttaatctccatctttttttcttctgacttcagatctgtctctgtttgattccccctatgttgaatttgctttttgctttttatatccagatcacgtgacactttcttcttgggtgccaagttttctaattaagtaacctggcatgtgtcacgtgtattgtgctcatctatttgggctttttttgttgatttattacattgggcttgaattttagactttttttgtttgggcctccatttaatttggatcgagtcagctgggccaatatctggcccgatctgtgtttttttttattttttttccttctattttgatcaaaaaacgttgttcgttggatctggatcaaatggtcaaaatattcgacagatgggaaacatcaaaatctgtcgcatgatctgtagacactccctttttaatatgttgaaactacagccggtgtgatggcccatagacatgcaaagaagacaatggtggtaagtcctcaaacgtggtggtaagtaaaaaaaagaaaaaaaaatctgacctgaccaagagaaaaccagatatcaatcgtatccgcctgctcctgcatggacacgtaggcacacacagagactcacgcatgcatgtgccacgtcggatcccgccgcaacagagagacccacacggtctcttccatcgctcgccgtgcccgactccatctgcgtctctcgcgccgccgccgccataaaaccctccggcccaacccaaacccaacccaaccaccacccaaaaccccacgccgccacaccaccacaaccaccaccaccgtgcgccgcggccgcgcgcgcgctccggcgagcgagtcgccgacaccaccaccaccgccgccgccaatcacagattaattaattccgatggagtcgtcggagatggcggtgatcgagtacgtggtggcggagctgagggacgaggcggcgggggccggggcgcacgtggcggcgctggcggcgctctgcgacgtgctggcggtcgccgccgaccacctcttcgacgccctccccatcgccgagttcgtcgcccgcctcccgcgcctcctcgcctccggcgagggagacgtgccgctcttcgccgcgcgtgccatcgccgaggtatgcgagggcgtccggccctgggcgaccagcttcgccaggtacggcgccatcgaggcgctccgtgacaagctcctcgccatcgactgcatcgagctcgccgaagaggtaattaatcggtagtagtaatagttatattcatctttctgaattaattatatagctatacttataaaaccctcttatataaaccctagttttattaggttaaagtactgataataatactatggttaatatgtgtctgtttaaataaaatttaaaccatttatatgcattaaaaccctagctatgttaggttaaactgacaatattatggttaatatgcctataaggactacatccagcttgtcgaagaggtaaaatttgtacgtactagtagtaattgtattcatcttttcggaccaccttaattgtaaacctaaaacccctccttaaaacctgaaagccggcctaaaaccctagctatattaggttaaacttgataatacaaccgttaatatgtgattttttttctaccttttaaaaaaattaaatgtatttcaggtgtacgagacaatcttttttaataaaaaattacgacacccactaatacttactgtccttatatttatatttatataccaatgatatagattttacactataatttatccatatttttgtcggtaacataggttttacgtgcacgattaagttaattatacgttcgttcgtgtattgtgtaacataacacgtggtttcatcaagactgcattcttttttttttacaacgacatacattttttaaatctaaatctcctattgttgttccatcaatagtaagattaaattgagtacaattgtaagggtatatccttctcttttatggttggttggtgtggatgtggtgctaaaggagacggttgcttcgttttgtgtgtttatacagtgccttcgcgctctgggcgtcatatccatggagtgccccaaggagtgcctcagccacggcgtgccagccgccgtgctgcagttcttcgacttcttctcgatgcacaagcaggtgaagcctcctcatcctgatcagactatctctcatctcttgtggtttaatccttctttgcgctgctctgccgcctccgtgcttgacatgcttgcgcccacgctcaccacctgtttgtggaaatgcctcgcagaagctggtgctcaagatcgtcgccaacgtcttgggcgacttcagcgcgaaggatgcggccaaggccatggaggccgcgcccgttctgtgcaacctcctgcaatccactgacaagacggtacgcgtgtttaattttatgatggttatattatgagtttgtcttcttcttctctttcttggagagctactgtttctgactgatgggtttgttgaccgttctggatgtttagatactcgactccgccgtttcttgcttggttttggtctctgatggtgcttgcgacagtgcccaacacatggaaaagctttacgagcttaatgcagtccaagcgacgatgaggttgatggagaacgacgggtggaagagcctcagcgatgagactttatctgtatgttgcatgatactgcttcctcagccatcgtttttcttactctaaaattgactcaaaatgaaatattcttgttattccacattaccttataaacctgtagccttaaagatgtaactaattatcaactctttaagtattcgaaatcaggagactctttgattaccacctttataattcgcatgtgttttttcatgtttcatgaaaaggcgtcctttttatttagaagtcatttttacggcaaactatcttagatgtttatggctccctttagaaaatctaaatagtgtaagaagtatcgacaacacaggcacactatttagtaatccgcagcaaagcacatgtggtatgttagctgttaattcattcctatcttagttttagcaattgatcattcatgactgaattgacatgtgtgacagggcatccttggtcttctcaaagacctagcttctctctcagcaagggctgtaaagtctctttttgagttaaacatttgtgatttgctcaagcagatgataacatactacacctcgtcgcacagtgatcacaataaggtacatttttccctgtgtgtcttagcatcagaaattttgttgccatgttttcctatgatgacctaatacttgacacaaaagcagattaaaaattttagtgtaaattgttaaagtggcgtcacatgtttataccttaatgtatattttcaagagttagaaaaattggtagtacttctcatttgttttttttatacaattacaatgaatgtgtgtttatcagagtagagtagatatgtgaatgaactgtacaagtattccattgtacagtagtttttcgtaatatctatttacacaattcaattcaattcaaaactgcaggtgcagacgcttgtagagctcatttattatcttatgccacctcttgaaatgtgtgaccatcgtaccgaactaatcattgcaaagaagaatgtcatcacagaacaaagtggatacatccaacagcttgctagcatccttacttttataatacaggtaagaaaattctctccagtctccttgtaacacaggaagatagttctgcaactatcccttgatataacatatttcttcttgtaacgtaggttgcgaaatctgctgcactatcatcaatttgctacagttgtgttgttgtcatcagaaacattgttgaattaagcacaccttcttccttggtggaggtacagaagacagtaaacctgtcaaggtgaacttttcacacagttgaattttctcccaaaaatattttgaggggccttgaaacacgcttcctttatttaactaaccaacttgaatgatggtactgatatcttgcccttgtatcagcttacttgctggctggttggcccggaagaaccgccatatcatattccaaacgctcaacgtttcgaagacccttctgagaaaagaccagaaattcttctttgagaccttcatcagggagggtctaaagcatgcaattgatgcaatactaacacaggaaaaaggaaagagccgcttgccagaaagttgcctttgttttgatttagacttggagacctcgacagatgatgcatgcaggattaataatggtgctatcctgaaactagcggaggagataaagaaaaacttcttggtaaaggttgccaagtctcctcacaagtttgggtgtgcttttaaaagcataaaggaatttttttctcgtttgaattgtcatgccacggcacccccagctaaagatcaggatctctgcaagcagttgtctgatttttcaaggcaattattatcggatgaactgccaagtacttctacttttgagtttgtgcagagtggatctatcaaacatttggcaggttatctttccaatgggacatactttaattcaaatctcaggaattgccaggacttgataggggagcttaaggaggtgaaaatccggctgcagaagttcacgcacttggctctcagcgtggacaatgaaagctcggtgaagccacttgagattttggtggagaaactgatagatgcgttgcatgtgtggtatgacagtttccctgtaatcctggctgatgaacagtgcacacgtgagagcaccatgattcctctgagggattcaggaactgaggaaccaatgtcactatatataaaattttcgagatcagccagggaggaggagttggaggattatggtggagttctccctgttgatctttcttcgacacctgaatccattgaagaggtcctgttgcctgagatctgtaaaagaactggcaatgaaacttcatacaaggtattacacattacaccggcttgttcatattttctcaaacgtttactgcatgttttcacttttgtattcacacatatcatgaaccatcaagtgtaaattcagttttatttataacgtgttatttctatgattcaggaaaacactcaagaagcaaatgggagcagaaaatctgttgggctcagaaatggtattaaacctttctcctatgccgcttacctctaggatctagtgtacttctttacatgatgttacaaactgcaatgttgtttacttggtcaattatgatatcatgattttaagagaaacaaactaacgaatgttgattccccaggtgacgggcacaagttctcaagattgaaattctcttacaaaggaacacaactccagtcatctacaccactttttgagtcaatcctccgctcaatgcatgaaggagaaaccgatctccagattgacccatctttttgggataaagaacacaagatagtatacagaagaagaaacaaaagcaagaaaatatcttcccatagttcctacaatattcagttgtgccgtgtgcatgaaaaacttgaaatgtcattgcttaaggacccctttttctccaccatactcactggcaagcttcctggtgatctggatgaatctgatccatcatataacttcctgttcatgctgaaagtcctcgaagggctcaaccgtttttcatatcatctatcaatggatgataagttatgcaaatttgctgaaggctgcctccaagagtttgatgaccttaaggtggcaatttgtccaattccacgggatcagttcgtgagcagtctactgacaaataagttagagcagcaaatgcaagatagcttgtttggggatggcttgataccctcgtggtgtatctatttggttgaaacttgcccgttcttgttgtcattcgaagctcgatggaagtatttctgcctgacggcacatcactcattcatgacagatgaggctagcagttcaacagaaactaagaagtacagcgtaacacggagcaaaatccttgaagatgcttcatcgatgttgaacaaacatggatcagacaccaaattcattgaggtggaatttgatggagaggttgggaccggtcgaggcccaaccttcgaattctataccacagttagtcatgaactacagagagtgggtcttggaatgtggagaggagacgacaccagccaagaatgcgaagctggttttgtccatgccccttttggtctctttccacagccatggtcctcagcaaacacttcatctcaagggatcagtttgtccaatgtggtacaaaaattcaagcttcttgggcatcttgtagcaagagcagttttggatggaagggttctggatattcctctctcgaaagcattttacaagatcatgcttgagcaggtaacttttcagcaatcgtccaatgtcaatctcttccctcttctttgatcattcatgtcaccttttctctgatcatgcctgtttttgcttttaggaccttgatatttatgacattccatcatttgatcccaagttgggcaagactgttatggagtttcaagcacttgttaaaaggaagaagttcctggaggaaagggcatccaatccagcagctgatttgtcctataaaaacgtgcgattggaggatttatgtcttgactttacccttcctggaaatccggaatatgaacttgtccctggaggttcagagaagatggtgacacttgacaatttggaggagtatgtgtcttcaattgttgatgcaaccttgaaaagtgggatatccaatcaaatagaagctttcaaggctggaattaacaaggtttgtgaggaaaatattcagtagatctaatgtctttatttttttccaaataaagccaaaaaaatcactcctgatttatttcagcatcctgcaggtttttgctcttaagactcttcggttgttcagtgaggatgagatggagcgtatactatgtggcgaacaagattcttgggctgtatgcatcctttacaattccttttattttatacattcatttctgcaagagagtttcttgttagagtttctaactttcaatacttgcagtcgaacaaacttgaggatcacatcaattttgattatggatatgatgcgaacagtgcatcagtaattagtgtaagtacaacatataagcctatgcctcccacatattttatatcttaacttgtaatgaggaagtcaattggaaaaatcgttttcttttcagttcctggagatcttgcgggagtttggaagagaggaccagcgggcgttcttgcattttacgactggagctcctcagctcccacttggtggcctagcttcgctcgatcctaagctcaccgtagtgcgaaaggtttgcgtttatttttaactcataagagactatcctattaggtcccaagattaatatttcgatagaaacttaacttagtattattaattgtactcaacagcaatgtgatggcaaagtagacaacgaattaccgagtgtcaatacttgccggcatttcttcaagcttccaccgtactcctctaaggtaccataaaaacatgcactttcaacctagttcatgaatgatgcaaaactaaaaatgatttctcaattgccttcatttctgattgcaggagattatgagacagaagctcaaatatgctatcaaggagggtttaggctccttccaattatcatgataaaaggctgaaggtacaacttatagcagaacgatgtacaatacttcagatgatagatgttcattcacggctgatggcaatgatggaattgcactgactcactaatttgacttagattatctgatctggcgatgtttttacttggggaaatagttacttgagatgtaacaccaattttctcccctcctgctagattatgtatatagactacttcgattctttcattttatatgtctatatgatatgtatttacacccccaatctctggggactgtattgctgctctttgataatgaatatccaccatttttttaactctgaaactgatagtgattgactgtgttgatgtaatttacgatggattgaaatatgaatttcttgacaaatcgccagtctgtcgtgtaggttgggaactcatttctatgaacacatgaagaactattatgtctgtacttgtaacattgacagaaacatgcacgagcactatgctatattaatttcagataccaaattgaatatatatgatccgactgtcatagccaaacacaagacccaggagcattagtcactgaaaaacttgcgttacaaatccagatataatccagtgatcttgcatataatcaaaatccccatcccatttttcaagcagaaaatagaacaaaattcagaggttcagatgcttttacaaccattgttagcatctgctgatctgcaacacaagtcaaagcaacactctgcagatgactgtcaaaaaaaatggcacgttcatatccatcacaaccaaacagaagaattaatagcactcagtaactcagaaaattatgctacaatttccaaaacttaatccattgttgtcacatataatgaaaatcctcatcacatttttcaagcagataatagagtaccaacaaccagttgacatatcagagagagtaatccaaaatgtagatataaatatataatagaacatgaccatccaagatgtttttgcagccactggtaactcatctgcatcacttataatttaaataactgttgagcaagactgccaaaaagatgcaactagagagactagttcaacacatagcctactgaaatgatatagcttaatccactgcctcctcctatggattctgagtatcacctaataacatttcttgtttgtaatctgttcactgtctcctcatctactatgacctgcatcaagaacatgatactgataagcaaaacaagaacaaacaagctgcaactctgtcatggatcagatgatattgagagctacaatgccagggatcaccagaacaaacctgagtaagttgtttcatcaaactgaacagctcaaaagagcaggcgatccatggcagtgttcagtgagcactctggagaatcgatcggcgaagccgacatcgagtagttgagccggaagctgatgagagaagagctaagagcgttgatcttggttgtgcctgagaatgcagcctcagcatctgcacgcctcttgaacatcaccatggcatatgcattctctgtcttggcctccatgatcggcccaaacttgctgaagatgttgacaagttcacttagaggaagaacagcacttgggcagatgaaattcagcaccaatccagccagaaaaggatcttctctgatgtcactgttcttcttcttctcatctgcacttcttgtgcaccttcccattgtgagtgaaatcgccggaggaggaggaggcggcgcatcgccattggtggtggtggtggtggtgtcacggtggatcaccgccggtgaccgcgacatctgctgcgcggcgcggctcatgagcttgccgatctttgtggacatctgatgggacagtggctgtggcgttggctcgaaattctccagttccgatgcatcgtcatccacattgccagtgatcgtgttcttggttgctcttcctctcttgcggcgtggcgccatggcgttcgcctcgatgccgtggtgacacgtgtactccgggaggctcctcgcggcggcgcccctccaccggtcgaacgccttcagctgcgccgtggcgatggcgaggtcgagcctgtcggctccggcgagcggcgccaccgccagcgcggagacgtacccgacgaaggcctcgccgcggagcgcgccacgcgtgaacgccgcgtcgaccgtcgcgccgtgcgctccctcccggatgccggcgttctcgatcacctgcttcttggccacggcggcgccgtcgcagcagcagcagcacgagagccccgcggccacgcggcgcgcgacctcgcccagcgcggcgtccaccgaggcggtgagcgcgggcatggcgtgggcgctctggccggcgaggagcgcgaagtcgccgccgtcaccgcggaacgggaggagctcatccgcgtcgacccacgcgaacgtcttgtcccagaagaaggcgacgagggtggcgccgtgcttcctccgctcctccagcgcctgctccgacgcgtcagccgggtcgaacacctgcccgggccaccacgggtggcacctcaccttgccccacacaagccgcccgggcgcgaaccctcctcgccgcccgacctccccctcgtcctcgaaggcgcagtcgtacctcgcgcgctcgccgggcaccaccaccaccgccggccgtggcgtcgcacgcttcttcttctccctccgcaagcggcggaagttcaagaggaactccgccacgtcagggtgcacgacgcgaggccgccccgggcgcctcacggcgctcacctccccctcgccaccgttcttggccaccgcgccgtgcgccgccgcgcctttctccggcggcgccatggcgatcctccgccacctgtaaaagtaaaacaagcgccaaaaaccgatcagcaccatgtcctgtcgagaggacacgagagtgcgagagagacgtaccggagagtggtgttcttgctggggctggaggagatggccggagatatcgccggagttggagacggaggaggtgggagctcgccggagcagaggagggtttggcttggggtttactagtagtagcagaggtagaaggtgtaagtgtgtaatttcgaatgttttcgaggggttaagtgagaaatgttttttgtctggactttggactatgcagaacagaagtactcctggagtactacttctgtggatttgtcaattaggaccttgtatttcgcacaaaattatatttcttacaagaaattagtgttttgtatagactatatactatatagacagattgacacaagttaagtacacaaaaagaagagatgtaatctgattgtgcgttagttacaaccaaaaaaattcttgttgatatgcacaattgcctgtgtcatcaatttcatcatttaactatataagttctttctttgttttgttaatgtgtaaatagtttgaatatccttaatgctacaatattttttgacaacaaatgcaaatctgcacctgccttttctacacctgttctctgtataatgcacgctgataattggtatgcaggtaatgcagcttgtgcggtttataggtagtatcaaattaaatattctcttcgtttcatattactccgtataagatgctttgattcttttttatgtcaaatttttgtaagttttaccaacttttacagaaaaatgtactaactcttttaacaccagaaaaatatcgtggacagatgacgacggcgtcttttggcattgcgaccttcgtgagggcgtcgtttttttacagtctttgctccgtggtggtgttgtaagcccggtggcgaccggtctcgcatagcaacgactggttcagtgctcggcttccctctctatagtgtatgtctgggcggttggcacatggttcgggacgtgtgctctagtgcacatcctgaaaaacttttttataaccttttctttctatcttaataacattggatgacctccttcggttatcccgacaaattttattaaaccgaacattaaatatattttaatagtatgattatttggtgttgaaagtgttgttatggtttttttataaacttggtcaaacttaaaataaatttgattaagaaaaaaaattaaagtaacttgtaatatgaaacagggagtattatctaaaaaatatcaaatttcattggggatattgttgtaaatcacataaaggctctggattatttctgaaagcaaaaagagaagcaagaaagaaaagctgtgccatgggccatggagaagggaggctgaaaccgaaactgccatgtctgaaactctgctgctgctgcaaattctgcatagttggtggttggcaaaagattcacaccattctcccaatcccaattaacatacccttttccgtgatatatgtatcaggtttcatcaatgcatttacaagatataggtaagcaaatattcctacaaccttttgtgcttggaattcacaaacttctgtactttttacaggtgagttgaatgtccatagtgaaacataaaaactgatgatggtgtttctgaagtggagatgggatggtgaatgtattagcagaaagttgaaaaaaaaacttggagtttaactgtctaaatatttactttgaaaattgatggtcaaagattaaaatatttgacttgggataaacccataatgactagtaatttgaaatgaagaggatggaatttaattgtgccttaattaaaaccaaaaaaatcttcttgatgggcaccgctgcatgtccttaattttatcatatactagttatataagtgctttcttcatttttttaatgtataaatggttagaatatccttaataatgctacaatattttttttgacaacaaatgcaaacctgcctttcctacacttgttctctataattgacggtgataattgatagtatgcaggtaatgcaacttttactgtttttcgtacgtgctttaaaggtagtagtactatcaaatttcattgggggtaatgttgtgaatcacataaaggtactggactattctgaaaaaaaaagagaagcaagaaagaaaagcatataccatggggattggggaggttgaaaccgaaactgccatctctgaaactctgcaaatgctgcagatagacacacacacacacacacacacacaccgttggtggttggcaaaagattcacaccattatcccaatcccaattaccagcaacccttttccgtgattatctgtatcaggtttcatcaatgcatttacaagatataggtaagcaaatattcctccatttttttgtgcttggaattcacaaacttctgtacttactacaggtgagttgaatgatccatagtgaaacagaaactggctatgatccttctgaagtgagatgggaaggtgaatgcattagcagaaagttaaaaaaaaatcttggaatttaactgcctgaatatttactgtacttcttgaggggcatgaattgcattgcattgcttgtggttacagcagctggagttttctgtgtttcaagacaaggcaagaatggcatgcgtccaagagaactttcacccttttggccaaagcagcttttcaccactgcagagttgcaaaacatgtcttgtttttgttccaatggaacagcaaaattctgaattcagtgcttgggccgaattttgatcttcttcttccaggccgaattttgttttatcctattttgggccgaatttgggtcgattacgaggctggtgatgaaggccgtccgattctttggcccaaggaccaggctacaaattttgggccaaattgggatactgatccaatcttgggctgaatttggttaacgcatcattttgtctgacagtcatgtggtacaatgttattcacgacaaattttgaggtgcaagccctgatttcagttaatttttgtctcataaaatatcaatgtgcaggcccatcaataattcaattggtttatttgggcagtaataatcaagtcatcatgggctcatggctttgattgaacttgcagatgattttaattacatcgaagatgaactttgaattgcatgggcaaagtcttcatgcttcttctgcatgtctttctcctttctatatgttagtggagttcatgtttctgacttggtactcagattttaagtttttaaccttcacaaaccggtatgaaatacatactccatgcaaaagctcagtctcgtgttgctctttcattcacagaaccaattaatgagctcatactagaagaaaacagtgttccattttgtaataagtagcctttgcttttgagatgttctgatgaacgcataatgagccatgatttcagggcctttgtctgccatatctgaaccttcttctctttctttttatttcaatagaaaaaagtgaagttagtgatcagatacagaaaatgcatatagttaggtacagtagtaggggcaattagtaattactactcacccgtctcacaatataagggattttgagtttttgattgcaacgtttgaccactcgtcttatttaaattttttttgcaaatataaaaaacgaaaagttgtgcttaaagtactgtaaataataataaagtaagtcacaactaaaataaataatagtttcaactacgtactgcatcctatcctgtcacttgttcaaccagctgttcttaattccacacagcaatgagctgagtttaggaggtggtacctccattatgtagtccaaatcaagctatcagacaaacaccagcagctgacagtctatctacagtcagtactggcaatgccatgccttagctgctaattaacatagctcaccgagcaagatgtttagtgctaattaaactactagatccagtgtagttaatgtaatcaccccgtgcgcctgtacacttgtcatctctgtacctttatccaccttaatgaaatgaaatgaacagatgaacaatggtactgtatctactagctaagctagctttgctgccattttgctcaacagtacactactgcaccccaagagatgctcataatctagtttaagagataggattacatacaccataattaagttggagttgcttccaaaatttgttctgagagtttgtttctaaattgatgctacgaaattgtgcaggccacgcatgaaactaatgcaaccaaaaaaaaacactaagggctggcccactaagctagcttgatgctaaagatggattgggattaaggtgacattgctcggtgacattccacgtgacattgagtcactgacgtgtgggacccacgtgggtccaggcacatgtgggtcccacatgtcagtggctcaatgtcacgagaatgtcatgggagaatgtcactggatctgcgttcccattattcagataagtgaagcaagattaattgttaggtgcaggatcaattgtttttttcagatgcaagcaacacctgcgtgcctacaaagagattcaggtagtagtagtaccacatgtccacatagcatgatttttcaggcatgatgcaccacccttcagtcctatatagtctttgagctaatcatactcctttgcaaaattcctgattagtgactaaaagtatcttgattgtgaagctagcggttgcctgattgcagcctgcacactatctattactttctagaagggaatcaacacaaagcaagtagagcctctgtcaattagtgattttgcttagcatgctcgctgcattatagtagcacctaccagtctcttggattgactttcctcgagagtgaattttcagagttagtttaaaaagttcactcgctgcctcgctggtctcttgattaaaaattgtgttaaaaaatggaatatgatgaacaggtataatatgtctagtagactgaaggttgtacgtcttagggcaaagatctctctcatcttatttacatcctacctatatatgtgcacgcataattaatctcatagcaatgcaatgtcaaccaagctaagtagataggatgaatgccttcttgaaacatttcaacgagtttcatcgtttgatcttcaacttgttagtcgttattagggttcacagtcctgttactagacaaaaaatgctcacgagtgatttcttcggtttttacaaaaaccgtggtaaaccaacaaaaacgaacagtttcggtaaaaagaacatatttcagtttaattttttaaattaacttgattggaaaacagtttgtgctatcaagccggccttagaagtcttttttcctgttgggtttgttttccctggacatagccaaaattgaaattttaaatattaattttagagttcattttgatgttttcttcatcatggtttagttttcagcattggtttttaagtcgttaaaaacatatttatacaagttttactcttttttttcgctaataaacgtgcattttataattagctataggcaaatcgatggacaattaattactctttgcatgagctacatttcatcatatttatggccatgcccaatatctgttgttctctcaaaactttacatgttttgaatgtttttatttgctgttcataatcaacaacgtactaatccttcctatgtggttttattatttctgaaaaagtaacagttattttctttgttgcaggtgtatgcagtatgcgtcgctcttgtcttatttacatcctacctatttatttgctttctttcttattctaaaataatcaacagctatttagtttgctgttcataatcaacaactaaacggtcaattactgattactgtttatttgccttctttcttgttctataataagtatagcagattgaaggttgccttagggcagaggtcagtaggtcactatcgtcttatttgcatcctacctatatatgtgcacccataattgatgtcacagcaatgcagtgtcaagaagtgtcagctaagctaagtggatagggtgaatggtttgtccttgcaacatttcaacttaattactccttgcatcttaattaccagatatatactcatttcatcaaaaaaaatgtttcaagctaattgtcgtttaattttgttcaaagtttaatatatctaatttgactattatttttgagaaattcatataatttaacaacacgtcaattatatattttaaaacatttctccatttaatctcaacctacttcattaagtacctgtagctaacttaaaatatacttacattttaggaaaagggagtatcatataatcatattcaatatacctgttgttcctctcgatactctagcacctgttttgaatgtgtttacaattattgttcacaatcaaaactaatccttcccatgtgattctgatttgttttttctataagaatttctgctctactcaacacaagtaaagaagccgacgcaggagacaatcctaatcgagtgcttgcttaataacatatctaactgctagctctaaaaattaactatcatctacaactataacctaatcatatgctctattcgtcctaaaatataagcatttttttttgactttgacagtttttcaagatgcttctttgaccaacaatatctataaaagtaagatgttttaaataaaaagaattacttcctccgtttcacaatgtaagtcattctagcatttctcacattcatattgttgttaatgaatctagatagatatatatgtctagattcattagcatcaatatgaatatgagaaaatgctaaaatgacttacattgtgaaatggagggagtacatattatgatagtttgtttgatgatgaatctagtaacatcaattttacatgattaatctttttttttttttactattaaaagtcaaagttaaaaatatttaacttgtcactgtactaaaaatgcttatattttaaaacggagggagtaataattagatttagatatgtactaatacactattaatatctggctcacctatctctcgtatattttttttttgagctgagctatagttggctacaaattatttgtaataattaatctgtttttcttctatcttctctttaatcttcttcacatgcgtataaatatgatgtgaaaaattataaaacccgtttcttacgattatcttatgctaggattagtacactagtagtagtataatcacagctcgctaattacgatgcagtgatgcaatcaccccaagaaagaaaagaaggcaccaaaagcagaacaccccccaatccttctttttttttccctctcaaagtatgctggaattttttcacagtttcctcgcaataaattactggggtcagtggacgatgcctcccttcctttgactcaccagctcttgtcggggagccaaaccctctctgaccggacacctgacctcctcacgacaatgacatgtgggcctcacaccatcgtggcccccaccctgcagtgacatgtaaacccagaccaaccaaccggtcgccgaaagcccaccacacaccgttcctcctcgagaccagcaacactcggaaggagaggagagactgacaggtgggccatgcgccacgcacgtgccactgactcgtgggcccccacacgcgccccgggacacgtgcgcggcctcgtgcggcggagccacgcaaacggccatggctttggcacagcgaggcgcacaggcgcagcggccgcataaacgctagctcgtccactctcctctactagcagcagcagtagaagacaacacacacgcagcagcagctgcagcaaggcagtaggagaggagttggagggaggagagggagctccaagaatcaccagagagcgagcaagagagaggtgaggtgagaatggtgttgcttttgatttatatgccctgcttctgtttgcggaaatgcgtgtgtgcttgcagtattgtcttgtggggttgtttcttgggttctttgtatgtatggaccatggccattgttgttgtaggaggaggaagaaagggtgagagctctcatggttgctgggcttctccatgtccatggcgtgtttcaatagctagggataaagatcaagaaaggcttcttcttgctagctccttttgcattgcatcccttttgtttttcctgcactctttgtttcatgtctcgttgtttatttggtttgaggagtaagttcattcctttccttaaaaaaggttcattccttttgaatcctcttcttttctttcttctcattctcatcttgttcttgcaaaccgcaacctgagaaagagttagcaataaataccctttaatactgttaatagtagcactagaaatccggtgctttaatccgaaatacaatggcgttgccgttactgcaagaaatgcagataagtttcagtttttaaaacgtttaaagctcccatatttttagctgagagcatgaatcacgctgcttgcatctgtcaggtcctcccatcactccatctgcaatgaattttaatcctttggccgctcaggttcttgccacatgaatgcattgcttcactgaaccagctacaaacatgggcaaacacatttcaggatctagacccatggggatcacaaattcacaataatggcagaatggctttaccaccagcacacacacagggccttctctgtaactgtgcaagtttactgcagccttcttctcactttgaatttttgaccctccctttctttactttctgctatgtgctattgctccattccatgtaaggctgctattattattcccctcttgagagagaatgaccattctagcccatgctgttcatcttgatggtgttggatgaatcaagggcagtttggtattcctgcaattttttacatttgttgtgtgaatgggttcctgctgtgtttgccggattcctgctgccaaaggccattgggggtccttgtggttgtggctgtgggcaactaggtgcactgttacctctgcctgaggttacaggtgtgagaagaaatgtagtgcacattactttcctttcatctttcttggtctgtaaaaatttcaaattagtgggatcctatgccattttattaagtactggctttgctactccatagctttccaaactgttgtttgtttcttctaaaaaaatgcctatgctaataacctgtaccttttgatacggtaacagtacaatttcaccactgtactttgctttttcttgcatttaaagtttgcaatttgcaagtgaaatgtcaaccagataatcttgtgttggcgtacatgtttgagttgtaattaacttgcaactttgtttttttattacttacctcatgagttctttcttctttctttcttgcagaagtaaggtgagctcagaaggatttggtaagggatctcattatgcagacttcaaaaaccaggttagtttttttgtcctagaactttcatgtatcttgcctcttgctcttgttttcgcagcaggtatgcagttctgctcatgcatgtgcgtgtctgagacagtggttacaccatgaccagacagtactaagtagtatccaaggttgtgtgtattaaaatggatctgatgtagggggggccattgcagattgaattttccatgaattgttacttgccaaatataccataaatcttacaatgcactagtgtacttgatctttgctaagtattaggccttttcttttggaagatcattttttttcatcggtagcaacttagaacagtcaaaatgagaacattcctgtgcttatttactagtattaccttgcatgttgctggatcttgtacacaaccaagtgaaggttgcctactggtgaaatagtttttggatgtactactcttgattagtcttgtgtaagccaactgttttctcagattattgtactgctcctgttatcaatctcttcatcatctggcatgtgaactaatagatctgtatctaaaaaaatccgcactaatagatggtatttgaaaacattgtcttcaaagttggtatatcagtacactcggttgttcaacaacttcatgcttagtgtactgtttgcggttaattacagtacttacaatcattaaacttctgtttccctcaatacctctattgttgtttttttttttgcggggaatacctctattgttgttgttagtctgttgatcttcaagacaattagataacatgttttttggctattgatttgtgtaggaatgggccttcagatgccccacagaaggcttctccggcaacaccacggtcatctcgggtggcgaaaactggagggaatgaaactgactctgcagggatcacaccaacaagaaccactccagagaggagccctaaggtcaccgagcgtcggtcaccacgaagcccaattactgaggtgctgatatgttttgcaggcatcgcgtttacttcactacttggtggattcttagaagcatattttttttttaagaagtgcacctcaaattctcataagatgtttcaacaccaaaactctgcatatttcattattctgcaatggctttgggcaagcaagtgaacctttagcacaacatacattttgggactgcagatttatttatagaaatgatatgttcagacacaaattctgaatatttcattaacctgtaagcaagcaagtaatataatgatggtgattgacttcagaaaccatttagcacaggaaaaatacatgttcttttgtcatgtggttttctttatttgatttagtaagtgtaaattttcttaaatgggtattcgctgaacaatttgcaccctgttccagaagcgcccaagtaggctgtccgagttggagtccagggtcagccagctgcaagatgagctgaagaaggccaaggagcagctgagcttatcggagtcacgaagacgccacacacaacaggaagcagaggaagcaaaaaagcaggagcaggctgcaacctcaaagctcgaggacctacagcgccagcttgccgagttctcagctgcggaggagtcccgactccaggaactgcggaaggtctcacaggagcgtgaccgtgcttgggagtctgagctcgaggctgtgaagaagcagcagtcagtggattcagctgctctgagctcagccttgtctgaaattcagaggttgaagcagcagctgggggccaccacagagtctgatgcagctcgtgccaagcaatgcgagtttgcggagtctgagctcgagggcttgaagcaggagatggagctccggcttgcgaccatcgagggcctgaaggtaaacgttggcgagagcgacaaggctgtagctgaggcgaacgcggtggcagctgagaccaagaagcagcttgagatggcacaagctactattgactcgctgcttgctgagggtgcccggttgcaagaatgcctgaggtcgaaggacgcagagctcggccagtccatggctcgattagccacactggaggaagatctgaagaaggcacataacaaggatgatgttgatggcagctttggcagccctgatcatggtgaagctgtggagaaggtggtggtaactatccccaatggcaatggcagctgtggtggttctggcgcagagattgagcagctgcggacggcgctcgaggtggctgagattaggtaccaggaagaacaaactcgcacgacgatcgagacgaagaccgcctacgaaatgctggagaatgccaagtcagagtacgaccgcagagtgcgcgatcttgagctggagctgaagagcaagaacgatgagctcactgaagcgaaggccactttggctgtcaggtgtgacgggaagagcgatgtgatgcagccagagcttgaggcgaagctgatgaagtcgatcaccgatgcgacggagctgaaggcgagcctgatggacaaggagacggcgctgcagagcgtgatggaggagaacgagacgctcaagtcggaggcggggaagaaggcggcggaggtgcagcggaggtacgaggcggcggtggcggagctggagctggccaaggcggcggagcaggacgtccggatgcggctcgggtacgtgacggaggaggccgacaagagcagccggcgcgccgccagggcgtcggagcagctggacgcggcgcaggcggccagcgtcgagatggaggccgagctgcggcgcctccgggtgcagtctgaccagtggcgcaaggcggccgaggcagcggcggcggcgctgggaggaggcggtggcggcattggcaggaacgtggagcggacggggtctctggagccggcggagtacaccaactccatgatcggcgggaagctggcgagctcgccgttctccgacgagccggaggaggagtcgccgaagcggcgcaacagcggcgtgctccggcggatgagcgggctgtggaagaagagccccaagtgaccatcgacgccatggacagcttggtgtggtgtgtgtactagaaagaactgaaactgactagctaggctgagctgatctgatcacgccatggatgggtttagctgcaaacactgtgaatcaaagctagttaagttaattactactggttggttagttggttttgctgctgtggtcgcagtaaaaaaagaatgttaagaactcttgtaatgatgttggagatgaggagcatctacattttgggctgcatgctgtctttgacaagagtgatcttgtgttgttagctgatcaggcctgtatgcaatgcatgcttttgttgcttcatgttcaaatttctcgctgtctaaacaaaaaatatttaattttctcgcatggcagggcatagttccatttagaatggagacatctcgcatggccggcgcgcgcgcgtctcctctgcgtttttttttcgtttcttttttacctttttccccttttcctttcttttttctgattttttttatctttagcatcttttgagtttgaaagtttttaaattttgagttgaaaattaaaaatctgatcttaaaagttttcaaatctcgacttgaaagttttcaaatctaaaattgaaagttttcaactttttaaaatctgaagtttttaaagtttgagttgaaaattttcaaatcttgatttgaaatttttcgaatctcgagttgaaagttttcaaaattttcaaatctggatttgaaagttttcgaatctcgattctcgagttgaaagttttcgaatctgagttgaaagttttcaaatctcaagttaaaagtttttaattctgagttgaaagtttttaaaatttaactttaaaatttaaaacttaaatcgaaagttttcaaatctaacttaaaaaattttcaatctgtctaaaaaaaaaatctccaaaatttttcctaattactatcatcagtgttaagtatattaactaataaagaggagtcctaattactatcatcagtgttaagtatattaactaataaaaatgctcgccagctatttttctggcgcgcatgcgcgccctagcaacccccgcttgttgatgcatgcgtcagacaagcggcagttgaaatttttctgtagactgtgtttgtttggtgtttcatgggccggcccagcaactagtcgagcatagcttcgtttggggtcacatgtttatactaggactgctcatgaacacgataatcgatcgccaattacttcattgattaatccttttccccccgaagaatacttcattgattaatctcgcacaacatgatataatttgctgtgatcatacccacggaagaaagaaactgaatgtctgaatatacaaaccggagacatacatgaagatcatcatccattcagatcacacatgaatcatccatactcatcgatccatcagaaagtcagaattcagatcacacttttctgaatgctgacagaaactacagagatcgatgtctagtctaggcgactagctccactgatccaggcaagcaggaaccgaagaacatgccgtaagtagcagctagtacgacttacataatagaaaccaactaaactaaaccatgatactaacataatcgatcgatcagaacagatcactggtagtaactaactaattaagcaacaagcacataaacagcgtagatgatgccgggtaagtatcccaggatggtgagcagcagggcgatccagaactccatctgcagccagcaagaatgcatgaaaaatcaaatcaaatcaaacaaaacaagaatgaaggatgaactgcttacgccgatgccgtagcggaggaagacgccgagcggcggcagcaggatggccagcaagatctccaagaacgtctctgaacccatcacttacttcacttccttcagatatcgatcgattcttcttcagtgtagtattcaggtagctagctagctagctggtgctaagctgagaatgctatggtctcaagttgagtgtgtgtgtgaaatgtttagcaagtgcagaactcagctggaggacaactctagaacagatcgaggaagttgggccacgtggcacctcaaagcttccctggcatggcacgtagcctttggttcagggacacctgtcctgtcctgctgcctcgcttgcactagcaggctgctactcactccgttcccaagaaggtgaatctagaccttaatatgatacattctagtacaagtaatctgaataaaaatacgttcagattcgtagtactggaatgtgtcatattcagtggttggttttttatgagacggagggagtacgtgcgtcccaaaacattagttagagcatgtgctatataatccagctataaacatactctttatgtaaaaaaaagacaaaccctaggtttctgtacctaatgtttgaccgtccatcttatttgaaaaaattatgaaaaaaattaaaaagacaagtcacgtataaagtattaatcatgtttatcatctaacaacaataaaagtactaaatataaaaaaaattattataagacgggcagtcaaacgttagatacgaaaacccagagtttgtctttttttttatggagggagtatttcgagaagataaaagagaaagggaaagagaagataaaagaaagggaaagcagcggactacaaatttatagccagctgtagcatggacttcgaaatacaatgtgtgtatgatatctggcaccatgtatcgatagtgtaatatataggtagctattgtatgaattgactatattaaattaactataaataatttagagttagtagtaaactatactattagttttatatgggatttgacttatcataaaataacgaatctatatataggttagtctagattcaacgttttagaataggtcaaattttattctaagattgcagctgtaacggaggaagtaattctctagctagtgtaacccaaaaaatacgtttctttcaaagtagtgcagctgctcatacgtacaaactcatatacacatacgtcctatccgtaatgatatcttttaaagaatggctgaggccatatgtattctactgtgacagatatgttcttttaccactgaaaaataattaggcgtaaatatgaacattcgtgtcttcacaatagcgattactaccttcatacgcaaaatataatatttttaaaatatcttatattttaggatagagaaattttatctttgtatatttcttcaataaagtactcgaataccaggatcaacgcggaaagtttcgattgaaatagaatctaaacaaggaagaacatttgtcattagttggttattaaaagcatcccaaaaacatctagattaaaatatggctttcaaattaagtttcaaattagatgatgccaaagaaggtagggtgccatacgcagaagggaaatgactcatagaataggagaggcaaatagagctcttgcacattttcactaattcatgaacaaaatcttggtacgtagacacattaattctaattttatttaaaaataggtttaaacttaacaattcgtgttgcaaatacggctagttaagcttaaggtggaagggcgaatcatgtgtgtatatctgttcatccaaaggcaggagctggttagcgtcaaaagtctatctgcgcgtcaatagcaagcagagaaggaatattgtagtctgatttgtatgccctttttttttgttatccttttcagattgtaatcgaatatccactgaatttatcagtagcttttcatggattcgcgtatatttgtaaaaaaaaaaagtaatcgatcgagttgtccttctcttatccgagccctgcataactaatatctatatgatcgagatccctgatgacgcaggcatttcgtgagagatgatctgacttaactgcttgacgattaataaattttaacatccttatcaaccaattaattctgccatccttttcgtcatttctaatgccctgtttagcccccacacgcaaattttacacactgtcacatcaaatatttgacacctgcatgaagtattaaatatagactaaaaataattaattgtatagattgcgactaatttacgagacgaatcttttaagcctaattactctatgaattgacaatgtagtgctacaataaatatttgctaatgacggattaattaggcttgataaatcatctcgctgtttactgacgaattctgtaattatagtttttttattagtgtccgaatacaccatgcgacaccctatatattacccaatttgatacgtcaaaactttacacctctagatctaaacacgctgcacagatgcaggagagatgtatatgttctgggaattaaagagagtatgaaatataatcaggattgatatactgttacctaggagacctttcattattatactatttttttagctttttcaccaagttgttgttgaagattatttgtttcgaatacttatgaaatcactttttttaaaaaaaattcttgtgctgtattacttaattagaatacttgatttaagttattataaactattgttaactttacttaaaaatatttaatatatttctacaactaactagatgattcatgataataatccaataaatagtccatagcaattgctctacctggaaattgagtagaggtagctagtactacaagcaaagcacaggaacttccatctgtgtacagtaaacctcctaacaagtaaactacttatattagtaagtacttactccctccgtcaaaaaaaaagataaaatgtgggttcctgtgtcaacgttttactgtccgttttatataaattttttttataattagtattttcattgttgatagatgataaaacatgattaatactttatgcgtgacttgtctttttaattttttttcataatttttttaaataagacggacggtcaaacgttagacacggaaaccagagtctgtctttttttttttttggacggaatgagtaatgagtaagcaaagagaagcaacatgtccaccgaccaggcatgatcgaacacgtaggtacgttacacacgagacgggagaatcttactgtaacttgtttctgcaacctgcatgacccatgactgaacctgctggaatgcagtgcaatgcaatgcaatgctatgatctgttctatttgtattttaattgattttagtccttgatctaacagaattgttcttctttggccggtgcaaccagtccactgctgatatcttggccacgagatgcccatactacgcacttaggtcaacctatctttaatttttttaaaagtagtatagggctatatgctccataaagatgttactagagaaaatacattacttctactctgatagtcaaactggttaagtccatctcttcctaggaagagaaaaaaaatgaaaaaagttttttttttagtgaaacttacacatctcacaatataacactcaacaacgaaacatcatagtgacatcttcaatctttaaaatatactaaccaatcttttatagctcatagatgtagcgtacatgtgtttgagtttataaagggtgagcttgagcttgcgtatgtgtttatattgagtttcgagaaaaaaaagaaaaaaaaaaacatcgtccctttattcgcttgggtccacatcctagccagaagcaaaagatttgtataacatacagaatgatttttagctacatatgtaattcatattgtaaactattttgactttttttacgttaaacctcaataactatagcatgtatagagaaatgtaataactcttaaaaaattaaattagtttcattaagtctaacattacattttcataggatgtttatttagtgttaaaaatattatctctctatagtttaaactaaatttaaagaagtttgaaaaaagtcaaatcatcaacggatggaaattgtaaaatggatggagcagtaattaaacagggcacatattctgttatagaggatgacgcaatggataagtaattcatacgtggcaggtgggcactgttgctctagcttatccggttggtgctccatcatcagagtcagctcatgacgccaaccaaccggcaggatggtgccacgtggctccgtggaccctcgacacgtaacctgccaaggctgatgtaggtgcgtcgacgtggcgcccttgggggtgacacgtcacgcgcggccattggtcgccagttttgccggtgccggttgttggaatgttggtggtttaatttgccttgtgatgtgtcgatggtgagcgtgacaattgacaaaggagtcaaattaggagtagtttactcgtaatttcgtcatgcgtaatcattattgttacttcgagttagttctccgatttacataacgacgctgctaattttttagagtcgtactttctccattttacaatgtaagttattctggtatttttcacatttatattgatgttaatgaatttagatagatatatatgtatggattcattaaatacaatatgaatgtgtgaaatactaaaatgacttacattatgaaacggaggaagtagtttataaaatggaccaagcatttcggacatagagaatatatgtttaattcgtagacacagtttacaagacacggttcatttttttacttaattatgtatttgttgttttgttgtcttatttttcttacttgctgcaattgaaattgatgttcgcaaaatagataaataattttgagatgtagagtatcaagaaacaaattcgaaatcttagagcatgttctgtttgaagtcaatatctgcagtaacagaatattggtatattaaatatctttcctaccaaaatattaatatattaaatagtaatttgttaatatttgatttgctatcgatatttatttataacacatttgtattgttaaaatattagcgttaaccagacttgcgtatgatttgacattggcatggtagcaaacctaacaagctctcgttagcatcatcttatctagagtactacctccgtcccaaaatacttgtcgctttgagtctttttataacttttgatcattcatcttattaaaaaaataaaaattattatttattttgtttgtgatttgcttttttattaatagtattttaattataacttatcattttttatatttatactaatttttcaaataaaacgaatggtcaaacgttaaaaaaagtcaaagcgacaactaagctgggatggaggtagtagaaaggaaagaaaaccattcatctttctatacaacatttaatcccattcccctctctatctctttcatggatcatactaccttttactttgagaagtttgccacacacatataacactttgagttcattttagtgtacaatacatctttctctgaaatggagagtatctggccatgttcattggtacccctcaaagatcagcatgaaaatgagttctggtcctttgtatatatccctttgccccggatgttctatcatcaactttgtctccatccccatattcctgagggttttttccttgatccaaaaggacttgtcattctcatatgcgtgactcacatgttctatacttgaaaaatcaaaaagatattttcttctcttatgaaaggaaggaatactttaacatgatatcagtaggatcacactttgtactactctcggttcacaaatataaaatattggaggacatcgttttcgatacgttgctttgactaaaataatttatacaaatataaattattttaaataaatatagttgcatatatattacaataatttgtttcacgataaatctagttacatcatttttacgccgtaaatttttatacttttatctattgattgtcaaagttaaataaaactatttatctttacattgtttttaaaatattttatatttatggactagatgtgtcatgtaaatgccctgcaatgtcccatcttgtgctgcccatgatgtacacacactgcacctcatgacccataactagttattgactaactaacactacaagtccacttgatgtattaagaaactccttttttgtatttaagtaagtagtgttagttagtgtaacagtgtaaccatcgaattatctaaatgttggttcagaatcgatcgatgttgacctggcatcaagtcgaaatttcatatttattgctgtgtagtcactccattgcacatgcatgtgcctgctttcctcatcattttcaggtggattagctgttgaataatccaacttgcaccatttttctatatcttagagagtaacctagcaaccatgccctgtcatgtaatactagagaaattaaggtatcatgggatccacttgtatgccctacctttgtggatggaaaattcctaatttttctacatagaaaataactgaactggtaaaattttttgagacattttagttatgaaatcatcatgattccaaataggacactaatgtagatttatcttacacagcctcaattgcgtaattttcacattttaccagtatatcgaactcctatgttttcagtaaaaagctggacgaaagcctttaatttaagaaaaatgttgaacattactccatttcggattaaagtattttcaacaacaaatgtgaaatacccagactttgccacctattttcaggcaaacatcacattcgtaggcaccgtccatgtttgatgttgttaccaagtaaatcatggaaacgtgtaatcatcgataatcgagaaaaaaaccatgtggctgtgaactgtgattcgttttcaatattgcaaagcagtggaatcaatcactttcaccagtgaaaacctgatacgattagtacgagtagcagcaaaggagtacgtacattggacgcccaagccgtataaagtcaaaaagcaaccgagcaattctcccacctgctatactatccctgtttacaaacactccgtatttaattaacgttttagatatgatttagtttaaattttaaaacttatccactaataatttataaaaaaatcatatgcataaaaggtaatatcacaatgttatagaaccattacattttataaacttagtcatagttttaaaatcttgatataatcgtgacctgggtagttactagctttttttttttggaatcagttacagaggttaaacataggtccataagttattgtattcatggcaaattgttttcaagtgttatgcgatatactaaatgtgagcggttgtatgtacatggtgactttgttaatattaaaaatattccagcataatctctgggaggtatttattcggatgactccgtcgatatcgaaatgtatcgttacagtcatacagatatgctcattctactatgatgtacgtgcgtatgcctagagacgtgttcatatctttattgcgttttggaaaaaaaaatcttactctaaacgtgaaatataatactcctacatttaggacggaagaaattacacgaaataaattagagtacgtatacacgtatacgtattcctactgccgacgtcgacgtataatacgccccactcccacacacactctctctccgcgcttctgttgctgctgccgctggagctgaagctgcagctgctcctctcgctaaaaaccaaccccccaaccgcctctcccctctcctctcctctccccctcgcatttgcagttgcagagcaagaagcagagagagaagaagaggaagcagaggaggaggagtccaagaattgaagcaggagaagaggaggtggtggtttgattcaagaagaaggagaagagcaagagcaaggatgttgcgaggagggacgagcttgctggggatcgtcaacttcgtgacgttcctgatctcgatcccgatcctggggggaggaatctggctggcgtcgagggccaactccaccgactgcatccgcttcctgcagtggccgatcatcgccatcgggctcgccgtcatggtggtgtccctcatggggttcgcgggggcgtgctaccgccagacgtggctgctccgcctctacctcttcgccatgttcttcatcgtcgtcgccctcctcttcttcatcgtcttcgccttcgccgtcaccgaccgcggcgacggccaggtggtgatgaaccggcggttcctcgagtaccagctctccgactacaacggatggctccgcgaccgcgtcgccgaccccgcctactgggccaccatcagcgcctgcctccgcgacggccgcgcctgcgccgccatgcgccgcttcgcccgcgaccccaacaccggcatgctcgtccccgagaccccctccatgttctacgcccgcgacctctcccccatccaggtcaccaccacaatctctctccctctctctctctctctctctctctcctctctctctctctcttgattcgtcagttcttgaggagattgactgctgctgcttctgatgcgattcggattttggaagttggcgtagttgtgacgcgctcagagaggggggaaaggaaactgacttcttttttgatttgttcctgtttggtccaaatgaactgaattaataaggagctaaaaatagcggagaatcgatgtgtttttaggcgttctggagttgaaaggttggattcttggtgagttttggatggattagatgggcattagcagtttatccattgccaactacaggtcagtgtagaaaaggctgggattttgtggcacaaaaataagagaggattagggaaagatttgcatttttatggagctctattcatcaattaggggaaagatttgcatttttggggtcggtcttgattggattattgattcaatttgaaggaagggaacaaccacctatactgttttctgatttcttgttgtaaagtttggttaggatattcccagttatcactgcatggtacccatgtggatctcaagatgtgctgctttgcttaccactttcatcagcagccccccttttgcttagcaagtcatatggccctttaaaatatttttgttcctgcatcagcttgcaccttcgagaaattgttaatcctgcaaccttttgcttgcccatgatttggccaaagcagcaagaaaatcacaaacctttagccgcacccgtccttcgattccaccggatacctttcttcaaaagcaatcttttttcttgctttaatagtttattgaactgcttcaaattgcaaggaattttgtctaaattccatgcggcgcgccctaagtacatcctatttagggtgattcagacttcaaatcttgaatgattaactccctcaaagcaatctttgaagtgtgtacaactccctcaaagcagtgtccttttttatggagcaagttggtacctccaactccaggctatgcaccaaaagaaacctatgtgacaagaattgactgcctggtcgatttgagtctttgtctatgtcgtttatttttttccccttaggtgaccttgctggtgcaattgctaagaccaaataatactaagacgtttcagagttgccactattgcagtggtaagaagtagaatctgcaatatgctgtgatgctgaggacaaggtcattttcctagctttttctctcttcttttctggataccaaaagacaaggtggaccacagcattagcatgattgaagggatcacggcctctcgcttcttacccaacacaacaaaatgcgatcaggacagctaaaagccggttgctaggtgcctcatttgagagttggaattggaccatggaagccttgccttgtttgtcctttatattctcgttgctgtcttctgtaactgccagtcttttttttttttgctacaatttcacagatcacatgaaaaaaaaaaaaacccatttctcttgtagtctttcaccggagactgtactgtactggtatgctatggattgcataaatattcttatacagattagctgttgcccatgtctttataggcctactttgatggagccaagaaatttgtatagtttaatgtgcatgggtacatactttgtactttgtaggacatgtcctgaccatgaaagcattcaaagttggttcgtggtttcccttaatttagagtcggattgctttgttttcccttttcatgtagacatatgcatgtttgatctctaatcgaactggcaccatcaattttgtgttgaatataggatatctttttatgtattcggttatatttgtgtttgttgctgtcgacaagacttggcagtctaaggtgatggaaaatggataattgctccccaaatttgtacatactgtcccaatctatggggtactttaaaatgctcagtttgtgttgttaagctagtgctattgtagttctattcatttcaatttatgttggatgtaaagctacctgtagataaattatactagttcttccatatctaaaaaaatgttactccctccatcccaaaaaaagacaaaccatgggtttccgtgtccaactttgacggtccgtcttatatgaaatttttttataattcgtattttcattgttgttagatgataaaacatgattaatattttatgcgtgacttgtctttttaatttttttcataatttttttaaataagacggacggtcaaacgttgggcacggaaaccagggtttgtctttttttgggacggagggagtatgtactagtcaaattttttaagtgcacatttacaccagttgtccccatgaacaagttgcaagaacttaaattctaacgctgaatatttctggttaatgatgttgatttgggttctgatcaacaaaatgttcctttttgtgtgtgtgtttgggggggggggggatttccaggagtgaattacagtcaatgagctatgatgttttgcttgtaaaactacattctgtaaatatgcattttgttgtcttgtcacttcctttcatgtccattaggatagtaaaaccataggagcgaagttctgaatatctagtttggattatatgctaacaccatttcatgacttgacatttgcagtctggatgctgcaagccaccaacatcgtgtgcatacaactatgttaacgaaacgttctggaccgcaaaccctggcgttccgaccgtcgtgaatgatgtggactgcagcaagtggagcaatgaccagcagacgctttgcttccagtgtgactcctgcaaggcaggcgtcctcgctggcatcaagaagagctggcgtaaggttgccatcctcaacatcgtcgtgctgatcatcctcgtcatcgtgtatgttgctggctgtgccgctttccgcaacgccaggaggatcgaaaacgacgagccgtttggtatggcaaggatgaccaagactcaacctagcaggttccagttctgagatagtgaagaactgggagcctttgcccctttgcctgtacaaaaagaccacaattggtggtgctaaggctctgtctgaatctcttatatattatttactggaatgtggaatcagctacactttgggtggtgaaaaaggaaagtagttcttgtttcagaatgttcagtctggtttggttttgtgcttgctatagtgtttagggttaggtctgttgtgtactgggtacaagatgagatctgcaagaaacaagagtagttccctcatttagcaatgtattgtgctgtaccattggagattttgatttggcataatcttagatgaatatgttatcatcatgtacatgatgaatgtattgctctgtagttccttctctctctctctctctctctctctctttcttttactttgtttccattattaaaaattaaaatggttgaccatgttatgatgattgctgatcaggtattgcgcaatatgatgatcttagatcgtctaacaactgcacagttatgttctttgttttctgatggaacaatttttttttcttctgtataacaacatagacatggttgaggcatcgatgtgacaccgggtataatcaaaaacttccctactattgtgggctacagtgttgtgatccagcgacagatgaatcttcagtgttatgaaccacctgcttcagtcatttgttgtaagttgtaaccatgaacgaatactatgtgctgcggcattctatggagaaaattccctctatggattctactacctccgtccaaaaataacgcaattctggctattcatctagacaagggaatgctcaggcgcatagcgggaattgcattcttgtcgggagggaagtatagtaggtaaaaggaaaatgggtatcaactggaatttgtaacagctgtaaaatgatcacaagaagcaacaacatttttttagataatggattaaaaacccagcctctacatccaaaaggatgtacacagcctaataagcaacaacatacatgggttttccatcgagggaggctatctcaaaagcaaaatacataaccagtttgccttaaacagttgccaacaacatgaacccatcttaataaaattaatagtgtgaaactttattatcttcgaggatttcatcgcgacaaccaaagcagcgagtctccctcagccgccaagaagcagttgatttagtgagacgacgatgttgatgatgatccctgcgcaaaacaattacaaatccgttacttctctgatttaaagacacaggatcaggttatcactacagactgggcattggacattgtcaagcagtgaagcaggcattgctagcagaagtcaaagataaaggccctatcgataatcaatatgcttgggcatttcacatgtcaaacccagcagaacatcactacagttcaggattacctcatctgatccatttggtagctccatgaagttccatcacgcacaaaaaccagtaccacatttacatgtaactgataccccactaactgatggtagattttctcttttgccccatagttaagtggcgtttgctcactaggcagtaggcacaccccaagctaatgacaacgaggtccccgggtcacatgtccacatgtcatacatacatatgtggcaaaaccgcagaagaacaaatgccatccacttatacgtggcaaaattgcaaatctgacgtttttgtgactagtggtcaagaggtgcctacaaatgttacagggcacggagatacacaagaatgcaaaattttagctattttccattattcatccccttgcagttttcacattctcgattatcaaaaacaaaaaaaaaagaaagaaagaaagaataaccaagcaccacagccccatgggtttcatattgacaaaaggtagttcaaacatggactagtatgccacagtacaaacgggccagaaggttacctcatgctcatgcccatgaccatgtgagtgatcatcatgaccatcccaaggatgacgcatgccctgaaaacattattatttattaaaaagagatgaatcaacacaactcaagatcgaggaaatcgaaagattatattaccaagagaacagcaccgtcctgcttagccctgtagaaaacccaaaacctgtacagacaagacttgggttataaatgtaaacaagtagaaaatccatggtattagaaaatcttagtcataagcaaacatctgtaactgttcataattggatatgcttgaaatgacaggaaaaaaaatggaattaaagacaaatttggttactgtcttgcaatgaaaggtaggttacgggttacctttttaaaatgtaaattaaaacaaaatgcaagcgtgttaacaatgagatttctatactcatgctgccatgataagctattcaagcagaagcttaacagtaggctgcaaatgagcaaatgacttcatcgagaagcataagaaaatgtctggcgaagaatagagtggacaaaagaactaaggacaacactatcatgcatctttgtagattgattttattataaagttgtgacattcaggcaggacggtaccctccagtagacccttgactgggcatggagctcatatcagatttgcttaataattataagtgcttggttgttttagttgccagtgattagtattagttggcgatgggtttaatagtacaaatcatttattctcagaggatgtttttccccctgaagtgatgtttaatgacgacctcaaggtgacatagtagtttgtccaaatcttaaagctagtcccgtttcacaaatcacaatggatacaatggagatagaaacaagaataattagccatatggttggttgtccttatcgtgcctaatgctttcttattcatgtgttgtgaataaaggttgcaaaacgatgaaataacaaaacattggtttgaaccaaaggcgtttcaagctagccaaatactgtgattcttcccagagttgtgaaaaaaatgcatggatgaaaaaggtggttaaaagctagctaaaaggagtctaaaatttgctacagcataatattgtaattcataaccaaactcccggagagcctaaatcgtgaaatcaataatgatatgctgccgctgccgctgccgttgcctatccaagaagaaggagcgcgagcagcgttgatatcgatgactattctactccatgaggaaatcttccgatacaaagatgagtcccatatggaccaaacgagaggatttgagagatccccaaattgagtaaacgtttaactgcaatcgaattcctctctaatataactaatcgatcgcgcacaagcagtagttgagcagtagaacgaacgaatctagggtctggtagaggagggacggatctcatccggtcggcgaggatgcaggcccagatttgggggggaaatgggcgagcgagggatgcgtgcggtgcgtaccacatgacggcgcagaggcccttgccggcgacggtgtgccagcgcttgttgtgggggatggtgtaccccttgtacgtcgtgccgccgccgtgcccgccgccgcccatcgccgccgctcctctcgccgccggccacgcgctttctctctcttctcctcggattcggctgcgtctgcgtcactgcgtgtgggggtggctgggtgggtgggtgggtgactcaccttggctcactagtgggccggaaattaaggcctgctagtgaattgtcctggcggcccattattcgtggtccttttcaaccatttgggccgtggggttttcagcctagttagtttgaggaacttttttttttattttacacatttttttattaaaatatttacaacaataatttaggcctctagacgccctctagaaaggcgatttttaaacgtgatacgcctagatttataaattttcaaaacgaaaaaaatatttttgtaaatatttatttaaaaaagtgtaaaaattaaaaaaaaatatcttagtttgagtatactagtaatagaaaaaagagatggggtgtttggacacaaattgtgtgctccctccatttcaaattacctgttggtctaggcttatcacaaatcaaacattttaatatttaaccatcaatttctatatagttatgattttgcatcataagatttatattttatatccaccgtgtgaaatactttcatataatatatattgttaagcaaaacggatttctaaaatttaatggtcaaagatagatatgtttgatttaggacaaatgtaaaacaacaaatagtcctatatgaattgaaatccttcatatatattttttcgcaaaattccatagaaacaaaagagcccattaattataccagtccagtgggaaatcaaatcatcattggtcggtccagagttcacacaagctcactaaagattctttctagaatgccatatgattgtgaagagcttgcttgcttaccagttatcactctgcaagtccaaaagttgagaagaaataatgataagacatatgaatcaattattcaaacaatgcatgccagttagaatgcagtgagcccagcacaagcaatgcagattaaccacatgtccaaacctcttaactaactattgtcatgtagaaaaatcaagctctttcttctccaaaccccaatcaaagcacatgattccagttaagagagaagagattggatcagagaaaggactggcccccatgtggtgttaataagaagaaaagtagtgtgcatttgacattcagcaatccagttaggtttagtttatgacatgagatagatgtgttctttctccagttcaaacacatttctttgatcttatgctgaaacgtgatcccctcatgatcagcaatttctttgttgtttagcgatacgtgttacatctgggtcaaaggatggaagaagctccctatgaacggacactgactccagttgacgtttttggctactgattgttcagcaatggtcagagattatgtccatgtcccctcttgcatcaacaaatctcccccaaattttggtgacaaagtgttattttgaactggaggaactggatataaatgtcgacaaaggttcatacgaattgtgaatttgtgcatgcatggaaagaaaatgtcggcagctagctgccctgctcatttggttggttgacagagcagaaaaaattcagtcagtggcagaacttcagagttgcagatcatgcatagacagtgctagcttccactaatgtatgacatgttcagacatcaaattagttgtagtaattaactcagcagcatcacaaagagtacgtaaaaagaataagaaaatgccatgaaacacatgttaattagtggcatccgacaatacaccgtacaatattgtactcgtttttgcgtcaagtcccacagtagctgttgccaacattttcaaggattcttctgcatgccaaattaattaactaaacaattgggatcagtgcaaagctggctgtatttcatttcagctcgaccaacgctagacacatttacaaatcaaacctaattaagctaggagttcaccatgcatatgtctgtcttccacatttgatgagcaataggttggatcatgtggcatgtacattgctctagtttggcattgggtttggagccatttgcatctggtctagataaggttgttatttaggttgccactcttgttgccttcttctcatttctgttggaaagaaaaattaacttggaaatccctaatgcaagatgattagacagacaactaggaaaattgaggagatgaacatttttcatgcagatatatatgtaattaacctagatggtagagtagatctgtagagtagagtagttagatccatgtactttaacctgccacttgtgttgctgaggaattttttcatctactaggtaaacctaagttaggtcaatgtacaatgcacatatatctcctctctactaagctacttcatgcatgttgtcatgaatgcgtgtttgatagtagtttaacttgttttcttcctaataatttttgtcattagatgatgcaaactagtgcatgttgcagatatttcatctcttgggagttgcctaagaaatactagaagctagaaaacaaggggaaaaagttactaatgccacgtcaagtatggagaatataatgcatgcatatgtactgaaacttaaattaatttgatcagtatttggccggcacgcttcgtataaatacatttcaaattttaaacaccgtacgatcgagggcaactagtcaatcaactgggattatagatttgacgtcgttttgaaatacatgtactccagttgttgcttgcatacggcatgaatatgccactcgtataatttttaattaattaattcgtttaattaattactgcattgtgcctgacctaccaatcattagtaagatgcatcgatcacttctgcatcagaccatatatatgaacaggaataaatagtagcgtggtagctagggtcgttatagttgagttttgtttacactgtcaagtgtccaatgcgcagatcgattagtcttttattcataattaaataatattccatttgcttataatcttattctataagccagatgagataagcatataaaccagagaacacttcatgattggctaactggactcaagttaattcagcacatggttcagctttgagttgaactcttttgcaccgtgccactaattcaaattaatatgaatattttagaattcaacttagaatttagttaagcctcgttggagagaagcagcagatatacagttaagtcagaggatcccatttccgtgacagaatgaagttgaatttaacctgcccatatgaacagaatgaagctaaaactttcaaaattggatatagaaatacaaagttatatttatcatagtcttatttttactatttttctttaataaaatagttcttcaatttgataaataagaaaaggttgctggtattacaaggccaatttagccccttttgatttaattgttattaaaatattaaactgataattatcaagccgtaagggacctggaatcatgattaagaaacataaatattttacttggtgcggatcgagtctcatttttttttcataaaatgaatttctaattttgtaactaacagatcgatgcaaagttatactcggcttagagtctcattttttaagtttcttagatctttgataagtttaatattctgaattaatcgatcaattttaatttttatctttgttagactcaattttaattttgaaatcctaatttgaaagttagcaattgtgaatgccatgaattcttctgttagtccaaaatgttattattcgaccgcctagatgcatggatgatcttatttaccactttttttcttcgataacgtgggaattcaattattcatgctatactataatagtcattacaggtatagataaaaaaatatagtagactttcttaaccgtcttcttttgtggttaccatcgattgaaatgcgggtcatctttcatcccttttgattatacatagaccagaaaattgctatacttcttgtggtgaagcatcatgagactgaacttaacactcaagaaactgatggtggtcaaatttaattcctagttctactaatacttccatggttaccaagaaattatctcctttttttggactttgaaaatctctccctttgtggaaagttacatgatatatgaaatgcattgatgcctaacaacatgtacagaagggaattaaggacatcattttcacaaacgacgtagtcaagcaaagaacaacttaattattcaactagctatatctatccatgacttgtaacatcaaaattggtcaatacttttaacttcttgttgcagcttcaacatgctggaacttttattccacaagatccattgtttttcatgaccaaagtacaacttagtagcctaatctagcaatttattttccttagcttactgttctttgaaacaccaacttaacaaagtatatatttcttcaagtattgcaccctagttaaccctttggttaactttgcatttggtaacatatatattacatcaagtaattaaactttaattacatgcatatatatatactatatatatctcacatatatataaatatgactctatactaattgacatatctcaaccaccttgtagcacttaagtactaattggatcagcttgattaattaagtagttaattatttcttcgtgggattaattaacgccgaatgccagctagctcgccgcgagctcatgtccagagcggctcgtcgacccagccgatggggctcgcttgcatggcggcggcgccggcaccgtcgacgacgtagagcgcgtcgacgggcgcggcgggggaggcggcgccgccgacggcggcgcagtaggcggcggcggcggcggtggtggtggggtgctggggcggcgcggcggcggccatctccatgcagaggagcgcgacgaggtgggcgtgctgggcgcgggcgccggcgagctcggcgtgggcgcgcgccagctgcgccttgaggtcgttgacctgcttctgcagctggcagatggcccccgcgcagccgtacaccgggtcccggatccgcgcgttcgcctcgtacaccatgctgctcaccgcgtccgcccgctgctcctccggcaactcctgcaaccacgacggcgacattaacggcgagctcgccatggccggcaacaccgagcacacgatcgagttagctagctatagctgcttgcctgcaggagcttgatgatgttgctggcgccgaagacgcggtgcgcggtggtgaacttgtgcggctcggttggcgggaagtacggcgccagcacgcagcggtcgacgcagcggcggcgcaggatcttgcacgcggcgcacgggctgagcaccaccgtcgtcgtcgtcgcagccaactgcggcggcggcgacgtcggcgtcggggaaggaggcgccgtggcgacggtgcaggccgtgtcgctcgacgagcccatcttgatcagccttgtagctagctgatgattaattgctgggtttgtggggagttaagtggatttgtggccattgatgtggtatatatagagaagagagagtgtgagagtggcagcgcttagctgggtaagcaagctgctattggaagtgaagctgactgtttaaacctaatgttggtaggaatggatgtttggccctgtcattaacttgctatagtgccattaattggttgactggttggcacttatcagctctgacagttatttgaagtgtctgcctgaaaattagacagtggatctctgtatatatttgatcttgattgttaggggaaaaagattgataagtacaacataacatatactgtattgaagatagtggatcaaaataaattaaaattgtcgatgcttgatatatatttatcgtgtatatattagaagggtttaattacttctcaattaccttatttttatctaaatttcagtcttgtttcctacgtataaccctaacccactctatccttcttttctcatggttcgttttgtacacacgttatacaccaccacaatgcctccccctaccctcaccccctaacctccatctgcctatccacacaccgccgctctttgcctcgttggcgtgtctcgggctctcggcatcaacaaggctcgcaggacgcacccacctagctacctacctcataccgctttatccctactatactattgtggccgtagcgctcctctcttcttctctggtgcggcatctctcctcttccgtctctagcgacttacacaccagtggatatgccatcactactccctgcctcctaaccatttcaatgaggttccccgctactcgacagttcacccctctactagctcttagctcacaccatcgtcaaggtggtgcaatcgccgccacactacccaccaaatccaccgcctattattgatacatcttccacctcacacatgacctctctataaagacgctccctccaccaacccctctcctccaaaccctggggacctaattcgatacgtttttcatggttcaattaatttcagcgttgcacacatggatgcggcatgctgccatcagcgatatcttctctccttctagcttgccctcccctcccctcttttggttggaggttttgaaagactatgggtcatcccatggataactcccggcttttaccactactaaaatataattgtgcgttcagaattatagataaattaaatttagttaatatattttgagacggtaagtaatacatggagtataattttaccgccttccaaatattttataacaaaaattaacggccggccggccatgtcgatttcttaataaacaattttaacctttttttttaccagaaagggcttgtaacggtcatgtgaaagatatggtaacattagttaaaaatgcagcttgtgtcccacgtacgtacgtacgtaatctatgttgatgtacctatgtacttacgtacgcgcctgtacgtgacgcagttggcacattcatgcatttaattatagatcaatttctctctccttgacatagagcaaatgcactatatatatatatattccccctatataataatatattagcagctttgcaatacatatttttcacatgacaaatcttagtactaatttcacatgtgaaataatgaacaacgttttgtgatttgattgtaccatccattaaataaacttcatattgatctatttgaaaattaatcctgcagatgagagtgatcgacaacatggacatatttgaaaaaaaaaagggaattggttaactactgaaattgacacgtgcatagatttaaaatgaaaagttagatatgtgtagtatattagatgcataagagaaagttagagttgctgggcttatatattaggaggtagtacatgcacacatgggtatatatgttcggtagtaaaacatgtacctatatcatgtgcatgagactaaatctctcgaatccttttagatgtgtgcgagacgccacgcgggtgtgtgcacgtgagtgcggtgtaaaaattagagatgcacttgataatttagtggtaagaagtgtgtacattgtgatttcagcctgagatcacgtgttcaatcttcaacaccctcacaattttttcttaaaaaatgtttggagggacatctctccctccaaattctctctctgttttttttttgcgttttgaaaattaaaagtcctgaaaggagttgagtataaacttgaaagaggtataacgaattttcacttgtatgtgcatgtgtatatttggtagaaaattggaaaggcaggtagggatattttcaatttgtctcatctattatatattactataagattatatattaatatatagtaccaatcatcattattgccaatatactacgatattgggcacggcacgtaagcatgctgcagaccacaaaaacattagagcctatcctagtagagattaagcaattatttcgccatagaaattaaccaacacatatacatcgatcagcttgcaaataataataatttagcatgcatcatgtgtattggcaaggtagttgtagtggaatcccgtcgtgtatatatagaccaccactacgactaatgcacgatgatataaatttcgcctgcgtattgatttcttttcttgaagctgcatgcgaatttctaaagtagaaataattgtatttgcatcgccgtgtggactttacatgttacaacaacaatacgcttttactctaatcatcatcatcatcgatcatatcatctcccaaatcaaaccatgcatgcatggtgcatctggcccttttgattacaactcccttcgtcctaaaaagttaacgacgtcctacattattttgggatggaagagagtacgtaccagtgctttcgcagtcaaattaatagttgcactaaaaggtctgggagagtaattatgtttgtgccgatataatttgccgcggaaggataaagtgaaaattgattctaaaattgagattgaatgattcaaaattgtcttttagtttgaagtcatgaaattagcaactttttattgttcaaaatttatcaaaaaaaaagaaacttcttcacctacttaggccctatttgtttagacttataagccaacttataagccgaaaagtctaagcctaaataaacaagcagcttattcgtttggctttttttgaaagccataagccactctaacactattaagccaaaagctaggttggagaagctttttttggcttatgtgagatagatgtatgactccatcactaaacttaggacattaaatccatcgacttataaatcatataagccaataagctgacttaaaacttaaaagtctaagccaataactttaagcctaaataaagagggccttaataatctaaatcacaatcttgttagccccatttaatttcaccaacttttttaatcaccttctaaaatgacttcaaaaaatctttatattttaggatgaaggaaataacttacacagatatatgtacatacgtgaagcaccgttgctgcatgcatgcaattcatacgtatagaagtatatatatcactatcaagatatataatcaatagtagataatgagtcagtagcatattagtgtctgggtagcggattgcagataacaggtgctattatagatactaagttccaatagcaagatttaaattttaagttacattacatatcaacacaaacatcgaatttcattcaaaagtttagacaacatacttaaattactcatacatattatagcataaaaatataataacataaataaataaaatataaataagcatacgctacgttaagttcgtccatccatgtatgaataacaccatttaaacgcaataacagtccaacgaaaccgatagaaaactacagtagtgaagctgaacatatataatagcagccgctaagtttcaatacactaatctccagtccgctaccttaattatagcggtagccgcagaggtaaactgcgaacactatttattaacttgatccctacacattggatcaacgcaagaaattaatgactgtgcatgacacacactagagagagagttgatttcttgctctggtagatggatggatagatatacgagcgagaaattaattcagagatgaggttggtatagaggtagtagcttgctaaatgctaacgctgctaatgggatggctggagcgcactttgtgagacttcagttgagcccaacctggaacgagaaccgggattaatttagcagccagtagtctgtctgcacgtaatacagcaaactaaatcaactctctcagattatcctcgtcagaaattcagacgacgcgtatagacagatgcatcagaagactgcattatatatgcatgcatgtctgaagaaaaggtacggaaagaaacagagaaattggaaaccagatgatgagatgctacgacagttaggtatggtgatacacccacaaactcaaaaagacctcagctcgattcatgtaaaccctcttgtttctgttaagtatgaacgaggttttgcatgcagcatatctgcatatgtatacatatagtgaggctatagcatgagagcatatctgcatatttcatatttgcatgcagtggaggggaattgaggtagtaggcattgtgcttttgccatttctcaaatttttttccatttgtttttttatccacatacatgcatatattgatgcaagagtaaaacgcattggtagcatacttaaatttaaatgtgctatctaatttcaaaactaccacatatacccccttacatgttacaccctcaatggtactcaagagggtatgtggcacctccatgagtggcggatctacaatactaacatcggtgttaggcaacaccgatgactttcggtagaaactatagttaaacagcttatccatatattataacactatattctaagtataattagcatgctatgacattgatagacacattatgacaccaacgaataaattttctagatctgccaccatgacagttccatgataaggttatatggtaatttagaacctaattgttatactaacaaattccgaaacatagtctacattttcgatatttagagacctatataaaaaaaacacgctactaaatttgaggaccatcgatatattttactcaagcaagcaagatgcacttgacagtgcagtggtaaagggtgtgtggtttcaatcccgaggtctcgtgttatattcctaacacgctcacaatttcttcttaaaaaatatttggagggacgtctctccctccaaatctagttttattttactcaagcaatcaatatatcgagacagcgctagctgccatgcacattttcctcttacatgcatctgatgctttttttccccggctgcaaatggcagcgtaccgaactccaattcggcgcagacgcggcgagaaaatggtcagaaagacagacaggtccagcagccagcactaggactgtatcttgcactgttcatgcgtacacgtatgcacagcacacagcctgtttctgcacaggaataattaggacgctacctaagctacttatctctgaatctctgatatgatatggtttttagatttcttcagttaacgtactacagtatatatgcttctctcttctttttttcaaagcaccacttgatggatatgggctcatatgaatatgattccttcatgccaatggttgtgctctatcaatctaatctatccatctcaaaaaggaggcaacagtagtctgaatactgaatacactttcgtttcagcattaagattttggtggaaattacaggccaactgcaagtgcttttggcccagcaggatttgggccataaaggcccataatacagggccaatggatccttaggcctagcccagtatatccaaaggacaactgggccataaaattcatttcatcagatgagagtgattggccacagcgggctcaatccttgcataacaatgcagttttgattcctattaattactacttccatcccagaatataaaaagttttaaaattaaacacagttagaaagtagatagaattaaatagaaaaatgttgtgattggttgagaagtggaagtaggtgagaaaagtgaatggttgagggttgtgattggttgggaagagaatgttggatgagaaattgttatattttgagacaaatcttaaatgctagaaattgttatattttaaaacagagggagtatttaattagtggtcatctgtgaagaaggacacatgaacctgaacatagccattagccaggtctgcatttctggagtagtggtaattctcactgcatgactgcaattatcctgcatctgcagcagatggaaacaaaacaagaaacttttttctttcaggcaagatgatggccactgcttcccaaagttcagaaatcccagttaaagtttcagagtaccaaagaactgtagcaatggtaaatgctatgctagcaattgattgcactatccacatcaaacacatcaagggatgcaaattgcaaaaaatacccatgccaaccatcccctttggttggcaacttggcatcttgtctcttgcccagtaaccattgctgaacctgttcattggctccatgttgttcagggcagcatgtgccatttgcccttctgaccatgctgctgtatagtttatgaatgcatgtagatgcagcagaggagatgtcatcacacacatggaaattgtggttgggggttagtaaccacaccaccatcttttggacagtttttttggctggcattatactagcctttgatgacaacctagcaatgccattgttcagggttgtttctcttctttatttgccctaactaacctacctagtagcttttcttgttgttcacagatgcttaattcacatgtgaatctgttaatgctgagcttgtttagttagttgcctagcttacagtagttgagataagtagggatcaatcattttcttttgttaattaccattagattatatgaaaacaatgaaatcagaagaaaataatactgaaattttctgccatcttgcacagctgcatctgcaactccgtcgtcagaacaatctttcagttttctgaaaccaggtagcttttgatgcaactttcttgggttattaactaacagtgagtgctgctgggtctgtgtgcatctcatcgccagcttgtgcaatctgtccggcctacattgacacgtgtagcactgcctggatttggtcgttgggtgattatctcgattaccgtgcatggctccacttttaaggacccctaagtgtcgcctaattatcagtaaagtaaagaacagagctagcttacctgaattttcaagtaatgaaccccttttaagatgatagccactgtccttgtgcgtagcaatcacttatataatcccctgacaaacaacttgttttacaccatggaagtatatagtcaagcattcagtatgtggatcatgatgcttctgtcctctctgtcccatcacattctttttggacaaaaaattccataacattcttgatgaatgaatctcttaatttgctgctgctactttgatgcaaataagtttatgttttcagagctttggaatattgcctcacacgaatggcagtccatactgtcgcttgtacgtatgattttcggtagcttgtcattttcacagcaacaacttctccctttctgccattctttgatcaacaaatatacagttcatctcatatatatgaatttattcatttgattgttgcttacataaagtagttgaattacactcaagcagtaggagtagtcgtcagttgcagcatagctttcactgacgtctctttaacaagttgttaattagcacaagcatatatatttttctttgtgtccttttgtgtttcttatttttgctgcaattattcgggttgaaaataataagaagcgaccaatgagaaatccctcctcttttctgacagtgatgcttctgtttttccttctctgataatgcattgcttgctgcttgcttccacgcagtaggagaagaactgaagaagagtttcagagttcagacaaagacagatcatcgaaccagtagtcaatcagtcgtcgtcaaccagacaacgataattaagagttcgtgcacgagacgatcttggaggagagaatgagaagaagaacaaattgaggagaagaataagaagtgagagatggaagcaaattcagagaaacgcacacggcgaactggagatgcagcagagtgaccgactgacagataatacgggccaagatcgatcgagcctgaattttcttgcaagtggctcacatcagttaattttattcttctgttctagtaacaagtttgcaactaagaaacgggatcataataattctcctaatgagttaattcgagcgagtataagctgctagatgacagagtgataggtgagccaccctgcattcctgcagttcctgtctccaaatcgtcgtcgtctcccaaactctgaaagtgaccaaagccaaactctcatggaccagacctaaattaaccaaccttagcctgcacgatcaccattattacggagagagattatcatgttactgcagtagattatcagttgtctcctttaatttctccggttgcactacgctcagttcagctagctgaatggatgcattgtcaggttttttctgaatacttacttattttgtaatgaattaactattataacgttagaaaacactcttaaagagaaaatagtttttataaattcataaacataattttttttaagaaaaatacatccttaaaacttagaagctagggaaatgtgtcacattaatccattcttccgttccttgcaaagaacatgtaacacatatgttcttctttacttagaatattagaaacatacgtgcataaatataggaatggaaggaaaggcagatttttttttcttattcgaagcctccattgttctcccaattatgaggctgccaagttaggttttgaaatttgtttctttctccaacttgattaatcatcctaactgcaattagctcttaacttccatgcatgagcaaaagggagaggcctccaaccacacgcataactgctcgtggacaataatacacaaatggtcataatctccaattaagctagatacccatgcctaccaattgcttaagatgatcactttgctgaataatgacaggttggagaggaagaacaaatgctgaattattattagttagttcattaacttaccaattaccatccagcaagacaggactaaaccaacgcgtaggtggagatcgaacaaatattcctcaactacttcttgtccatgatcaaatgatcaccagctagctcgactgaagatcacgatttcatctaaaaaaactgaatagtttatgaattgttgtaacttagagtagacgtgtacagggcagaagttagttctttggacaaaatcacatgggctcatcgagattgacctctcttgagaagaaaaaaggaagaaagagattggaaagagtagtgagagtcggcctggctgacagggagagctgcgctgtctgaatcccagcacattcttccctctttccatctcaaagactaattaacacgcattctgatttgtttttgactggatgattatttagttgtttaatgaccgtttggttcctgtatgttttctcggcgctgaataaccgaatgatttcgagggtattaacaaatgaatttattattttaaaattgaaatttattttctcagaaattcatatatataattttttttacataaattataaatttagaagtccaaaaagcttgtgtatttagctctcgaggatattaacgatgaattaattctttttttaataatgaaaatggattacatctcctgtttctgtcataagacacacagctataagtttataagtttaataatattaaaaaggtaaggtaaaagtaaatcaaaatgagaaataaggtgatgggacaaacgatgaattaattcttataatatttaaatttgttttcttagaaaatcatatacacaaagtttttttacagaaattataacacttagaagtctgaaaaatgtgtgtatttagttgtccaataattttgttaagcagaaaagaacacacccaattcacatccatggctatgcttatgccttatcagagttcttgtatgtgactagtaactttttcatggtaaaactcacagcaatcatgcatgtctacagtgaattttgaaagtgttgaggggttcagtaattcagttcctgtctccatgtgaagtgattccacaaaaatgtaccgtcgatgcgttgatgacaattgctggtagctgacaggtgggccccaagcagtcctgcacctgtcctactacgtggcaaccgcacacagaatctgagtacttgaaggacgaaggacatgcaaattcatctcccatcttgtttacaagaggttaatccatactcctacatgctttcacctttttacagttctaatcaagacattgaaagttcttgagctcgatcagaaattcagaattcatcagaattttgcagatgcctggtccagactggtcatcctgcttgtcaaatactcctactttttgatgctaagcttctctgcttcagattcctgcacacatttgcaacaaacacaacacttgtgtggctaattgcaccattagagaaatcagcaacttttgttgctttttgagtaggttccatgttccaatcccaacaaactcagaaatggcctcttctccttccagctcaaagtctttttcctttggcttcaagagagctgagagaggaatagaattatgtggttgtattaaaagagagcaaaagctgcagctcacctaatattcttcatcctggaagtctgaataattttctttctggtaaatgccaatccaatcaattagttaattgccaaaaaatcttttgtataaaactgatgaaatataccactgatgacaatttggtgaatgacagaggtagtgattttataattgcattggagaacttgtgattcagttaaaaaaatcggaggctctgaatttatgacagtttggccatgctagttgttcttggctgctagcttctgaatctgtgagagctatgcttcatcactgcggaatcctcaaaaccagccaaagatccagcagctggtggtagtcctgcagtccatttccaaccaagttgagaagttgtaatcagcagctctgaccataacactagtacttttcatcactggtcatacactaaaaccatcattaaacttacttgaaaacactatttgctctcctaatggaacacagtaccacaacaataataaaatgtgtaggtgcagccccaccccaatggccaccagatccatcactagagaattggagaaacaataaattattagtactattccatatactacattttcttcttactaccatttcaattcaaccatgaatgaaaaatgtgaaaatttttgtgtcggtgaggtgtgtgatttagcaggagagagagagagagagatttggttgatttgtttgcaagaaagaaaagcaaaaaaattgtggggtgttgtggccgttgatggacaggcaagtttcaccacactcctcccgccttctttaaaccctcctcaccaaccatctcatctctctcaccatttcattttatttttcatttttcaccacaaatttttcaccattccaagcaccacaaaaaccttgttcctcctcctcatctctctccatttctccccatatcttgattgagcttgttgagattccccatgcacattcctccctccatttccaccaccaccccaaatcttgttgggtgatctatctatctatcatcttcttgtaggagtactagtggagtttgttgatcttcacccccaccaccattaatggctgcaaagcttcactagaggaggaggactagtagtataccatcttcttcttcttctagcttgatctggtgctccattggtggtgttggtgcatcttgatctgggattctggggagaggttgagtgaatctttgggcctccatggggacggcggcggtggcggcggcggagaggccgaagcagcggcggagcagccacctgtggaagaaggcgctgctccacttctccctctgcttcgtcatgggcttcttcaccggcttcgcgccctcgtcgtcgtcgtcgtggcgggccgggagcggtggcggtggcggtgtccagccgcgccaccagctcgcggcgtcccacgtcgcggtgaaccagcaggtgagcctggtgccggatgcggcggcggcggaggcggccggggtcgggaacggcgcggtggtggacgtgggcgacgacgaggggggcgagggggcgaggcggatgctgatagtggtgacgacgacgcggggggagcggcggcggcggcgcggcgagctgctgcggctggcgcacacgctgaggctggtgaggccgccggtggtgtgggtggtggtggagcccccggcggacgcggcggcgacggcggaggtgctgcgcggcacgggggtgatgtaccggcacctcgcgttccggcccgaggagaacttcaccaccgccgacgccgaggcgcacgcgcagcgcaacgccgcgctcgcccacgtcgagaagcaccgcctctccggcgtcgtccacttcgccgacgccgccggcgtctacgacgcccatttcttcgacgagatccgccagatcgagtcagtacatccatccatccatcccatttggtttctcacttttcttttttcttgcttgattactaggagtatactttcttcgtttatagattgcaaattggaatgtgtgctaatccgaatgcttcttgattgattcttccatgttgatttctaacctcaaaggttgaacctctcacaatttttgcttgattattaggagtgctctttcattttaggttgcaaattgtggaatgtgctaatccgaatgcttcttggttgattcttcctgttgatttctaacctaattgtttttttctaagtttttcaattcaatttgagttcttttcgatccccatttcttccatgtccatgctgttcttcagggagttgaatctaggaaagaaaaccttcaaattcaatccatctaggtcatacgttttagatttttttttccttttcagatgtccaccacctactagggcttctcttaactaatcaccacttcttaatttggtaaatttactcaagccaataaaattttagtagccgtgtggttcgttgggggaagtatcattaaaggcacaagctgtcattagtggaggagaattagagtaggttagtgtgtgttgtacctatatgcttttatcatcatcttgtgcacaatactctgatgtgagccagggagtcaattattggatctagctttacaccttatttattccatttctcccaacaaactagtatgcatctatgcttcttttgaagattgaagatctcttgcttttgctcacccccaacaaccaaatatgttgcaaccactccaattagtttaattaagaccttcaacgtgcctgtggctcatgagccatgagcaaagcaaaaaactattaaaaatgtgcaaaaatgattagttaacagtgcttgcagtacaactagctgtttgcccaccgacgtgtgggcccatccctgtgcaacctaatgttagaaaatgcatggtgaatcacacatcactctccctatagcatgaactgaatgttgcatttctggtgctccccaaagtgggtagcaaaatgcaggaagaaatttgcttgaacacaattttggcagaaaatagtaaccttatgttaggccatgaccattgaactcccaataaaaggaggccccatccccaccatctgttgctttctatggccttgaatggccatttcatatgcagaacgagatctgcccaccgtttcggtgtagagttttccggaatggcgtctagttgccgtcttggattcggttggagtcggcagaatggttggtcatcgagattgtgcttgatgatttttcttgttcatacttgaataattgcaaagaaggaaaaaacagcaacattttttggctggcagtttgatgttgaacattgttttccttccatgttagctgtactccagtattgtgatcttgcagccagagaatactactatcatgtccaattctgtttgctctgagcctctcaaatccaggtcaaatctttcttctattttcaattagacctgattcaacaactggcggaaatgcctgacgtttcaccttgcctcttatctttttcctatccagctaaaatatgctaaaaattgctgttagtcctataatgtgatcctcaccttatcatcatttcttccaaactagaaatgcatggctctgaaacatttgacttgccttttgcctttactttttcaatagcaacatccaaactttgatgagtagtactactacatccgtcccatattacttgtcgctttgagattttgtttgtaatatttgatcattcgtcttattcaaacacatttggaattattatttattttgtttgtgacttgttttattatcaaatgtcctttaagtatgatttattcttttctatatttgcacttattttttaaataaaacgaatggtcaaacgttacaagaaaaaagtcaaagcgacaagtaatatgggacggaggtagtaccacgttcagtacttgccttgataaagaaaagatgtgtacactttgttcagtactatggtactaccactactgctcatatcatgtgagtgaatagtggtaatattcccaggaagaacatagcttttgtgttgaggggaacatgttgagattaaagcgctcctcttttttccaaccaaacttttgtgcatcacttcatcaacccatagtgcttagtgcgcgcacatcagcaacaaatgtggcgcttgggcgtcaaccaagcacatcccagagctactagcatcgtcacattgcatatattcttcgttgccttgttaacagttcgatacgacctgggatgtgtcacagaatttaccgcttaatacaaatgaggaagtgcaagtgtgcaatactgtgttctcaccacactccgcgcacattttggggcatgggttttgaccgtggttaccatacctgtttacttggaattagagttcgagagttcttttaacttgagaagctagaatttgtgtactgtttatccaaagaagcttcgttaaccgagttgagtttgttaatcatattgcagatgacctgaatacatgctcaataaagttttgcatccatgttaacggtcgcctcgtcccatagcttgttctgtctagtttttttagccctttcaaactttggaatttgaatccatttaattcaatatttgtcacttgtccgcatgtatgggcaagtggtggattttagtctattcccacgtatgttgaggcagttgcatgcatgcaataactcaccttgtgttgtgttccatgcctagtgtctagtgatggagatgggtgacaaaaaaaattagcataatagtagtactagattttatgatggaatgaagcatgtggaagatatttcaatggagttatggtgacatattctccttaaaatatctcagtttgagtgaagcctcttattttcaaatcaaacccaattaacccatgtgtgcttagtgtcggtggatgctaattctagtcaactggcactgtactctgtctaagaaagatgagattgatgtcatcacaaataattcatgcatttcatctttgctggtgcatatttgtgtaattcttacttaactatatgctactacggtatatgtatgttctattctctaactgttaacatgtacagggcatttggcacatggccagtggcaacaatgtcggcaggcgagaagaaagtggtagtcgagggcccgctatgcagtgactccaaggttgtcggttggttctcgagggacttcaatgatgggaccacccgtgcagtgacatataacacagaggcggacttgaatcctgctggtgctgctggcacgcgagctcacacgattgacgtctcagggtttgcgttcaacagttctattttgtgggatcccgagcgttggggcaggccgacgtcattaccagacacttcacaggttagttcatctccaatcttgttgtcaaattgatcaagctacactgcattttagtaatagcatcacacattctgcaacacttaattggactatagcactaaacgtaataaatagtatgcaaattgaggaagatttgattggatctgagatcacaatagttttaggctgtccacatcatgatagccaaatagtgaacctcctaaaacagaggacccataattgaaaaaaccgtgtatttggaagtttgaaaggagaaggatcgtataactaaacacttatacttgcagaacagtaacagatttccccagagctgaaaatcaacagcagatttgatttcttctaaaaaacatgtgatggtcaaattttcagagctgttaggaaattttagtttgaatagattcattaattttggttcttaccttgaggggagggaatatcatactttctgaaacccaagatctttcttacagacaaacttatgtagaaaagactctcccactaaacaacttaaatagatatattaatttaggttcttaccttttggaagttgcgcatttcataacaaaaactgagttcattcttcctattgataaaaggacatttataattcggaaaagatgaattatctgaccggctgatttcattataaattatttcgtaatcatacagatttttctgagttgatttgaccgccctagtgttacgcaattatcgacttcactttctatggaacatggtgtgcaacagttggcaatcagatgctccaccatcactttcatgcattcttttcttaaacttcagatttttatcttgttcaagtcacctactgacctactggtcacatccttgagctgcatcccaccagtgatactgattactgaaagctacattgccattaaaccataacatatctacaccgactgctgattataacaagataatcgagcccttcgattactcatcgaacttcttgccctccagttgaattacgctacaggctagttgcaccagaaagatcctaattcgtaaccacatcaagtttgctacaatcctagacttgcaaggaatgtgtattgatacaaaacttgtgagcttcattctgaattatgagctgatgctgatggtattatacttttcttgcacttctcataagccagaaacagttctttgaaggagacattcggaataataatttgcttaccattcccgcatcaatgcaaccaaagttaaatcttccttctcccaaataataatggatatacttttcttgatgtgattgcaggattccatcaagtttgtgcaagaggttgtattggaagacaggaccaagctaaaggggattccctcagattgctcccaaatcatggtttggcaatatactatgcccatgcaagttcatgcccaaacctctactccaaaaactcacaatagaaggtagggagagaacaagcaagaggattctccagaaagggaaaaaagtgggaagttgatgtaaatgtggtgaaaacaaaagaaaaggaagaaggttgtttacactgagtttttttccctttctttttctctcatttttgttttctttttagtttggggggccatgaattgtctgcggaaaatctccccccaagcaatagtatttattcagattcacttgtgattctttaactctgctcctctcatcttcatctcatctcatctcctgggtaatcttttgtgagggggatgttgcttcaaacaaattccccttgtggattgcaataatacactgtagaaatgtgggtgaaaatttggcaatgccatgagaattcagaagattaaggccttctcagaaagaaaaaaaaagagcacataatctccttgctgtatattctgacattgttttcactcttattctggcattgtaaaagcagaattaaggttggtgattactgtctcggatactacttactgctttcgtcataaaataaataattctagtacgtgaatgttcattgtgtcactgcccatactagtactagtactggtggtagcaacagccaggttcagacatcggggacaaagcctgaaaaaatatggggaatttgggtgtgtgatctgcagcaagagtgcagctgcagattggcagattgctcgtgcaagttttacagcgacaaacttttcatgtgtcgggccggcatggcagatgcgcgcatcgagattcacgtctcctcgtactcttattttctttctttctttctttcttctcctcgtcctctgaagtccaaattgtgatggaatcagatttgggcaaattatgagcatccaaatcaattacgagcaccaatatctggactgaatttcatttttggaaaaaaaaacactagatcaatgttggtgtaccctttttggcccacgccagtacgtgcacatggagatggtccctttccctgtaaagccatataagcccatacaaactgtttaggcccacacgaccaaacttttttttttcttgcttgtttttgttaaccgatccaacggtctgatgggccaccaaagaaggagatatcctactatggtaaggtgattacaacggtaaccgctaaaaacagtatgaattgtatctctatgctaccttaaaagttgagtagtttttctttcgcctccgtctcccaccacgttctcagcatgtgcccacacgcatagcttatgtacgtaaccacttgtatgtaaccactgaatctaatgttttattctgtaatcatagttatattggtttgctccgttttataaagtaggggtatgttactatctttgaaaaataaaatctagaatttccaaatcttatggtaactcgcggttaccatgtagtaagcttgcacggtaagttgtggtaaccgtggtctttgacttaaaaaaaaggggaaaatcacatgaaacaaaaataaaaccataacaccacattagaaaacaacagacataccataatattgtaatatccacaactactatgattatagctccagaatatatcacccacgagcatcagaccttcatttcgaagtaacaccaccatttagtcatgcaaaaatagagttagcttagcatatattttctctataaattttatcaccagacatcattacaaattgtttgggggattatttcccttttcttttcttaaaatttgaattcgaacaaattttaccaaaccttatcaccggtaaccctttccgttcccccactgcccatagaaaagcatggctaacggtggtttggaaaatctagttggtgcattgtgcttatttttaaggttgatgtggaaactgaaacttacatcgctgcatttgattttacaaatcgaattatagttaaataaaatatattatccaactttcatgtctccccctattgtttcataatttcagcccatgatgatactgttgtttgcaacacagattataagaaacaaaagttcaccaaacaaccaaactgtcgaaaagctgttataacaaacgagattatcataaatccaccaaaatgccaaacggagcataagtgagaggtaaaattttgatcttttttttttccttttgtggggagtttttttgggaagcaaggtagttatttttgcgattaaggtaattaaatttgattataatgtattactctaatagagaaaaggtacaggaaactaggaacaatatgtttgtgttaaaaacctgttaatgctaaggaatttgttaagagacacaaaaaggaacgattaaagagttattcacgacaaaagaaagttttttatttatgtatgcatatacactgtttcactgtatgtaggcaggcacaagcagatcgagttgtatttattttgtggtccaaaaaagagttagtacagcgccaaaagaattcaataaattcacgagtacgtacgtacgatctgtaccatagttttgcatgtaatttataaatgctaccgatagacgtgcccctggatgtgaaaaattttcagtttttttgaataaagaaaacatcactatgtgaaaaatatcactaatgtgtgcgtatatatatatttagtacatcatctgtggaatactcgtgagccccatacatgcatccacctcactgttcttgaatgtgatatttatgtttgcatgacacttcacttcgttcctgtttatttttcagttttttacaacactgttttacattaattctacatttttttctggaatatatagtatgttatttatcatgcacattttatatatcttttagatatgcgaatgatttacatctctgatcttgctaaaagagacatggccaataaatctaaaaatataaataaaataattttatgggacaaaactctatctcctttctaatgatatttaactaaaataccgaataaaaaacacaaaaattccacaacgataatcataggaattatgctaataattaaagtggaataaaagatcctgattacattcacattttatatacaaagatgaaaaatataaactgaggctgtgtttagttcctgaaaaaagttggaagtttgaagaaagttggcagtttggaaaaaaattgaaagtttatgtgtgtaggaaagtttttgatgtgatatgatgtgatggaaagttgagaataggggggaaaataaacacggcctgacctgtttatgtggtgtttggatccagggacttaactttagtccctgtatttagacactaatttatagtattaaatatagactacttataaaactaattacataaatgaaagctaattcacgagacaatttttttaagcctagttaatccataattagagaatgtttactgtagcatcacataggctaatcatggattaattaggctcaatagattcgtctcgcgaattagtccaagattatggatgggttttattaatagtccacgtttaatatttataattaattttcaaacattcgatgtgatagggacttaaaagttttagtcccatctaaacagggtattagcagcactcaaataagagatcaagagattcagagagagaactcaagaaatgtgtcatgatcgaatatgcttcatatatgcctccaagacacctgaacattaaggaaacttgtcgttaatgcagacaaacactgaaacacacggacactgacacaagcaagcgaagatcgatccaacaagtacttccaacgaccgacacttgttccgacgatcgatatatccatttcttctgttcatcatcgatcagccagtgatgatgaggtcgacagcattaggatactttgtgcctttcgttcttcagatttcaaaaagattaaaaaagaaaagaaaaagctctgcttagctttcatctgcagtgagagatcacatagagagagagaggggaaaatttaaggcaagttgattaattaaagaggagaaacttaaaaaagaagaagaaagaaagaaagaaaagagaagacccaatgcaaagcagcaaccaccttgagagagatgatgatggataggtatgcatcatccttttccaaagcagaaaacgccctcctacctatccatccatatatatctttgatcgatcatttgggtcttgaaagcatgattaagtgtaattaattatcaccccatcaatctgtctggataaatttacatgaaccatctttaattgtaatgcatattaacttggatgaaacatgcatggaaaaggttgagcctagtctatccagtttggcagaaatttaatccaatttctttgtcaagtaacctgaagggctgaaagtagtgtgccttcacctaatctaaagggattaattggcttacctcttggaatgtaccaaaagcagttaatgagttaattaatcaattgttctttgattcacctatttatgactattaatatcaaaaatcaaattatgaattctttgatcattgtataaaaagttttaaccatataagttaaatattttttattttgctacagtagaaagtcaaattgattaaaggcatggttctgtaaaattataggacaacaataaatgggattatgtatcatttccaaaacccctcatacaaccatcataccataattccctgtacctgaaatttactctttattaattaacaacatagcagacgaatttctcatcacccactaattaaaccagtacagctaactttaattcagtgatcatgcatgaacaacatactcaacatatggtactggggcatatttgcaagctagtggcgcacaataatatgctcaagtagcatatatgcatcattggaggcaaatggtacgtgcttgtagctatccagtgcaaactctacactacactgctctgtgataaattacttccagctaatcttaaaagcgactctgatactatgattaaagaagagatgcacataagaatagtgtgtgtatgatcgatgcagcttaatcgctcgttaggctgtcgctttgcaactcgtgacattatttaatctctgatgggaaacacaatgaaaggatggctctcacttgcactatatatatactactatataattgcatatatatgtgtgtgtatcattagtgtttgtttgaccatgattactggtgcttgacatgtaatgtgtcagacagttttaaaaaatttcggttctagttaactatatctaattacagggccttcgtacaaaaaagggtatttatatggctgagataacaggacaaacactcaggttgaagatatatttcaccccacatgcatgtactttttatctagttttaagatattttgaccttgatagttgtttaatttaaaatttggaatgcatgcatggttgccactgtaacttggttaggaacatgtacatgtgacattttgcattttttttgtttttatattttgcaggagctagtgaaaagaaagaattgtatgaaatgaaatttgccatgcaagaaacatatctgtacctagagaagtataaatttgatgtgtccctggagagaaatttgtgataagattgaatgaatattttaattattgaagcttgccagcacaacagacatgcatatgggagccgactataaacaagaaagagaaatataaacagttatgatgagttggcacattgtttgcaacatgatccatcaaataatttcctgccaccttgcatatagagaatgatatgatttattttgttcattagcataatcatacaataacttttctttatttttcatttttttaggccacctttgcaatactatacatatatgctagtttgctgtcctttcacactgaactaaaaatcatcctctataatttgtttgctcctagtgtatatatattgtaaaattgtacacaacatagatgcaggatttattggctgtcacagcttaataagtaggatcatatctataactgattaatgctgacacaacttttttgttagctgatgaagcactcaatagagtaacttatgactgaaggcaagtctccactaactatgctgagtgctatggccattcagacaagcagggtcctgatgaaggcccggccttgcaagttgcaactaatctcctctcctaatcccaacaggcaatcactcatatgcttgtggggttgtgtcatcataattcagagttcagataatcactgttagttacaacttcagtgttttggatgatcacttgcagtttgttatgactagtagtgctacatatcttcagtgctacatccacctgatcctatcaagccttaagaatacataaatacacataagcacacaagtccaaaataaatcatactatgagtaattggatgccttcaagaaaatatttctatattagcagtgtattatatataatggagattccagttgtattattatttcacacttttctgtctccaagctgtccacagtcctcttcccactgatgagagagagttgcaagaatttgcaagaagcaccaagaaagtgtacccaaagaagcatcttcagctgctctcaccagtcaccactcccatccaagagatcccagcctctactacaacagcttccaacttccaagaacccatttttttcctttcctcctcctcctcctgctctggctggctctgggctggccgtgccctcctgtcagtcctagctccagctagaatccctccttgttcatccaccaccaccatccacatgattgcatttgtgcagattcctggagaattaagctgtcctctcatgccgatctgacacaccttgttgttgttgttgctgctggttgccgcacaaccgaaaggggggattatttggccctctttctctttcctttcgcaggaagatttggtgattcttcttctgagggctcctctgtatgtgctctttcccatcccattgtgccattttttgtaggatagatctggggatgttgcagatctgatcggtaattttctttggttttcttcagaaggatttgggaggatggggaagaaggggaagtggtttggagctgtcaagaaggtgttcagccctgaatccaaggagaagaaggaggaggtaaatgattcttggggttcgtttgaataggcccttttgtttcgaatttagaaagttcaatctggattcgatcaggatttgtagttttccgtctgaattgcaaacaattctgtttttcagtgaggtctcaattgtgttgtgataaaagtttcaattttttcttgttccaattagcgatgagcacattggttctagttttggacctggttgatatcaaaatctcacttttattgttactgctttaagggaggcgctcttttggtgaccattgcacataatttcaaaatcccaaggaattttcacccatgtcatggtttcaattggcattctttaattgccattcagtaatttgagaagaatacataacatatttcctcttgaaattgattgtcttcactgatttatatgaccaaattatcatattatcttccgcaattactatgtcttactccaatttgagctgaactgcaaccacaactcaaactttgtccattgaaatgaacagagactgaggagaaaattagcagctagtaacccgaacccgccagatctaaccccttcggcttctctggaagtcaatgtttcggtgccaccccctccacctcctccacctgttcaacagattgaagaggttaaggtccctgaagttgagcaggagcaaagcaaacatgtcactgtggaggctgtacctgaggctgtccccgtacccgcacagacatcgtcattgccacctggtgtatcaagggaagagcaagctacaatcaagatccagaccgccttccgaggttacctggtaatgtgaaatagctcttgaattcagctatctgattgcattttcattacattttactcagttgtctgagaattcgtcgtggctatttatttcatcagctgctttcatttaccactgtgttggtgcaaatattacaaaggtggttgtgttgagttttttatttatgctggctgctgattaggtcattgcaatttgaggttagacgctaaaagaacagttcttgtatagttttgtgattttgtctcctcatcaacatgactgcacatgaaagcaaatgtctgctggtggccaactggccatcctgagattttttttctcttttcctgtagaaattttaggtattggcagctcaccaatcaatcaaccggtagttggctggttgctgttaatttgaagtgagactcttgattgaagtatcttaggtatttacagttcctgtattcttttcataatgttgtgtggtaaaaacaagcttctatgattcaggggtaaacttttcttgtgtgacctgtgcacctggggtaacttcaaacttatagtttggttcctctcctttgaagtagtcgttttgttgtttatttgtttctgcatatgtttgttgacatgatctacgaaaaaatcttggcaagtattagaaattagttcttgatcaactggcagttggtggaagccacctttcattactaattttgattcttaatcattttttgatgttgatggatttgttggtcaggcttattgatgccccttgtcccttcatacaaagataacatttcttgaagtcgacttagcagcagtatattctcttccttggaaaacatgatagcaaattttaaaacttgacctagcgagaagtaaaaattttgttacttctataatatattgaccatttcatcgctgcaataatgcaggcaaggagggcattacgagctctgcggggacttgtcagattgaagtcactggttgagggtaactcggttaagcgtcaagctgcaagcactctgcgttgcatgcagactctagcacgggtgcagtcgcagatacgttcaaggaggctgaaaatgtcagaggagaaccaggccctccagcgccagcttctgctgaaacaggagctggagagtttgagggtaggcaaactatctcaaaaccttgcaatctgtcgataaaatatttcctaggatactattattattagttctattgtaaataaattttgcttgatgagaactctagtatgcagttgttctacatctctcagaaaatcataaaatatcattgggagcattaaacatactctatttgtgaatcatatcagatgggggagcagtgggatgacagcactcagtctaaggaacaaattgaggcgagtcttataagcaggcaagaggctgcagtaagaagggagagggcgctcgcatatgcattttcacatcaggtagatatctgtgcttctcaatgacagatgccaatctgtactctgactcactcaaccacacatgcttaaaatgtttcgaaacttctgtcttctgcagtggaagagcacttcaaggtcagtcaacccaatgtttgtagaccctaacaacccacaatggggatggagctggttggaacgctggatggcagcaaagccttgggaggggcgtgctgggaccgacaaggagagcaaccttgaccgtgcatcagcgaagagtgcaagcttgaatcttggagagggtgagatcacaaaagccttcaaccgtaggggatccaagccagacaagtcatcaccaacaactccaaagctgacccgtccagcctcccgtcaatccccttcaactccctccgctaaagtgtcaccgatctttgcaaagaagaaatccgcgacaccgaagaatgggctctcacaggttgatgacgacgcgaagagtgtgttcagtgtccagtctgaacgaccgaggaggcacagtatagccacgtcaaccgtgcgtgacgacgagagcctcgcaagctccccatctgtgccaagctacatggctcccacaaaatctgcaagagctaagttgcgcctccaaggatctgcagtgaccgatggtgcagagacaccaccggagaaagtagcctctgttggttcagtgaagaagaagctgtccttccaagctggaatggcgccgccttctccgatgaggcggcattcgggccctcccaaggtggaggtggtgaaggacattgctgagccaccacagccagaggccttggtgatcaatggtggaagcaagtgactcatatgacaagtaccaggagggagcaatggattctgcagatatatttcatccaatgaacaaaggtttaagattatatatcagctgtatgagttgccggcattgtttttccagttataaccacattatttgctctagcagattcgcaagtaccctgccagtcgattccatttgttgtttctgtaaaactatatcgatttgtcacttgaaacctttggtgtttgtatgtaaacaagtctcttctatttatgtgagccacatatttctttttgtgaagatccctctgaagtctgaacagtgcaatcgcagtttcagagtttgttgtattgcacaaacaaagcattcctatctgtctaaagaccatcagagaaaaaaaatattcggacaagtgaaaacctaatgtcaccagatcaaagcaaaaaatcacactatattaataatcataagaaatttacatttgaagttaaaattccacaatagcaaattccatgaagttatctcattgtgtacaacaaaaatattcctctttataacaacctgatcaacatctaagttataatgctgaaatcttacattgatctacatatcatcatcaaagaacaagaagaacaaatgaaagaacgaacataaggcgcttcaaatgttcaaattcatcgctacgactggttcttcagtcaggcgtaaaagaatctcactaaactttgacctatagcaatcttcaatgctacatttgttttttagtcagcaacatcttgatgtggaagcatttattgggcaattatttgcaaatttgcagaaactgcatttccacctctcttcttcactcacaaatttaggctcccgtgctccttgccagaagctgaggacttcctgaaattgatccttgagccacctagcatcataagagaactggtattcttcaagcagggaattgtccgcttgtagctcatatctgcaccagtttagcatgtcatttgcaagagctcactacactagtgattaggcattcagtagtcaggtactacaggtcatgtgcaggctgtaaacctgtaactcatatttacctcaagagcagctgttcctgagaccgtggtagtgtatggcaggtgaccttgaaatatttcaatacatcttctaaggtctacaaagagaaaccatgtcacaagttacaactcgcaaagatactagaattataactttgtcaaaaagtagcatgagcatcctaattttagcaatcacttgctggaatgttcagtatagtatattagcactatactgctcatggaatggaatgatttcccataaacagctggtaattcaaatcagagtgcctgtacagtaacaggaaacaattcaaagtgtagaaaatttgaggcatggaattggcacctttgcattgagccccaacaatctaatgtattgcttgatatcgtctgataacaagtaaccggggtccaggtcaaaatagctgaagaaattctctgctgggaatttctcactgatcaaattgtcccatagatacttgtaacacatcacctgaagcctgccacaaaaatatcaaccagagaacgatacaaacttcacagctgcaagcttgcatcatcatagagaggcaaaacagtaaaactagtagagaactccacatactgatactacttatcatctgaattttattcttaaacagtaaggctcaccaatttaccttttcattttttctagataatgtccaatttaccttttcatacgaaataagatatatctgtctcttagatggcgcaataaatgggataccagtgctactcttttttttttttttgtaaaaggtgtacttgccaagtatcatcaacttggattaatttatccacatactgaataattgaccccagagttgcttcctaacaatactcacaagatactataatcagaatgaaaggatactaccagtctaccattacagatctaggtacaagctaaatttgtttgaaagaaaaatgttaagtatttaagtgtgctctagcaaaaaatgatctttgaaatcttctttgtaactatggtgtgattgtcaatggcactgttaatataccaatcaagcatcaaatacaactttgtataattccagatcaaagcagaagtcacttgaagggaatcaccattcaccattcattattcaagggaacacgcatttgaagctaagcttaactatgtactactacctgccaataatacttttgtggtgtctacattttgtgattaagagcaaaccttccatttcttttttgtgcttctaagggaactgttggtttgtaacgtgtctttgtatccaccaggataggatggactgaaataccatctggaggcattcggagttcatcaataacacctatcatccatgaaccttcaacgaccccaattctgcaatgacatgatatagaatcaattttactgaaagtaatgttaacgaaataaaaatgttttctatcctctgtaaatcaacaccgcagccaagatgcactactggtttggagaagtatacacataagaacatgccaggtgcttacacggggatttccctagtgatgccctccaacattaactggtttgctccgacgataaagttcatgaatttcactgcccacgattcttctgcggatctaatggtgacttcgactctctcgataacctgctccaaaatgaagtaaatcaaaaccgaaataaatcggtagttagctcccattcccaaataaaggaacaaatggttgtcttcttcagaaattgagaaaactcaatatggctatgaagctcatgataacatcaaatcaatcatacgcaatcactagaaatgtgacttaatttcagataagatcctgcatggtataacatcatgatgaacaaaacaatggcaatctcaatatggcattatcatttcagtgcatttcaaggtagaaaaatgtgaaggcagcattctgcttggaagatcccaacactgcagtgcagggctcacctcttgctcgagctgggcatggcgctcggacccggccttcatggcctgcgtcatctccggcttgccgtgctccagcacgaactcctgctgcttatcgcaccattcctgccacaagggcgcacgccgccgtcagaatcactgagaatggaagaacacaaacacaaggcgatgcagctttaccgtggcggtgatgtcggtgacggcgagcgcgcggcggtcgcggaaccgcgcgagcagagaccccctccgcggcgtcgggagaggtggggagtcctcgatgtcgccgccggaggcggccgagtaggccgcgcaggaggagagctggaccgctcggcgggcggcggcggaggagaggaccgggcgggatgctgccgcggcggcggagagcgcggcctcgatgagcgccatctcctcgtcgctgacgatctccacggggaggtctccgatctcactcgcggtggcggggggcggcgcgtcggcggcggaggagcgcatcggagtcggaggaggagatgggggtcgggtcaccaaccacacaaaaattttgaaaattttgaccactgaccgttcaaaataatcctctaaattcaaatttaaaatttaaaattgacgtcacagccatttaggcctagtactatactccctccgtttctaaatatttgacgctgttgatttttttaaaatatgtttgaccgttcgtgttattcaaaaaatttaagtaattattaattcttttcttatcatttgatttattgttatatatatatatagttttgcatatttcataaaagtttttgaataagacgaacagtcaatcatgtagtgaaaagttaacgtcaaatatttagaaacggagggaatattaattaattgatcaccgcaatccattgatcataatatgaatttcagcaacatcttctttttcttcagtctgcgaaaaactaaccgactgaatcttaccctctctgaattctgaaacatgaacggatccgaatttgcagatatttcgctgtgctcaatctcttcataagaagaaatgtggaccgaatggctcaaagcttcaattccattgttcaacacaatgcccctgcgttgtgccaactacatgaacagctctgggttcttccccatccagcaagcagcatcagatattgtcactgagggtgttcttccactccatcttgcagttgagcatgcctgtatgcataagtacatgttgaggatagtttagctgatgaccacaagaatctagagcatgactaaggtgtaccatatcaacaagctcatccatctgctgtgcctccttgagatggtttgttgcctgaaatatgaccctacattttcatcagttattgttatactttggtcagcacatgacacaatagtaatgaagtttattctgttttattatgcctcaaaccggttctggaacaaatattaattgtttgctgagtgttaacttgtgagatatatatagttttccttagctctgcatttgtgaaaatctcattcggttgaaacatgtgtcttgagggaaaaataaaggggaaaaccttttagatgcccaaaaaaaaactatgaatgtacagaaaagttgcttttgtttcttcagttttatttggatcatggtttaatgggattcagagaccaaatgcaaccattataagttataacactgaaagatcttgtggtggtggtttctgcagaagctcttcctggataccattaggctacttgcaaagtacacagagaagattatctgcagcaacactaggatgcttcacctagtgcatactggtgtgatggtgtcctctgattatctgtacaaatttgaaacaaattttcagcaatgtagttgtaattaggttttgatattcatcacacaaccggcctgcaacacaatctctcaagcatatggaggaaacatcacatatatttcttttcacaagcaatacaaatattgttccatgcaggaatttggcttgcaacatagtctgttctatctgtagaagagtatgagaaggaattcggttctgtaacacaattattctatctgtagcaaagtaagtatatgagcattctgctagtttaagaaaacatcactcataaagaagcaaacgttgattatataaataaatgtaagtctgacaaaaaaattgaggacaatgatgacaggttggaacaagttacatactgttggttttttaatcaaagctgatagtatccatcatccgactgttaccaaagatgcaaattaaggacaacaattgatggactgacttgtggagggacataaatattcaaaccaagtggctgataaataagattacaatctaaaaccatatcaaagtcagccatacatacaaagagtaaattaaccaactacacttactaacaataaatagtagtggtagtaat

SEQ ID NO: 80836 - DNA, 14431 bp, Oryza sativa
gggacgcgagacggccaggcgcgacgggcggtggcgcgtggtgaaggtggcgacagagagagggggaaagaggaggggttgggttagaggaccacgtcgaacacctggcggccgatgaatagtgtcttttcctatttaatccccattttagcctatttcttgtaaatttgattctataaatcctggattttgtataaatgaagtttactcaatatttgtgtcattctaaccaatggatttactctagattaatattactcgtattttatttatataatttatttgaatttttaattagggttaattcttattccgtcgtatttagatttaattaatacaaatatgactgcgatgatattttattcatttctatccccacctcaacctttattttaaattatatttcagttatttattttgctcatttaattttaggttttattactaattaattattctttattcgcgatcaacaaactccgaaatcaaaatccaatggaataggcgaataaaattggcatgatgcaatttatttaaaaagtttttgaaggcccatatttttagagtttagatttttgtcggtcaaattttcagggtgttacacaatagcaaactattagccagctataaatatattttaatgagataaaagatgagagagaagagcagcaggctatagatctgtagccagctgcagcacggactccaagacgcaatgtgtgtatgacaggtgggaccatatattaatcttatagcaagcaactattgtataaattagctattagatcggctatattggagctagcagtgggctatactattaaacttgctctaaacgtcccaaacacctgcggttcctaccaacgccacagcgttggtcacaccgtagaaaggcgtagaataaaacctgcgctctgtgactatggggctatgattggtcaaggtttactcgtggcttggggatcaaatgaggtgacgccgatgtgtggcatgtgatgggacttggctggcgcaaagtgcccggacagggcatgatggaagaatcatgtgaacttccggcacttgacaggctcaagcagtcaggccaacaggtacttgcctgtttagttgcccagagatgatcaatttgatacactaagtacatcactgtagaagaaaacaaatggagtagggtattttactagttctagtagtactaggatatgtatagtgctagtacggtgtgatgtgttcgtatacttcttccgtcctaaaatataaatatgattagtatagtgtcaagtcaaatatttgtaactttagctattaatagcaaaaagataaaaaagatcaaccatgtaaaattgatgttactatatttatcattaaacaaacacaatatacaactctttttatttgaaacatctcacttttatagatatcgttagtcaaagtagcatcttaaagatcatgtcgaagttaaaaaatacttatattttgggacggtgggagtagctttgaggtaaacaaagcagggtgaattattatcttaaaaaaattgaaatagaatgacaagaagaagaatattaaatcgtaccataattgttatgcacaattagctctaatgatctattttggacttgggtcaatggtcaatactgtatcatgtttgattgttaatcactatcctccatctaattttaatagtcatatttcatcttgacacacagaccaatgataattaattctacttatcatccatttaaacatgctattagtcattcatcgtaaataagcgattcattaatatttacatttctcaatgcccatgtagccaatcatgtatggaagaatggtgagtcacgcattaaatttgagaaaatcattaagaggataggttgttggattgaaatatgcctatcaaaaataaacttttcagatttagaaatatgactatcaaaagtagatggagggagtatattttaagaataaaaacaatcacaaaaatgctacgccagtataccaaacaaaatgttcatcctaatataagcaacagaccaatgggtcggtggccaaagagatcgttctcggttttgggaccaacaacaacgataaacaaccatagtaaaatcagagttttgcacacagcaaatgggtaactgccaacgcaaaagcaatccaccaaactgaacttatttagaaaaccggaccgctcgaactgcctgccccactgttgggtggagtacaactatagtcacatcatccagcaaaatctgcccaagaaaattcgctggatcatccatccattctcggctcgtgatgagcgagtacctgaaattgccttgcgcaagctcttttgacatcattatgctttcatgatttcatctacgtgcacagaaccaatcgaccaatctagtaatactagtacttgtattactccttttctccggtgatcttgcacctaacctttgatgttttaaaatggcacacataataggagagcacctactctcttttttttttcttttctgttcattcaaaatgttttggttccaagtcaattaaaacttgatcattgttaggagacctctttgtttaacaaaaactacaccattagtgaataacagggttccagaaatcaaatggtaataagatcctattgcttctctgaaaatgatagtccttccattcagtaatataagacgttgattattcaattttcattcatgtttaaaaatacattcgtatgactataattttataaccataagcgaaatagtataagaaaaatatactattaaagcttttttacagttaaaacacgttctatcttaaggatgatttattttttataagagcccctttgaatcgtagtaatgaaaaaacagaggaataggaaaaacatgggattctgacaggaatacagttgtaaaacagagaattgcaaaacacaggaaaaacacaggaatgaccgtttgattggaccacagaaaaaatgtaggaatcagatgagagagatagactcagaggaaatgttccaagatgttagacctcttgctaacttttctccaaactgtgcataggattacccattccatagcaattttaaatgattggataggattcaatcctttgtttcaaagtccttcataggatttttttcaataggattgaaatcctccaaaattcttacatttttcctacaaatcaaaggagccctgagatactggaagatcgtaagatacttcgggctcgggctctgcattgagaatacacactagacactacaaacctagtagaaatgatgatacacaagttccttggtcatacctgttgggtatagattactgtgttaaccgagacgcctatgagatactcctatcttaacttacttgcacgcttaatttactgcaacttttctccagccgagcagcaactcaaacgtacacgcgctgtgcactgggtgatcactgatcagggaccaccttaacaaagcatgtgtcattgcatgacacagacgaaaccatggccgcactatcagcaggtcagcacactgtgccaggtttatctgcagtataaaaatacgaggagaagatctggatcctgccatgaaaactgcagtaacctccaaaagatgggagaaaagagcggcactactggtgttggtgtgcgttcaaggtgcttgctagggaatcttggagctcaatttttcttctccatttttttcttcttctttcgtgcgtcccgagaaaggattggtttggttcttctttcgatggttagcaagcggttaattaactaaatccacctgatggcgaatctttttgggcatgggcatggcagagcagcgcttaatcaagttggggctttttaatgaactccaaattttattcaagtgcacagcacgtactccacttgttctacaagtagcagcatgcagctgctgccttctgctgtagatgcctgtccatttgcgagaggtgttgtgttatttgcgtcttgtttgacatcgatgttgtgtacttctgtgccatttgttggttattagttatgcaggggcctcataaaagcatgacaggcatccgttgttgtgtatgcagacgcaagcagttgcatgacaacaacttgatgctacgccttataatttgcaggaaagcgatttagttagcatcattaagccaaatggccagcttgaagctgtagcgtgctttgtggtctgctcccccaagttggatccatttgctcggtcttctggttgctgtagatgtttactctttcatgtctaatccaatccccaaggtacctatctgtatgtgacataaaaagcccttggaccttgcaacttgagacgtgcctccaagaaaaatgctggctctctacaggatacaggcctatttctactggctttgaacatgatagtagctttttctgttctgttccaattttgacatgagcttgacctcctacatgtagaactcctcgaattccttgatttggaagtgatcaagcgaacacgtacaggtgcacacgactggaccaaagcgacgaataattgagcagcgagtagagtaaggacaaggaccagtagtcaccaagcatgccgtccaactctgaccaaccaacatgaaaatctcgtcagcttctcgcacgctttccgtcacttcctgccttcgccctggaacccccaagtgccagctcgctcgcctcagtgagagaaagccaaatctcacttgggaaatttaggcagcgttcgttctgggagattagagatagattgcacatcgttttccgcatgcacgcttcccaaactattaaacgatgtgttttttgcaaaaattttctataggaaagttgcttaaaaaaatcatattagtctatttttaaaatttgaaataattaatactcaattaatcatgcactaatagctcacatcgttttgcgtatcttaccaatcttctctatcttccctttctcaaacacagccttagagagcttacatagttacagttatgagaaacacctgattaatataccttttaataatttaaaaaactactccctccgttttaggttacaagatgttttagctttggtcaaaatcaaacagttttaagtttgaccaagtttatagaagaaagtagtaacattttaacctaagacaaattattatgaaaatatatttaattattgatttgatgaaactaatttagtattataaatattactatatttgtttataaacttaatccgacttgaaatagtttaactttgaccaaagtcaagacgtcttataacctaaaatggagggagggagtagggtttttttagaggactgctacaaaacggaatcccgttgtaacgggatagacatattaactattctcttgcacgagtatcacaggtatcaggtcctaggtatcacagataccgggtaacagatatcacaggtatcgggtaccatgcagctggtaacacaataggtatcaggtattagatactgtcttatagaaagatatcccgttcccgttccaacgggatactgttgtctaggttttctggtttttttaatagctcgtagtttatattcttcaattatataactatacctttttaaatcttagactaaaagcgaaactattaagaaagtttgtaattataggagaaactgtagcgataagaggcccaggcttaacacccaccagaccaccaccaccacggaggcgtacgtcggcgtcctccgcgatggcgacgccacatttgcggcgcgggggaaagtccaagtgcaccgcgctttcggtcggcttgtgtgccgtgcgctgtgcctgcacccagccagccagccggccagcctacgacgcgggccgactcatccatcatcgacggctacctcgatacctcctcctcctcctccccgtgaagacattctccacggtcgcgccgtcgctttcgtcccttttcgcgcctccacgactccacccctgcctcgcatccattccaaatccaaccgcgtcgctcgcccgcccgcccgcctgggagccacctcggcttccttcgtagttatccgcacgcggggaatggaaagggaggccaggccaagccaccccacgacgtggcgaggcctgggtgatcgctggttggatggcagctttctccatccacatcagaggataaaaagggagagaagggttcagtttgagttgtatttggctgctcagaactgtacacacagataacatgggcatctacttctatgctgaattgcaactttgcaagactaaacaggttgtacagatgctgatgggctacatgattcatcagatcaaaaaagaaagagagagaaaggaatagatggaaaaatggctggcagataattgcaagatgaatagttggtactgcatggcctagctggaagaagggcgaccatcctatgtttgtatccttgaaattttgcgtccttgccattatcgacggagcagcggtatccatatgctttcaacattgctcagcaaggttttcttggcccacagcgctccttcccaacaaatgccgtaggaaatcagtatgcagggcatgaccagcctttgtcacagaaggaaagcttaaaattagatgtcacaaactgggttacagatatttagggatagaataaaaggtgtagaagtagaaattagcacagaagtttgcaatttgttctatacaagagaattttctttctgcagaaaggcaatatgataaggaatatcctatggcttcagataaaccttttagtgtaaggaccacatgctatagacagtacttgaaagcaagaggttgtgatgcatcagcaaaaacaaaaatgtgtatgtagtttaaacctttaaggtcacaatcagaataatgagtatttttgcaacttattatgaaacgttcacttgaacagcataacacaataataatactttttggttggtaattgatgttccctttaggaccaatggtaacttttactaagcttagaccaggttttaccaatggtcagaagtcagcatccacagtttcattgtcatgaacttcagaactcagaagctatatagctaccgttaaaatggaatgaaattaagtaattaacagaatggtctaatccagccaaagctaaaaatataggtcaatgcgattggtaaaaagaaagggtgctgcacaaacctaaaagacaacaagtacatggaattgtagaagtcaactatgagcataaccacacgtacaatttatgaaatttgacttctttcaaaaaaaaatatgcacatatgaaatttcacgaaacaaactaatctcaactctcaaccatagtagcacacccttcagttatctccaagatttagtacaagttcaagaattatttggcaaaagataaacaatcaagacaagcagttctacataactcaccactggttaatcaaatccaagcgtggaactggatgaccagtggtgaacttaaataattcaaatgatggaagacaactccagaaaaaaaaaatgatgttcaaggtgtcaacacacactagttttcagggcagggaagaaatatatagctcatagcaagtgtgactggtcccagcatcccatatttacgtaaggatcttgtatcctgtgtatttgggcatgatttcattttacgaatggttaaacatagattctcacaggcctcacaccatactagacagaaatgcccttcctagtttccatgtaaaatcagagtggcaccacctatcagacgatgctactcaggtgggaagcattagcctgagaagctagcacagaatttctgactgaaacatatacacgtgaaatcatgtcgcttaggttctcataaacagcatggcatcccagtacattaccgtaatttcctctatctttccactcattagataggcacatagattagtattcacatgtagaactggttttatacttgtagactactgggttgagattacattcactcacagctttgtcccatatgtgaacatggatattctatatgtgataactccagcatacttgctgacaattttactggaaaaatctgacatgccatctcaaagctgctatactatattaccactgacatggcatgtgctacgaacagcatcagaagataacaatgctgtagtaaattaaatttcaagaacataccttgtaggcaactacatgagcaagtggaaaaccctggttaccattctgtgcaagaagcgagaaatcaccgataagatctaaaatcttgtggcggcaaggttcatcctcaaaccgcagtggtggattaagccaaccaccagaaatactgccaatagccaatgagtatacaattatataattgaattagaacaacgtaatctgcagtttaagctgtgcaacaatttcaacgcctagccacatgagcccaacatcatcaacaggcatatctttgtaaaaatagttgcactgccactaattgaactgtacacagtatactaactttggatggtgatcatagaacacgaataaagttcactgctaagctattgtgcatagtattaagttcttttcagaaaacctgaaatatgtattcatgctaacctagacaatacaaacattaaatagaaagcactaagcaggttgacctattttttaaaataactagcaattataagatcatttgacttgttactcattcagacattgcgccagacaatatttaagaaacaacccgatatatttaagaaataaagcaacaagtggaagtccaaatttctaaatccatacaggttgggatgatgccatgatctgattattgcccaatatcaaaatccatcatgcaataagtcaacaggtatgtgcttctcagaactacgtcaaggaaaaaaaatcaccaacccacgacaaagaacacaaaattccaggatatcattcctcacctgcaaaccgtagcattttctagcgatcctcctctgatgagcccagcagaacgcaatttttcaacctataaattccataaatgcagcaaaatacaaaaatgatcttccggtcaaaattaaaaaaaaatggaagagaggataaaacaataatgtggacagcacaactagcagaaaatgtaagtacttcaaatacttaggccttacccgtgcaagattcgagaaattgctgactactccaagatatgaaaacagatgtgattgaaagatggatgatctaatgcaacatgagatcgtgacaaagtagatgaacgcgaaagcatatatggaaagttacattgccatgattcttgtaagagacaccataagttgcatgaacaaaacatagaaggcaacatccatattgtataacatcaactactgtaaaatacctcttcaaatatacagaaagttcttgctggggctatcttgcttgagtagacattagcatctaggactgttgcgaagcgctgacacccaattcctggcacctgcaacaggatgcatgctctgctcaagttctaaacatatattttgagatattttagcattgacatccaagttaaatattccaaatattataataaagacactcccttctgatagagtgattttttggacattcaacgacatggttttgaaaacacaactttgactattaatttctattacgacgtagttaagatggtaaacatataataatatgatactacctttattgacaatctgtgcattttttacctccaatatattctcataagatattgatagctgatagatagtgtttataagttactgttactcactctgttcacaaatataagcatttctaggttgtttagcagagattaaggttgaggagaaaatatttttggtgccgctcatcgaatgagggatgattgggggtgagaggattgttgagggtaagatggggataaatttgaatgaggtgattgatgggataagtagttcggtaggacttcttatatatctagaaaaatttcaaatgcttatatttgtggacaaaggcagtaggtagcatacactgtattgtcacctgagggaatagataatatgtggtttattcatgtgattcttgaaccttagaaacaaaaatcttgaggtccaaaataagggaaactttgggtaagctgacctttatttcagtgcatattaacaaaacacccattatttaaacccaattacataccaatcacatgtattgcagcataatgaagacataatcaacattacaaaaggtaagactaacttaattatcagtaatcctataagaaagttagaagaagaaatagaagcaaataagggtttaaaagaactgcataaaataaatgaatgtgcttagaagttagcatttcctgatcataaaaggaagagataaaacatacttttggaaaatcaatcccataggttatacggattcttgaggaagggagtgcagctatgaaacaatcagacttctgcaagtaaacaggctcatggatttccggagccagtttctccagtttctggccactggaatccttggccgcacattgacctgcacctcttatagccatcacccactcttgcgctgatccatcaagcaacggaatctgtcatcgctgaacagttcacataaatcgggaaggcatcatgtgcaaacatttttctcgtggcagtgcagtcgcacatcaacatctatcaagctcctcgagataccaaaagggcgccgcacctcgtcgccgccgctgacctcgacgcggcagttgtcgacgccgagcgcctccatcgcggagagcaggtgctcgaccgtgcgcacccgcgcgccgccccgccgcagcgcggtgcatagcggcgagtgcgcctcggcattcgccacctccgccgccaccctcgtctcctccccctcaacgacgaagtacctcccctcgccggctcgcgcggggagcagcgtggcggtggttttcgcccccgagtgaagccccacgcccgacctgctcaccgcagcggcgagcgtctgctgcggcaaccctgtctggtagagaaagggggattagtcagtatcggagattcagagaagtgttttgcaaaccatcttactcactggtttccaggagaaggccgcgcgggagacggagttcagggctcgggcggcggagccgcacatgacggcggcggcggcggcggcggcgaagggattcaacttctcactttctcaggtgtggggcgatctctgcggagacgggcgagcccccgatgagtatgacggtgggactaggccggcatttttctcggatccatatgtcagtactccgtcccattcggaaaaaaccggagcggggaccgacccggtgagctcgttggttcaccggtcagaccgccggttccccggttcatggctaattattttttaagtcataattgactttcatatgcttgtggcgctgcattcattgaactttcccaccaaaccaactgtgccagagatatttgttggtttgaatgaaatacctattctatttagcagtttaaagtcaattatgaagtaaaaaataattagccatgaaccggtatttaagtcatgtctagcacggttttcggtccaaccgctccggttttaagccggttcaacagaaaaccttctggttcgatgttttttaccggttcaatgtaaaatttaaaattttccatgcagctagcacggttttcggtccaaccgctccggttttaagccggttcaacagaaaacctgctggttcgacggttttgtaccggttcaaatatattgactgtcttttctgtaaaccgaaccgtgacatgcactggttccggttttccggttgaaccgttgggccggtctggtttttttactatgattccaagtgcagccatgattttccgtgcacaattttaaccgtccgtcttatttaatttttttttaaaaaaaataaaaacataagtcacatataaagtactattcatgttttatcatcttataataactagcaaaaatgcccgtgcgttgcaacgggtaaaaaaaataatccaatgacaatagacatttttcaagcgtacccatatcaatgataatgtttctatggatcgttgtagctaacacaattagaaaattagagcatctttatgtaatgacccaaactcgatgatggcaatctttttaccaatgcttgctttaactaaaataattggattattcatataacaatatacatataataaaaaaatattctttcaatattattcttgcaaccaataataggttaatcaaatcctacactcaggatcaagtctacacaaaatagtcaccgtgcactcttctctaaataacaattaaaaatatgtttatttttaatactattttcatataatatgttattaaaaaaagtctgataatgataattgcatacaaaaagtgcagggattagatgaggaaacaaatgatgtgtaggagatggaaaaatatcgatggatcttatccgacccaagcgtccatcaattttatctcgctttgagtcggacggtttctcggagcggttctttttataaacggcggtttttttctcgcattgagttggatggtttcctctattttttttcgaaatgatggtttttttctcgcattaagtcagacggttttctcgaaccttattttgaaacatcggttttttttcgcgtgttgagtccgtttgtttttttggatctgttattttataaacagtgtttcatcggttagttttttcagagcggcttttttttataaacagttttttttttcttgtgtggttttttgaaaccattttttttagaaatggtgtatttctttctgatagtttttaatagcattttttttgtttttttcagacgaaggaaaccgtatttttcccgcgcatttttttggaaattatttttttcttgcgcatttttttcctttttaacggatgatggaaacttctctttctaaaaagttagattagattgatagattagattagagttaaagagatatatacggataacaaggggcgactttaagtttggtcgggtcgttttttcctccttttctttttacggagtttgagttagatgttttttttcttttttttattacggacgagaaaacctctttttcacgagtcggacttttttttctctacaggagtcggtcctttttttttccttttttttacgacagaaggttttttagagatagatatttatttttaattaggtatttattcacgcgtgtttcccttcggatagaaactttttttttcgcactattctttccttttgtaggaagatggaaactcttttgtcgctcggaattttttttatttggaatcggacagaaactatttctgtgggtaatttttttataattaaaaacggaaatttctttaccggttttttttggatcggacaaactggtttttttcgcccggttttttttcacccggtttttttaccggtttttttggatcggacaaactggtttttttcgcccggttttttttcacccggtttttttgacggacgatggaagcacctcttattttttaagtagtagtagatagtagataaaactactaattataaaaaaatttcaaataagacggacgatcaaagctgggcaagaaaacttatggttacacttataaatgtgattggattaatcaatgtacgagaaccactgacttgttatttcttggctgtttccggcctataaaaaattctccactccactataaaaaggaaaaacttggatcacaggtatattaacagccctatggtttcgcttatactttatggttttttaatcatgatttattttacagcatttacttttttgtcgttaaaaactcgtatataaaagttttaactatcaattattttctacttgctaataaaaggtacggatgaggtgtactccctaggtcctaaaataaccacctaaaaaaactgttgtaccagccccacgttaaagcataccaaagtgcagaactggacaggttttagcacgacagagtagcaagcaaagattcaggtgctccacctgatcacatgtaagctatgataagctgttccccaacttgatcagcccaaaaaactcagcatgttacaaatgtctggagctacagaaacaatattctgaaaaaaaatagagacaatccattatatgccactgagtttgtcatagctctacgatttgccactgactttgtcacgttctataatataccatcgacttttacttaacttctatgatttaccatcgccgtccagttagtctccgttactactgtacaattttgtccaaatgaccaaaatacccctgggataaaacttccaaaatgtggacaaaaattctgaaataccatattataaacataagattgtaaacattcaaaatttgtccaaaaacttaaagtctgacatttcagaatttttatccaaaatttgaaagtttt

SEQ ID NO: 80837 - DNA, 9208 bp, Oryza sativa
ctgcatttggcagttggcgcgtcttggtttgtactatgaggttttagcatatggttcgtgatcatatacttgatacaaaatcaccatggccagtaatttttttttgccgtgtagtagagactacatagccacttaatactagttaatactgttatttgtcgtgactagcattatgtggatgttaatgcatcaacctacctgaatgtcctcgcaaaaaggtaaaagagaaccactactacctgaatgtaactgccatggccccatgcatcagcctctcaatttttctgattaaaagccggtaaatactcatatatgggctgtgtttagttcagtataaagtttgtattttagttaaaattgaagatgatgtgactgaaaaattatgtgtgtatgacaggttgatgtgatgaaaaaggactgaactttgaatataaacacagccatggagttggcatagagtaacttaaccgatagctagccgcaaggttattcttttctgttcctgagtcggccaggggaggagactgacaaaccagtggatcatggaccccgggcaatgtatgccgtgaccattcaggtttcatttctgacaattaaaacttctgaattacactgtttcgatgaactcaaatatagttatatttaaggcccgttcatcctatgaaaatggtggatgaaattttgaattaaagtggcacgcttttcaaactgctaatcggtgcgttttgtgcgaaaactttccatatgaaagttgttctaaaatattagattaatccattttcaagtttgaaataattaatcacatgccattatcacctcgttttgcgtgaaacacttaatgctcatcttcagaagattcaaacaccaccatgttaagtgttattttcattctaaaataaacaaacctactaccacagaatataacacagcctaatactacgatctagacagaaatatattatagtactagtatgtatcacatcctgtattattttagtctattttgatatggatcgagtatgtcgataatataatatatttttaaataatttaacttattgaaaaaaaaggctgtaaaagtttataaaaaatagtatttgatgacaagggtacggatgaaggatatgaatatgacgagtattgcttgcttaaaattccttgctgtaaaggtttcgttgctactgtccagaacaactgctgaaaattaaagactgcacatcatcgccctattaccctcctaggctcctacaggcgcctaccgggcaaaggaaaccaaaaactgtttcttaaggaataagacaggcaaaatatattaaacctattggagaacgactaatcgactatatgagtttgactgtttgatatttgacgtggggagcactacgaatttcggataacgttttttattttttgctgataattaaccatctgccaaattaggacaggatgatgcgattcattagcaaaatttattgctgcagtcccaccctagaacattttgcagatgttgcttgcctctattttttttttctcatcttcttctcagcctttggtcctgtttagatcccctgataaaattgtacaccctatcacatcgaatgtttgacacatgcacgaagtattaaatatagacgaaagaaataactaattacacatattgcgtgtaaattgcgagacgaatcttttaagcctaattgcgtcatgatttgacaatatagtgctacagtaaacatttgctaatgatggattaattatgcttaacttaataaattcgtcttgcggtttacatgcggattctataatttgtttgttattagactacgtttaatacttcaaacgtgtgtccgtatatcgaatatgacacgccaaaactttacacctctagatctaaacacagacttagctgaatattgtactgtacatttgcttccccctctatatatatttataaaaggtaaaaatagcaagcataaagtggtaccttcaaaaagaaaaagaaaaacgcttgccaaattgttcagtgtatagtacttctagttcggatgtctgttcagaagtcactttatacaaatactgaaatacgtgagctgtcaatcaatgctttgattactgatattgcacagcacggaacttatggcgaaataagagcttgagaacagtttcatcggtggagtagtaagttactgtagtaactaattcgtgaccagtggtaaaagaaaaacaataatccataacctggactgtttttctcattctttcctgaacagaacacaacagtggaactctgcattacattcataaaatggtaatgaaaattgcaacattttcttttgcgggatgaaacttccccgttctaaactataacaattcaagtaccctatttctaagagaagaggtacctgctgaaaatcgcttcaataaatctgcttaaaaaatctattagatatttaggttcgtagtactccctctctaaatatgaatatgggaaatgctagaatgacttacattttaaaacggagggagtactaaattgtgtctaattaatattatattttgagatgaagggtataacttttttttgcggggatggatgttgcaggtaaagatattgttttccaatgtttcttaaaggacactatgcttcatccaaaaaaggacactgtgcttaaacaaaaacatttcaatgtacaagttcggtggagacagccacaaggccacaagacaggcgtggcgctcagcattgaagaagttcatgcaccaacgttctaaaattttatatgatcagacttctactacatgattgcctagattttaaattcggtccctaattccaatttgagctaaattaagtcacgggcatatgcatgggcacacacctccatcttttattgttcttttccacacttgctttccaagccaagccaattccgttcggttcatctctttggcctcgtcgctttccaaggcagccatgcttaacctaactaagaacctccagaacgttgctgatgagaaaaaaaaaacattattactccaccgcgctcacgccaaagagatgatccaagctttgatcattcactgtagcctgcaggtcactatctgaatctctgaatttcgtaagatccactatagttaattcggtagttgaacttcggtcgaagtgggattaagcgcttcttaattattttgggccccaaagtttctctcagactctgacggctgaaaagattattacactgtcgatcgagaattcgagattgtagcgaattgacaacctgatgaagggatcgatcgatagtgaggtgtgcaatggacacaggaatggcgggccgtcggtttgttgagatggcctctctcccgtcggatactgtcggtagtagctttttgccgtgttctccgtcgccgtaagatggtgtcgtccatgtgaatgaacactgaagaatgaagatctgaagtgaccgtgtagcggttagcagtctgcagcaaacaaactgatcgtgatcggaaactgagggaggtgatgcataaatcaattcaaaatgtaaccgcgtgattttagatctcaggttggaatctgtaaatagatggatgaacagagtatctgtagtctgtacacgtataaatggcttcaggcatggaggagaggagcgatggccgatgggactcacgccgcgcggcacacggattgtggcgatgggctgagcaaagagtcacggggccccgcttcccaggtgggtcccgctctttggccgggtgggccacccacccaacgaccgtttcacgcatggcgcaccaaaacaaaaaccacacgcgtcccgtcgaacggcatacggggaggagaaaatacacgccgcggcctcgtcgtgtggacgccgaccaccggaggcgcccgtgcgtgggtcgggaccacggtacaccgagtccagcaacgttagcgaggcgcaaaaacaaagggctcccatataacgcaagctgcaagcacgcagccacgctcccattccgcctctcctccacctcgccaccaccaccctccactccctcgtcgtgacaggccggacccaccgccgacgatggacgccaccggaccaccgccgccgccgaccgcagtaggctccgacgtcgacggcggcaccggctccggcggcgcgaggacgacgaccttcttcggactgtccacgtccgccttggtggcggcgggggcggcagcgctggtcctcgtcgtcgtcctcgtggcggccggcaccgccaggctctgcgcgcggcggcggcggggcgcgaagcacctgtcgatgtcgcgcgtcgagcacgcgccctcctccggctcgctccgccaggcgtcgtcgtcgtccgctcccaaggagaaggaccacgcggaggccggggcgggcaccggcaccggcacgagctcctccgacgtggccagctcgtcggccgcggccagctacctggagtcgccggtgaggcggaagccggagaggatcagctgcgccgcggcgatggacatgggctgggggcggtggtacgacctggaggagctggaggcggcgaccggcggcttcagcgaggagaacgtggtcggcgagggaggctacggcacagtctaccgcggcgtgctcgccggcggcgaggtggtcgctgtcaagaacttgctcgatcacaagtgagtactcacagtttttgtttttttttgttcgtccttgttactgttcaccttttgtactgtagttggcacggtcaaaacgggcattataatttccagtcattccagataaaaagatggcaactgtaaaagaaaatcaacctaagcagtagcagtaatttttttttttgcacccttgttaccttattttattagagattttttcactagtttaaatatatgaatgcgtacaagtttgttgtattcggcatcatatttggattttggtctagtttggtgtacgtgatgcttttcttgattaattgcatttgttgttaatttgtcacaataagtggggtggtggttgtagttgtgttgttgatatggctttaagtatgccagttattatggtcatatcattgggaagatatgcatacatgtcgacttattagcttaaacgcaaaatctgtcctagagttaatagcaatgcatcattgtcatgtgtactattaatttctctatgggagggttttcatgaagtttgtaaagcctgcttccgaattttagcagccaatggaacgcatccatgacatatgtagtttgtcaaaatgcaacagaattttacggacctattcccctgaaagaattatttattgattactattcagcaaatgtcctagttcaaatactctggaaaaacctggggaaatttcaaggctcaaactaccggatggacggtgcttgagtggatgattgttttctagtaaaaagtgtaatcgcgcaacttatgaaagcagctgatggactgattagcaacctaacgttgttcggtggcaaattgtcaactaatagatctagtgcggttttattcctgggaagtatgaaacaactaactgatgcagaatttattttatttttatttcaaaagtacacccagtaaatattgtagagaaactcttttttgtctttgccaaaaacaaagggtaggtctttgcgagctttctttcttttttttagggggggtggggtggggggggggaatacgcaaggagcatttcttttgtattaagtgaaataaatagttatttacatgaaagaaaagagcagcaggggaccgaaacaggaacaaaaattcatagtaatatctctcacactaaattctcgcgaccaagcatccttctgaatagcagggctagacttactgggtttgtttgacgccagagcgctgcttcttccaccattcctctcgcaatgtcgatccaagccctttgttgctgattgaaaacccgattgttgcattctttccatattatccctttcttttttttctttctttctttcttttttttttgccaggcctttgaaagctttcttaaataagtgtggttcataatcttcagttgtcattttgactggccagacaaaagtcattagagaacctattttttcttgcagaaatatatagtaagcaatgcagaggttcttgcaccctgaacttgcattatatataagtatgactatggtagtaccgatgtcctaggtttctgcgaattattgatgaatttcttacattgtactaaatcaagaagctcatgtgaaccagtcaattctgttcagattaatgtccatagagaaatactgctacttttaagtcaatgttgcaaagaatagttattttttcttttcttcctttctagttctctgcttcatttttttccgattcatgtgcctgtgatatcagttggtggctctttttgtgcttttgtgtgatggatagtatatatccatctacttagttggtagagctcgttggcagtcatatgcaccgatctatcctttctttcaagaaaagataaagcaagagaaagccaaagcgatgagccgatgaccatgcttttccttttctgatcctagacataggcaagaaaatttatagggttattagctttgacgcagttttagtttagctttcaagtaaatcaagtgcacgcacgaggattggctcagggacagcaacagtatgtttgttttttctctgccaacgccaaatgtgaaatggatcagtgagatttctatgcaaatggtttataatgagcagcaagagaagttgatgaattataggtttattatatcacgtacggataatcatgtctgaagaaattagggatgcctgctgatctggaattaaactgtcctttttcaggggtcaagcagagaaggaattcaaggtggaggtagaggcgatcggcaaggtgaggcacaagcatctggttggtctcgttggttactgcgcggaagggcccaaacggtaagtgatgccaccagctctgaatcctcgatgagttctgagcattaataattcagcagaagtgaaaacgggggacaatgcagcgatgcaaataatcaatgccatcatcactccgtgctcacaggatgctcgtgtacgagttcgtcgagaacggcaacctggagcagtggctgcacggcgacgttggcccggtcagcccgctgacatgggacattcggatgaagatcgccgtcggaacggccaaagggtgatgaccggtgtcgatttgccctgaatttccatctctcgctcttccgtatcggcaggtgactgatctgacattgtggatgctgatattgtccattgcagaatagcgtacctgcacgaaggcctggagcccaaagttgtgcaccgagacatcaagtcgagcaacatcctcctggacaagaagtggaaccccaaggtatccgacttcgggatggccaaggtgctcggctccggatccagctacgtgaccacccgtgtcatgggcacgttcgggtatgtacacgcacacgtcgtgacacacgctcactgtctcaccgccgctccgttgttgatctgcaattttttgtatacttcgctagctatgtcgcgcctgagtacgcttcgacgggcatgctgaacgagagcagcgacatctacagcttcggcgtgctgctgatggagctcatctccgggaagagacccgtggactacagcaagtctgtcggcgaggtgatcgatctatgtcacagcagatgggggtgcgtcagtcaatctggcatttgtaggtggctgacatatattgtgttggagcgcgccgtgcaggtgaacttggtggagtggttcaaggggatggtggggagcaggcgggtggagcagctggtcgacccgcggatcgaggatccgccgggggcgagggcgctgaacagggtgctgctggtgtgcctccgttgcatcgactccgacgcgcacaagcggcccaagatggggcagatcgtgcacatgctcgaaggcgacgagttccccttccgcacggtaagtgtgtccacgtgtgagtgacggggctcctctaacatacgtaaaagagacgtgtctatgggttcatggggtgaacccacctgttaacgacttatgagtatgtttggatagcttttagctgcggtggcttctcgcagaatcaaaagttttctcagacagtccagcttttgatccagattatgagaagctgtagttatagaatacagaaaatgaactagaagccagaagctgagaaacccagcttttccagattcttagaaactggctttcaaccagctgcttcttaaaattttaagatcgctaagcaggccctacatctctctaactttatgttcgaagagctgcttcagatgcgctaatggcgcaagtcatatactccacttgattgcgagctaaaggcagctgcatcttgcaggagcaccggacgccgagggcgacgcaccggacgtcgccaaacaacacgcggccgttgctcatgtcggagaaggtcggagccgatgatttggacaggtcgatgtggcgatgatgatgatgagcagctgacatttttctccctcgacacacacggtgtacattttttggttcgtttaacgcgcccggccgggatccagcgtttgataatgttgttgcttttgggggggggggggggggggtttaaattgtgtttggcgtaatgtataagtgacacgatgttttaaaaaggcaatgtcgtccctgaccaaacgttgatacgctccctacgcgactgatggcttcgtgttgatctggccggggacggttgagtggttttcgtcgtggcatgtggcggtgctctgctacgcatttacagtgcaagtgctttactccattgtctcaaaaaaaaattacctcctaaactatcgcggcgaccgaattacccccataaacctaaaaaccagacattgcttactcagaactttcaataccggacgaattaccccctcgacctaatctaggagcagttttatcctacgtggcgtatgcgtggtaatccggtcaatattttatttattaaaaaaatatgagacccacctgtcattctcctcttcccctcttcctttatctcttcacacacacacacactctctctcatggggcggcacgtaggggcaggagctggtcggcggcgcggggacgggcggtgcggcaggcgcaggcagtcggcacagacagggcgctcatggcggcacgcgcggtggcgg

SEQ ID NO: 80838 - DNA, 8950 bp, Oryza sativa
cgtgccgcaccgtgagagagagagagagagagtgtgtgtgtgtgtgtgaagagataaaggaagaggggaaaataagtatgacaggtgggtcctatattttttttaataaataaaatgctgactggattgccacgtgtacgccacataggacaaaaccactttggattaggttgaagggggtaattcgtccggtattgaaagttcagtgtgagcaatgcctggtttttgggtttatggggtaattcggtcgatcgcgatagttcagggggtaattcatattttttctactttttcttaaatctaaacataggctatcaaattaaaaaatacaaaaaaaagtcaaatcagtgttagaaactgaattgggccgcagatggcatgggatggccacatgtcaagtgaagcccatgcaagcacactgaacaacaaatacaaactcttaatttcccataaaaacaaacctaagacaagttaagacacatcataatagttcatccgttttttaatatatgacgccgttgattttttacatatgtttgaccaattcgtcttattcaaaaacttatgtaattatcattattttattgtgattaaattttttgtcaaatgttctctaagtatgacttactctttttatatttgtacaaaagaatccaaataagatgaatgtttaaacgtttgtcaaaaatataacggggtcatatattaaaaaataaagatgaatgtttaaacatttgtcaaaaaaaagaacggggtcatatactaaaaaacgaatgtagtactatgaatttgtactgttcggattttttataatccggattttagtttagaatatatcgcatctcatcctaagtttgttttttaaggacggagggagttgcgcttggtagggcatcgaaaaaatagaacgccagaatgactacgacgataactttgaggccggttcagctcctcgtcgatcttcttccctacatctcatcttccctacttgttctacaaactcgccgtatcttctagccttgtatcctaaactattttcctcttcaggtacaccaaatatatgtgattttcattgttattagaattagagaaaaagttgctaacaagtacatgcatggtcctaaatgtttaaagcgaggtcacatttaggtccagaatattgtaaatacaatatttagatactttttaatgtattatagtaggtccagtgcacgtctgattgtgttcgacagccgacgtggctatccaccatgcctacacatatgtagttagccccctctatggcgggggggggggggggtgagggggggtaatgcgcgactagtcgcacggctcccccggcgcgcgactactctgtacgtatgttaacaatcaaatttggtaatatctgcatcggaaagaagattggattgaagcggaatcaaacatgagaattatcgcggaaacagagtaagaatcggctgaggtttggatcggctaagtccgagtcagactgggttaagtgatacaaccgattccgacaatacaacttgtatccgatatcgggtttgagttgacgtacttcaagatgattgccatacatggatagagtcctgggaaggcgattaattgtatctattaattaagatattttatgtaaattccttagagataaatatgggtaaaagtctgccgcaaagacttatggtatcttagagtttgttagagataatagtcgtgtccggtatgggcatatcttgtaattctcgggtataaatagaccccgagccctatgtaattttaaacacacgttcaatacaatttcggcgcatcgccaccctttcgctttaattttattttgacaagttcttgctttcgtgttgagctgcatcggtttcgatcttcgacaagaggtaaaacttgttatgacggcttacgttctcgagattcgtcgagttatcatatatcttacataatctttgacaatatcgttatctaacctactatcgactaacatctgttagtagaaggcagccgattaggttaaattttgacgttgatttagattatataagatatctaccactctatgaaactcccagcggcttgattgtctagatattgttcttcttttcgtacttaatgctgcatcagttgagtttgatctattaagtcgtgcttagaatcggagtttcagccgatcttatctgatttaactatatttgctctatatgtttcattgacacgttaaatctgccctttatgtcaaaatattattgcatctaattatattaagcttctgtttagtatattctgcctgttttaacatcttaacatagagtcgtataggagtattagccattatatgctagatctatctgatcggctatgctatgaacatatataatcctgttattaatgtatatttcgatctaagtgatttatacggtctcggcatggcgaccgaatctatcccaatcacttgatttaagtatgtatcgatataaaaattatatattgttaatatctacagccgatcgaatagatttagttctttattacctatttgcaaccgccgatcgatttacatatgacatcggctcagagataaatgatacgtcatcggcacttagccgatcggctatcatttataggtttaaactgcggtttctttatatttatttcttgttgattgcaggatcaaatcaactggcacgctagcatacccgaagacgagttttggacctacactggaattaagcagatctcccaggcctcgtgtttttcgtcatcaacgtactagtactagtctattacaagtagtactactacactaatgttataataatactaatattattactatatatatatatatatatatatatatatatatatatatatatatatatatatatatatatatatatatatatatatatatatattatatttatatatttttgatgtataaaaaatatacacatacaaagtttatatacgtgtcgtatataaagtttgtatacacgtatacaaagtttgcatgcgcgtacacaaagtttgcatacacgtacacaaagtttgtatgaatgtatacaaacttttttataggtatacgtaaatgctaaaaaaccgaaaagaaaaaaacggaaagaaaaccgcaaaaaactgaaaagaaaaaaaaagcaaaaacagaaaaaaaaaccaacagaaaaaactgtaggccccacctctacgcatgcgctgtcgtgtggccccctccgcgcgcgccacgtgcctcgccgcgcggggaggcacgtggcgcggctgaaataaggtcagtgtcctacaaccaaaaaaattaccataattttcgtgtgtagtcaaacaaagtcaacttttttatgatatccttcaataaatatcatatttcttcgagtgtcatgtagtaaatagtttagaaaacaagatacgtatacttatcctgcactcattttcgacctaaaattgcagccattggttcaacacacacacacgagtgcttttggctaaaatttcataaaagtattaattttaagaaataacattaacagttgtcctctggccctgcatttcatcaatattaactctaataaaacacataaatatcaatcttcatcctaaaacaaatgaatgaatacttagggtttgttggcacacttttcaaacatcagtgtgtttcgtgcaaaaaagttataatattagagttactttaaaaaatgaaacagaatctttttaaaataattaatacttaattaattatgctaatcacttttgtttgcatgcagctaagggcagtcccaatctctacctaggattgtatctatgacatttactatattgctatatagaacttttagtttatgtggtactatattaattaagagagagtgaagagaggaagaaattgggtcccatgcaagacacagcttcaacacaagaacctacgcactagatgctatcaagttttgagagaagtgtctttataatagatgaagaataaatatgattggtagagaagagagatgatgtatttattaatggccaaatttaaaaaaccatggattgtagagacattatatacacagtttataaatactatggattgggactaccctaatcagttgtttccgacctctatttccaacctctatatggtagaacgggccctaacctcgattgttcttgtttccaatctctctaaaacgggccctaacctcgatttaaaacaggcccttaatcaacctaggcatgcagtcgaactcatattcgtaatttattactagcattttcgatcgaataactcatactagtaagtactccatttgtcttggcccacctacatttgcatttaagcttgcggcccaaataacatgagtattacgtttaagggtatgttcacttttgatgtcattttcaatcttaccaaattttaataaaattatcaaaaaaaaaatatttatatttaatttaatgccaaattttagtaactatataacaaatcctaccaaaattttaaaattttagcatgttacaaaaattttaaaattttagcattaccaaattttggcaagatttttgtttcatcaaatgaacaggaccttatattgagaacagaactgcacgggcatgatcactttgatgtaattttcaaccttactaaattttgataaatttactataaaaaaagtggctacatttagtttgctgccaaattttggtaactatataaaaaatcccaaaaatttgactaagttcccaaaattttggcattggttggtaaggttttttttaaaacttactatatatataaaatagctacatttagtttgctgccaaattttgataactatataagaaatcccaaaaatttaacaagttccaaaaaaaattttggcattggttggtaagtttttttttagcataaagtaaacaagccctgcaacttaccaactgttaaaaattaaatcaatacaagtacctattaacgagtatatcaatacaagtacctattaacgagtataatcttcacctaatgtagaccatttaaaataataaggaaaacagacttgccaagcacaaatgatatttggatttgggcctctaaccgcacaaatcccagtacaattggatttgggcctctaacctttaacaggaccttggtggaattgaaccaccttccatccgtaaccggagagcgtaagcccaacaatcaacggaggatctcccgaactgagaaaagatccacattaccgccaattaagcgaactgagattttcgtatgtaacgtccataactattttgtctaatggtccgatgttgtattacaagttggattttttttccctcaaagtaacaaattttataaaccatttcaaataatatatatattagttaaccaaatatgataagatttaagagtattttgaattgaaccgtttacctcagtttgtgcgtgcacttctttaaacagaaccaaaacatcctaaacacactacacaactctgaaaaaacaaaacaatactcgagtgatttttaccaaaacaatagagcccttcaaaatttgacttggtgttttctgccctacaaaagacttcatcagcttacttttagctcattattaactacataataaactcaaatcaaacataaccttgtgaaaaacgtcagctaatatagtagtgtaactcatcgtgtaaaataaaaacgagtgtcttatccttttggtataacatgtagccgccatgctgtttacacgacccaaattacagccatttacctccggattgacctcaagaaaacaaaccttccgcagcagagacggaactgttatccagaacctccatggtgctcaactctcaccgaagaaatttataatgatacatctggcaattagtccaaacaaggttggcaccccagacttcaaagctgcaacagcttaatccagcataccggaaagtcggtccaacaataaccatgaaaattgatgagcaccaacaattaccaacattagacaagtcattcctgaagcaccatgtaatgagcacaggtgatcacagcaaaacatcatcatcttgcttcagatgtcaagcttcagatgtcaagatcccagacggccacctcaaccaagtttgattcgcaagaatactcctttcttcgggtgacttcaggttgaacttgtcttcaggtcaccttaaaacgacgagagaatgctacaatttctacatagtacaaactatgatgaatagacaaatgctaaataactttttgcttcaagaacataaattctcgtacttcaacgtacagaaactaacataatgctaaggaggacaacatatgatcatattctacagcttgcaaaagaggttacattgctgactatccaagaaaagaaattctcacagtgcaaatatataaaacattactagccttctcgtacatgcataaatacagaaagggcaaagtgaaagagctgagcggttaaatcatacacaattagttgatattaaggcgcaggagcgctgtaaattctgggcaagaacaagagcttatttcacttaaattggacaagagttctccaatcgtatgctggaaacatcataatagtatttgaccaacataacatacttccaaactgatagttgacagttcggagtatagctgagcacataatctcggaagcaaatattaccactacaccgacttatggatatatttaagtatacaaagcaagtactagatattcgttagaacaattgcgtagtattccagctgctcttaaaccaattaccaagcgtaactttaatcaacttgagtcaatatgtgagatgcacttctagggatgataatactgctgtttatcagggatattaattggcaatgataataataattaagtaattcaagcaatttaaagtaaatccaggaatattatgtgactagggatattttaaggcagtgataattatgaaacgctgaatgatatggaaatttgattacgactaatattgcacatgtagattatcttttgtaccttggttgttgcgctgtagctccacgtttagattcacgcgcgatcgttgaacgatgtagtcgcagtgggatctgaggacaaccaggggacaacgggacacaagattggggggagaacccggggctaaacaaaataacccccgtgcgaactccccccaggacacaaaaagatcatctttattacggtggcctgccatgcgagcgcacccaacatggcaaaggccaatcttgcgatgtcacatctctcgtttttttttcgtctctttttcttttgaccctcagacacaagcacctcgcttgttacatgttctcttaccttgccgccttcatctcagcacacggctccctcgaacaacatctcttagatctaataattatcgaaagttcatcgaataattatcaatacaaagagacatcatcgcgcgaggccccgatggagaggatccaggcgacgaccagcctcctccctcgccccgccgcttcatccacgccagctcgtacggagcatgccccaaccggacctctaagaggtcagatctacacgcgacaacacaaagaaatccacagatcagcacgcggttgcgacatattcaggaaacaagccatgcaagtaaatcgaaacgaaacatctaagcgacacggatgctgaactcaccggctccagatctgactcgccgaacgcgaggacgagcagcagcagcagcttccgccgatagatccatggccgccgaaggatgagcaagtccatccaagatctgaaacctgcgcaacagaaaaaacaaacgcgtgttgtccatataaagggagggaaaacctcaccgttccggcatcggaggcgacggattcgacccggaatcaaacggaagtcctaccatggaagggattcggggtggcgaaattctagttctgggaggaggagatggggaaagcggctagggttgcttggctacggtgggtggtggagaggcgaaacagaggaagcaaggtatttatggtctggtcagacgcagcggacggtccggatgaggcggttgtgctcggacggccaggatgcgaggcacgtggcgcggcgccattggctgagacagctggatcgcacaaggacaccgcaacttgcggggtatttgacgtcactgcgtgcgtcatctgcttaaccggatcgtttgcgggagcgaacacgaggatgcggtttgtggccgacggtattggggatcctgattggctgcgacgcgtattctagatctgagctatttaggccatgtagcccaattttaggccttttagcccaaatgataatcacgaggtgttctataggccttttagcccaattttcactacagttggtcattgtatttgttggtggaataagtttatgttttctccctcctgtctagccattggtcgaatcgcatccctcactagcaaaacggggtataatgcctcccatttccgaaaaccgatacaaatcaactccttaagtggttttgtaaacgtttttgtcctatatgcgcttaggtggcattgtagatagaaaaaaataatggcagtgggtcccatatgttagtgaagcattcatcctcctccctctttttccacatcccaagccagcaattctggcgagctcacaccaccatgatcatgccgcagccaccacgaatcaagcatcaccctcgccgccacccaatttcttcagcgccaccattgctaatggcggcttgtagcgcccgttccgtcgtggtgcctagcgggaaaactatctcttaaaaactctatttgcgaaatatgtttctttgcttgctgtctagtgtccgtgccatctcagatctcaaatccccgatctatcgccgagttcaatcccgaatcccaatccttcccaaatcaatccctccgcaaaagtctatttggcctccctcgggttcga

SEQ ID NO: 80839 - DNA, 19260 bp, Oryza sativa
ggcccatctccccctccctccccggctctctctctctctctctctttctcgttctctctctctccctcttctccgctctgtcagcgcgccgcgcgcgtgtgcgcgtgagccgcgccgagccgagccctccctctccgctccctcgctgccgcttcccgcgcgccgttgttcgcgtgcgcgcgcccgcgtggtcgccgcccgtgccgcgcctgcgccgtctgcgccgcccggccccactgcctgcggcgcagccgctcggccccgtgagccagcacgcgtgcccaagccgcgccgctcaaatcgccgcgccgcccgttgcttcccgcgcgcacgtgccgtggtggccgaccgcctggtcgccgccgccgtcagcctctgccgcgcctgcccgcgcctgtcgcccgtgtcgccgctttgctccacaccgtccccgccgtcatcgccgtcgtcatcgcccggcccccgccactccacgcgctagcctccaagggacggaggcagagctcctcctccctctgccgcgtcgcccccgctcccctcctccttttcccaaagaggcaaggggcaagccccctttctctccctccttttcccctttttctcccgccggcgtcatcctccctccgccctgtcgccgatttggccgctagccggagcgccagctcgctggcttgaccgtccaaagtcggttcccctctcccaaaccgacattgccatcctataaagcccaggcgccctccctctcttctcctctcgttgtcccatcgcctccactccattgtcgccgcctcccgtgctctgtacgccgtcgccgtttgtcgtcgcgcgtgtcggaggagccggcacgagcgaggacgcggaaggggactccgggcgcgccctcttcttcctcttcctcggcccgaggccgaaacgatcacgtttcgcgccgtcggctctcgtcactgcgcccgcccgcacggtagcgcatctccccgttctccctcttcgctccatctcctccccttagactcgggtagtagcatgagtagcctccccgtagctagccggcgccgccccgacggttgccgtcgctcgccgtgtgctcgccaccgtcgtcgcccgagctcggaagcgccgctcgtcgccggcctcgctcggcgccgctccgcccaatccaacgctagcatcggattcccgtagccgcgtagatgctctcgccgccgggaatcggcccctcgtgacctcgtcaccgtttcccccttcttccgccgccggttgccaccgccgcaatccgccgccgtcgagcatcccccggcaaatccgagccgttggctcgactcccctcgtcccgtgcaacttcccggtgtgctcgctttcgcctagatcaccgtgtttcgctccgccgctcgccaccgccgtccgccgtccgttccggccggcgtcttcttcaacctcccgccggcccgcgtggctgccacgtaggcgccacgtcggcgccagctcggccaagaccgggtcgagccgaccccggtcagccgctccctccggccccgctcgcgggcgcggtccaccgcgaaccacgcgcatgcaccgcgccccgctccacaccctagcgccgcgccgcgtgctccctccgcacggtgagccaagccgctgacaagctggtcccaccccggaccacgcgagatggactcggtccaccggcgccctctctctcccctccccgcgccctattgggccgtgtcctcttgggccggccggcccatttagctcggccgagccgccccttttctctcgggccgcgccctagccgcccgagggaagtctacttcccctccctctaccttttctttttccaaaagggtttaattaaatcatttttcctttagaccaaaaatccaataatcttataaattcaatatcttcccaaccgtaagtccgtttgactccgttcaacttccaaaattcctcaaatctcgagatctatctaatggcacgcttagaggtcattaataggactttattttcgccgtttgttgagtcgtcccgttttgcgtgtagtttcggagcccgaagacccgcagtgcgaggatttcgatgatcaagctcaagatctcgagcaaggcaagccacctttgaacatcttgagcctatatttgaacttaattatgttgcttgaaaaatattatgcattgataggatcgcacttaatctgtttgtcccgtctgcaaggcagattggcggacctacctagtttgttgcatttgatccttcctttgtcaattgttataccatattcacttgtaaccacccagttgcgcctcggaaatcgtgcactctgcacgagtatcgacggtcgccttcaaacttaaaatctgaaaaacaacttgggtaaaacttgggttttacaaaagacttggaaaacccgacacctgggtcggtgcttgcgaactaaatgaatttccaaaaccgcggaccggggatcgtaccgggtgtacggtttctcgctcttgcacttaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgccttgtgaaattgctgttgtggaaaggggttcaatgtttggaaaatctgcagctgatgggatcagctaggcccgggtggccgtttgaaagttgttggcccgggtggccgtttgaaagttgttggccgggtgccaatcttgaacaattttaaagactgatacattgcacatactccgaccggacgagacgcactgtctcatccgtgtcgtttgagaagcactcacttagttgttttcagaaaagagttcaaataaaatcaattgcaaaaacaacagcctttcgttgaagcctgcattaaacacttatttcccatggcttgctgagtactcccgtactcacccttgctctatataaataatcccccccagttgctgaagaagatgaagcggatcccgctgacgaggagttcttccaggagcaagccggctacgatgagttttagggtttcggcctagttcccaagtcgcgcctgtgttgcttggtccaagtcttggcttccgcttccctttgtaatgcagttgtgagctcgggatctgtccgcagcccagcatgactgtacctctactctataataaagaactttgttgctgtgatattctgtcttcctgtgataccagcactgtttcctgggactggtatcgattaacaggttaatttagagtgtcacgggctagttccggtcgggactagtttggggcgtgacacggctgctttcgaccacaacgctccccttgccacacgcgttgttgtcacaaccttgaggagctcccaccgtcgcctgagggaccaccttcctcagctccaactcaccaccattgccgcccccccccccccacttgcacaagtggatgttttcgtggaggggggcaacggcggcgatgcgtcgaaggatatagatgagagagggccggcttggggatagcaagtgcctcctcgagctcccgtgccatcgtggcctatgatgtccttgctttatcgacctcccgcagcgcaatagcctccttcggcagcaacgttttcgtggtcctgtcacgtccatctgcagcagcttgtccctgctagtcccgccacatccatgcgtcacatatggatggacggcctttgcccctctccctcctcctcacacgtacgtcactcgacgaagatgatcacgacaccaaagagctagagaggaggcatggctgacgcatgactactaaagtccatcctctctttgggggcatgggtaggtggatctgtcatggataggaggtggagaccaaggtgtgggggcgcggcaaggcggatccatctccgccaacctgtccctctcctcctcttcgcaggcgttgatgcccgtcagtctgtccccggaccatggagaagaagcgataccaaagagagagaaaatggtaaagggaaagaagtgagactgacatgtgaggcccactgtcattttttttctatctagaataacacctaagtgccacgtatgacgaaaaccgctttagaaaactacttgagaagtcaatttgcaccggtttccggagataaggacgctacccggttttgtggttgagggatgatattcgaccaaaggcaagagataagggacgcagagacttattcttttcatggccgtgtcatttgggcctttagcccatcttgatttaattttgtcgaacattaatcgttgcttcaagatctgcaaactctttcagttcaacaaataaaagatgtttgtcatgccaaactttgtattacttgaaatgggccgtgggccggccttattccaactcactgctggactcatcatttatttttttgtttatagaaagaatactaaaataaaccatatgttaccgtatttattttaagaaccatagattaccttataatataaaataagaaatatttattatgtgaaataaattataaactttgatatactaattgataatatctattatattcaaacaaatttcactttgtcatggctatacataaagtcgcatatcaccatctttcgtaaacatacaggttaatatgggtttagatttttttcttttactatacatctaagtcacctacgtatattcatgggtaatattcgaaggaataattcatattgtcaaaattatttgtgctaattttgtcaacactatttagatgagaatgacatacttatataaggatataataggtttccatgcgacattttttattgtacgtatgtattttttttgtattttttttgtgaatagtactgcgcatattcgtaggatggttgtgcacatatttatatgagtgtctatgatttcgttttagatcattagttaaaaaaatattttaaaaaagttttgtgggatggcatgaagcgatgccacggtggcatgactttttcgataacatcgtaaagagtttcactatatatatgcataatttgaggaaaactttagtgctgcaaagaaagaaacaaaaaaacaaccagacggagcagatcatatatacattcttcttttttttttcctttttgacatctcttgtataggtacgtacatagggagagattagttggtttttagctcgaatatatccaatataatggttgaaaataatggatctaccagttgaagtgtaaattgatgaccagatattttcttttttatatttttccttatactttttttctaatttatgagatctattacgtgatatattaagggttcttgtagaagtgtagaattctattgcttatactgacaatatacttgtaatcgattattatttgctgtggcttggtggcatgctttactttacctatcatttgttgatagttctccacttagcatagtccgttatatatggtgcttcatgacataagtgctcgttggatggtagctaattattaggtgcactatgaatgaatacctcgtaagcaatatgacttgacgattagttgatagaatttatatacttatggataagtggtggcatatgattatatattaggatatttttttattcataaagtatattatatactacacattaaacattttagtaaataagcaataagttctagagtacttatcagattggttgctccttgttttcccagttatctacccattgatataggaattattacaaaagacatatcttttgataataatatctaaatccatctgaaccattttatgcactataattaaattgacaaccataacctacatcgtatatatttaaaagcaacttgtgtataattaaaatatattttatataaaagtttaaaaattaaataaatctattttggctttattatattcaatatttaattaatcttgcactaatgatatgtgtcgtttcatgtatcctgaataagctcagccatccagctacagccatccagctagatcaaatgaagcataagtagaagataaagtagatcagtatggtgtgaaaagaatatatacaatctttgatatttaaatattatacgaatagagaaaacacattcatgataaatttagtgatatcagtttgacatatcattattttttataaggagtaggtaacttttgagaattgctagtcacaattagaattgtttttattttaaaaaatgcaagtctaatttaactattacataatatatactttaattaattttttcttctcattggtgtttcgatgacatatatgtgcctatatttttacaacgtaagtagagcatagttaatatgggcagtttggttttctatccgagtgaaaaaaaaagaaaataaaaagatgtcgttagcccggcctgcttatgtacatatgtacgtacttttttaccttggaatatatgtacgtaccttttttttttggaatacctactaaacgtccgtacttatgtgcacatgcacataaagattggcaatattgggttttggagataattttaattggtatgttttacaatagatctaatggttgaaaatcatgggtaatatacgatggaataatatgtaatgttaataattagcatattattatatagatgggaatgatataattaagaagatataatatggttacatgcgacattttatgaatgtgggaaatactaaaatgacttacattgtaaaacaaaggaagtattatttgttgtggcttggtggtatcaattcttacctatcatttgttgatggtttctcacttagaattgtccattatcagtacttgataacacactgcatattagatgtcatctaattattaggtgcattaagcacggatgcctcataagtaattaatatgacttgataattggtggatagtggtttgtatatgaaacttatacacataggaattagtagggatatatgattgatatatttagctctattcctaattgacaaaatatattatatactatatattttatagtaaatttaaggttgagttctaaaatcttatcggattggctactccctttatggtgagatgtttcctgaaatgattcatgttttcagatactttctatgcaaagtttttttaaaatatcaaataaaaccatattcaagtttgtaatatttaatagttaattaatcttacgctgacgacatgcttttttttcgcgtgtcctagataagctcatctaatgaggtagaccgaatgaagcctaagagataaaaaaaatacatccacatggtgtaaaaaatatataatcgttaattttccaaaaatatatgaataaaggaacatataatatatgaaaatatattcatgataatttaataatgtcatttgggcatatcaatattatacagtagggagtgagtaaatttttagaacgctgctcataatttaaattctttttattttttgaaaatataagtccaataatttaactatgttattaagagatatacaatcatataatctacaattttaatttattaatatttttaatggatgttttgatgcgatgcactatttagaataaaacttgaaatagcatatatttttacaactttaatttaacatagtttttcatctaatctaccatatattaaatgaaaatcgatggctaatattttcttagaatttctataatttattagatcgccacatggcggcgtaggagcgtttctaggggtcctatgtggcggcttaggagggtttctaggaagtttaatggacttttagtatataatagatagatagataatagataatagatatattactactatcttactatatcctttcctgatcacatctacacatagcacaaactgccaccaaaaaaaaggaaaacgaaaacgaaaacgtgtacatgcatcctgtactttcctagatatttccttttgattttatatatccaacaattaggtcaaaaggctcttcttttttttctttccttttttttactcctgctcatcatcctgtgcaattctatgaaccctaatgggaaggcccttggggaagtcgacgaaggggaagacgaaggcttggtccggctcggcgagctcccacctgaagttgagcaccaggtggtgcaagaacacggccatctccagcttcgcgagctccgacccggcgcacagccgcgtcccgccgccgtacggcatgaagctgctgctctgagccaagccgccggatgatccgctactctgcaatcgaacaaaagaagaacacttgtgtgtcaacaattcgaagcgaagttatcgtatcagcagtagtaattattgttttttttttcgcgtcatggaatgatcgattggctgcagtttttgcgcagcagattatcttgctcaatctcctgcaggataatccggacacatgtctttttcgcggctgcatgcagacgagcagataatctcgtcggcgttggcaactacaccacacacagatccattgttcgatcgatcgatcgagcatacatacacacatgcgtcgttcacccctcaacaactaatgtccgtgagtcgcagcggataagaatggagatgtgatggatggactgcagggctccaatcgtccactgattggttcggtttgatccgcttgcgatttggaccaacgctcctggatttttctcgcacgaatgcataatccatcacggcgtcgccgcctaatcccccgttccattaccgcacatgcacctcggttttcaccactgactttgtgtgatgagaagagaaaacaattcgtgggaacaccattgactagctagcacgcaacacggcgaaatgagaaagcacatgcgcgcgcgagcgagcgagctgagctgagcattcactttcatatcaggttcagtgattcaccatgcatgttcctatcgcggagcttgcctctctgcatgattgctgctcgaggcaagcacgcgtttagcctgtgctgcttttgcagattctgacatgatccccttcgcttatgattgacagacactgcccaacagcgacatccgcgcttgtcccagtattttcttttccttgaatcccagcaattaaaccgagattaatagattagattcactgataatcctactgcgactgaccttccatctccagggattgaagcgctgggggtcctcgtacagggacgagtccagatgcaccgcggctaacaccggcaggatcttccatccgcttggaatgtcataaccttcagttcagttcagttcagttcagttcagttagcttctgctgtcagatagaggagaggtcgattcagggaagaagagtgaaatcgagctactcacccttgtagtgcacgtccttgatgaccttccggtgcaggaacctgaccacgtttcctagccgcaacgtctcgtttatgacctgcaataaggacccaaacaaaagaaatatcagtgccaagtactgtatatttcttttttcatgttttgtttcctgaatgcaagttctgttttgggtctgctttgaacgcaagtactacaatctacagtactgcagcgactaaactatcctgctgactaagacccataattacatcacatacatgcatgcaacttattctcgatcggtaggcgacaattgtcgagcaactcatctgaatttctaaggcctcaaattactctgctcctttatctgataccaccacacacatatactgcaactgactggaatggtatttcggcatgttctgctctgccgtctgaacagcaatgcagaagattcagataccttcttgggggcaggccgtgctactggaagcctacaacaacaggtacttgtcatggcatttggatcgttgcaagacgatgggcctcaccctgtagaaacttccaaggcgaaagaacctcagctggctagcttacaaggcagaacagatcgactctatcgatcaatgcacacatgcgtgcgccttcttagctcgatcgatccaaactgaagagagggagcgtaagtactgtagtacgtggcccggcaattatttcgcagagctttcagtctccattcgtacatgacatttcgggaagttgctatctctctacgcaagtgaccaaacaaaacagcaagagctacgctagcacaaagcctttgcaccgatttatattagtagcgtttagggaggagggatcggaaggaacaaagtagggggggccttacacattgcgtgaaaaccatctctttgtagtcttcccagctcaatttgcactcccctcttagcctttgtctccttgcaatcccaagatgctcctcctgcatgtcacgcgtcagtgtgagtgtaactaatcgattcccatgtcatttctgatgccttcgctttctgcaattgttgctctacagttaaacgtagcactgagctagtgacagtagatgttaatttcgaatctgtaattctctgtaccctcagttcttggacagccttggggcagccttcaaggaagaagatggcgagggcgagcgccatggacgacgtctcgtgcccggcgaagagcaagctcagcaagaggtccaggatttgctcttttgaaaggttagattgtttcagagcccatccgagaagatcgtcttgctctacgcttgcatcctccttgctcagcttctcaacccgctcttccattttcctctctattactccgagaatggcagcacgcgactgcaggggaacagtaaaaatacacagtaaacatcatggaactaatgtcgacatagaacagaaaaaaataagctcacggtgaaaagttccttcttatcaggaaaagaaaaaaaatatgtgggacacctatcaaattcagatatggtgttgcctaaccgcctactagtctaggattatgtctcttgtcatagctttctgttttgaagagaaaaaatgtcgtttcctttcgatatagaaaagacacatattgtgtcgaccttcaaatgagagagaggtgttcttcagctgggtagctaccccttttcttttccaagtgcgctgtatgtataattcattcttaaacatccatgttggcagtgtttagttataggcctgcagggtacttgaaacttaacacacggataacaacattctcgacaaagtataatttccgggtctacactaattaactaagagtgcacacaaccatatttacggagactaggattaatttgaccgtactgggtgagataatgcactcagaactccacaactataccaatgatgtttccttgtatattcctcggcactgaacataagatagataattaatccaactcatctggcatttcatgagacatgcaaattaatgtgttatagtgttagcagctgtgatcagtgatcacagtttatttttgttagccaattagtggaagaatctcctatggtgtattgccatttgacttggatcactgatgtgtgggcctgataagtgtgagacctagctacatgttattcacttaaagttaaaggatagtactgcagagatctatttcccaattaaggagaacgctcagtaggagtactgcagtgtctcttcagctaataaaactacaagcaccctttcattaactaattaaaaccaaactgtgaaggttgctggctaatcatccgcttaacgaaattaatgtggttcgggtgtgtggcaaagagtttggtcagcggttgaatcatgataaatgatagattccccagcatataatcatgccaaattatgaaggttggtcatttactttccaacagattaaaaattccacctgccaggttgcatgctgttgagcacagcacagggtgtgtgtatcggagagagatcgtgaaagctagcagcatgcatgctgaggcaatcaataaagatcatttgagtgtgacctcacatgcagtaaaaagtaggcaacattttatgctcacatgagtgatgatcagtacgtccccagggaaaaagaaagaaaagaatctgcatgatcgatcagtccccaggatgcatactcagaagaagtaccaatgcatggttttttgagttaactatatataggttttggctcatgtttggaagataataaatatattcatatgacctctgctagaatttcaccttaagcaactgcctttgagaaaaaaaaaaaaactggacctggcctaaaagacatactgctagcatgcatgcacgcacctttcaatcaacattttttagctttctatattgccaaatagctatggtctattgctagtatgcagtttcaatcctatgttgattatctcaaaggcaagataatttgtccgaacaaatcgtactaaaagacccgctgtgcgagctgaccgattggacctgatctcgatatggatcactaattcactatgctagtatagaactagctgcaacaattcctggaccatccacaattctaaacacatacaccttgtatatgcccctacatatatataataagtgcactgccgtcatgtatatatatctaatgatgggccatgcatatatatgatatatcatgcatgcggactagctacacacaaaaccaccaaacaaaaattaaagaaactaaacctggccctctctagccaattcctttctctaaactcttttccccccgtgtgcataccaaacaaaacattgacagggaagtcatcgtcactcctacacaaatatatagtatatatattcacttatcactcacaagtcgcaaatcatctctctctcctctccaatataaatatgatccccttgcgtacatctcgatcgtcgtagtaacttgttttctctttagataatgaaaacaacaaaaatggtttacatctctaacctctgtcaacagggacctgcacatgatcgtcgttgcaagttgtttgctttagctaagctgggtatagtagtatatgcctatatgcagctgcttatagtatgcatacggaataggggaagaaaggaacctggccggccggtcataactcatatgtaaagtactctctcctcctaaaaaaggcaacatagacaaagatatgatgtaatctaggacaatgaatttggatatactcctgtatagattcgttgttctaggttacatcatattacttgtctaggtcgttttttttttgaaacggaaggagtaaaactcatgcgcgcacgactttgcgcgcgtacggccggggcgcagggtgtgtgtaggcagagagggacatcgatcgatcgatcaatccgcacgggtggggtggtagctagctacttcctccgtttcgaaatatttgacaccgttgactttttagcaaatgtttgaccgttcgtcttatttaaaaacttttgtgagatatgtaaaattatatgcctacataaaaatatatttaacaatgaatcaaatgataggaaaataattaataattacttaatttttttaaataaaacgaacggtcaaatatgtgataaaaagtcaacggcgtcaaacatttcgaaacggagggagtagctagtagctacgagtacgtaccttgagagccttccagtagggcgtcccgggcaggttgagcggcgcggagaccacgcccttcatgaaggtgatgtactcccgccgcagccgctccgtctcttcctcccccgggtccatgctcattatgttcttcgccatcaggttgaacgtgaactgcacgcacgcacgcaaacgcgcgtttcattgatattgatcgctagagcgagctgattgatatatgcatgctcaacttaatggaggacgatgtgtgttgtaccttcttggcttggtgctgagcggagaaggtggaggaagggggccaggcgcggaggacgaggagggtgtggcgctcgacctcggggaggaggacggcgcggaggcggacggaggagaggaagttgagggagatggcgcgcatctcgcggtgcgggtccccgacgaggaccagcatggaccacttgcccaggatgccgccgatgctgcgcgggtagctgcactcgaacagcctcccctcgttctgcaggatgtaccggttgagccccgcgtccgccgacaccaccgtccgctccccgaacaggctcgaccggtatatcttcccgtacctgcatgcacgcacgcacgcaaccgcacgccaccccccagctcgccgtcagcctattattaccgatcgatcgatatcctagctactagctaagcttgcttcacggcgaggcgagcagtgcgcgtgcttatatagctgtgtgcgtgtaccgagtaatgaaaccaccgaccgtgcgatgtgctgctccatgaagcggccgacggaggtggcggggtgggcgcggaggtagccgaacgtctcgccgacgagcggccacccggcggcgccgggcggcaggttcatccgcttcctcttcgccggcgtcgtcccacctcgccaccagtgcccgccgtggcatttggccacggtggtggtgtagaacgtgagcagggcaaggaggatgaaggggagaaagaagagcagctcgctggttatggacgccatcatggcggccatcagcctgcaagcaagctagctatacaccgatcgagatgcccgccgactgccggccagttgctctctcttcttctactacaaaatttatttatttttccctcttgctcgccaaattacaagagtatcctccacgcctctgagtctgcaaaaacctttctgctggctgctttgcgcaaagaagagaatttggtagctaggagaggaaggtgtgcccacttcacctcgctctctgctgtggacatggggtactcttatataagtttttgaggcgtgagacaggaagaagaaggatgtggttgttgcgaggattcttttgctataattcaatttttggtgtggcgcaagcatgcaggggaggaggagtggggctcctgctagtagtaatagctactggagtagtggtattttttttcccgctctacttgccatacaatggaatactataatgcatatattcatgccaagatatataatacatacaactatagtactagagattagtgaataattaacaaactattctaccgttctgatcctgactaatgacagggtctgcacaggaggcgcctcttgttcagttaaaattggcaggatgtggatgtgagaagctggttatgtttttatttgtcacatgcatctttttttgagatcaggataatataaaaggtaaactttctttcaaaaattatatatatatatatatatatataagttagactagcaaagtcttttattacagtttagtatagagatcacctggatatagaagaaataaagcaatgctccactggttaaacaacttgtaatctgtctcataggaatcaatgggcaagttaggtctcctgcggatactatagtgctaggttttcatacttgcacgcttcttaaaattccacctttgtatcaaatttcaattggcgctaatttcatgggctggttagcggacatgcatgttgcaaattactccatactgttgtagtgtgttgtacatactctgcagtctgcacccttaaaaatagaatatctagtagtatagtgtactaatataatgcaacaacaggtcagatgctaattgtgttttattcttatacagttgaggatgtgaacatacataattagtcaagccaagacagtacaaacctatgttgcatataacatctaattaatgaagacatagcacttcccctgctgtgcagacggctgcaaaatcggaatcatccaacagataatgacagctctactggatcagagtctaattgattgctagtttgccgctactccgtggctctgtgtgtattgctggaaatccaaagatggttgctgcggctacagcagcgccgtcatgccagctctgctccatgtccatcgcctctacgaggcagagcttgacctttgctgctgttatatgacacctgaagatccaaacttacccctacaagtatttgatatttagaacaagatttaatcaaaaatttcaactttgaccaccagtagtttctcaaatgctagatttaaaaacataaatggaacactgaaaattaccatcataatattataactcattagccgccgtagtattttttttccttcctagctacttttttgttttgctttttcttccttcccctagcataaaccggtctggctgattatgttgtgtataaaaaaaatttcgctctaatatattgacgtgcaattcttttgcgcgttcgtgaaaaagattttacaatcattttcaaatataaaactgattgtcgaagttcaaatgtttaatcaaaccttgtcctaaacattaattttttgcaagacttttggctcttgaatataatgtgaattgttatatatgaaagagtctacaaacaaataacataaaatgtagtgatatagaccacttcacaaagaaaatgttcactgcctaacttgaatttaaaaactacaaattcaactatgagtagtgcaggtactgtccattacattttttttcccttgatgcgtggatcaagttcaattaggacttgaaatttttgggatgatggatgtaaattgttctagtgttttcaattactagtatgttgggaagaactattcattatgtggtagtatttgagaagtgggggacatccttaatgattagaggactttctctaagatgaccagcttcttaatttacaaaagagttgcacctgaattatgtatttctaaatagaagaaaaacaccactagttaatgtattggtgaaacatgcatattcatatcatgatgctctgtcaaggtcttgaactttttattagtatactgatttatcatttgagttgaaagctagccagcatcgatctgatttgttttagaaaacagagcatgaacagtattcttagtgcttccagcttgttaacggaatctaatggctctcatcaaaactgattggtcccgttcatccacgaacggcatgagattccgtagcactgacaatcaattcttggtagcctgatcaatggcactggcagagagatggcccctgcgccatgaggaagcatggaacagaaatgatcaaaaggaagggtctggatccagatttccagataggccagcatcattgttaatttggtgccatggaaagatgattagggtgatgtttacagataacttttttatatgtatgctgcataattcgtggctgttgctgcggtcccatgtaattatggtgtgatgcacctttaatttatggacagaggcctggaggttgcgaaatagtatctgttgcacgccctgcccctcatttagtcgatgttcactcaattgttatgcgtatggatcgtatgcgtccttgtggtagtactcctacctcttaagaaaaaaaaatgtaatcatacggccatctgttgtctatgcataatttagctgggcagtgattactaaatcgctaaataaaacgacaaaaaaaaatagacgatggctcatagataaaatccaaagagtaaattgcatccacggtgcatcaacttgacaggtgggtgtaatttggtgcaataacatgagaaatgaacattccaatgtaacaacttggtaagtaggtgtaatttaatataaaaaatttataagtgatcgtataaatgcaacaacttacaagttaggtatgattttgatataacaaattaaaaggttatgtgacaacttaattatttgcaacattatatatatataaattcatttttaagaacttattttgacaatatactagcgcggatttgtataagtatatttatatttttatcctaataactaatagctgaaaatcaattaaactggatgtagaaattattatatttcgattgataattgagaaggtgaagaaaaaaaaatcttaaaggtaattggatgtaaattgtactactatgtgcagtataattcataaatattaaattcaatataaggtaatatccgtatgattactatgtaatggcatgttgacatcgtaaaaaaactcacctaagatatacttagccaagttaatacaacaaaatactaaattgttaagttattgtactagaacgcacctgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtattttgggagatctgtgtatgaaggagctacaaagtatcagccagcctctcccttgttctgggtttctaatctggaaaagtccagtcccctcccccatctcagtgggcaaggtcctccttttatatcttaaggggataccacatgcaccatttctctcttttttgtggggacttaccccaccttttcataaacagacggagacttgtatggttgctgtccgaatgaccttctgatgagacgggccacaactacctccacttccgccggaagcaggcgcgacgtggaatcgtggctgtctgctgacgacatgaccggtatcagaccagtcacgtcggtcattcttgtccaccacgtgtcagcttagcaacctacatgctcacccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgttgccacctaacccgcgatctgaccggtctgtgactggtcacagaccggataaacgagtgcactgcactgcgttacatacggcgtgacacgctcagcccaaccgcaataaatg

SEQ ID NO: 80840 - DNA, 11854 bp, Oryza sativa
atttgagttcttaaatgatggttgtaggttcctggtgtcaaacctgatgatgttattggcacactagctgtcagcagtgtatctgcaggctacaaggtaataaaactttctactgtgattatttgtgaacattttattcatgaattgttcttcaatattctcaatggatatttcataagtatctctcttcatgaatcgttctccagtgccgtctttaatctttcacatcatttacaaaagttagtacttataaactgctgaggtgttatagattcactgaaactgtttttatttgttttgaaatgattgatattttgtaaaagttgattcataactaacttttccaattgcacatgacaaaactgaatgtctggaattaagtcataggtatgttgaattttgtaacaaaaatgcaagaaatacagtgtaactaaaatgtgatgccgttgcagtgtgttggatatgatatcttattgtgtactctggtccttatttgaaggtacggattgtctcccctgataaagacttcttccaaattctttcaccttctttacgtttgctgaggattgctcctcgtggttctgggtaagtgtacttggttttttttgcctttcttgcatgcttactggaatactctaatagctaatcgtttttatttggacatggaggatggtttcatttggagttgaagactttgtcaagagatatggagcactgaaaccatcacagtttgttgacgttgttgcgctttctggagataaagccgacaatataccaggtaccctttatttctattgtgccttatgctacacatctgttctgacatccattcttctttcagactaatttttgttggtagctatgaaaactatgagagaaaggatactaaactttggtctgcattgggttgtatttatttatttatttctcgcaataaattcttgtgcttggctacctttgtttttcttgtccaatatctttcatttcagctctaaaacagaaaaatggaccacagttgcacacgattttgatgtgtcaaagtatttttaagttgataatgtgatagaaaataaagttcatacactgtatataatgtgcttgccgaagaaaatggtggttgcatgatctatagacatagtgatttcattttggttcttctacctatttatttattatttattatgtgctgtaatcttactgtttgataaaaaccttaaatcaactcatcaaatatgttatggaccctatgaagtctactgtcccccatctttttaaggggaaaaacatgattctcatgtctgaaaattatttcatgttatgatatatgtttgtacgttaccaacacttcaccagtgcaatgcagattcgtaagctaattttctatatatggtagtctatcgaccaagttgtttatgatgtgaccggaaccatgttctttttcaggagttgaagggattggagatattaatgcggtaaaactgataactaagtttggtatgttcttctctttaaagtttttttttagattgtcgccttggtgcgaaccactcgagctaaacacattctgttctaataaaggactgcttgtatacactcaaactactcaagattgaaaagttcatgatttccctgtgatcaatctacctgtttagtcttggttattaagttctactcccctaaaaaatataagtagtttttagctttctcaagtctttcctaaatgtaagtcatcctaaacttctagccaccttttactcctccctttcttccgtgaataattcacattattcaatgtggtataagtaaagggtaacaaggtcgtttgatgtactttattatccctgtacataaatctagaataacttatatttggaatccaagtattctatgttttgagtttggaaatagtgggcatattagctgtcctgataatcctgcaattctccaaaagttataactttgtcattttattggtactcacataggttccttggagaatctgttgaaatctgtggatgaagttgaggaagaacgaattaaacaggtatcattcttaatattatacattagatgagatatcccctcttcgcatttatcagcatgcacttatgcacagaaatgccaagatacagaaactgggttgcatgacgcttttgtttcactagaacagcgcaatacaatgaccccattaaatggcattgatattttaccctttagtataatatgattatcttcttgaatgttgattgcacatactctcttgtcaaatatatcattttttatcttatgacttctcaaatggttgagcaaatcatatttggtgtggtcctttacaggctttgatatctcaatctgaacaagcaatgctttgcaaaagcctggtaatcttttttttatgttgctcaaaagtcctttctattgtcttgatgaatcatgaaatgcaatcatcttccatattatattgtgagattctatctcaaccagactcttctcattgaatttacacttcttgtaggccacattacgttctgaccttccatcctatatggttccttttaagacatcggatcttgtgtttcagaagccaaaggtagcaattgtagcatcatatatttatgaaaacaactaaaccattactaaagtttgtccctctgattcctgcttacactgttattcttgcccgcaatgcttcttcaggatgatggagccaaattcataaaactcttgcgagctttggaagcatatgcagaaggctcgtcagcagacctaatcataagaagagccgcctatctttggaacaaacttaactcatgactatgctgatgtttccagcagtgacaacatacgaacttttcaagcacaaaagttccacctgagaagataggtgccttggtgctatgtttctgtcaaatttggtgcgagcggctcgctgtgctttctggcacaaaaggtggacggtgcatgtttagacaggctgtgcataccatgaaactgataattagttagttttgtagataaaagcacgtcatggctcatgcaatctacagaacatgatattttttacactctaatgaatggtggctgctggctggaaggtggaagaatggcatgtaggtacctgaaagcttaatcattcgattatgtgcaacttcgtagaaatattatctagtgacatgtcactattcatatgcacaatgataccaagttggtcacaaaagtatgtggagtacgtgtcttttcctcttagcaggtgacgggtacctagtacgtatactcccttcgtctcagaaaaaaaggcaaaccctgaattttcgtgtccaactttgactgtccgtctcatatgaaatttttttataattcgtattttcattgttgttagatgataaaacatgattaatattttatgcgtgacttgtctttttaatttttttcataattttttcaaataagacggacggtcaaacgttagacacggcaacccgggtttgtctttttttttggacggagggagtgtacctacgcagccatctacttgcggactaaagtcaccaggcaaagcaacactccaagccaaacaagccgacgcacggcggcgtcagctcgccgcgaaaccgcgcctgcggggatgtagcacgagctggtctgcggcacctgctgcccctgcgtcgtccccggcacgccggccgccgtcacacagtaccccgtcggcgtcatccctctgctcggctgcggcgtgttctgcaaaaaccaaaaaaagacatggagatcagatcagggacgtccattccattcgatccaaagactgcaggcagaatcggtaggcaacgagcatcgatgaaacctgcaccgtaactggagtaacggtggccggagccgccgtgccgggagcggcggcgagcccgatgtcgtagttcgccgtgaggtcagtccggtagaggccgaacgaccgctcggactccggcccacccttgaggtcctcgtcgtagagcgcgaagaggtacgtgtccaccgatttgcctggcgtccgcggcgtgccgacctgcgacttgaggtgcgcgacgaggttgccgttgtacgccctggcgttgtccaccgtggcgccgccctcgtcggcgtcgcccttgtacggccacccggtctcggcgatgacgatgtccacgccgctgtaccccttggcgtccagcgccgcgcggatggcgtccagctgcgcgtcgaacatgttggtgtaggtgagccctgacccggcgtcgacgcgccccgggttcggctggaacaggcagaacgccagcgtctccggccgcgtgtcggaggcgtaggcgaagtacgggtacgggttgatcatgaacggcgcgccgttctgcttcaggaagtccagcaccgggtccaggctcccggcgaggtcggcgtggaacgcgcccgacgacggcgggtccgacgacgagagcaccgccatggaatgcacggtcgagatctgctagtcaaccgcaaactcgttcaagaaaccaccgcgatgcgtacgtagagatgctgtgatgagatacgtgccttggtggttgagccggcggggagcgcggcgaggaggttctgcatggcggggaggagctgcggcgcgagggtgggatcgccggagttgagcagctcgttgccgacggagatggcggagacgggcaccgtggtcgggatgttcgcggcagcccaggccgacgctgccgccggggaggacgcgaggttggggacgtcgccgttcgggacgccgaggaggatggagatgttggagcccgcgagcgcggcgacgaggtccggctggggctcgtagaggcggaccttgccgatggacgtcgacttcagcaggttggccgtcgacgccggcggcgggaggttgtcggctatcgtcccatagttcactccgatgaacgactgcgacgctgcaaatatcaatcaaactcgcatgagaaatccaagtttacaaaatttcagcaaaattcatttcacatacaaattcacatggccaacgctgtcgcaaacttcgtacgcgcagcatctgctaataattacttaattgtcacgttaagcatatggcagtggtgagagcacacgcaaacgtactacctccagagcagtagttggatagcaacaggacgagctgcgttgtacagctttggcctctttggggcagccattatctgtcaaatgctgccgggcgtgaagcgtgatcattgttcctctttgtttggccaatggcgagagctgttgcctgttggtcaagttcgaattattctcccccaaaataaagcctccaactattctagcggccgttaggtgatggatcttgcgcccacgagtgttggctcctatgctttggatatttgatttggtatttgctagattccttgaccaacccttttggtgtactcaatgcgaatcgttggtaaaagtcacctcaccaggccaatgtaaattgagcatggttcatatgcagctagcgcagattacagttcatgccaagttgctctgttctttttttctttttcaaaaaaaaggaagagtcaacttcgggtctctgcaatgtttagctacaaagtcaacagccatagcacaacggcttcttaccatttctaccgtttgagaataaagcgttgaaaaagtctgattaatcctataaagtatggaacaaccgggtaaattatctcccaaaagtatgaaattggttcaaataacctgtagagtggttttggccaccgggaccacgacgaacacacagtgacatgaggatgtaattgattaaatgcatttttactcctaactatagcggcttaggaaagaagtaacgtgatcggagaaagttagtgattgaactattcggctgaaattggttaacgtgtctgtcatgcaaacaataccactcggtcgcatcaccgcctaaaagaacacttacaaaccatcctcacatgtttctttagaaaataaaaaaaacttccaaacaactttgatatgttgtttttttggaacacggtataaacgtaaatattcatacacatgcgtgcacttatctctataaacatatatatatatatatatatatatatatatatatatatatatatatatatatatatatatatatatatatatatatatatatatatacacacacacacacacacacatacacacacacctaatatcatatctctttaactagcttaaaagtacctcccagaaactatagaatactttatgtggaacgcttttcgtactttaggggcacaataaccgatttcatacgttatgtagactgataagtgctttaggtattaaataaagagttttctctaacaaacaatatatggtgttctgtataattaaccgtcgcttttgaatgcaatcccaaaataattcctctctttatctaggcgttgggaatatgatcaggagtcgtggcagagaaactccatttctctccccactttgcccctcgtgttggcgaaatctcaatttctcggagcaaaaaagtaagatctcatcaaatcctccccacctatttattagaaaaaaaaatgtgccatcaatcgccatcttctttgctcaccattccggaagctagaaaaggttcggtaactcggcacgaatgagtaacctgcatccgtaaaaacgacgcagaatttcgtcctaccacttcgctgaactgactaaagtattctagtgcagtacgctaattcgaggaacaaagaatcacaacgaaagtgaagccattgttccactattccaaaaccgaactaagctaaccagttaataagcatccagcgagcgaaacatgatctgaagatgattcggtgataccatttcatctatctatctaccaacaaaatgcaaaaacgaaatcaaaactttcaccgcgataagaaacaacaaggtagcatgtcaatgatgtacaagaagcaacgaatcactggcacaattcgcaggagacagcttgagtgagaaagaagcgctctagcgcggaaagaacttacttgccaagtggaagaggagcgcttgcagcagcccagaggtgacagcagcatccagccacctcctcgcccccatgccaccactgccagccaagctactagcaacaagaatcctactgcttgatgcaatctcgccgcagcttctcagatgttcgagtccaattatggctactacttgggatcagtgaaatggtcgaagactcaaaggagctcgagtggcaaactggcaatgggagaggcaaagaagaagacaaggaggaaagaggccaggaaggaggaggaggaggcgagtcgtcgatgcagtctttggcccccttgcttgctgcgtaaaataagaggagagaaagcggcggggcgcgaggtgacaccgtggggtcggcagcacaggacagggacgacgacgacgacaagggttgtgtgcgggagaagccgcggtcaccgtcgcctcgcctcctttctcgcggtgcctgcctctgaccgcacgtctacacgcgcggcgcggcccgccaatgcgttttttcccctctcctttggtgcgtcaactcgccgagaaatacagccccggcatataagaggaaaaagcgaaacggtagtatttacaaatgaaaaataatttgtaaataaacttttatatacgtgttcttaacgatctaaaagcaaaggctaaaaaataagcaacaataaaaaaaatcccaaaataaactctaaatttaaagttgaaaatttaaattttagctgataagcacaagcataaagataatggtgataagcaggtgagccgtaagacttgtttagaggagattctgatagctacaatttttttttaaatcatcgcataacataattttctctagaccgtctaaattttcacttagacttttagaatttatagttgtagaaaaaaataaaatagaagatagaagctagagaacccatttttttctcaccagttagtttaatcataagctttaagaataaaaccgcagtgtggatcggcacagcgaatagtggctttgatcagggaagggaacggaggcgatacatcgttctcggttctcgggtgtacttgcttctatctttttcgtgaacgcgtaaaaaatgtgcatgtcaatatatcgtcgcgaggatggcccgtgacgagtatgtggctgtgcggttgtgccgtgagcctgactcgcgagagcagatcagcgtcgtacctggaattttggtttcgggaggtgatgggattttgctgtctgtcaacaatctgtcatggacgttaagcaggattgcatgagcgagcgagtggcgaatatgggcgagtcgtgttgtggcgcggaaacagccacacgggtggttatcgtcgtaattaatgggtatactaatcaccggtgctcatctccaattattaagccgctggcgctcgctgagtgaggtaaagcgattccatatgccataatgccacccggatcgtgatggggatgatggcaaatatgggaagaaaacagcgtttcacctcttgttcatcattgccccggttaattgcagtagtatgcacaagaagctttgacctgtgctgctgacaacctcgtatgagtgcgaatgctctcctcctcgtcggtggttactggcccgttgctctatcacaagttcacaactcacaaattaaacacaccatcgtccacaaggcagagcaaggctaccaggccaccgtgtccacgcgcggctgggtcccctttgtcacggacgcccgcggtacccacggcccacggccacgggggatcggctgcctggccatggtggacttgggcgtcctcgaattcggctgagttaagtggcagtgtctgtgaagagcatctttttcatccttgaaaaagtaacatgaggtaccaatctaatctaaccattgatttagcagggatatgatcagtctaataaaaacagatgtcctctcttcgtcgtccctgcccatccgtcgccgccgtgcatccagcccgccgccgtccccctcgagctagccgccacgccgctgctctcccgacgtttttttctctcgtgaaacagaaaatgacataaattccctcccacccatagtaccacttcaatgagaaggtacggtaccatgaggtacggacgatttctgaccgttggatgatgccagatcaatgatcaagatttggtactccataacctcaataacagtaaaaaacctcttctgtgaaattttcggggacatgggcaattggccaaatggctggctggatgactgaagccggaccgagtaggtctctgtccgttctccgagcctgcgttgacgtgttgcgtggctgtagctgtagtttaggcgatctgtttgctcggattatcgagatggcaaaatgggaaccatggtcaggccagagtcggcgtgtctcgcggcagcatccgaaaatatagagcacttcaagcactactggagaaatgatctttaccaggtcgaggaaaaaccacaattgtcccggttcataaaaaacagggactaaaaataatttttagtccggtttataagttcaatgggaagatttgatctatcaaccgggactaaagatggcaaagatggtgttggacgacacgtggctgcgccatctttagtcccggttggtgttttgtcccagttattttaaccgggagtaaagatggacatctttagttccggattcgccgtcagtttccaaccgacgttaaagatgggttccagcagtgaagcgttaaagatgggttccagcagtgaaggcaaactaggcaaagtgtgtactatggagtgatcacacgcgcaaatagcaagtgtgtggatatgtgattcacgtttatacgtaagtaatttaagcattacgcgctgacatcccatgtgtaggtatgtatatatatactcagggtaggcgacttcagacagaaactgtcaggggcaatgtacaagttgtaaatagacacatgtggttcatgatggctgagggttttgtttcctaaataaaatagggagctgagaactgtttgtatcgggctaataagagcatctccaacagtctctacatctcactcttcaagttaaattttaataattctaataaaaaaacatgctccaacaacctctccaaccggatggctaagccatccgactgaccaaaacccttcctccactagccaaatttagccactctatttggctgaccaatggtgggccccacacatccagtcttctctatccccacacggcaaccaatgaggaggcacaagaggagcatgaggaggaggcatggggaggagctcgagcacggcagccgccggcccccgctcgtcgcgaccgccgacctccgcactcgccgtcgtcatcatgtcgcgcgtgcctatatctcgtcgtcgccgccttccacctctcgcgcacctggatctcgtcggcgccaccttccacctcgccgcgcctggatctcgtcgtcgttaccatacacctcgcgcgtgcccggatatctcgtcgtcatcgcctctcgcccgcccggatcctcgtcgttgttgcctcctgcctcatgcgggcggatccccgtcgccgtcgccccccgcctcacgtgcgctggcgtcctcgcttcagagagggccagtaaggagctcgaggatgggccgatggggttgccctagcgggaaaagaggaagcaaggaagaaaagaggaagaagggcggtggaggctgacatgtgggttccattgtcatagactcaggatgaaaagtacaaatggagagtctattggagcgaggaactagtttgacttgctaaatcagataaagagttggctatatgggtgtttggagagccggattttagtagtctgttggagatgctataaggtcgacaggtcgttcatcaagtcttgcacccaatgttcatgtgaattcagtcaaaaatgtgtactcacaagtcacaacgtgctatcggaaggcattagtgtatcctctgaaactgcgtagtacgtgctctcgtgcaagcaatcatgcatagcatagtgttttcaggtgtaggtgaagtaaaggagtaaaggactcattctcatgctaatacaaagatcgtcagacctctcgaaattagatcacatttatagaaaaaactacaacgacatctacaatctcaaattagtttcatcaaaattcaccataatataaagtatatcttgatggtatattttatttggtattatagatattaattatttttctattaacttgttcaaagttaaagaactttgactaaaaataaaatcaaaacaccttataatacgaaatcaaaggagtatttttcagctacttcaacgtacggattattaacatggatcatttgctccataactctaaagatatgtttccttagaaaccttcttctattgcattgtttagatcatttattttaacctatttttaggtcttttttctcaagacatttgatttcttcctataatcaaatacgcaaaatctatttcgagaggcatctcgatttatacttaacgagcgacgcggacaattgcgtgagaagtactagtagcgttacagacatgcatgcaagtagtttttgctattaggttgtccatattttttttcttatgaaattttctcttaaattacttattcgatctataatccgattacaccgttgtgttcataacaattaaatctttacaacaagatctcacatgattatattttgatgaaaaatcacaaattacttttatgatatgtctaaattacttttagatttcactaagttacttcttagacatacaaaagtaaattcagtaaagcctagaagtaatttacatatattatagaagtaacttagaaca

SEQ ID NO: 80841 - DNA, 14646 bp, Oryza sativa
attcctgcagccctgtctcgttaaaattcgaagttttttttttctaacaaaacgatcattttcgtatttttttccatgttttgtttttacatgtgcttcttaaaatcccgcgtttcgttggtactgcattccttttcaattcagtttgttaactggaattccttttcttttagtagaaccaattgttgtgggatttaataaacaacgagaggtgctgaagcgatactagcatgtgaagatataaaaagattttgtgctgctttcttttttccaattcagtttgtttactggaatttcccctttcttttagacaccaattattgtgagatttaaacaagaggagaggtggtgaaacgatactaagccattgtttagttccaaactttttatttaaacctttaactttttcatcacatcaaaacttttttttttacacataaacttctaacttttccgtcacatcgttttaattttaacaaaacttccaattttggtgtgaactgcccctgtttagttccaaagttttttttccaaacttccaattttccatcacattaaacctttcatacacacacaactttactatcacatcgtaccaattttaattaaacttttaaactttagtctaaactaaacacagccctaaacacaccctaggaagataattgaccctgagcacacgaagcgtgtggacgaggaaggtcctcacgtttcggatcgggacgaggcactcactcacacatatccttactcatactagttgtccgtgactgggacgggtgtatacattaaaaaaaaccccaagtacgggtgggccccacggctgcggccccctcttcactcctattgggcccaaggtccccgaaagcgaaacggaccatttccagtaccccccggtgtggttcaccggcggtagccggtcgccgcccacctccaccctttcccaacacggaagggaggctccgatgagggcctcatacgaggtcatgtaaacgggtaggtttaaggtttaccacatctggcaagcctagctagctagctagtcttcccaattccttttgttttcccttttttataattttatttacttttaccatgctgttcaaggtggttttcttggagtcccattggatcctttgctactattgtatgtttctttttccttggtgggccccacatggcaggatggttttttatctttgcctgcagctgctgttgtgtcctgtgtgacctgtggtcgtttttggagctgtgtatttgtatggttcctgtcagcttgcttctgctatcttcttctatcgcctttttccgtcgttgagagattcatgcctatcctccttggcctcctgtagctgccatccacacgatctctcaaaatgccatgcgcactatatgctgtgccgagttttatatttgttctgtgtctacgtcaacctcgaccacattagctatagcagcgagtagtttgaaagaaaatgtgaatctggagacggtattctgtctgcaccacacgaattttattttctgttttcttttttccttttcttttgttcattggggaaaaaaatatcctgtgaattgaattgaattgaagctgttgtcgttacgagttatgaaaattatgtcaggtagtctgtgagtctctgtgtgcgcttcttcatctggctttggtacgcgtgaagcacgccttgtttttgttgtcaggcggcaatagatagattggttggccaatgattgacgcattttccgtgggcttctcgaaaactttgggtggacgaaaccattgtttttaataattattgctccgcttcctcttttgagcaagtccctgtggtcctttttgtcggtaggcaattaggcattgaagtatctggtagcactagtgtgattttgttggatggagctaattaatataaaacctcgtttagctcatcattcgatcattggttcttggataactataaatatccgcaactactagtattgaaaatatagatatgaaaacgtatcttcctgcaaatctgcatagcaaatctttatatttgtttttttaatcatttttcagttatttaagatcttgatatttgattgtgcatagcctaggaacgctgtgaacggagagagtatttggcaggtgcacatcctcttcaaaatatataacatataatagtatatatgcgagtaaattattcatcgatccccaaaaatgttttgacttgaatatgtgaaatatcaatatatgatggccatgtatacacgagatagcttactgttttgaatcaggcctgccaataatctttacttggttgaacttcaacctactaaatctctaggtatccatcgatatatcatccattgaactggcaatcaacagctatcacaacatataggtccactatgtacactgttcaatagatattaactactattaattaattataattctgaggacacgtagacggaaaataacagccacgaaataaactaaacacgtatccttttcttttgttatctagacacggaggaccggatcgctcattgatggtatcattttgatctcttcgatccgttcctttttccggtaccatctatatgtattaactcaaccaagccggccttctaaagaaatgaaaatatcgtacacacacatatatatacagctactccgtatttacaaatacatcttgtatatataaacagttagtgtgttcgtactctcttatttatcaacgaaatgaggcagatctcttctgactattttcatcaaagaaaataaagagaccatgtgatgatcatgccgcgtgcgtgcatgctagctaactcctttctttccgggaaagaaaatctcttctttaatcgtcgtaaagaggctacagtgttaggataaagtagtacttttggtaccctagtactccctccatcctaaaatcacttttgtacttcaacacggttttcgagattctattttgaccaacgatatttataaaagatattttaaataaaaagagttatatactatgataatttatttaatgataaatctagtaacattaattttatatgattgatcttttttatttttttactactaataggtaaagttataaatatttgacttaatactatgctaaaaatacttttattttagtatggagggagtagtaaagggtacagtccaggtccagctcgagaaggcactatacactgtatagcactgtacattgtgtaccggcataggcagagagataagttgcaaattaaaccaattggattcgatcgatcgaacaggggtcccatgatcatcacatatatccatgatcatcacatatatctagccattgtatgattaattgcaaccatcttttgactgtagattttgtcatcctgaaatttaacaaattgttgttggatcggtttacggttggtagtttgcacgtccgtgtcacgtagaatacgacgtactgtacgtacatatataagtacttgcaaattaagcacatgagaaatatatatataaaggtttgtctagctacctaattaagatggattattgtaaagatatttcttacacatttatgattgggagagttcatatgtttccatttatttgcatgaggggatggaaggctagatatagaaagtcttcgcacgaaatatatcgtttggcggagttaaaatctgtatcaattctcctctaaaaaaatctgtatcaatcagaaaagaacggacatatacgggtatacccatttatgagtaagtacttgcaaatcaagcacgtgagaaatatatatgaaggtttgtctagctacctaattaaggtggataattgtaaaagatatttccatttgcatacgcatgattgggacttgggcgagttcacatgtttccatttgcaggaggggatcgatcggacgtattccggccggccggcgtccggcgccgcccgtcggcgcgtggccataaaacgcgacgagggggtacggcgtggtcctctacatgcacggtgttgggtcgccagccagccagccttatcttgctagctgtgacggcgaccacagtacctgccaccctgggggaattaatctagaggtaactaactcagatttaatttataaggctttgatggatggaagagaaaacgtgcgctcagatttagactttgatggagaacatttcttgtgctatgtctccctgttttccctcggttgatcatgatactgcactctttttcatacaacaatataagtatttatagattggtatgtactccctccgtaaaaaaacaactctggagctgtctagattcttgtaatagtagtggttggctttttttttttggggggagggggggagaggggggtagaggttaaggttagaaaaagcaaactttagtgcttctaagagtaagtttaatagaaatgcttactatttactctttatttctcttgctatgaatttaatgaatatttattggagcatttgtagaactgttcttacatgagagcatcacctcttactttttattgtctttttcttccatataagtatataacttgcttataactcactgttgtttttctctaattaaatgagagatgaatgggggtgagagaatagttagaggtaagattgaaagaaatttaaatgaaagatttactgatgggtaaaaatacttatattcctggacaaaattcaaatactttgtattattgaacgatggggggactaaatttgccgacaaccacctcttcattcttactgttcaagcgttcatcctttccctctcttatctgtgaccccacggcatctctcgccgagttgattgctattaatgcctcggccaacctcttcacctttttgctagggccatcggtggcgaagaagagcaactcatcggagagaatgaatacgtacgctaatatgacaatcatcaaatctttcaagatccaggtgacagaatcttaagcattctaacatagtgccacgtaaaggaggtaaaattgaaacctcggttggtccctttttgctgccaacactgatgctaatgctttaataatgaccgtacaagtggatccttttacagaagatctagttgccccctcccccatgtgttggtgtagcgtgtttagcagtggcggtaagtactccagtacactcactctgtcaaaaaaaaaaaaactatttccctttcagaaaacttaaccaataaaacgatgtgatcttttatattgtctagattagttgtactagaaaggattagattcccgtataaattaagtatttttagaatggaggaagtatttatctagattaatttgtcagatcgggttcttttttagagagagagagggggaggataaaccaaatgtgtatatgagaggacacaccggctcggccccacctgtcgtacactatgaccacatgccagatttgagcctgtcatgtgggcttcactcccccggcatctaaatctacctctcattttcgcctcttggaaccctccaggggcaggccagcaaaagactccatatgatgcaggtcgctctgtgattgtgatatcttagtactgtctccccatttctgaataagttcatttttcattcatcacatgcatataccaatacaaagttaaaaaatattaaattacttcttatcaaatttcaatataactattcatcattttataaacatttaatataattattttttattctcacaagctccgaagtgacgattattctgaaaacgaatttattttgagataaatagagaaaactaaaaatgaatttaatatgtaacggatgaagtaggtttcctctttattttcttctctctttcaacaaagttgtaggagaaataccagtactagtagtactatatctgatgggattaattagttcttcgttgggtttaggaggcgttgattacttgttagagcactctgtcctgatcaaacctatcactgtctggcaccgtgcctggaggtttgcctgtcgacttgtgattggctgctggtggggacacgtcacccttagaggggttaatttcttgaggtgacctgcagcagctggggaccgatatggaatagaaaaatggcaagataccacatatgggaggtactcccaccgtaaaaaaaaaaaagctaacctaagataataatgaaatataatttagaacaatgaatctggatataaaggttaaaacccgtgattcgttattctagattatatttcatccttatttagattggtttttttttaggactcagagggtagagggtagagggaagaaagcacatgattttatttaagagatttgacacacacacggacgatattggtttgttcgttggagaggaaaaagagatactgttccaatattttctcagtagctggatttggccctctcttttctcctcacatttctgccatgtttattctctttctggaactgggtactattatatataatatggattttttttgcaagaaatatatcatatggtttgtttaccacctgaaaataataagaggaaaaaacttaagagggtaattatactcactccttctctaaggctgtgttctttagatgatgttgggagctaatctctcgcgcacacaaaatagagtgacttattaacgcatgattaattgagtattagctattctttaagaatggattaatgtgatttttaaaattaactttcttatagaaaatttttataaaatatatctgtttaacactttgggaagcgtgcacgcagaaaacaagtaacttgagttggaccttgtctagttccaaactttttcttcaaacttccaacttttccatcacatcaaaactttcttatacacacaaactttcaactttcctgtcacatcgttccaatttcaaccaaatttctaattttggcgtgaactaaacacacctttggtaactgcagctgccgaactcagcctaagtgcactcttgtagttcaaatttaaattagaagagtgttcttattttagaaaggagaaagtatatcggtactgtttggtactacatctgctaattgatttctggcatcgtggttgggtaaaagtggacagaaactgatacctcacatgcatgccacactttttttttaactgcttgtatgtattatagtagtacaactgtctctgcctaagaagatgcctgaattggcaggtgactatgagcattccacccgtactggcggtcccaaccgtccaccagtaggaagagggcatgtattgtattcctagttgttgcatctcattttcgctgttgcttttattttcttactcatttgtactatttattccctagctagatagaacccttttgtatgctccacaccaaagctaaagtaataaaatgctttctctctctctctctctctttatggggaaaaaaatgtatagaattgagctccattgtgtatgtctctggttcagcagcaagaagaagatggagtgatggacacctgagcatatcctaagacatggtatctttgcctccattcctttcaccagcaggtcagtgtcttaaaacaactcacatttgctcaaaagatagcattcactaacctgtggtagcaatatatagagatattcatatttttttgcctgtacaatgatttaagagtttatgagatgctgctgtgaatttggatttgcttttcgaagcgcatttgttattattttcttctactaagactgctagtcaggcagtactggagttagctagtacaagtgccgtacataatgactcttctttagttttcttactaaagtgggaaattgaaacattacatggaatatttcgtgggtggggccaaccaccccgaaatggaaatctggggccctcaataatttcgcgcatcgcaacataaaaatagtggctgtgctgtgcgtaggttctccattggatggaactgatgggccaaccctagttttgcatcttctccttttgtttttgcatcttttctcactttacttgctgtcaatgcaacaaaaaagataggataactttgcctcatcaatcccccaacagttccttgtctccattgctatacagtccacacttcctttcctgtagtatgcatctatcaggaaaaaataaaagaagtttgtctccactaaagagagatataagaatgattcaacaaggagtgatttggtctatcacaatatgattagtaataattaagttgtgttatactccatcagtttcaaaatatagaaaaatattgaattctaattttgcaccgcaatatagtacttctacgcgatatccatggttctcattccactaatccaaagccaaccagatgcctcgaaagggaattcaagcaatccaaaattcaaaaattgacaactaaaatgactaaaaaggaatcttttgacataaccttagtatctgccaaagaacctatagcaatccttatattttagtagaacggaagaaatatatatatagtaatcttgtttagtactgtaaatgttgtaaatgtttttagacgtccctagtttggtaaactagtttacaaatgataataaaatacacaataatcgcgagagacatattataggtggataatatatttctgtttcaattttcattttcatttaataaattcccgatgggattggttgatctcttgttgggcgacaccaatcgtatatgtactatcgatgaaaatgcaaccggccaagcaacacgagctgagttgtacgtgttgctggcaagacattggcctggtagcaaccaatcacttgcacacacgcggattacagtatcttattctctccaatagtcttgtctatatgtacaagacgtatcacagagaatcaccggtgacagcaatgttgatgtgcggcctagattaagtagcttgtgctatatacgattccttttgtttatccaatgttagtttcactttagatgtcaattcaactataactagctaacccagtgttttagtatgcgtttggttggaggaataggttaggtcggattgggtcgaacccctttttcataatgattggtttagggatgggtgagatgggttagttcccttagaatattcaccttcgatccgggtccaaatcatccggcaaaaacaaacaaatgagttcgacccacctgggttgggcgcacggcgtgagtcgcgtcgcttcaccccgcatgcttgcgcgctcggtcgcctgcttgctcacaccgttacctgctggtcatgctcctcgacccaccggcttgctcgcctgcctacgctgctccttcgcccgtaaatgcaagctcctccgttcactaggccatcgtcacacacctccgcccgccgtcatccatcttgcaagcccgccctcaccgctctttcttttgctagttgttggcttgcttgtccgcccaccggcctattttgcataccgcttctttgcatgcttgcgaattacaccggcttgcgtgctcgcaagcctgcccggttgttgacggtggttgcaaacaccatccatcccatctctcccttatccttttaataaccaaacaaaaaattggaatcgtccgatcctacaaaccaaacatgtgagtgaaatcatcctaactctaaaatcaggggatgtttcatctcatcctatctagtcccgaaaccaaacacatgcttaagtagagatgccatgaagttgtaactgaatggtatcataaacattttttaactgattaatgttggatctcgatgtatgcaatggctggtaactgttctcttatgtttcttatagtttctagctagttctcaaaacaagttcgttctagctatatatgaaactaattcgatcgctgattttatccattgaaacgatgatcctacactacttttgagatattaaaacagcagggaggcccctgatcgatgatcctactttcaggcagccgatcaatgatcaaaattaattaaaaaattcttcccttttttttttggtactgaaaggaaccaaatttggtcaaattttgtacaaactcaaatgacgaaacctcgtgcgttttccataattggcgtgcattgaccttccgtttgggggtaggatagtgcatcactatccgtgcacggttactgtgtgccgaaaacggcaactctgtataccaatttctgccctgttcaaatccaactaagaattggtcgacccttttttttttaattccaagtggttgcatgttcacgcaaacacaaatgcatactattatatgatttgaaattaattaataagaagtgtttttctcgcagattgcgatgtctgcatcactgcaattaagccattagcatacgtgtattttgtgaacaggtttctgctagtgactcatactgctattcccagctaagcatcatcaccttgcagaaaagatgagacaaattaggatgcatgcgacaggataatgtaatgcctttgtcagctctgatagggacgattttctcccccttttatctctctaaaagaactgataaaagggacaatcttttgtgaatgtttaatctacaaagtataacatgcaaacactatggactaatattattactgaattgagaagtacaagatggtaaatagtattatgtttgacttaccatcgttaataggggtttgtgaatccgaaataatctcaaaaggaatgcaattgtagcattttttttgttgattttataatttatactccctcgtctcatattataattgttttgactcttttgctagtaaaatttcattaagtttgatcaaatttatagaaagttatagcaacatttcccatataaaacaaacatattaccaaaatatatacaatgttatattcaatgaaactaatttgtatgtcgataattttttctataaatttggtcaaacataaacaaatttgatgcaaaaaagcaatttttttaatgtgaaaaacccttattggaagaaacaacaggtgtcgactgataatgatcattaggcataggttagtttctctggactcataagtctttctagcttcgccactaaacacaacaaaataagacgtcacactcttctcgtgcggcctacaaaagatatataaatagaataaaagaccaagagtcctaatagcaaagattagaaatcctactagggaactaatctaaatatattacatgctgaaattcggatgacatatttaaaatatatataaatcaaacttaatagttttggataacaattagtcaaattgcaaatatatttggtgtataactttaattagcatatccatatttcaaagtactttaataagttgttgattttaatctattcaaactatatatattagcaatcaatggtaaaagtttaatttgaatatgtttcccaaatatattaaatacatcccataaaaatcgcggaggtaatttgtgagcggagattgatttcggttactatatattcatgtctctaatacaactattaatttggctagatttttaatactatgttataacaagtttatatattacaataaataactactttgcaagaaaaatccaatgatcttatttctcaatgccaataaaaaaacacgagtttcaaattgatgtaataacgataggtttgatacatcacttcttagcagttgctttctcttggccctatattaatcattcataaacaggggcggatttaccgtgggggcgggggggtcttgagaccccactaccatccttgggaccatggagacccccctaagcccccactaaaaatttcttccatggatgcgccgtttgtgggagttgagatcggctggaggagaagctggaggttgaagacgatgttttggcgacttgggccggctatgaagagcagcccatgagcttaatcttccaattttggcccggcccactcctccaacctgtagctcaagcgcggcacacggccagggtttcctctccctctcccttctctgaattccccagccgcccagccgccgttctctctccctgtctaccaaatccctaacactagtgtagtagcgtttgaccggccatggacgcgggccgatgggcgaccggcgacgggaggcggccgtggtggcgaggcgcccgacgcccggtggcgacaccggctgacgagggcgggagctaggaggcagcgtggcccgtggccccgtgggcgtgcggcgagcggcaagcaggcggcggcggcggctagcgagccatgagcggacgaggggcccggagggcgggaagccgggaagggaggcggcccgcggccaggcggcggtccagcgccggcgcgcccgccggggaggtggcaagacgggccagggcgccagccgccaggcggcggtcctgcgccgacgcgccgacaggaggcggctaggtgacggtccagctccagtgccgctgcgcgctcgcgccgacggggaggtggtgacccgcgagccagcgaggccgcgagggcgcaaggacgctggtccgctggacgcagcttgcagcagcagcagccagcagccagtgattgaatatttgaagttgaaattgccaaattggtaacctatttacctctaatactaatagacagtctaaatttgtgtctcaagtgaggtagtgattaaaatttataattgtttctacatttttagtttgtcaacatgccaaaaggaataatgcttatgtattattctagtttaaacaacacagatgccagtaatcctccacgcaaccacgagaatataagtccgctaaagaggtctagggtagagtctgttcagccccacctactattttttcctagatccgcccctgttcataaacaattaatttacacattatctccttccgtacctcgttgatactccctccgtttcataatacaagggattttaagtttttgcttgcactgtttgaccacttgtcttattcaaaaaaatttagaattatttttttttgacttactttattatccaaagtactttaagcacaacttttcgttttttatattgcacaattttttttaataagacgagtggttaaacagtacaagcagaaactcaaaatctcttatattataggacggagggagtatatgattgtcatccaaaggcatgtagttattatgcgtccaaccaacagtattttctgtcccaataatgaagtgattcgcccctagcatagtgcatacatatatatgtcgatgcactcagcctatagtttaactaaataaactaaatatttatgtgcgccagaaaaattgcattttaattaattttgtaataattaaactagagtgggtataacagttactccgaaagtgattcgtgcccatctctatacctaagctacttaattagctttgctataacaagtgtgttcgatcgaaagcaatgctagctatatacagtatgaagcttgagcagttaattgttgctaatgtttttcacattagattgattaattgaaccatgtgcaggcgtgcagcctcacgtgtcctaaaacctaattaagtgtggcatctttttggcgtatatgtacatcatattacttctagaatagcatggcctatcaattacttactccctccgttttttaaatagatgacgctgttgacttttaaacatatgtttgacaattcgtcttattcaaaaatttttatataaatgtatagatataaattatgcttaaagtactttgagtgataaaataactcacaataaaaaaatataattacgtaaattttttgaataagacgaatgatcaaacatgtgataaaaagtcaacggcgtcatttattaaaaaacggaggtagtacttatttatgtgtgtacgtacgaatcatgcgtgtatttttaatgaataggcggagtatatgtatacatacatgcaacttggcttatatgtaatattttgtatagaatttgtagcaaaaaaataaattatgtgcgtgagataattccaagatatatgcatgggaaacaatatgatttgagagttgatagtatagcttgttcattcaataggatattcgagagtaatcttgctatatatagtggtgttctgcattttgtgcttatgcaatgagagctttgatttttttaaggttgttaattgataccagtgataattgacccttccagctagctacatcctagtacccaaatgttgagatccaacaggtaatatatataaactatataacaagatcgagatatatcagaatactttctcaaggactaaaagcatttcatgccgtaggagaccaagttaaattgtccgtgtatatgttttttttttcatgcgaggcatgtataatattgatgagttaatttaattagtatgcttgtcatagctagatccagtgatcagtagtaatatcttggaagaaatagtaataatgtatgccataactcataagcaacgtacaccttgccaatatagttgcaagtggtggcatgtaacccttttttttttgttggctagagcaagtggttgtatgtcataatgctctttatgtatatattacctttatgtatatattactttcatattttaatgtatgacgccgttgactttttatccaacgtttgaccattcgttttattaaaaactttatgtaattatcatttattttattgtgacttgattaatca

SEQ ID NO: 80842 - DNA, 29002 bp, Oryza sativa
aaaaagaaaaactaattacccagtttgcatgtaaatcgcgagacgaatcttttgagtcttattagaccataattagccataagtgctacagtaaaccacatgtgctaatgatgaattaattaggctcaaaagattcatctcacggtttacaggcgagttgtgaaattagtttttttattcgtgtccaaaaaccccttctgacatccggtcaaacgtccgatgtgaaatccaaaattttttatttcaacaactaaacatgccctctattgaagataaacaggtgtagctcacgctggaatcttaagtccctctcaactaacatgttactattggcagtcacctagtagtagtggcctcaaaggcaccaagaatcttgcagataaatagtcttcgtcgcatccattattgattagtatatatagtatattatatatatgtaacttctctctcccacataccggactttctatttgcgaggcctgagtttgtagtattataaagcaacaaataccatctaactaacgcaagggatctatatatacattaaacatatcacatgtgcacataaaggttgcagaatactgttgtttagttggtatatattttgcaaagcattggtatttaaaatagcaagaatgggtcttacgttgctgcagcagtactggcaaataccgtggtcaaattggctgttgggcctccttgcacaactaggggtgaggtggtgggttagcatctctgatggtacaaggattgcaatacacgccaatcttctaggaaatcgaggataattttttgcctgcaagttggacatcaacaaatatatatatatatatatatatatatatatatatatatgttagtacaagactacaagttgccaacacacagaaaaatattgttaagtataagatacccagcttgctagccaaagccacatttgcacaatactacctccatcccaaaatgtttgacgccgttgacttttttaaaaatgtttgaccattcgtcttattaaaaaaatttaagtaattgttaattctttttctatcatttgatttattgttaaatatacttttatgtatacatatagttttgcacatatcacaaaagttttttaataaaacgaacggtcaaacatgtttaaaaaagtcaacagtgtcaaacatttagggaatgagggagtacaatataatcatagggttggcaacatgagacaaatatcaagtttccttttttaaaaggaaaaatattatcaaattatagcctcatgggcaatatagaaaagcaaacggcctggatccaaggttcctccacttgacttgctactattgagagcaagttgtgtgttggtggtactactaccattacactgcttactctctttttttattattgaaaaacctaggaggttgcattcctgtgcaccatttatttcctcgtctctgactctgagttataagtcgataagaggaaaactttgacctggcctggctcttaacgattgccaggagacagcactgactgcatctatccaggggcccaccgccagtagctaattttcctcgagtataacagtatccctttaggatcaacaagtccaaaagggtcgtcattatctgacttggctaatcatgcaaggagatgctacgattctagacctgttttcaaacgttatgcaggaacaaaattgaaagaacatcaatacaagttgctcgaattccgggaagagtcaagaagaaagctctaggattcactgttcctagcaaggacggtaatttgaccactgttcagtttacggcacataacaactgccgtcaactaaaaaccttgaatagtagtattgtaaaagccaagagaacattgtacttgcacgagttgcaagttggaacatgagtcttttctaagttcaaaatggagcttaaggtcatagattgcggcggtctagctagcatcatcatgcaattgaaaaaaaaaatgcaaaaagttcattgagaaactgtagctttcaactacgtggtttacacgggtgggttggactacacgagctctagtggagaagacatgatggctatatagacagggtagacatacatgagacctggtttttatccttagacgtacgtcctggtgaaaggacacgtcacacaaccatatacgaagaaactctaggaatctatcgctaatgaaagttcaaagtgttctttataaacccagataaaaaggtgtgctctatccaatctacctagctcacatctgaagtaaccagaatcagaaagtccatgtaaagaaagtagaggtgtaaacgattagtatcgtccggacagaaggcaacgtatccaaaacacactgaacatataacatatagcgcatgaactactccagaactagagacaagaccgtctggaacatctgaaatatgttttatcaatggtttcctatgagcatcactctttttggacgccaacaggagtagatccaattactggtaaccaagaatggtagtgccgacacagtgtgatgcaaagagaaaaggaccaccactaggatgccccctcttttcatccaccggcccctatcagactagattggaagcccatcagatcaatgggaaagaaacactttataaatggcctcccacaataaatatatatcagatatcgtccctagctgactacactatacaataaagaaatgtcaaaatgatttgttcttgctcagccaatatgaaaaatatcatagttttattctatcgatgctatggttggtttgttgggtcactctgtcgtgtatgtccactataaaacgattagttgttcaatttaggtgtcttgtgtcaaagagttcagggataaaatcagttcagcaaggaattataaagactactgccatgtaacagaatatataaaagtgtgaaaaagaagtggcagcggctataaattacaagtatctatctgtatacccaggcaattgccaaaaacagtaggtgtagcatgaatacagactctggtagttaaagaagataacttaaactttggccaacttttttttgtgcatcatatgggcaatttcttaggcaatcaggttactgggttgcaacttgcagtgcggttgctttaggatggcggtccccagtcacacaaatacttctctgttcagagctttcaaagggaccgctcggataaggtaagggaagcagctgggggatgcaactgatgaatcagggaggtgtacttgtaacacctactcttatggaaaaaggagtaactctatgcatggtcctagctcctatgcaacaacccaatctaattggttggcatctcgctctcgaacaaacgttgctagcttaggctctcatgccaccttccaaaccttggaccaggcaactaatggccaatgcaagacagccaaactactggacacccatgtttgactcctaggttagaaacttagtaacactttctctctttattcttttgtactaggcctcaccatgtttatgtctgagacgggaaccaatcccgttgtgccaaccgaaaggcaacttaatttagctgagtcagcagtgaacaacttaacagaagtggagaagggggtccacggccagttaattgaaaaaagtgctaaactaaaggcgagttatagagggaaaaatactgcatgatgagacatgactcatgaggacatgttcaaataccgaactctacagccaggccaggtgctttgtactactattagacaaagcaccattagaagaacccgcatcctggggagcaaagctgtccctggacagaatccagtcttcatgcattcttatattcttaaataattatgttccgatgcacaattaaagtcaatgtcctcaaatggcagcagccatagcaattattcaaataccgaatcaccaaatgaggaaatccaccagcatatatgttgaatactttctgctttttgggtgcatttggcaaataagttgtcaggtcatccgatattctggcaggtgcatattatttctgttagtgctttagatggcctattagtaatcatttcatgcccaaatttgatgcttctagatgcatgcccctttaggccaaccatgataaacaaactgctcagtaaactagtcttactagcgatccaagatgcaacccatcaaaatcgcacaaaaggaagcattagacttttagtttaattgcccagcaatcaagacccagtaaagtgattcttcatgtctaccaacaagacagtccggttgcttcacctcagttggctccccttttttctgaacgaaacagtaggttcccctagaacctggttccgtttctttaagctcacaaaagcaaaaaccgttgcttagtatacactaattcttcagtatatgctatgcatataatagcagcatgatgaggatagaaattttcaagataaatggttttatttctctaggatggagtgattagggggacaactctgcccagggggggcaaatggatgagcagctcaactcctagatttgataaacaacgccctcaggaggattaaacaagccatggtttagtcatagttgaggattttaaagagggaaaggagaacccacaaggtagcaactgtgggctgtggcttcttttattctgtgggtggaggtggaaagaggacctgatctggcacacgcaccatacgaggtaatgtaggtatataaaatggtatagcaagacgtggaagattggtatccgttcttagaaagtccacaactccagactaaacgggtcagacccttttttcccactaactaataattcaaggttccgcaaaaaatattaaatgtccaaatcaaggattttataatactgtgtacgttgcctagtaagcgatcatcagacagcagagtcaagcatatggaaacgcagaaacagaaacaaatttactttttatgtaaataaacaaggtaacacgtaaattcaaggaataatttcctgtacctcaattcgacaccacattatcagatgtcatcaaggatggaatcctgcaaatttcagccatttcaggaggtgacttgtagatatttaggctgtagtatgtaactccaatatcagaattgtgccaattaactgatgatcaacataatggtatttttgccatttttcttcagctactgacaacaaaatggtattttaccttcttgcaaaaagaaatggtattttacctgtgaagtttgagacgcaatcagaatatctgagtttcattgtaataagggagaacagcaatacacagcatatgggctgggccatagatgggccaattgggtcagagctatctataatacctattaccctaacattactaatattaatccagaaaaaggcttagttttaacttatcttgtaatgcccatatgaatttgcataaacaaccttctcataccaaaaatattatctgtttccaaagcattttttagtttaacggttttgttgggaaattaccatattttgttagaaaagtatttgcctgttgcaagtaatttttgttcatagttaaccattttttacctgcatgagcttgatcatcagccatttgtgccatccctggggactgaagaaatatcttcagttcttatattgcaacctgcagaatccagaagataattgataaatttgttatagaagtcttcacttaaaaaaattacaagggagccataaaagaacaaaagtcgaataaagtgtggtttatatacataataaaagtatacagcgccggcggaaccctcccactaatgcagcaacaaagaaactatattacccacaatgaccttatttgacatatccatcaatatggatcaagcttgtaaatcattgtaatacagctcattgcaaataaagagccacataaccagtgaagttaatgatgttaaccataataattacgtaaagatggattggtaactgtctattacagtcggaatgcaattcagtagcaaaaattaaagattatgctattacactctttcctagattacttacaatttaagctactctctaaataaatatacatggtatgcaacataacttctgaagttgatgcagagtgcgctgagattaaattggttttccttaactgtagatgtggtagcattcaaatggtcattgagccaggacattttctcctgaaacaagttcattgttaggattaacaaaaggaacattgcaggcataaactctttatgcgcaaataatataaaatacaaattgcaattcatattcataccttgacaacggattgaggttatttcaggagatggcacatcaatgccctcatcactaagtaatattattcctgatgactccacagtaaagggaaaagctaccgctggagtcataggggatttagctaccttgatgtacctgtgacctatacaagtgcagcttgtataactcatacaaaactaccacggcaggtaaatataaaacagatatttgatttgttaaacatataatgaaagaactagtaatactgatgctataccactgcattcaatgcagaaagctataccaaatccttacgtacaggtcttacacagagcaagttcaaaagacaataaacattgttgtggttcctcaagtttaattatgccacttaaagtgtatatcaaaagtggtatacgataataaaataaaggtgtaaggagataaataatgcgtgtacatagatgaaattgaaatcaaatgtagttgagactttcctattgcattgtcatgcagcatatcagatggtgggtgaaaatggcgttaataatatttataggtgtctgtttcattgtgaaatataaaaataattagacagacctgagtgagcctcaaagactagacgtatagttacagcatgagcccactggattcctagagcagcaacaagatgagattcaaagccttcagcattattactatcgtatttcttctcaactgcaatagagtaatagaaatgttactcaatctcaacaaagtgtccaaaagataatttgttttcttggatgcccaaaccttcaaatgaataacgatagccatcatcattactttggctgcgtacttggtttgtaacaacaacaggaatctgtgagaactctgctatagatctgcatgttgagaaaaaaaaaaaggaaggtagccaaatgtaaactaaaccaatgtagttcaatattatgaaataatagtagaatgctatgaaatactagggtctaggtcactaacttaagaaatgaaagggcccatcttagagggtgttgtctgagacctgttgcgcttttctcaatctcactgtcacataagcaaataagatgaaacagggattcaaaatattagatagtttattcttaaagaaaaagataaagatgagatcttcataattctcataacataagtaatggacagtattaacagtagacaaatcccacatgtaattagttcgtatggaaacatggaacctatttgtgctagacatcgttacagactacacatcatagtaactgtattaggccaaagccctctatagagctaccagtgcaagggtacagcaagatatttaaaacaatggtgttgctaattgaaaccaacacataacatcgtgcacccactgctaccacacttgggattccacctcccccaacaagttatcccttttcaggattcagcctcaatattatttaaggtgcaaagtttcatagaaattatcttagcaagttgaagaaccaatattttatataatggaaaccatcctttatatatctgaaacttatacacattatatagaaaatactgcaatacattaaagtttacctctcatagctcattgtatagatgtatttaaaggcccactaaaatccatacatttcagaatatcttagaagtttaatttttcaaatctgctaaaaaataaatatgggagtaacatttatcatacatgtagccacatattaaggatctgacaatccaaaattcacattatgatatttattaatcaaaataactttctaaataagtaaaacaagaatatgcttagaacgtgattattactcatcatgatgactatcattgtttgaaagtaaggcagtatgaaagacaaaacaatatgtactatcatgcatttcttacgatgacataagagcagccatgctatcaacaacaagtagcttcacatcatgctgaagaagagtcaccttcatctgttccaaactgtagaaagattggaaagaaacaaaaaggaagggagtgtttcatgcatattctgctgaatttttgcacatggaagcaatggggaatagttctaatcattgactagcaaccacattgttgggtagaataaaggtattttgaaaatgtgctaccggaagtctaaagatttgtaaattgacccttcaaccctcaaatagccctcctagaggcacagtaattccctgtcaacttcctatgctgattgagtaattccctgtcaattggcatataaggaattctctcttacaaatatgtatgtacctcttggtaaattcagataatgatgttgggcgcaggactaggatcctcccagccatctgtacaaaaaatacaagataacagcccatgaagtccaatactatgagaacaaaagtacaacaccgcagtgaattttcaaagtgtcgatgtatatgtacaaggtgaagcataagaaccttttgggccaagccttcttgacgaaatatttgaggaaagcttttctcaccaatctcgatcatcctagatacatcatgcaaacattttacagatagttctcaattggtgtgcttgggagaacgtaatagtaagcagaaacttcagttacctccgtgaagagaatttggattcagtatcaatatacaaaactcgaccatttaagcctccatagcattctggtaatgttgctagcaaagcaagcttcagacagaactgcaaagtttgtgactctttataaaattttactgaatgtataataaattactcaatgtaatactctctccatccaaaagtctaaggcatatttcttttgtcaccaagaccaaggagaaattaactcattccccatgtaccaaaaccagggaattatttacatgcatgcaaccaatgagtattaaaatggttacttgggttccgatcaacaatttaatttagcatatggagactacaaatatgaccgtctcatttgggaaaaccaaaaaatgaaatatgctcaagacttttggatggagggagtataagagaagcacttgatattctctacacggagaagactattaaacaagtgccatttgaagatccattaattggctcagtgaatgcctttgcactagacagaatcaacaaaagcatgcattattatgaaaatggaaattttccactaaccaaccagccccgaataaataggttcgaccatgaccgctgctggctggaataataaaagaggataatacttaggagtagtaacaagggtttctttaatcgataagatagcacacgaataatgtcaaaggggattcaagtgctaggctcagttcctatctttgatcaatgaaataagaatgcagtaaccagcacacagcaatgccataaatcgtaatgccgcagcaccctgttacatccattcacaagatccatttgcttttggttccctatcgacaccaagcgatcccagaagtcaagcagacacaataattggttcgtatccatcacagacacacaaatcccacaaagcatcattgcataatgctgagctgctcacctgggtcttgccaatccccgagggcccaacgacctcagtgagcttccctgcggggattcctccatgcaatgcctcatccaatccgcggagcgtggtggccagccgcccatctcctcttgccctgaaggcctcgaggagcgcaagcgcctgcagatcaacaagcacagtaacaaaccccgatcataaacgcaaatgcactgtcccaatcatacacggatcaaccaaacgagagtaactcgaatcgaatccaaacccctcgaaaccgggggacggcgaagtggggggggggggagggtaccgtttggtacggagggcaggcgatctcgctgacgtgggcgacggcggcgcgggcggtgtggatgccggcgtcgaggacgcccatgagctccacctccggcagcgacagcacgtcctgggtagaatggggtttagcggcggcggttggtgttggagcagggggaggggttttggagggcggcggcgggggctgaccttggcggtggtgaggcggcgcgcggcgaggatgtgggcgaggtggggaggtagccgcatctccgagaccagcttgttcgccatggcgatcaccgccgatgggttgtgtggggggagagagagatcgggggattggatgggagacgggttttgttgggggggggatggatttcgaatatcttttgtttccgcgctctttggaattgtttcggtagtttttatatgtttttagtcaatgacatgtagtacccacgtgagtcaatgacatgtggatcaggatgacatatcttaaattttgtaaaattataatggcatggttctaatttttcctttttatataggggcaacgatttagtacggtctggtttggtttgatgcccaaatcagttatagtaccaaaataaattggcattgttaaagtttgtacgaaagagacaataaaaactcgagtgtttttttacatcaaacaactcgccaaagttttgacgataccgtaatgttgccactaccataaatttggtagggctagacatggtaataaacataaccacccctatttaataggagtaaattatgattttaacattgatcgttcctaaatccaaacgacaccataaattttatagcacaaaagctataagatttgtcgtcaccatggagcactttatgaatcatgccaagcatgaaaatccgacgaaattgtattgcctcatactctgtgacgcatgacgcattcggtgtaccaccactcccaatacctcctcccatccattacatagggccaacacccctccacccaaattatggtaaaattgtcttcctcctcctttagactccaacagagttggaatcacctccgtccttcttttgttggcatcgcctcattccttccttcccctaatatgctactccatctaccgccccttcctctgcttcggtgagacgccatcaagctcgaaacattgacttcctcttattccttcttcatccttatttctcaaggtcgaggacgcccatgagctccaccttcatcagcgatagcacatcctaggtagagcggggtttacaggtggcgacagtttgtgttggagcaagaggaggggttttcaagcgatggggctgacattgtggcagtgaggcaacgtacagcgaggaggtgggcgagttgggggtagctgcatctcagagaccagtatattcaccatggtgatcaccgatgggtgggagagatatggggattggataggagatgattttagggggacgaattcgaatatcttgttttattttgtttccatgctatgtggtattgttttggtagtttattgaattaggtgcaccggtttaatataaagccttatttggttcgatgcctgaactatttatatcaaaataaatagcatttttgtagtttgttgagttaggcgcaacggtttaatataaaaccttgtctggttcgatgcctaaactagttatatcaaaataaataacatttagtttgcgattaacaaattgacattgtacagaatttggcaaaaaggacataaagactatatcgtttctaaaaacttgacatcaaacaaattgccaaaattaccatgataaaaagatgttgtcagtaccataataatttgggcataacatagacataaaaaaataaccgacgtcccatttaataagtgtaaattatgattttgacacctatccttccagagccaagaccacgctataaattttatagcacaaaggtaataataacatttgtcatcactacaagttatcatattgtatcatgcgatcatgccagacattgtgatatctcatcccttctttctatatagttaagacccaaagctacgttgtggttaagccacgtcatcatcagttgtgaatcgttggattaatacattagattgtttctcagccgttggatagaaatgcggcatactcaaatgaaacagagcccaaccagggtaaggcccacctaaatcgcaggatgacttttagggtttatttggatcggtggggttccccggctcagaggggcggcggcgtctgctgtgtcgccctttccatcgcgcgcttgtggtagggacagcgctcggtggtgggagagttatcgcgccagatgaacgagcgtcgcctgatctggaagacggctcaactccccgcgagactgatctggaagctgcggtcgtttctcctccccgcaccgcgaatgcttctcctcccccatccaccgcgcgcaccagcagtgggtccgccagccgcggcgccgcttctcctcccccacacaagcgacgaggtcaccaaacgcctcaaccccctcagctctggtcatggcgtgcactgatccaatgattcaataaataccctaaacccactcggtcgcgatgtgcatcagatcaaaagcctccacccgtagcaacatgagcgagccaccgccagcatcagtgcatcagcagaaggggatcgccggcagtaggccaagcgacggaaacgagccataccacccgtaccagttcaagggaagttatgggcggttcccagtttctgtctatccctcttctaatgacctgcattatttggtttgttgcatctcttcgtgtcttctccatatgtcacagacatgttgctgtttgttgtgttgctgcccgctctgattacacaggttcatggatccatctgctagggatgaggttgttcccctttcatgttgaattgctgatccctatttttcccaggtcatccctaatccagcatttcaggtaaatatctctttctaatcaacattgattgatgcacatcgtttctcaccacttcagctattatgttcttgacaaatttcaattaatatccaaacttgccctcttttctttcgtacaacagtatttgtgcctgcattttacttactccctacttcaatttttgcacatatttgattgcaggtttatttctggatttaagtaccctacaatgttgaataataaataaattggcgcaaatttcttcttatggtgtacacatcactaaatttgattgcaaacaatacattttctgttatgctcaattttaaaatcattttatgttaccttgcaactgtccataaaccttatattttatattggttttagtattatgtacaaaacactaagtaaacttacttactgatgaatcgtccctgcatataattcctaattttctttcagtgagctgaacaggttggtgaagtaattattttatatgcaactacggacaattatttgaggtgaaactttacaattaaaaatatcatctcacaggcagcaggtgatatcacacaggtcacaggatttttgtgattggagataattttcatcatatgcagcacaatgatcaatgatgtaagtgaaaggtatatactgccgcgcaggtccctccttttggtttttctttataaatgttaattgagttcataatttaaactatgatattatgatctcaattttttttttgaatttccttatcttccttattatgtattgaggagacttaagaataagtcacctatattgtataaaaattttcaactattcatttccattttctcatatgataggtactgtcagtttagttaatcaatatgcccaccccttattatgtaaaccatcagtcacacaagagataaagactgttctttagttgtcacctggattcatcctgctctagacatttgtgcagctaaaatccttcaatttagaatctattcatggatgttttaaacccatgccaatacataatatcccgcatcaacgcgctggatatcatctaatataacatataacgcatctcgcatccggtgtatcaccactccaccatacatcctcccaaccattacacaggcccgacgagtcccccaattgtcctacacctatcttcctcatccctcaacaaagacattgacaaacttgggaccacctcctttctttccctggcatggtactccatctgcctcccttcccttgcttagcttagtgagatgccgtcgagctcagaacatcggattccccatccctaaatatttaacaccgttaacttttttaaatatgtttgaccgttcgtcttattaaaaaaaagtaattattaattattttgctatcatttcgttcattgttaaatatacttttatgtatacatatagttttacatattttacaaaagttatttaaataatacggacaatcaaacatattttaaaaagtcaacgacgttaaatatttagtgacggagggagtagtacgtaacaagaggttttgaagaactccaaagcaagcccatgaaccagcccaagaaaaaggcccaacaacaacccaacaggcagctgcaagcccgcgacaacccccaaaaggcaaaaaaaaaaaaagaagaaagaaagacctcccaaaattcaaaccatcccgcccatgtaaacaatcaccgcccttgactcaaacgaggacgcagtaatcaacacggctcgagcctaaacccacgcgtgggccctacccgtcagcctctccccgaaactgccgcacgcgtctcccaattcccaaactttcccttattattcccagaaaaaaaacctctcaccgccaacgtctctctccccagctcgccgccgccgcctctcccccaccccgcggcgatctagggtttggacccccgcctccgccgccgccgtcgctgtctcccgcgcccggccggacggcctcccctccctccctctcatggaggcgctctcgctcatcgacgtggccgcggaggacgacctcctgctcgacctcacctcgcccccgccgctgcatcccgatccgccccacgcaggtgagaacgaacgaacgaacgaacgcacgcccgttgctgtctcttgcgcttcgttttcgatcgagatttttggggggtggaatcgtggtgtctcggggttgattggtgctgtggggttgcttcgatctggggatctgacggtttcgtgctgcgattttcgttttagggtgtgatgaggtgatggccgccgaggcttctcgcctggatcccgccggcgattctccggagatgaggcgggttgtggatccggatggcgctacggaggaggcccctgagcagtcggagtctccgaagcggaggaaagcgaaggccggcgttaatctccgcaagagcttggcttgggacagcgccttcttcaccagcgaaggttgtgcactaaccaaattccccacccatgaatgaaattgctggtgttcagtagtatttgtttcttgttgtagacttatagtagactcctgcatcttttgatgtacatttcgatttagggatctctcccattcctcactgtcgtgatgatggaaacagaagggttacagaatcttagagggaaaaacagcaccaggctgcagtttacaggcccagcaccagatggcatgcctgtaatctgtgtttcttcacaagcactaacagcaatattcggtcacacgctgcatcattatagaagaaccactcctagttcccaatgttttggacagtgaattttttaaaatgctctcgtactgctgttgatctagtccttggtttgtcagcctgtcatccattttccgttgcaaagctaccaattcctttcagtctttgagcattcacttgttttgaggcagtttgatagcagctctgaagtcctaacatttccctttctgttttttttccctgcctgtctgatgtgttcccattccttattacagtaggcaaatatcgtaatgtagatatgtatcagttcctaatgttttctggtttgagcaggtgttctggatactgaggaattggctgttgtaaacagcacattccgcaaggcacagggttccaggttgcctggaatcgctgaggaaatgaggaggtcaggggagtcaacaacttcgactcttgaaagcgaaagctgggtgatggaaaatctggagactgagctgtttgacaacgtccgtgcttcgatccagagatcgcacggcaatcctggaaaagccccaggtgttactgctgttatctcaaaacccccgaagtccaaggcaaatgttcctcgtgttgcaggtaagaagcttcttctgagttttattatctgttggtttcatgtttgtaactgatgtagttattctttttgctacttccagcaaggaagggggttgatctgatgcctcagagtaaggtatatagcacaattcatatatggtttgatctaaaattatagtccttgtccatcactgaccaaaatttttcgatgcttgttcagataagggcccctatttccacaagccagggtgctgctggaggaaaacaaaggatccaagctaccttgaaagagcctacaactgcaagagtggtatggtccatgctagcagatacattacattaaatgtgttgtagtttagttgtttacattcttcatagtcccttaacatttaaaagttaaggggctatgaatccttctcaatggtttgaatctaggcaaaatttgctacaggacacttaaaatttgtgtaacttgctggtagactcacggctgaaagacatcacaaaaaatttgctggaggacactttcggctcaattgtaaagataaattcttcaaaaagacgagaatgcccctagggtcaaaagcttttgagctcaagcttggtactaggggcattctcgcccttcttaagaattcatctctccaattgagtcgaaagtgtcctctaccaaattaccaattttttagggtgtctttcagccgtgacacgtttttgcgatgtctatcagtaaattacacatattttgattgtcctgtagcaaaatttgccttgaatctattgtatgatggttaagccaaaggcagacacaaacagatcacaaagaactagaatgtgctagtttaaatgaataggaaattatgtggtattcttatcttaacaatgaaaatgctgcttgttagaacaacatggtctgctgaatcgttttctaagtgtctaagttcttactattatttattgaaatctgagcgatggatatacaatttgtgatgtttcagtttgcgagatgtagcttcactagcttccccatttccttatcttagttatgcaatattctggaattaatttcatttcaactctctgcttgagaagcctatttcaggatctacagaagtaaaaccatctttgaaacctccgagggctctaccaagagttgctacaatgagagcgccaactaatacagctgtggcttctggaattccagacaaaaggagcagcactggtgcgtcaacaatatagattctatctgctataatgtttataggtggcaagactaacatgtattctcttgtaggaggtgtggtcaacaggcagacagttggtaaatctgtcaacaattcagttagcgcacattctaggcctggtggagtgacaaaatctacttcaacttcaaaatcaggtgccttaccatcatcattatcatcatcagcagcagcaacagcagcttcaattggtaatatgctaggtcaaaaacctaaatcatcaaccctaagcaacaagagcagaattgctcaaaggattcctgttcgttcaacgtcaaggactgatgtcaacaaagctaacccagcaagagcatcgagaaataatattccaactgggggcaaaagtaatcgtgtatctccaagcatttcgcctagcagttctgtggacagcttgagttctgtggtttctggggcttcaacagcttccactgtagggaagatgagccatacatctgagagcttcagtacacggtcttcttcattatccccttccctcagaaatagcaatgaccacgctccaacaagagcagatgcagacacccagggaaaaggttccaaaccatctggtctgcgtatgcctacacccaaaattggttactttgatgctgtaagtaaatttagtgttttcttttgtctggtccatttagtattttcttcattgtgatcatgaaagtattcttaattgatggcattacaaattataatctgtgtcgtatgcgtttgtctccagaagtccatcgaccaacagattggtgcacatatgcaagtgcagcccatgaagatccagtgttcacctcagctatcttctgctcaaatgggggacccagcatcgtctatcttgagtcagccggaatcgagactcgcagcctcacctcatgagaaaaaaagcagtgtccagagcaaggcatcacctttactcccccttgaagttgtacagatagaacttgagccttcccaggcgatggaacatgaagtgtgcacaccccagccctgcccagtggtagcagcagcagcagcagcagcagcagacacagcaaaggagaacattccggctctgcatcagaacatccagccaaatgatggcgctggttcgttagcagttgatctgatttgccagagattgtccaccatttctcttggggacgccaccgacctggcctcttgatcttgtagagggatttagtcgtatggtatgctggttgtttctgatacatccttattattggaaggcaattgcagctgaagttctttctctggcatgtgttgttttaactcttatgtcttgagtgtaaaatcctttttctgtacatcgcatgccatgataaggatttcgctctcggttgtaatcagattgcagaacacttaagagagttgacactgctatgtcaactacaggtttgcaagtaatcgtatatcagtcacatttgttcatctctttccctacaaattgttggttgaattgttcttgttcatataactctagattgtagtatctgaaagtagttaacataacactgaaattgtcatgcaagcacaaacttacaatgattttttgcatctcactgattacagtacacatcattgttactacaaagcatcaatacatctgatctaacagtgtgtgatgagctagcacgatcaccaatgcctacactttaggatcccagattgcgcatctggacttctggagcatgtagaaaaagattgcaaattgtcatcttcatcatcccatcaatgattaaatcagaacacatcaggttggcagtgtaagaggtgcatatgcataatgttatcagcagcattttatgtccctggagtgcaggagctaccaaactgatgaggtcaagtgactctttttttaattgggctcatctcacttgctcctcttcttggcctccccgtaaagaacaacgcctgcgactgttatcccgtagcctagcatccccatgaaggttaccgggtttctgaatatcaggatggaaaccacaacagcaacagcccctttcgcatttccaagaacctggtaagaatcaagcaacgcgttgaacattgttagctgcaaacatatcgacatgtgcctgaatgttaggaagattgaagatcatcaaagcatcatgctaacagtgcaggtaggagggaaggttggattacttggagagtgagtgggctagtgtgcttggtgactaggaagtttgtgaggttcacaaagtaggctaacgaggaattgcaaagcagtatccagataaaactcggatcctcccgcgcaagcgcagtcaccatagtgagcacattgcgctccatgataaacgttgctggaatcagcagaacgacggccaccggagccatgtaaccaagaagctccatgggattgagcttctccctgcatatcaaattaggtggaaagggaataaaattagctgaccaaattagttagaccaaaatgtgggtagcacaataattcataaaggattgcgatgtgatgaattattactcctccgatgacagcaagatcccctgcaggacagtcttgagcgccctcgcggcggttgcgccgatgcacatgatgaaaccaaacagatggaagcttggctcaccctgaaattgttgagattgttcaagaattggatcgtctctgttcaagcattgcaggttgggagagcaatcaaggcagatccagtgaggaatcgcggccgccttaccccggtggcgatgacgacgccggcgacgacggggatgagggcggcgtaggtggcgcacgcctcccggcgggccgcgacggcgtaggcgaggacggcggtgaagaagggcgtggtggcgccgacggcctggttgaacgacacggggaggtaccggagcgagacgttcccggcgaccacggaggcgcagaacaccgccccgagcagcgccaccctggcgagctgccccctggagcggcgcggccgcgcagcccgcggcgcggcggcggacgcggcggcggcggcgtaggagaggagggcgcaggcggacatgtggcaggcggtgaggaagaccgggtagcggaacccgtaggtggagaggaggaacttgttgaggaggagcaccccgatgttggacgcgtaccacgacgccaccagccccgccgtgaacagcctcccagccgacgccgccggtgaagacgcagccgcggcgtcggcggcggcggcggcggaggaggaggacatggggaggagggtgaggttctcctgctgctgctgctgccccatctcgactcgagctccgattcggactggctctgcctcgttaatggagagagagagagagagagtgagagagggaggaaggacacgtggcgggggattggggtggattaggaggctaattatgaagctctgtgatgtgatcctcactgttttttctttcttactccctcactcctgcagtttcacattgttcatcataaatcatattctttatgattagtaattttactattattaatgacaaaacattaatagttattaatgatataaaataatgactcatattttcttttaaaaaaataagacagacaattaaagttgtacacggaaactaatggctaagcttattttgagataaagtgagaactatttttttatattatttttaagtattttattgtttggtctggagcgtgacacgagatgtggacaaacatgtcaatgttatgcaaagtatgcaacctgtcgggctttggaaacgtagattattggactatcgtttctttatgagtttagggtgtacaactagctatattattttgctaatcacaatttctatggttttttttgagaagggacaatttctatgggttggtgtactgtattttagtgatattagcatatacatgtgccagtagcatatacatgattttatacgttcaactttatttattttatcttctagttggtttttttctagagacactgatttttttatgaattgattttcttgtgaaaatgtcccttttatggtttctgaaagggtggtttttaactttttttactttgttttttatagtagtaaattgataattacttctctcactccgtcctataaaaaaccaaaatatgataatgtcagggttatggataccacatacctaatagtaattgactaaatctcggcaggatccactacataccatgtcttatatggaaactgacctcgagggagttctggataaggaaagacaaccagagttctacatgaaaacgacaaggactactcagattgtatccatattggtttccctagttctacttggacaagaggacacctatgagtataaatacagggcccctggagaggagagggggaacgaccatgggaaaagacaatcaacacccaacgggatcaacacacgacaggatcaacacccaatacaatcaacatagaagcctacatacgccaagacacgccgccggatatcgacttcaaggataagcacggctaataccttgcggtgtctccggatactgtcaggagaaacgaaagcgctatctctgatctcgccgggcacggattcgaggaggaaggctaccctgttgtcgactacgagtcagatcgtcagactgccatgtcgacaacagttagattggctacccaaatattgtactggtgtgattatcatgaataagagcaataccggcttcggccaacaggatggcttcggccaataggatgtagggttattacctgacaacttaggggcccgaacctgtataaaaatccctgtctccatctcttttacctcagtcttgcgtatagcctagcaccgacgatccccataccatgcaaatatcagaattgcgacatcaaacgtcgacagataggatacgatgttttctataaataaatctgaagagagacaaagggagtacgtaacaaaacgtgtactcgaataaattatgagagtattttattttgggattagctaaaaatactgtcgagtgctttttagggaaaactttcaaatctaactatagtatataattttactagaactatactataataataataacttgtatatatgtattaaaataatatatgcaactttatatagagatatcaatgtagttatagtgtagttacaccatagttacaatgtaatgtaattatagttttgtaactacaatataactagaatgtgactttgatgtaatttgaaaaaatctgccataaacatgtgatgatgggactagcttgtgaaaagagggtttagattcgataataaaatatctcattacaaatcttagcgcggaatcgatggctaaacactcatgaaaactgtcgaaagtcagctagtagttccgtttatttttcatagtagtactaatactaatattaaggacaagtagaacgtctcacatcagagtactccagtggataaagacagctattaccgacgaacagatgggaagtcggaagtacccaagcaaaacaactgatgaggcgaacgtgtatcaacaggcacgaaattaaattgttttggagtaatttatgacggcttcttctccgtacggactttggaatctcctctaatgaatcgacttgacgtgacagtcgtagtagtattaacagatgattcaagttgacccgattttgcttctttttttttcctccccttttgctggcgatccaccaataattaacacaaagagcaaatgccccactggtggcatgcaactatgcacgaaacttgcacgcctctgtgaagtataaatttattatatatagttgaagtataaatttattatatatataaatttactcactacaatgtgagagaaaaacaggcaataagacatcgaatgcttcctttcaacatatggttatatacactgtgaaagttggtagtagttgttacccggtcatagcttgctacacgcaacaagtaaataaaaagagcaattttatggtacttgagggaggtaccaaaaattaagtataaaattttgtacctcatagtatctagataccgagaggaaccaaatttacaatagaaaaagtagtatctcatgatacattctcaaggactgtaaaattgcttaaataaaaatgaattatagttcagtcacaagctaacgagaaaatggacatttggccatgttcaaaaaccagtttcgctagaatgccatcctgaaaatgcgtttcgctaaaatgccaatatgtagcgcgtgatcacaaccactttgccaatttcctccattttcaccattttcaattccatttttgctagaatgcagcttgatgagaccaaattgcccctcactagctgaaaggggatcaagatccagctcctctgtcacctcctcctcccatgagctcctcgacatgggcggcgacctacttgcggcggagctcctcatcgaggcgagagcgtcgagacaccatggaagccgtgaccaactccaccccatggtgtctagccccttgagcaggccttccacacgacggtgtcgggcgcggcggcgtccggggcggccactagcacctccgcgtagcgcggccctgcccaacacgtgatatatgccggcacgcgcacggtgatccactcggccacctccagcccaacgagaaatcccggcacgattggcagctctcgtaggccgacgatgtccgggacggggcagagcatgcacgcgcctaccggaccaactccccagcgccttcacgaggctggtcgtggtggggacgtcggggacgaggaccgacaccctcccggccacgtcgccgcagagcctggagaggaatgtggcgtcgaggaggtctagcctcatgacagcgtggtgccggagcacctgctcctgcgtgtcgaggacatggatgacgtcaggaggttggacggcgtggatcaggacctgctcctgtgcgtcgaggatgatgtggtcgccaccaccacctccgacgacggggcctgggcggatgacctagaggaaagggcggaaaatctcggtgagccggggcaatttggtctcatcaagccgcattccaacgaaatagaattgaaaatggtgaaaatgacaaagtggctatgatcgcctgctccatattggcattttagcgaaacgcctttttggatggcattccagcgaaaccgcttttttaacgtggccaaatgtccattttctccaagctagcataggtatcttttgtgtatgggcctaccttgtttttctcgtcataggcttatacattgtggggctcaataacaactactaccaccggatcaatggtcacatgttgttacccacttgtttttgttattccattatcttaaaaaaattacctacttgtaaaataaaaattgtgcatgccctaaaaatatccaaatatatcaggggaattcaactttttgttgaagctataactaaactcagttgagagacacgtcatttaaatagctacgaagaaattaagaagacatatcaatatgtcatatatcacttcacaaacaggggtgaagctagagcaaaatggagggtggtgccacttgcttaatttactccactttagatcgagtttaagctgatgcgggtgtctaagtttgcataagggggtgcatacatggtgaaaatagataaagtatagccctgggatccccctaacatatactagctccgcccttgttcacgaacatataatttaaaactatacttttgcatatcataacaaaaaaacaaattaagtatttttaatacggattggctactcttctgtcgatagattttgctgggctccatctttcgttttttgggccgtccatcatgtttaagattcgtgcaataattgggttgtgggatggacttctctgtttgggctaccgatcttttttatctattgggctggcctttttattgattcctcgtgggtcccatagcaactgttcaattttgaaatccgcgcctgcttttttcttttctcttctgtgggtcccacatttgctgaattttctcatttcttccgacatagagagagagaacgcttttaggagaggagagcagagagcgacgacgatttcgtcgtcgtcaacagaaggccatttcgccggggcagcgattctggcggagcgatgtgagggcgattcgttggtgagtagctcgacgtgagggtgattagttggtagattcgtccattattcctccattctccctttggagcatcacctgaatctgctcaactgcatgcgttgatgagttttctcgtttgcgtttgggtttgctgctaaccagttttgaggggatttttttgctgtagatgagtggggtatccgttcctgtctcctgtgtgggggatcttggctgttaattcgagcacaaaggtgggtgggtggtgggaagggttgttgctgctgttgaggttttgagtggatttttttctgttgatgagtggggcattgttactgtttgatgtgtgggggatttttgctgttgattgggggggggggggaggtgggtggagtggtgggaagggttgttgctgctgttgaggttttgagtggatttttttctgttgatgagtggggcatttttgctgttgattggggggagaggtgggtggttgttgctgttgaggaggagtggattgtttttgcttttgatgaggaggggatttgttcatgtttatgaggaggggatttttgggatctcgtttttttggatgagtagtagtattttgtgtgtgcttatgttttttgctttggacattgtgttatttggctttcatcaacgatgtgatgttgttcatgtgcgattagatcatgttgtttaattttctcttaggtatttgaagcttcgatctggtggattcagttaaggttagttatttgtctgaacttgatgtggtgtagatctgaaaatgaatgtactaaattatgtagaacactatgtgtgatctgaagttgtttttaactggatttaatagagtttgatttctcatgtagatctgtttaccaatgccctagactgatttacttttgttttggttttttgtttggatgctcagatctgtagttttgcagatatgtagtttgaatctaagaatgatttgtgtgatcctaagtgagtgtggttatatgatttgtgttcattggaagcaccataagacatagctgtaccgaatttttaattcaccttggatgaagtgtctgtgtgtgcactgatgaaagttcatcctcagtttcctccgtgacatcagttgtcacttaaattgatgatttaatgtgtgtctgttttggattggaaccttttgtcatctcaagtggagctggcattatatctctgctgaacatgcttaatgaaatgatgggttgatatgtggttgcacctctttttattagttaactataaactataagctcacattcatgcatgtaccatgattcaggaaatgacagacaaatgataattaaatgaaatgatttaatctgtagtagttttattttgaagttaatttaagttttttcattacttcaatctgttctaactgtatttcctctattctatttaggttttatttgtaatatttgatccaatagtactatacctatttcatttcccgtgtttgttgagtccttacagtgtttttttttgggggggggggggctgtgtgagtgtgacagtttatccagctatataaggttcatgtaatgcatttggtgctatcctccagcaatgcacttaataacatagtttcatctttttcagtaactgaaaacattattctatatacggactttttttttctgtggattaatgtttgaacaattatgttacataggttacttttgtccaagtacttttgcagtcttcttgttatatgtaatttgattactttagcattatttaaaatatttgctcctgcttttgtttgctattcccattgtgtaatcacatttcttttttttaatagatggttcacgcaaaggatagtgatgaaatttttgttgattctacttcttcttattctcaaagttctgaaaatgatgatgttatttctgatagtgaagtgagtatttctgtcttaattttttttcctttttttttgtacaatgaagcaagagacttatatgtgttttttattgtgttttctaattacatgattaatcttcactatttttttgtaggactctaaaactagttgtgatgagatatcaaaagaggagctattgcgatctttgaagctgaagttgaataaaaagaaagtatctgttgactgcaatttgaaggttactttttttttgttatgttcagttttaattattatttttacagctttcccattttttgtattcacttggtaaatacatttccagttttttttttaaaaaattccctattcttgcgcagagaaaaagatctgaaacaaccagaagttgatttccaaaatcagttggattcagcattacttgaaatttttagagacaatgttttgattggtatgaaacgaaaactctactgccataaaagcaaggtaaatgtaatatatcgaggcaagaaattgaagatgtgcactgcccgtccataaattgttcttttatgcaatttttttttatttttccaattttctttttttgcagaaaaaatctgtcatgactgatgcaacagaagaaactaaattgacaagattctctgtgaagtactttctgaagttctggaaaagttgtctaaacgtcatagagatatcatttccaaatcttgtttcaaaacccttttgttgtttgagaaatgttctgtgccatatagacttgctttatggattgcccaaaaagttgatgtcaattcttgtgacatcattgttcgagacaaagtaattccactttcaaaagaatctgttcatatagttttaggtcttcctgttggaggtttacctatcagttccaattctgaaattggcaagcagaaaattcttgacacttttggtctctcttctttgcctactgtcaaattttttggagataagctgataaggaacgaatcaatgtctgatgatcaagtgttgatatccttcatgatggtttctttgaattgttttctttgcccaaactcatccattcaacctagcacaaaatatctcagtgcttttgcggatcttacttctattgataaattggattggagcaatcttgtttttgaatggttgatgaaacatcttagcaagcttgagaagtccaaaagttttggtggttgtcctgtaactaccttgtggttagtattattactctatctttttttcaattgctttgcttttttgtaaccacttaactttatatttttgctttttcttattaataggtcaattacttggattttcttaactttggtatgcgaaaagtgttgcaagatactccaagaatcaaagtatggaaaggaacaatgatcaaaaaa

SEQ ID NO: 80843 - DNA, 9700 bp, Oryza sativa
attcctgcagcccttagtatagatgaatctggatatatacatgcttagattcatggtattaggttgcgtcaatatcaaatagtaggttcagtttttttttaacggatggagtatggcataattactgcagtgaattaaatttgggtcatggaggttgagaggctaaatccttacggagctatcgtttctcttattcgcaaaacgacatatttacaaacgaaaaataacttgtgaataaaacttttatatacgtgctcttagcgatctaaaagtaaatgctgaaaaataaacttcaatgaaaaaaaacctcaaaatcaactccaaatttaagattgaatattcaaaatttggttgataagcataagcataagcataagtgaaaaaacgaggcctttacttcatgcaattcttaatcgatcccggcgagcaggtgttgaggaagggtgaggcacgatggtcgttgtcgggccaaaggcggtcatcgtagctgctggggaggctgggctcattgtactccggctagagcggctcagacgaagacggcggcggggatgactccgacgaccctcctggccgcctctagccatcgatcccggtgagcaggcatcggggaagggcggcggggcacgggggtcgtcgtcaggccaaaggcagttgtcgttgtcacaactacgggggaggctgggctcgtggtactccggcaggagtggctcggacgaagacgacgacggcgatggtagggatgactctgacgattctcctggcctcccgcccccctcgctagccacctccctcttctactcgcttactggcctcctggccgccagttggcttcaactcaccgaccgccgccctttctctgtccccagctctccgcacgcgctcgtccgtggactcgtggagccggtgatgacgtgcccaagctagagacagagaggagggtgggacccactgacatgtgggccccccattttgttttattgttttgtttttatattttgtttttagtgtcacatcatcgccacgtaggattacgtgatgatgaccaagtcaaaccaaccacgtaaacatcacgccagccaaaaccgtcatccaaatcgttgtgggacctcatctgcacagttttgagacttgagggaccagttgtatctggtattgtcgttcagggacgaaaatcaaactcgttgtcaagttaagggaccttatataaacttagggctgggctttccgaatcgaaagtcagtccattcccgtgcctaccgatgacgcagtcctccctcctttcttttcggtccacgcggcccgcttctctagtccagctcgcgcgtggctggcacacgcagcaacgcgtgtcgttttgtgagtggcaaatacgggagggccacggatcgctacacggatcggcaatattagccgtccgatggattccgatcgaacgggtagaaccgtaggagttctctcccgttcatcacgcgggcggcatcgacacgtgtagttttgcgaatggtcagcgcggaagcgccacggatcgccacgcggatcggcagtatatgccgtcggatcgcttctgatcgaacggataggagcgcaaatgtgttttcccttttcctcgccgggatccagcggcgcctcgccggcaaatataaatgtgagctccgacggcgacatctgccgtacctcctcttcgttaggtttagccagtgaaacacgatgccctacgtcacgtcggaggcgcaggcccgcgccctcctgcaggtcggcgggtggcccgtcggaactctggtccatgtcgtcatcgtcgacgccgcctgccgtgcccgccgtctcgaccacacgctgcgggcgatggtggcgcgcagggggtgggtcgtggtcaaccgccacgccgtgcttcgagtcatccgcgtcagcgacctggtccacaacatcctcgacatcaccctcccccgcctcctcgacgacgcctacgacgccacgcagctcactcacttccggaggcaggcggcggctcttcgtacgatggcgggtgtgatcggagggaacttccgcaaccgcgcctacgtcgtcgtccgcaagattcgcttcgtcgccagcagcgcccgcaaccactccatggcggcggcgaggctccagcagcgtctgctcgacatcaggcgtcgcctcagtggtctcgtcgaagcacctgttcacctttgagcgtttttagggtgaatgttttgtccggtagcagtgtggtttcaccttcgactcatgtgcagtagttttgtttgatgataggcctgagtttcatctaatggttgcataggcggagcacattctcaccttaggaggagtatataggtactatatgaaatacagatagaatcctgcatatattaggagtaaacatagaggagattcgaatttcgaaatgctatatgaattgtggaatggtatatcggaaaggatcccgtaatgttcaattgtaattgccttaacaatcatgtaaggaatggatatgatttgaacagaaatcgagttaatatgacacgatgcatttatttctcgtttgtttttggtctctgttcagatttttgctgaatgctgtttgtactttaggatttgaacctattatcatcctgttttacgatttccctgcttactatcctccctgcaatatccatgttgaaattgaggatcaatggaaatgaggatgatgcatagtggcactgttagttgagaggaagatagagaagacagaaaaacagggttaaggccttaagagacaaaattggagtaagaagccaggtcgtggataaaagatcattgcattctgataactagaagtggtcgctctgttttcaggatatgaacttacaaaggctttgtgcagactgctcctatctaataaatcaggtgactgcaataccctggagtgaactgtttttagtttttcttcttgttgctataattatctaataataccactttgcagattgctggtgaattgttggctcttcttgctgatgctgcttttgaaacagttagtatcccctttcggtaagattagaagaccattttattttgcatgttgttcttcatacatgttacagagataagatagccaaaagaaagattctgagataacctgcaattgttataacttctattgatattcagctagatgctagtatatgtcacctagttctatattctgcaacctgtctaggaagtagggtatataaaccagactaattcgaggactcattttactggtgcaaatcacgtgataagatcactaaaccctactagttggccatatgtccaaaggctatgccggtgtggtcagcatttagaactgtctagggagacaactagaaatatagtgaacgctaagttagtacaacaagaagactatccatgttccaattaggaagtccagtgcgagaggactatcttaagccttactggtgctgtttattgtggctaactggtgatacgatgaaaaggcactgcattgctatgttcgttaagcactttatttattttctttgtcaactatatctacatttgcatacaatgagttgaaattattttacactggatatttattgcactgttgtttgtctgtcatacaccatgtctatttagttgaaaacatttttcatggttctcactggtgctacaagaggtattgtagaactacaagaaagtagttctgtagcacacccaaattactagggatctgaagtgacaaatgcatgtagttttgctggattcagtcccacattggatttgctcaagtgtagcccctaggttgttgactaattttcacctaggcctaattttgtataccatggcggtttcttcttaatattgtttgtgaagccttgaaaaagttgcagagttatgtggaatgccttctccacatgtacatgtggctacatgcactaacatcactgacaattgtgctttaagattactgtgacttttaatatggaaaccaaccaaatattcaaactgaccagattcatcataatctctttggcacaaatacataagcacttcagatgggtacttgggtaggataatgcatgtacttgtaaggcctgtatataaatttggagatgcatcttgtatttttcccttcctttgtgtcttggttttggctggtggttagttggctgatgttgtacattcttctggtctggtttaattttaatcttcgtggcaatgtttatcctgcagtttcttggctgtttgaaagatgatttgaattctgaggtgccttgggcactgtaacaaatgtcacggaggcctgtgtggctgtgctgtttcgctatacatatttataaggatgaagactaatcctctggtgtatgggatagcttgggaagaggtatccttttcttcccttgttcacatcttcgacgacttgcataagcttattctggaagtacgtattttgtagtgtgagttgactactgtgttgtatgctaactttttatgcattagcagttgcggtagtgtgacatattctgtgtattactgatgatcatttctatcatgcgacaagcaagataattgtctttgttatggtacttcattgcactattgatactcatgctctggtttttgaatctaaattgaatctttttgcaactcccagtttcatatttgccaaggttattggtgattgttccttggttgccaagcaaagagcgtttattattcatgctgcatgtgcgctagataaagctatgatggtgcggttatgtgaaaagagcggcaacttttattgcacagaacttggtcgaattgcaaaccacttttaccttcagtactccagtgtggagacttacaatgagatgctttggcatcacatgaatgagagtaaggtgataatatatatttttctctttttatttatatgatgcttgtaaatttgcactaaccttttgttagaataattgggctaggcccaatttattctattaaatctcaaaggcccataataaatgttaaggataataataccacctctggatttaagcgagaaatatctcaacctaaatagggagttattagaggctccctgttgaccagttgaggtgggggtcggaatgccacacgcgcgcgcgcgccgggccgggccggggcgtgggcgagggcgaggcgagggcgtggctggctggcggcgtgcgtgcgtcacgtcgctatccttttgcagccactaacccacgttccacgattccctccgcaacagcgcgtccacgttctttctcctgatagataaggaggccgcgagtccgatccgagttcctcgcttctttcccggtgttagtttctccttctccgcgcctgagttgctctcgcttctccgcttctgatctcttgcgcgcacgagagattggaagaagcagtgcctccgaaaccacaccttcgcctgagatgggtgatcaggtttttgggggagtgcctcctgcacgactgctcatcgccatgtctggagttgctgccgccgctattggcggaggtggtgcgccgccgccgacaggagctggtgcgccaggaggaggtgccgtgaacgactacaacaacggaggcaattctgcctcaccatccagcggagggccattctcggggtataatcttctccttctactgctgttagcgttactcctgttcccattgttagcgctatactgtgtgcgctatgttcttgttcctgttctacatgatgcctttagcatgttatcgcattattggtatgttcctgattctgacattcatgatgcgcttagtatgctactggttatgttaagatcaccctacactgcttatgccatgatcatagtttcaatttcttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcactcgaggccaagttcggagtctgacgccggcagtgagctgtatgtcatggagcagttctatgactacaagatggtcgatgaccgttctgtagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacatccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaaaggagactgctttgtgtgtggcaagtctgggcattgggccaaggactgtcttgagcgcaaagacaggaagtctgccaacatgatcattagcgagggcggaggaacatcggggtacggtaaaaaattacctacagttctctctgtttttcattcacctgattggtgggtggatactggtgctaatattcatgtatgtgctgacatttctctgttttcttcttatcaggtcgggagaggttcctccttgttgatgggaaacgggtcgcttgcggttgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtcaaagttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatctttttgcgaagagtttggaattattcatgagatgacgcctccctattcaccccaatcaaatggggtggccgaaagaaagaaccgtactctaactgagatggtgaatgccatgttagacactgcggggctttcgaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagtcaaaaagcggaaacttggaccaaaaactgttgattgcgtgtttcttggttatgctatccatagtgtgggttatagattcttaatagtaaactctggagtacccgacatgcatgctggtacaatttttgagtccagagatgctacattctttgagaatgaattttctatgaaatatacacctagcacttctagtaaagaaactgtcatgccccatgagcactttgcaccgatagaacacaatgatgaaacgcctgaggaaaatcctgaggaggacaacattgtagatactcgcaagagtaagagacaaagggttgcaaaatcctttggagatgactacattgtatacctcgtggatgacaccccaagaaccatagaagaggcgtattcatctcctgacgctgactactggaaggaagcagtacgcagtgaaatggactcgattatgtctaatggtacttgggaagtcgttgagcgtccatatgggtgcaagcccgtaggatgcaaatgggttttcaagaaaaagcttaggcctgatggtacaatcgaaaagtacaaggcaaggcttgtggccaagggttatacccaaaaggaaggcgaggatttcttcgacacatattcaccagttgctcgcttgactacgattcgagtactacttgctctggcagcctctcatggtcttctcgtccatcagatggacgttaagacagctttcctaaacggagagctggaggaggagatctatatggatcaaccagacgggtatgtactagaaggtcaggaggaaatggtgtgtaaactattgaaatccttgtatggcctcaagcaagcacctaagcaatggcatgagaagtttgacatcacgcttacatctgcaggctttgttgtgaacgaagctgacaaatgtgtatactatcgctatggtgggggagaaggggtgatcttgtgcttgtatgtcgatgacatactgatctttgggaccagccttaatgtgattgaggaggtcaaagactatctgtctaagaattttgaaatgaaggatttgggagaggctgatgttattcttaacatcaaactacaaagaggagatgagggtgggattacacttgtgcaatcccactatgtggacaaggttttgagtcgctttggatatagtgactgtaagccagctcctactccttatgatcccagcgtgctattaaggaaaaaccgaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaaggatatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggctgagtggcttcgtgaactcctgatggatttgccggtggttgaaaaaccagtgccagcaatcctaatgaactgcgataatcaaacagtgattattaaagtgaacagttcaaaggacaacatgaagtcatctagacacatcaagagaagactgaaatctgtcagaaagcagaaaaactccggagtgatag

SEQ ID NO: 80844 - DNA, 8073 bp, Oryza sativa
atacccacctaaggttgcataatagtggaaacctgtccattgtgatcggagatcccgtgaatttggatggtgaaacaaactattgtgtgactgagagaagagacccttgaaaggggctcattttcatgatgtgcttctcttctttcctgtatggtaggatggcttatgtcttaatgtgatccgagtggcttttccaagcagagatgttgacctgcagaacatctcagaaggaacacacctatatgagttcgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttaagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaatttattctattaaatctcaaaggcccataataaatgttaaggataataataccacctctggatttaagcgagaaatatctcaacctaaatagggagttattagaggctccctgttgaccagttgaggtgggggtcggaatgccacacgcgcgcgcgcgcgccgggccgggcgtgggcgtgggcgtgggcgtgggcgagggcgaggcgaggcgtggctggctggcggcgtgcgtgcgtcacgtcgctatccttttgcagccactaacccacgttccacgattccctccgcaacagcgcgtccacgttctttctcctgatagataaggaggccgcgagtccgatccgagttcctcgcttctttcccggtgttagtttctccttctccgcgcctgagttgctctcgcttctccgcttctgatctcttgcgcgcacgagagattggaagaagcagtgcctccgaaaccacaccttcgcctgagatctgcaccgggtaggcgggtgatcaggtttttggggagtgcctcctgcacgactgctcatcgccatgtctggagttgctgccgccgctattggcggaggtggtgcgccgccgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgttcctgttctacatgatgcctctagcatgttatcgcattactggtatgttcctgtttctgacattcatgatgcgcttagtatgctactggttatgttaagatcaccctacactgcttatgccatgatcatagtttcaatttcttggattaaaatatgccgaataatgactatatttccaacacctttctggatactgggggtcccattcctctggattcgaaaatagtgtattaagagaagaagagcaggatgaattagaatgcatgcccacaagatattaaggggaagtttgggaggggggacccactgacaaacataggaaaatttcaattctcatacaggtatctattggagaaatgctgtttatcaataattcttgagtctaacaactttctttaactgagcacttgtatcaactttgcaggtttacatatcacgtgctctacttgataactcctctttgcactctaatgctcaaagcattagtcgaagcttggatcatgttatgaggacattatttgagatttgtctgcgtcaaaggtggtctgagatgacatccttattattagagtactgcaagggtgttgaccacaaaatatgggcagtttgtaatggaccttcctaatgaggtttttcatcagttaccgcttgccatttacatttttatgtgtttgctatttttttatgtgttctctgaattagatatgtaaaatagtagacttgaggatgaaaatatctatctggatcgtctttatgggatagaagaaaatgatatcggagctctgattcactcttctcatccaggaaaggtatgccctgacttaacaagtggtacctgtaactttgcaaagttcatacgaatactgcaattactgaaaagtactggctaatgtaatttacaacaatcttttgctgaaggtctttccatatgtcaacttatcttcttgtgtgagcccaatcaccaggactgttcttaaagtaagggcttttggaagccatctgcagccttttttgctgagaaaggtgaactcccaaagagatttggtttagatcagctacactgggaatcctcctgcaggtgataaactgtaccagtcttcctttttcttctctaaactgatatttctaaagaaatgtttctttcaaataaatgtatgatgcattaatccagaatgtcttctgttgaaacctcaggatattgcacagcggttcctctcttggtcatactccctgtgctagagagttaaggtacgcagaaattcagcactgcagacctgtattattaattgcacctaattcaacataagggcttgttagtgcctttggacattattatgcttattattgcaataacttcacttcaacgagattgttttatttacaaatgaggatagtatcacaaaggtagatatgctaagcaattaagcacactcatatagaatcagtaataacttgttatagtctctatggtctcctactttcctaactactactttcgcaacatattaccttaatattgcttcatagtattagctaaacggagaaacatgtgtagggtgtactaaatgctgcttgtccacttgccacttgcattcacagatccatcttagtggcattgatgtgctttgtctttcaggcagttgctcttagtggcattgatgtgctttgacttgtacaaaacatccttggatattcttttaatccatcttgagttatctgtccatgtgtagctttctcatctgagagcagcataatattcttagagatttattgaacaactaccgtaataggcccaacagtggggctaaatcttcaagaaagtgtaatgataggactgtagctttctcaaggagactttaggtttgtggtgtttacattggcaaacaattcagtgattatcaattttctctctcttttctactcgatcatattcttatttctattttattagctaccatcgctggaatttttttttatccctgtaggaagtttctaggcagtgcggtttcaaaaaggtttttaagcagaaagttttttgtattgttatagaaagtttatgcatagtaatgtttatttcttgtataaactttttgactagaagtttctgagcacaaagatttgtgttctagaaaatttatgcgtaataagcttcgtattcctgtagaaagtttatgtattcctgagcagacaattttttatcctgtgggaagtttctgagcacaaagcttcctttgtttatcaatagacttggctataacacatgcatacaagttttaatgacaagtctcacgtactatatggctgcacattgctataatgagaagcactaccctgaaatcaaagctatcacaaagaaatctaacactgaatctgtataaatatgtgaaccgcactgtcggcacatcgccacctctacattatgtaaatctgtattgacagttacatggaaaaccaaacaaattctaaccgagatgagtgaacttaagtgaaaatcaagcataaaacactgtattttttctataaaatttggttttcaaattaaatcatcaccatttcactgctgtcttgtatgacctctacatttgacctatatcagaaagaaacaggtcatattgtactgccagtatctttctgtttttctcctgcagttctacctaactgagacactaacagtatacaggatctgcgtgggatgactcaagcacatatgccaggctgttggtttcttggtatgtacctcaaacttaaacatgtttcttggtgtgtagctcaaacttaaacaagtggatgtttatttatatgtaaacaacaaaattgatggaatgctgactgatttttaattacacatgatctttcatagacaaaatcttgatgaaaattgtggccattcttggcctcacgtcagataaattcttacatgggttttctggttgtattttgtgatgtgctgcaggtcatttataaaacattcaggatttcatacatggaaacgataaatgatctgctcacagtaagtacctataagctaacttcgcaccgtctcgtgcgagtcgttcaaaaaaaatgaaatgcttatacgtactcaaggctaaaccaaacattagtgtaaatattagacttttacagagtagtacactgggtgtaaaagatgataggtttagtaattattggcaagttgttggaattaacagtgttcttaatgcagaccatttcaaattgtagtgctagaactgtgcaagctgtatgcacattcaaagggaatagcgccctagcccaacataatatcttctctgtttttaaagaaaatagtgcagtttgtgggtatacattattagttactttttcaatctattgcaaatcctgatttttactcaacagctagacattctgaccaaatggctgttcttctatatgattgtttgattctattttcatagattttcatttttacaataagtggttactgtttttaatcatatatctttcctgcttgccttggtcatagcacaggcatatacatgatacatttgtatgatcatacattcaaattttgtcatgcatagagcacataagacggggaaagcaacatgtacattctttacaatcctgcaccagagaagtttgacgatgaagtttttcattaactaatcgacatgatattttgtaattcaacatgaatcatctgtgactttatacatgtgtgaagtgtgctaccagtatttcgacatggaagatcataaccgaagattttacggggggcagaggggacgaggtggtggatgacgatggcgagctcagaggccacggtgatggccaaggatcgttttgctgtccggggagtactaggcttaggagattgcaactatggtgtccatgtggaagtgccagcaacgacgaggcagagctcgatgatggcgttgacggtagcgaactcaccgtgcagcccggcagtccaccaccaccgttggttgctgctagcgctgtgtgtgtttgtatgtattcctctacgtcgcaatgaagcctatggcgatgggcgttgtggcatacaacgtgtacacaaggtgtacggtgctatgaagctatgaaggtggcgatcttgggcaggaggcacaaaggcaggagacgccaccagtaaacatgtgtggacttattagctagcgtacttcctcggaataagtccgcttaacattcgtcatctttacgtggaatttagttgaaatccctaaaccgcaaaaccaaatatcttcaccttccatcgtagcaaaaccgtcttagtcgggtcccatcatagtatggatggttgttttaacttatgtgcatcctagccaatagaaagaaaataaaaaacatttgagatccatatatgttaggagatctctatttcctttgatcgccctctctcatctattcccatctctcccacttcttccttctttccccatccctctttagggcgacgaccagtgttgacatggggagtggcggtggcgggagagaggagacaagacaatggtgggggctagacacatggaggtcacaccaatgacctcatcgtggaggtcacaccctagcatgacacatacaaaaaggaaatggaaagctagaagattgcttcgtcaccgtacaagggcggaagggataatcaaaattggtccgtgctgcctgttgtcagttgtcacaccatttatgcctctgcggatcataacaaccatctgctacaactgttgtccgtcatcatctaaatccccttatgctgtcgcccgtattttgaacgctcctagtgcaccgcgaagccactttgcagcgctaccattcaaactcaatccccttatgctgtcgccgtattttgaacgctcccagtgcaccgcgaagccgctttgcagcgctaccattgtcttgcgcagatcgtcaaactcgtcgtcgctcctagagtgttgctgcaactgcctttattgccatgagatcgttggagatgctccactgtcatccacacctcttagcaatcagatttggtgtcgacgctcgcttggcaagtgatgcctctaggacactgccaccagcctcatctgcattaggcgagctgacaacaatcacaccgtcagccgaccctgtcaccaatgaccaccgtcccctgttctcgcctggcgccgatgaaggggcggagccagccagtgtaccttgctccaatcctccaaatcttaaccaagccagtgggagacaggtaaaataccacctgttttcagctttcctacagtttcatcaatgaacgtaggatggtctggtactggcactctggtgatgaattaaccaagcacatggctgaatagaccactgatgacttggataaaagcacgacacacctcaagttacacaagtctgttattaataactccaaataaattaatggaggcacagacctaaataatggacaccacaccactaataactcaaaacgtaaagcacgacacatctcaagttacacaagtctgttattaataaattaaccaaggcacatacctaaacaatggacacaacaaataacttaaaacataaaggacaacacaccttaagttacaaaattaaatactgggtaataatgatccgacatccaagttaccaaccatggcaacggctgcaaggctcccggacattgaacttgactgtagagggaattttcccctcgatgtatgttcggatagccaagagcgaattatgcactcccttgataacatcctgatccaatgggaggcagacatcgatgttgccgtcagaacaccgaagttgagtgcaaagagtgtccaatgtaaggcactcaagggacgttgtattttccataatatgacatattagctcagccaagcttcttgtggcactgaaaccagtgatcttcacattcttaagcttgtcgtgccggtgttcggggatttgccttagacatatgggatccttaaatgtcaagtcatgcttctctttctgtgaaatctgaagatgaaaaatcaatgatacttcaataaattataaatggtccaccatagttattagataagcattgcataatgaacggcaacttacacataggatgaaagtctccaaggaaggagaagcatcaagaaaagatgcaagagaaaaataatcataagcccaggaaaatctccatgttgcaaaagtaatcctcaagtatctaaggtggaggaatttgccagggccagttggtgtatccaccatctgcaaaaagaaggctcagaccaattatatttcagagcatggtactacattacacgccaacaatgtatcacctaaagtgcggtgcatacctcacaagacaaaatgacattaagagtttcaatatctggcatactaaacggaagctcaacacgagcataacagacactgttggggaaaaccacttccagattcttcaatcgcacaggttcctctagtgagaattgcgcttgtttaccttcaaagtgaaaactgcatagatttggagctttgctttctagcatttgtagcccgaaacatccaaatacccccaggaagctaagccgctgtagcagacaaggtattgtcaggcgattaatctcgccacaacgcttgatttccaacctctccaaagctaaagcattggaaagaagatattctatgtcggtatcaataatacgcacacaagatatgtagcgcccgttccgtcgtggcgcctagcgggaaaatgta

SEQ ID NO: 80845 - DNA, 37028 bp, Oryza sativa
ggcgtcatacattaaaatacggagggagtacgcaccaatgcgaccaaaatggctcatcaagtaaagtcagcatgtgttgatcacccccaaatggcataatatacaataggcaaataataaattcattgaatgtgttgaatgcaaccgtggcatatatatcaaccaagggagatcgatcgagagagaagaaaataaaattagaacaagagattaattaattagtatgaacttacaatagtgctcatgagtagtcctcctttgctactacttggataaaaattccattgttttttatgaaagatggtgatcaagttgttgggttgaatgaattgatcgatcgatcgatcaatcgagggcggcacaggaaacctaggccgtcagcctagataactccgacgcgtactacgttggatcgatcacttgcttaattattagctatatggatggttaattagatcgatgggtgagctagctagctgtccaattatttaaacagtgtactacgtacatgtgcacataatttatgcttgtatggcgtcaagttggcaacaaaataagttaataaactaatctctgccagtaattaatttagtactgatctccatatatatgtttgttaataatttgagatgtgctaagtatgtatggcgcttttgtgtgacgaaaaagttgagatttcaccgataggaactaaatcctagtgttatagtagtatataattatgaacacggggcatatatattcttatattcttaattgtaatagaaattcaataatatgttatgaattttaaattttttttagataatgaaaatttataaaatccagcttctacaccaacgggggtccacaacttatagtcgacttctatctaactataagtgtgaattaaaaattgtaatttattggctcttgtaacataaaaggaagcatatttgtgcactgttaacatgtttgcgtctttcgtgtaatcgagaacccgagaggaaaaaaaaacaaagataacttatctgcatatgcatcttgatgcgtacagatatcgatggatcgaacggtggaacagcaagtggtccgtgcaattaggccacgcgcgtgctcctcgtggtccattatactaaaacaaaaacgcacttactaggaaaacaaaattatttgatttaatttggtgatatatagtcgtacttgtacttcctccgtcccataatataagggattttaagtttttcttgcaacgtttaaccactcgttttattcaaatatttttgaaattattatttattttatttgtgacttaatttattatccacagtactttaagcataacttttcattttttatatttgtaaaaaaaaattgaataagacaagtggtcaaacgttacaagtaaaaactcaaaatcccttgtactgtgggacggagggagtagctaatatagggcctgtttggggagttttagattatgagaagcagctgtttggtagccaacttctgagaatctggataagctccgaaacctagcttctccagcttctggcttcttagttcattcagcttctggctttttagttaatttttcagaatctataactacagattctcagaagctgtggactgtttggggcagcttatagcagaagtagcttttggaaaaagctgtagctaggacaagctcccccaaacagggccatagtatgcgtttagtatgtagctaggagaggtccacgtcacccctctggctaatttaatcgccatccacgcaattgggctctatttttctccgctgctgctctctgtgttaaatttgcatatatttctatgcgtgtgcgtacggatgacttaaatttttctgtgtacacaagctaacctactcatcctgttcctaattaacaggagttatcatctcctccttcctattcttaactagatgaacaatttagttcatctaatgcatctaaactgttcgacaagtctatttagtataccctcatttacaaaactggttgcctgatactattatattaaaaaaaattttgggccagcaaattagttcacaccgggtattgagtgcttgtttgtttttccgcagcgggatagatctgtggtgtggctgtcactatagtctcttaggactatagaattatattttcttaattttgctatatcaaaagaaacgtctctcactatcttatacgtgttgttcaaaaaaaaattagtacacaccagactgcactttcaatggtgattattttattgacaaaatctaacatagagtggctgtaattttgctttgctagtgaggaagcaccggctatatatagtgatagagttggggcctcgtagtcgcatatctctgcgggcctcgtagacgcataatactcaatagttttaaatcctggtactaatgagtattacacaagtgagtgcattttaaataggaattcattaagaccatgattaattaccatcagtctccatctatttaaccgtgtgtagtgttgtgtagagtattgtactcaatctaattgtagattcttttttataatgttgatggccgttttgatgtgttttctataaggatattaaacaagactggggagaagagggcgacaaaaaccagagggtagattcataatgtggtaacaaaaagggtcaacaataatttaaatgtcagcatgcgtgcccactcatcaaaactcgatggtatgaccatcattatgtcaaaagaaagattttattttggtcatttagtatcagtatgtcatctaagaggacacacgagtacttactacactctgaaacccttgtcaagtaaattcatccaggattgtacaatagtggtgataaagccttggatatccccttgaaatatactccctcgttccctaaatgtttgacaccgttgatttttttaaatatgtttgactgttcgtcttattcaaagttttttgtgaaatgtgtaaaactatatgtatacataaaagtatgtttaacaataaatcaaatgataggaaaaaaaataataattacttaaatttttttaataagatggacggtcaaacatttttaaaaaagtcaacggcgtcaaatattttggaatggagggagtaaatcctccttaacgactatgatatagcgaaatatacatcgtactatatgcatttttcattctgttttctatcttgtccttgctatgttactataataaattacattttttccaagtgctataaatgaaagtaactgaccccattaaggtcctctcgaatgtagaatttttttagcgatttgtgaactgaattaatatctaggaaaaccctacaaaattcatgtgccgttttgaaatggaaagtaatatacgctcttatatcgtctgcttggtggcctatcggctgcggacaaaatttaaattgtaaaactaaaatttaaagttgattttgatgttttgttcatcacagtctatattcgaccacaagattttacaccataagttagtatttttaattgatatttctacagcttatcatcccgagcccaaccaattagaacaatagactcttttgagccccatctattgccctaaaaagaataagttaaagccaaaattcgaattttaaagtttaaattttgaagttgactttaagatatttttaatatagcttcttctttagcattgacttttaattttttaggatcatatatataaatattttatgcacaaattatgttttggtcagtaataagccattacggcttataataaacttttggtcaaccgacaagtccgtttttccacgatgtatcgcaccaatgaaattcatgtgtataagtaaaggatgtgaaattcatgtgtttaagtaaaaggatgcttttaattaaattcatgttatcaacctttgaacataaatatcctaaggaaaaaaaatcatgtgtagtaagtctaaaggaggagtaattgatcgaaagaatcaacgcccacgtttcgtttatttggggaataagccaaagccaaacgatatatttgcaagcaaaaattaatttgtaaataaaatttgtatatacatgttcttaacgatctaaaagcaaatagctaaaaaataaacttcaatgtaaaaaccctaaaatcatctccaaatttaaaatttaaaatttatattttaactgataagtacaagcataattgaaaagatgagaccgcaagagtaccataccttaccttacatacgatggaggcagccacgtagcttcatatttccaagctactcctacccttggccttgggccctctgtcaggaaagatattttgagcccagagcaagcaaccaatggcaggcgcacgcacacaccaaatgaggctaccatcaaatggcctaatcaatcaaagaaaaagtcaaattttaaattttccagcttaattttaagatatttttaatgtagtttctttttcaatattaacttttaagtcaccaaaagcatatttataaaagtttcacctataaatatatttttatttcctaataagcccttttggccaaacgaggacctgagcaaatgagagaagagaagggaaaaaaaaagaaaaaagaaaagaagaaaaacggggcgcccaaatcgggaaggattttaaggataaccggctgcccaccggctacttcccgccttctatctatatatccccccctccctcctttttctcctcctcgccaccgctcgccggcgccggagaccaccaccaccacctcacctcacccacctctgcttcttcttcttcttcttccccgtggtgtggtgtggtggtgaattgttgttctgttcccttcatttttcgttgattcgtgagcgcggcgacgtacgtacggtggtaagcatcgtcgtggattcgtctccggcgacgggggggagtgggtagggtagggatgttcgtcaaggactgggactgaggtgatcggctaaatgtaccgccagaacgagtcggccctctcctgcttctacctcttcctcctctggttcttcttcttgaaatagactccacgccgcgccaattcccagcccgagcgggagccagctgctcaatccgtcgttgagattggttgcggtttgctctagcttgtgaactcggcggagatttttggttttttgttttggttttgggtttggttgggtgagtggtcgatcgatcggaaggtgttcgatcgattgcttgcctgctttgtgatggagttggatctgaacaacgtggcggaaggggtggtggagaagcatgagacggcggcgaggagcgactccggcacgtcggagtcgtcggtgctcaacggggaggcgtctggcgcggccatcgcgccggcggaagaggggtcgagctcgacgccgccgtcgccgccgccgcctcccgcggcggtgctcgagttcagcatcctgaggagctcggcgtcggcgtcgggcgagaacgacgccgacgacgacgaggaggaggaggccaccccctcgccgccgccgcaccaccaacaccagcagctgctcgtcacccgggagctattcccttccgccgctccctcgccgcagcattgggcggagctcggcttcctccgccccgacccaccgcgcccacacccagacatcagaatcctcgcccacgcgcctcccccggcgccaccgccgccgccgccgcagccgcagcctcaggcggccaagaaaagccgccgcgggccgcgctctcgcagctcgcaataccgcggcgtcaccttctaccgccgcaccggccgctgggaatcccacatctgggattgcggcaagcaagtctacctaggtaatttcatcgaacacatcatcttcctcctctcaatccaacgcgacatcgccatgaacaatctaacaaacaccttcatcttctcccaaacaatcacaggtggattcgacactgctcacgcagctgcaaggtaaagaacacatcacatcattcatcagaacatgagctctgtgtttgtgaaggagattgagagaattgaatgatgatggatggatgcagggcgtacgacagggcggcgatcaagttcaggggagtagaggctgacatcaacttcaacctgagcgactacgaggaggacatgaggcagatgaagagcttgtccaaggaggagttcgtgcacgttctccggcgacagagcaccggcttctcccgcggcagctcaaagtacaggggtgtcaccctccacaagtgcggccgctgggaggctcgcatgggccaattccttggcaagaagtaagaacaccatatatatatatagctctctctctctccatcttcttcttcctcatcttttcatttcaacatgttcttgatttattgtgattgtgatcatccattttgagtagggatgatagtaagtagagatagggtgtgattagatgcatagaacagataagagttaagctagaaattaggcagtggatagggaattcctcaccggtgggaacgccatgcttggctgcaggtacatatatcttgggctattcgacagcgaagtagaggctgcaaggttatcatcagcttggattctcttctcttgtacaattgattcaaaccaaaaaaaagtcttttcttttttaaaattttactttctcgtgttgttgattttcgatggaccttgtaccgactcgaatctcctctctttttttttctcttcttttttctcttctcgttttaaacatcagggcttatgataaggctgcgatcaaatgcaatggcagagaagccgtcaccaacttcgagcccagcacatatgatggtgagctgcctactgatgctgctgctcaaggtaacatgcgtgctgaatctgatttgattaaattttttttctgtaactgattaactagctgatgaactcagctctgaacagatttaattaaatccgggttcaattgtgatttcttattatttttaggagccgatgtggatctgaacctgagaatatctcagcctgcagcctcacagcagagccccaagagggatagcggctcccttggcctgcaaatccaccatggatcatttgaaggttctgaattcaagagagcaaaggcaagttgcaattcagtcaaaattcttccgatggatgatttgtttgcatgtcaagcaagttgcagtaatgcgaaagaaacacaaaagcataaataatcaagattcgctttcaccgtggtagcgactaaagtatgatgtgcaaattgcatatgtagtcttctacctagtgtacttcatagaccccatttctattgctaccgtctaaatttgatttctctattgtcggacccaccatacgtacaaattggccccaaatttcatcaaatagtaacaagtttctctttttcttcctgattacgttgtaggagcatctctttcatgaaaactgtaaatgatattcaggatcactgcttagttgatatttcaactgaaaaacttgtgctttgctgtgcagaatgatgcagctccctctgaacttgctagccgccctcatcggttccctcttctgaccgagcatccgccaatctggactgcccaacctcatcccctattcccaaataatgaggtgaaaattttgtagctttcaacactgtatttagcttcatccacttgcatttcttgtgtggctatcagtttagctcaagtcttacatcaatgtgcttcatttccttccggcctgtcgacttcagtagtattaatgcctggcacaagtttcatatgtaggttcttgaattttcagaaaaggcctaattagggtagcagtactagtctatatgcattataaatatgtttgattttttcttcaaaaggaacttcctagagagttgacgatttcgcgttaggctttttataaatcgtcagtccaactgttcctctcaacgtgctaatatcttataaaattagtgtcggctgttgttcaaaattccccattgggaaagaaaaatgatactctgccatcttgttattattcagaatgattagtatactacatcaattggttattaaaagaggttagactggtttgccgttagacatttggacctgggagttttgttcaaatttacctctgagacttcaaggatagcttcagttacgtccttctcttattttccttggacggaaaggtgatctcgacgtctgtagctgagatttctgtccaattgaatcgtcgcaaatccaatccgataatcatattttatccaaacaaaaatacaatataatagttcttggcaatttgtacacctgtatcttgatggatggataagaaattcagcaagctaagctaagtacaatttttcactgtttgatgatgcaggatgcatccagatcatcggatcagaagaggaagccatcagagggggtagctgttccaagctgggcatggaagcaggtgagccatcatcaccctgctcctcctcacacgctgccattgcccttcttctcctcctcctcgtcgtcgccgtcgtcgtcctccgctgcagcatcatcaggattctccaaagccgccacgacagcagctgctgcccaacacactgccaccctccggttcgacccgacggcgccgtcgtcttcgtcgtcaagccgccatcaccaccaccattgataaaaaggaaagaagccatcaccaccactgtaaattttgccgggaagccggcaaatttttttttttcttggccgtcgccggcgtttcaacgttttcgtctttgcgccggcgggccggccgggtggtttcttgtagtgattagttaattgggattcatgactgtatttgcatccacacataaaacgcccaaaaaatgttccaaatgctcctagtctctttgccccctgatctcagagaacagatcatactaacctgagatgtattgatccacacaccttgttgtagagaatttgttatatcagttactgagattactaaacagtacaggcatcaactctgactttacttagaactcgttcttttctgattaagatatagatacgattttttacctcggttttcgttagcatgttttttcaaactgctaaaaggtacattcagtgcaaaaaaaatttctaaatagaaattgattcaaaatgtcagataaatctatttttaaaatttataataaattaatactcaattaattatgcgctaatgtttttaatgtccccccttaatcttcatttacgataaaaaacgagcacctttacctagtagtttattgtggatagggaaaaaaattaaaggtttgcataataggagaattattcaagttactttcttggctgtcacttggtgttgttgtcctttcttagtttggtgccagctaccaagttgcttccagagcaaacactagggatggcaattgtgcccgtttgcccgtttacccgcgggtaaaaaccctattagggttgggtttgttctccattttatacccatgggtatcttattggttcaaaagctatgcccgatgggtaaatgggcatgggtatgggtaatcactacccatgcccgctttgcccgtttacccgcgaaatctaacttacatgtaggctaggagtaaaatccactagaatacataagccacgttctttgttttctacgatttcccttttatttcccttattatttctctcctcttactctatcgccgccagaggagagacacgacaccgaggtggagaatatttgatgttttaagttcgattcgaagttagtagcttgtagactttttgttccactgcttttgttgtggcgggtaaacgggcacgtccgcgggcaatgggcatgggcaaccatccttacccgtcatgtagtaatgggtatacccacgggcacaaataatctcacgggcatgggtatgggtaggcactacccgtgcccgtcacacgcgattgccatccctagcaaacactgttcgtttgttcgttctgcactgtgccaagatttggccataatggacagggaagcatttggtacttgtaagaatatatgcatgtcccttacagtacatttggaaccacacagttttttctctttcctgtactggagtagattagatttgtctgcaggaactttcactctctgatggctagtagagttaaatttgtgaaaagaacactgaaaaattcaggcagatttggtacagagaccgggtagaaaaaatctacaaaggacaagaggacagtgaaaaggaaatacagtggcgaaattttgacagattttaacatgaaggatagtttatggagagagatactactcacttttagagttgaacacatgtatcaaaataggtaaaattaaatgtgaaaatattgtgattgattgagaggaagatgcaaatataaaatttaaattatggaagattacgattgattgagaaaagaacgtagatgaataagtgattattatattctagaatggacggagtatattgggggaataataataactggtgcatgggtgcgacctcgtctggtgttacgtcgatgcgatgctgctgctggctgcgacttgtgaagctttttcaatgttttgttcgtcgaatttgacggtgaaattaccagacggacggcaggcagctgtcggcatcgggtcacccgacggcaaaaagttggtgccacatgaaaagaatccgtcacgtgaagggacatatgtaaactattttccatgaattccgactgctactagctagtatctctacactagtaaaacataatataagttttttttgattgtttaatatttttgtcttaaaatataagtatatttgatcagggccatcctagggacgtgcggccagtgcgcccgcacagggcccccaattttcaggggtcccctaggtccaaaacttcaacactatatattcaactcagtaagtaaattggtagcctaactagtcctgaaaatctgttatttttcttgtcgttttggcttcgattacgcctttgccggttcacacagttgcggcggttcgcaatctttaatcgcctcccactgtggacctcgccaatcgccaatcgtaactaacgagaggagtaaacgatgcctcacctttttctctcgtgcggtcataccgcctgacgcctgccacgcccctgacataattctttctagtaatttctaatccggtaatccctaattttagattatcattttaggccattctagatttctatgaaatatattacggagtataaattattttcatattatattatcaattaagtttttatccttcaactttgcacagggcccccgaatttaacgggacggccctgtatttgatcttttaacaaaatgtatggttctggaaaaaaaagtttttgtttgagacagtcaccttagttgattaaattttaaatttttaattgtttatacttctctcatgattggctgaaaatatatagatttaccctagaaaatacttataatatgatacaaattttaaatcttaaaaattcttatacttaatttgaaacggagaaaatgtctttgaaaggtatgtaaatggaagacatgcgatcgatacaatgaaaaataattaaaattataagtagataggttttaaggcaagcattatattagtggtgccttgcccgccattagttctccggcacatgactataaacatattggcatgaagtataaaatgcatccacaactataaaaaatcctcaaaagaagtagagtactgctataagtataatctaattgtacaactcatgtacaactagagacatgcaaccatagatgaatcaaaggagagcatgttcatatgcactgcagccgtttataaccattggtcaaattcaatcatacgtgagccgcatagttaggttgtatgcatagcaatttccaaaatagtaaatgatcccatgatggtaaacaggtcagacgctagtagtgcacttggtgttaaatagtggatatcttatgtgttgagatagattctctcttggattgtgaatgactgtaccaagaaacgtgtgagcaattgattctatattccttccatcatattggcataatgttattgatgtgaatatgagagatggtggcaagctcatccatgcatggtaagcatctcaacatttcaacgttcaaacatcaaactttgcaatctcgaccagtgataaccagtaacccgtaataatatagcctctcataattatttgattgttagccaaccaaattttgaattttagttgattttttttatcgttgtatatttttcagccttggtttttaaactgcggataaaataaataaataaataaataaataaataaatatatatatatatatatatatatatatatatatatatatatatatatatatatatatatatatatatatatatatatatatatgcttataattttttttcttcgttcataatataaactgacattttttttaaaaaataactgcacttatgtacatattataaagggctctgacgcactcttcctattatagacattaacagcatattttgaaatcaacttgaaggtgcagtttttaagatcataccttataaaaatcaaaagagatgtaccaaacgaccaatgctagcaaaactcttggttatgatgaacatgcatcgttatattggtactagctagatctactggtatcctccaatcccattgctcccttcctttaattgttctttaattacttgcttccatgtaaatgcctctgaatttgtttacaaggcacaaactgcagcacaagttggcaattgtttgttgcttcgatcaggagaacgatggtggttcacatatattttactatagcagggaaccaacatgagatctgaaaatgccaagaatatatatgatagcttagttattttggtctcagcagaagcagacttacttcatttttttctattttctcaaaaggaaaagtagttaatattgcttaatttttataccatacatagtgatattttaaatttaaaaactgagcatgatttgaccaaagttagctaggtgtacatcagtagtactcctacatagctagtggatcgatccaattatatgtgaacatcaagaaaagaatactagatatcatttttttttcatatggaatatcatggtagctaacacctctgggcaacatagtaatagaagaatacagagagtacttttctgaatggcaatgagaagctgtcgtacaggtgtcgacgtgtaacattatagtagttgtgttgatgatgcctccccagatgagattattattattaattattattcctttcttgaaagtattgcatgcatgatacctcaaaatattcaaacaaacagctccattagatcaccgacaaacgaccatcaggtcaggtacgtaccatgaaaaagataactaacaacactgaaaggacaaccacccttaagcaaaaaccaagacaccacaacccccaagcattttaattagtactgcaagcattctgataattaatcccttcatgtacctaaaacaatatcttcttttcttcccattaaaatattagatttgaccccatattattggtgtagatatggaattaagaaaataaaggtagatctgatatggacacaatatataggcaattatatcaccaggaggtgggcctcattggtgaagtgtatatgttgttaaggtacccatgtcaatgatgattcataatattagcttctcaggataaaaataaagtttccatctctttaggggtgtatttgtgagtacttcagtttgtaatggcgtgcgtagtaatatatgtacatatatgtatttcatgcaatcgtaaaaaaatacacacacaacgatagtgatgctattggtagacacgtagattgagaaatggacgatccagattacgtgcagttgctattattaattaacaaatcacaatagcaactgcggcggatctcaattggttcgtaacggtctcataagaggaatcatccttatgcatgatggcgataagaaaacaaagtataaataatacttcaatttggattttttaaggattgaggccgtccttttttttttcttctaccatgtggtgggtctctctctccttttggcatgattcctcgagagcaaatatattgctatttttatttcgaagcgcctatatacgtcactgcttacgttaattccctgccggatagtaataatctaagtttgcatgacatggatcagaggagactaatataaaaaatggacaagaaaaaaatagattaacaatgggtcatcgtactagtactatattgggactaatcacattgttaatgctggagattgattccttgtattagttgtaatcgaacgagttctttataaaagtggtcttattgtttgtactctgctttttgtttattggggataatcttttatactatcaagacgtgtagttatactatgaacacatgtactgcttttagtatgtcctttattaaaaaaaaggcattatttattttgtgtgtagcttaatcatcatgacacacttgtcttgatcactttgattatatattttggtttagcctaatcttgatttttttattccctgccagattattcacttttagtaccaattggtttcagtaattattttaagttaacaagtggggcctgccctgtctgctaagataacatgggcaagcaaaattcaacatatatttaaaagagccagatgaccatcgagttgaaggaaacagctgcatgttaattacttttaatttgattagatttgtcagatccaagcttatttttctactagctggttacaatttgttatctatttagtacaacaaatcatgaagggtctggatgtgtgtacagtacctattgccagctccaataaaatttctccttttttttgcttaatgataatataatacaagagcctcgacaagcacaaggaatccgtaccacatattaattatgaaaattttactagtagtatattggtagacttaatctaaaccaagtaataattaaacaatgagatgatatcaaacaccacagctccatccactgtaaattatagtaaaaacagagcgtttgtccgaaaccagctagctgtcattttcgtttagttaaaatacgtgggaattaattttataatattttaattcactaatatatgagaagcattaaattttagtacatgaaaatgatatcagtatagttaatactactaatatattttataaaaggaaatagagcaagctactgcgttgttgtaaaatagacgtccttgcaattaaattttaagattttaattcacaaatatattagaaacactaaaatttaatacacgaaaatgataccagtatattaagatagttactttgatgtggttataaatttaacagctttaatacaccaatgttgacaaagtaactgccgaaaaacctacacattaaaacccgtatcagtatatatcttgattgacaaataaaaaaggaaatgaagaggagtaagacagtactatcattgttagtgtcctaattaggacgatgacgaaattggatggagcacattgatggcgacgcaacaccagcaagctagctagcactgctgattgcttcatccatcaccatcactcgtgccagctgatcatatcattgagttcacacgtgtagctagcttaattagcttgctcacatgttttaaatttcttttcttatgtaataatataagatggtttaaactctccgttcaacgatcaaagattcaaattctttcaatgatcaataaaagtcgtaggcagcgatggagctagaaataattccaatcctgaagaaattcaactatatcaacaacgaaaatttgaagggagtatttgacggtgtgcctgggaggttgtctaggatagccgggcttaaataaaatctacaagaagttatacaaatatgaaaatatctcgtattttaagtcttcctttagtaaggacatcgctcgtgtaaaaatcctataaaatttatgtgttctgaatcggtagatggtaaaatcagccagtcagtcaagtgttagaaaattcttgggccttttcttgccatcagcaataatcccggggcctgttattaatgataaaaaagtctactgactccctccaatatagatcgaattttgagagagtcaaattggactttttacttaatgatgaccctgagctctagttgcacaacaatacacagaacggcccaacaaagctcaattcagcccattacacagtgttaagctgctggtttgggcctattcggccttatttaggaataagttcactttgtgacccttaaaagtgatcgaaatctaattcgtgaccctaaaccacaaaaccggatatctcgacctctaaactcttaaaaccggtgcaatttgactccctcggctgttttggaggacggtttcgctgacgtggcgcctacgtggcgatgttgactcagtcttcggtccacatggagctgacgtggcgcttatgcatactagaattgaaaatatatatgcagaacccacttgtcattcataccaaaataataaatgtatagccattgacatgtggggcccatatgtcagtcatctttccttcttcctcttcctcctcccttcctgtcccttctctctctcctatttctcttcttcttcgtctgcaggaggtggtgggtgctcgagggtccgagtggccgcggcggcgagcgggagcggaggcggtgacccgacggcggcaggaggagacgccgctcaccgggtgatgtgccatcccggagtacaacgccattgagctcctcgcccaccacgacacgctccacctgcgcgctctcgtcgagcggattcataccgccgccgcatgccaggccgatgccgcttatcctcaaaagaatcctaccgtcattaatggcattcctagccttcttgtttttgctttgacccagcaagcaagaaactcctccagcgtctagtcacctcaaccacgaacttgaatccgttgctctgctactgctgctgtaacggttgcgctttgagtgtgactacagtgtctgctgctactactactactactctgctttgccactacttggttcgcaggaaggtggtgagagggaaagtgtaaggatgagagagggagagggattgggatggagttcttggtggctcaagcgctcctcctcctcgtcgtcatctccaactccctcccgctcccttccttgggtcttgctgcaaatggtggcacgccgccgccgccgctgggtcgccgcctcccctcccgctcgccgcggccgctcgggcccgccgctgcctgcagacgaagacgaagagaaatgggagagagagaaaaagagagagagaagggaggaggaagaggaataaggaaagagggcccatggccccacatgtcagtggtcccacatttttttttgtgtgagtgacaaatggtcccgcacatatttttttaattctagtatacataagcgccacgttaactccacgtggaccgaagactgagtcaacattgccacgtagacgccatgtcagcaaaaccaccctccaaaaccgctgagggagtcaaattgcaccggttttaagagttgagggatcgagatatccggttttatggtttagggtcacagattagatttcgatcacgtttgaggatcacaaagtgaacttattcccctcgtttatatggatctcatttcaggcccatccaacttgaaagctactagtaatatttcggcccactaaggtgacacctagatgggttgggccatagtccatggatgagacggcccaatgggctgaccagtcttcttcaaccctactcctccaaggcaaagcaaagaaaagctcctcgtctccgcgttgccgcacaagggaaaccctcgccgccgccgccgtcggggatgacgtccgtgcgcgccgtggggtccacgctgccgtcgatccgcgcggcggcggagctggcccggcaggagctgctgcggcgggagctggtggagtgccagctggtggcgggcatctggtgccacgggttcacggtgtcgcagctgcggagcatccgcgccagcctgccgccgacggcgaggctggttgtggcgaagaactcggacgtggcggcggcggtggccgggacgcggtgggaggcggtgcggccgttcgcgcgggggatgaacgcgtggctgttcgtccgctccgacgagatcccgccggcgctgcggccgtaccgcgacttccagaaggagtggaagctgcagctcaacgacttcactggcgccgtcttcgagggccgcctctacagccccgacgacttcgcgcagctcgagtccatgcccaccagggtccagtcctaccagtacctcgtcggctgcctccagatgcccgccgtctccgtcctcgccgcgctccgcgctcgccaggaggccatggcgcagccgccgcccgccgacgagccggctccaacgccaccggcggacaagtgatcaccgcatctctcttctcatttttttttctcctgcaaatttgtgttgcagaaacattggtagcccataaaaacgcattgcgttgcttgaatatgatgtatcatcttccaatattacatgttgatgttttgcaaacaattgcgaattcgcgagtgatgccgcatcgccattgctccaatctcacgctcaccatcgttttggcactggttgatcgtgggttttaattgcactgatgcatgtgagagtggagattaacggtgtttgaagttgcttggaattactgatgtgttcatgagcttgtgttgcagtgaagctaacactgttactggtagcttgaatgcttgaaatgccagtgatgtgtagagtttgctgatttttttttcttttttcaaaagttagttttgtacaatcgaaagatcatgaattttgaaatatgacattgaactttggtggttcactttaatagcaccgaaagattatgttgcaaagaagacaaggattacttagcattagcagcacgccaacactgacggcgaaataacaaacttcaggaaccccaagggggttgaagcataggaggttgatgccttcaggcttcattcagttaagaaactatatccagcagaattgcatggtgagcaagccttactgaatatagcggctttaccaatgcaatcttcaggtagatgagtcggaacgacgagcacgtatttacactgtagaacaaaccaaccttgataaattaccatgcctgtcacaagacattagggtctactaaaattcctttcacttttcctatacatacaaaaagagagaacgttgctacctaactagcacataaacacccttgagcatataaagatctggcgtttctgcattctggacttctggtaacttgatgtctgagacagtacatagaggtcttatcaaaattacttccatgttttacctatacatgcacaaaggaaaagaacgttgctactagtatctcaaaccatatcaacacccttgatatccaaagatctcacatttctgtattctggttcacgacgaatcagcctgagagaagccatctcaaatactcagttccatcatcacaagctggggcatcatcatcaggagcagctaccctcttccgcatcaaactctccacaggtatggctttcctcttcctcccacctgcttgacgtggtcgttccccgtcaatttcttcgaaattagcctgcacataatgatgggaaaattataatcatcttaagggtttaacaagaagaagataccatcggtcagctatttcatagcagaattgttgtttgtgttacctgaacgtacacatgagcactagatttctcatggttgtcccttacatgcttgtacgaaaaactcttgccacacccagagaatccacatacaaagggtcgcttctgctcatggactgctttcacatgcttgtccagattggatttctgcagttcaaagtcccccccccccccccaaaaaaaaaaaattgaaaaggatggaacgatttgcaatttattggaaagaaataaaaaaattctgtgaaacagaatcaaccctgaaagattgaaatcctacctttgaaaatgacaacttgcagtccttgaggtggcatcgaaccctctcagtaacacaggaaccttcatgcattctctgatgacgtttgaagttcttcttcagctgtttggttccacagacatcacagacaacatgtcgatgacaagatttgttatgggccttgaggcattccaagttggtaaatgccttcatgcagcctggttcacagcagataacttcactataatccaacttgactgcacaagtaaaacaaggtatgtcacggcacaattaaccaattctcacttctcaacttctcacaggaagtaaaagcaggcatacagcgcatgcacagtataagtaaatcatgcatttgatctgaagagataaatgatctttaaaagaaacaggagtatcttgcaggatactttgaagagtttatatcagtattctagctcagaaatagaaaaagtcagagtgtcagatgacataaccagtctatatatgataaaattgatctaggagggttgctgagctatttaaagacagtaagaaaaatatggcacacaagtatctcaccatgtgattcctcatgcttctgtaacttagaagcatatttaaaagtcttcccacagttttcctcaggacagatgaactctttcttgctttcacaaggagagccatctttatgcatttcctgaacatgcctttggatattaccctttatagtgaacttacggttgcatccttccatggggcatgcaaatagctttccttgatgtgtaagtagatgccggttcaaatggtccttcctgctatagctgaaggggcaaccatctacatggcaggaaaagggcctctgcaaaagcatataccttaaatgttatactgaaagcagaactttatgatttacttgacataaaataagtaggtcaatgtacacacatatccattcagtgcaatatgctaaaactgttccgataatcacactactatgctgcaaatgagacagctgcatgaatagtcaaataccagtgacaaatatacatgtgtatcttgactgagtaattgcatctaagacaggatccttaagtagcttgagaataacaatatctcagtacgtacatatcactgtaagtaataacaacagttggaacaaaatcaagtcttagaatgagcaatttgaaatgaacaagcaaacctgaaaaagtgtgtgaacgaggcattcttgatggagcttctcaggagagtctccccatcctgatactagtccattcaaagccttcacgcattttggagttctttgggatccaatgcttcacgcagtcatatatagtctgccaaaatcaaaatatatcagaaaccacaataggccatgcactaatccaacgaaacagagagccaaatggcacctatacctatatacttgaattaactttcaaatgagtaattgttttggttgttgtgtagaatattcactgaacaggacagatacacgtcttttacactaaaggggaatacgaggagctggttattccatcacaagcatagctatctcttcagtgtacatgctctacctacttggttaactgtttgatcaaaagaccatcaagtggtgcttgcattagatacaaccaacagcgctacgcatgcagttcttcaacagtagacttgcgcgtaagaaaagatccttcaatagcttggaaaaactaagaatgcagcgcacgtaacaataacagcagtagcatagagcaagcagttttttgcaacagaagaaatcacctgaagaagagcgtgaaagaggcattcttgaaggagcttcccagaagggtctccccatcctggtactagtccactcaaggccttctcgcattttggagttctctgggatccaatgcttcacacatccatatgtaacaaaatagtgaaatagtctgcaaaaatcagcatagatcaacaaacctacccaaccaaaaaaggagtgaaacgacaactattaactgtccagggaaatttgctgtcaacacagcataactatcaccatccctagtccctacataggacagagcatctatcacagctattgcaagtaatactctgaacagagaaacacatagcatctatcacatgcgccaaagaacttgatcatttcagtgaacatgtatcgaaattcagatacctcaagtgaatggctctgcatgtgttgcctcaaatgggccggcttcttaaaactagcaccgcacaccttgcaatcatggtccatctctttgcacgtctcgccgccaccacgtcccaagtaatcatccaaatcatccacttcatcctaaaaacacaaatagcagcaccgacaaaaccaaacagtcaatcattcatccatccaagtaaccaaccaccgtggcgagcagccaaagcacggagaatatgaccactagacgcatctgaggttctgaactatgaagcgagagacgccatgagcgaccttatggtgttcgaggacgtgggcacggatcaaccccttcttggaacggacgacactgcagaaatcgcacttgtaccgcctaatatccctagcaggaggcgccgcccccttgctccccccctccccgccggcgacctccctttcctccgctccgagctccacgctccccatctctgaccaaaccaatcccccaaaattcgcgtcacaaaacacacataacgagcaaaatcacaaccaaatcaaccaaaatcaccgaaatccgcgctacacgcggcgtgaataagcagaggattacctctaattgcagaggaattcgctgaatcagcggctccgcgaggctccagatgttggcgacggcggcgcactgggagaaggagaaaccctcgactcgaaccaagcagtagaagcggtagtggagtaggcaagtcttagcgggttcgggtttgagaatgcgggtgccgggttcgggtaccaccttaaacccgcatgtgtgccctcattctcccctaccacagttccttcacgtgtgcccggggatggcaattttacccacgggtccgggtatccgcggatacctggcccgatgggcatgggcatgggtgtaatattttgcccgtgggcatgcccgcccgagacccgagaacatagcgagcagcggccgggtattattttttgcccgcggataatccatgccctactcgatacatatgtatttgctaattttggcccatctcttatgcctcataccctttcctcttggcccatttggcccactaaccagatacatatatatatatactcaactaatagaaaccctaacctaattccccactccttctcctacccaatccccacagcagctggcggcggtggcggtgcgagctattggcggctgcacggccgacggcggcggcgacgtgggctattggcgtcggtggcggctgcgctgccggcggcggcagcaacgcgggctagcggcagcggcgcggctggcggcggcgcataggagtaggcggcgcacggcttaggcggcgttacacgacggcggtggcggtgcacggcacagacggcgtcgcacgacggcggtggtggcgcacggcacaggcagggccgatgggtacccatcgggtatgcagtgcccgacgggcatgggcacgggcataggattttgcctgatagccctttcgggcatgggtcgggcatgggcacatgggtctcgggtcaggcatggaatcgctctacccgtgcccgacccgacccgttgccatccctacgtgtgccctcattagtgtggtgtgtttgagaaaaaaaaggggaatgctaggtgacgggataccgtcccccaacgggatagctcctctccacaacgcgattcttatccatatactcactggccgccgtcgctgtcccccgccgttgtcgcgcctgtccaccgttgcctccgccgccgccgccgcgcccatccccaaccgccgcagcgcccgtcccccgctactgccgccgtcgccgcgcccgtcctctgccaccgccatcgccgtcctcgtctacaagggacggctgcagggggcgaccgcgcgtgtcgaggtgctcctcccccaacgggatgcccagccatatctagtaggaatcacctgatacctggtaggtatcatccgatacctcgcaagtatcacgtgatacatggtagaaatcgtctgatacctcgcgagtatcacatgatacgtggtagaaatcgtctgatacatgataggtatcgcatgatacctcgtgagtatcacgcgatacgtggttgaaatcatctgatacctgacaggtttcacatgatacctcgcgagtatcacgcgatacgtggtagaaaatcgcatgatacctgataagtatcacatatgatacttgcaggtatcacctgaaacgtgtgtagaatcgtttgatacctgataggtatcacacctgatacctactcgagatcatcctgttgtgtagaatcgtctgatacctgataggtatcacacctgatacctactcgggatcatcttgttcgaaaacgggattccgttatatagcagcccaaaaaaatgaaaaacaagattgggaagatatgtaaaataaaatagagcacacatcttgaagtctatctgaaggacgaaaatttgagtgtaaacaaattttttttcacacgagtgatgtgtagcaaaaacaaaaaaaagtcgaaaatgctttcggacggatgtccggacactgtaaaatatcgaacgtcggctttatccaaacattctctaccacatgttcattcttctctctctttcttctcttgctgcttcaccagcattgttggctatctccaccacacgaatcattggtggccacacagtggtagcgacgggggcaagacgacacggggtagggggaggcactagagcttgctaggagccacacggcgatggaggcgatgcagcaacgccggcggggttctaatgctaaagcgattggtcctagtcgaggtcacctacctcgtgtcgttacttgtccgagggcagtgcccggagttgaagaagaagacggaggtgtcgggggacggtatcccggagttgaagaagaaaatggaggtgggtttcctcgggggtcggaaccggagttgaagaagaagaagacggaggtgggttttctcaggagccggcgactggagttgaagaagatggaggtgggtttgttttgttggagttttagggatgttgcatcctactattttagcttgttgcattctattgtattaaggtgtttcaatttgttttgatttgatgttgcatatattgaatcttcatgttacaatcaatatgtttcgattgcatttggttgaaacacttccgttgaagcgatgaaacaattttccttgattgatgaaacatctaaaactttttcagtgaaacatttttcatcgagcagtgcaacatgtgaaacattttacaataatacaatgcaacaccttcctagattgatgaaatatctgaaactttttcactgaatcatttctcattgaggagtgcaacatgtgaaacattttgcaacaatacagtgcaacaccgtccgatgttttgaaaaatatcaaatgtcctatttgtagcactcctaaaaaaagtatgtcccgactaaatgaaccaattctcagttctctacttctcacaggaagtaaatgcatgcatacaacgtgtgcaatgtataagtaaatcacgcattggatctaaaatatctttaatatatacaagggtatcttgtaggatactttgaagagtttatattagaaagagagagtcgagtgtcagatcacataacctagtctatacataataaaatttatctaggaaaagaaaaaaaacaatctgagttgctgagctatttagatacactcagaaaaatatcagaccctaatttctatcggcccctgaaatgtcaagaccggtcctagcaatgacgaagaggtggtgaaggttgtgtcaatggccttcgtcgccaataactcaccgttgctctagggcaagaggtcatccgacccgtgcggaggcaggtggcacggcgtgacatgtaaaagagctccaaggagcgtctcgcgttgtagggatcaacatctccgggacgaaactaaatggtacatttccagcaaccattggcgagttgaccatgttagttaaattgcaaatagtgtacagtggattgactggaccattgccttctctggcaaagctcgatcaacttcagtctctacgcatagaagggaacacctttgtagggcctgggcttgttccagccgatttcttcacttgtctcggtacaatgtcatacgtcagtctaggcaacaatccattttcatcctggtcctttctagactcacttcagcttgtggaacctcctctgataaacttcagcgttgatttatgcattctcaccgggcgcattccccaattcctagcaacatttgctcagctgacatatgtcccagacaaataataagcttacagggattgttccgttgtcattaggggttaccccttcatgtagtactttgcctccataaccaaaccctctctagcattatagagtttgccgccaacctaggaaatgttcaaactttaagacttgatggcaaaaatttcaatggtcgtcttctcgacttattaaatttgacggcggagctggaggaactatatcttaacaacaataggtacatgcgtatgtatatatgcaggtacgcttatatatacttgggttacgtatgcatcttggtccaacatatttttaggagctagctcaattgcctcgttaattgtgatgccatcaatgcaataggttcactgggcttgtgcctacgtcattgctaaaccttgggaagcttaccaaggttacgctttcggagaacctgcttcaggggcttgtgtcgtccttcccgtctagatttactgacatcgataatgctctattaaccaatagctgcctaccgcctaccgagtattggtgactgggttacactgtagttgctagctacaggctccgtggggttaccatagaggtttgtagttaaatggcaagtgaacgatccctgtgaaaatcgttgggatgagacatcatgtgacaaaagaggggtacactgtcgcagtggtaaaagtgcaaggtaacaaggagttgaacaacacgaacacctccagccacaataacaccggtcggtccaaatagtagcactgcaaagtgacagacaaggacgacaacgccacctgccggtgtggttctagccactacctgctgttgtggcaataatcggcaccatggggattgtagtcataggtgttctgatttaccgccggtggcacaagcctacgacaagggaggtggtcaaggtggagatgattcaggtgccctagaaccctccggctagtccagttctacaaatctctttcgagatcgtggaaagagccaccgggggttcagcgacgccaacttggtagtcaaggacgggtgcggcaaggtctacaagggcgtgctccccgtcgaaggcgactgcaagagcgtgtgtgcagttcgaagctgagcttgggtgtgctccggcaccctcgcatcgtgtcactgttgacgtattgcgtggagaaaattatggtgtatgagtatatgtcataggcggcgctatcaaatcacttgttccgttaggagtaatatggtctgtgaagagatgaaggagtgtgaagattgcatttggtgtagctgagggcgacgtctcacatccgctgggagggatagggcctgcgaagaggtgaaggagtgtgaagattgtagtgtgtgggtggaggggcaaatgcccccatgtggtgtggctgagggcgacgcctcacaaaaggagctcccctcacactcacacaatgttcagccataaactaattgttgttttgctacagtagaaacacgttctacatgaaaatgacagaaaatgacctgctcggaatggagttgcatcttcacacaggaaactgaaacaaaataccaattctcacaaggcctattagaaaaaaaaagtttcatgtaaaatactatgtcataaatatgcagtgtctatacatttgttgtcctccattggtggagatctaaactctacttttatgtgatattcttgagagcaaaaggttagaaaggggttcctacatcttctcctgctagtgccaaagacaggcctagcattattcatagttattcacatgaatacacatttttcattttttttataaaaagtatgtatatgcaatatatattacgtatgtgtataaggaaacaacaaaagtgccatattaaacattaaacatatgctatatattgtacctttagtgctatgtgatattatatatgccaaacatcaaacttttggcatttaatctttttcttacttttgaatacacaacttcaaaatcctaagtccacctctgctcacgcctttattattatgaaagagaaggaaacggctccgataaaaaagaagaagaagaagaaaatggacctggtgatccgctattagacgagaagataaaagatctagaccctatttaggggaacttgtagttctcagccgcagctggtgaaaagctaatcaagtcatcatatatatcctagctagctgcatatataattatatccatgcatacacatttgtcatgcctaaggagctagtattcactaagctgatcatcatcataacaatttcaaaagcaaaagctgattagctctgagtaggcagtacgtcctgcatacaactgtggtattgtttagttacgtgacgtactccgatcaaccgaactgcccagcggccgcttgttccacatggccagcggtggaggaaggttttgccacccagtgttgccgctgctcctcctcatctgcttggtggcggcggcaactgacggcaacaagtaagctactcacgctcgctcatcctcttgatatctctctttatatggttacaaacttacactctacactacatggttctccaagaaacgtcagtgttgatacatttccacctgtaattcgcctccaagataatttatataattaacagaatatacaatccatatttacatccaaaaatccccaaacatatgtacacatatttatatatgttgcatgctcaattgattttgctggaagaattaccatgcatgtatatatggacttcaatttcatctctacataacacgacttgcttatgtttattacttttttaagttatcatctattcaaagtacaatttatattgtacactaccagactagcctgtagaaaaataggatttaccatcagaaattatttttctatgagtgaaccgacaggaattgccgatagaaaaatcaagaaattcaattttcctatgggttccctacagaaaatcaatttctaacggttctttcatgtaggttaatgtcaatttttcgttaagtaggaccgtcacaaaaattagttttactgtaggacaactgcggggccatcagaaaatatcctcgcccacatgatagatcacaagtatggtagtggtacaagatttcaaattgtatgcatgataaacttattaggttatgggaaccaacgtgcgctccaattccttgtcttttacatccactacaccgcaacatagatatagaagcactcaatctgtcggtataaacatctattaatggcacattgtctgtcaggaaagagttttaccgatagtcattttgccatgagcgtctgctaggggttcagcagtcggcaaaagtttttaccgacagatatcctttttactggcagaagagtgccggcaattctttagttttcccaacagacaaataattactggcagacaaactattcatggcataaaatattagtcatggcagattgtctgccttcttataacactaccggcatatagttagatactaagaactacattagctttttttaaaagaccatataatatattgcatcgaatgtaccattgccaagtgcaccaattaaattaatgatcatgaaacaaacacatctatttatgaaagagaaaaattaatttattgttgatgactttatccttcacaaaatatatctgtttacaatcgaagaaatataggtcagatgcccacaccacaaacacccaatctagtctagagtgccacctgcaaacacaaaatagctacttctgatggctttgcatgtacaaaagacgatgaccatccttccagtagatttctccatccaaagcaagctatcctacatgcagttcttcaacaagatgtgaaacattgctagaattggttcagctatcaaccacatcccacctagaaaagatattacacataataagcacaagaggaatgttacatgatcattttgtaatactgaaagtaaaacaactatacataagaaaaagggtatttgttttttgagtaaatttcataaaactacacgttttgtggtccaagttatagaaaactatacacactttgacacttgacgtttaagtacatatattttggtagtatagtttcacaaatccacactatcaatgaatgtattcacccgtgatatgacatggctgttccacttaggacgaggatgtggcatcctattatcagtcattgcacgaaattaataggatgccacgttctcatcctaggtggaacaaccacgtcatcttataggtgaatccattcattgatagtgtagttttgtaaaaatacactaccaaaatatatgtacttaagtgccaagtgtcaaaatgtgtgtggttttctgtaacttggaccacaaaacatgtagttttgtgaaatttactcttgtttttttttaacagtgtagctttcttgtggtttgcagatcaaagataattgcaatagtagcattgatcaacttagttgcacattagagaagctagaaaaatctagactgtttagggagcttctagcaacttaagattctaaaagaagttgcagttgccagaaactccctcaaacaggccgctagtacatgttgctttataacaggagattctccttagactcatcagtagtagtaaacgagtatatgagtctgatgacgaaaaatccactcttggccgatggtgccagatctgtgttggcgcgaactaagtcgataaacacaacggcctaggagatctgcttagctctagtgcaggttcaaaatattgatgagatgcgggcgtgccagttagtttgatcctacaactgacaagatatataaataaaagggtcgatcggctcaaaagtcgatagagcgatattagccgatgccgatactagtggatgttgatagagttttgatcaatcagctatgtgtccaatatagagtttgacacttgatataagaaatgacataaagacaatcaacgatgacaatgtaataaaataacaatataattcaatcgaaaccccgatgaatgatacgatagagtgcgtgctaatgcgatggttaaagcatatatcggctggaggtccgatgtcattaaatccaaacgattagataaacagtgaaacctttattgcgatcagctcaatccaacttgtatgtaatccttataagccaatgcaatgtccagataactcattggctgaaaccccgatgaaacccttgttggcaatcaagaagcttgctggagattatggttccaagcacgacttagtagatcaaacttaactgatgtaatactaagtataaaaagaaacataatatctagacaatcaagcatttgattgattttcagggtggtagatacattatataatctaagccagcaaagaaatctagctaatattgacaaaaccctagatagagatcggtcgatgcaagtagaagacactgcgaatctatattatataatgtatatgataactcgacgtcttacatggacaagattagagtgtggaagcgatggaagcactaatcccaacaatgcaagccgccataacaagcctttatctctcgccggagattgaagccgatgcagcccaacttgaaacaagaactcgtcgaaaagtaaagtaaaaagggtggcgacgcatcgaagttgtattgatcgagagatagattaaaataaccgcatatgtacatatttatacccatagaccgacataagtccctataggacatgacatacaattttataaagataaaagaaaaacataaagtccttattgaaaactaaacacacttttttaaaattaaaaagaaactaaatgagctctgcctaattaatatatagaattaagccgccatgacatggtcttcatgattcctttctaaacttggcctcaatcagttgattgtgctttttacttaaccgaatctaccagataatcttatcaaatttttacattaacacttgacgggtttggttttcataatgcggaaatcggattcgggtctaaacccgcacgtgagcccccactctctccttccccttccaccccactcgtgtcgtgtggctgagcaccgtacgacgcctcccccgcccgcctctccccgacctcgtcgccggcgatggcctccgcctccaccgccgtggccagcgccaccgccgggaccacccgttccttcgagaagctatctgccccatggatgataggccggggacacgtggcgctccccccgtcgccggggcgttatcccgcggtcacggtggccgcggcgtcgcgtcgcaccggcgaaggtgggaggaggcggaggagagccaggggtgctgatcaggaggatggcctctccctcagctccggtgagttgcgtcgtcctcaccgtctcccactctccagcctctcctacctgactagctagctccatgtatccgtgctaattaagtatagtaccaattaaccttctagttgaaaccttgagcttggaattgttcgacgactcatagagagtcaaaggtgtgattagatgatttctaatcataaaacgcgcaacgattttgtttatacctcaccgagcatatatttatctgtggtgaaattaagttttctggttccccttatgtataactgtgagcagaaattgaggcaccaagttccactccccccgttcgcactaccgacaaggagagcacgaaacctgcatcagaaaccggaatcacaaagaaaggatcagccattagaagagttactttggtggttagtgtttgacgatataacgcttcatcagttgattttcagtgctgcgcttgattcagtaaattgaccttttgcaggtccttgctgcggttttcttcggcgttagcatcgccctgagggatggggttgggaaggcatctgaatattttgctgggtatgtgttatgcgtcacaactgaatttttatactgaaaaatgttttatggaactgtcagcatttacccatccaccagaacaattgtaggattcccgccggcactattatgttagcaaagccatctaggaaaagagttggtgaaaattaaaaatgtatgggctcattcattggtttgtgcaagttagtttgcccagttgcgattttgaacgtctcttacttgcttatttacaaatagttaaatgattatttctgaatttaactatgcttcttctttttgtcctcatctcctgtcttttaaattttatgtgtaacaatttgatatgtttctgttgtataacagatatttattggaacagagtttgtcagtagacaatctctttgtttttgttctggtcttcaagtattttaaagtgccacaggaataccaggtatgatttagtagttagtttggtatataatgcccatgtctatttcatccttttcttctcacatttttgtggtattcaaaacaagaaccgggtgctctcttatggtattgctggagcagtgatcttccgcacggtgatgatcaccctaggagcagctacgattcaggttgtttttttctcacatgttaacatcacttatcttcttagttctatgatcttgcagtaattcttcttaacttctcttttcctgtagaggtttgaagcagtgaacctattattggctttgatcctgctattcacttcatataaggtggatcgatcaatgcttcttttcttctattctccttttggtgtactaagttactttaccatgtttgaaatggacatatatgatgctattattgctcacccaatacttccttttatgagaatgacaagttctcactgtcattttacaaaaatctacctgttttatttcctgtgaaatttcagtcccatcactgtctctaacaacaatatactctaatactcaaccaatcctggactccaggtgcatgtattacattattaaaaaagtatttggcatataccttccatcagtcaatggctaacagcatgatgacttgcatcttttggggattcttgtttgttccagctatcttgttatagttcaacctagtccttccatcatttagtgagcactaagttgtcacacttcaaaaatattatgttttgcttaattgtaatgaatggcacctcaacatgttaggcaaagcttctttcgagtaacttcaagtgcattaaatataagtgatgtttacggatgctaatattcattcttaacatgatggcagttatttgctgaagaagatgaagaatctgatctatctgacaatttcatagtgaaaacatgccaaagattcattcctgtcactggtaattaacttcattcgatgattttcagtttctcttatgacattacatttatattatttggaacgaaaccaatctccactgtgagctccagatcatagccatactgaccagatactcactgaaattttttccacttccttcacaagtgaacttcttatgagtagaagttaatatacactcgcttgcagttgcggttaaactcactcttatgtttcttttgtcagattactacgatggtgatcggtttttcacaactcaagaaggtttatggaaagtaagtgtccgactgttgtccagtataagctggatcattatcacaagttcacagcagcttgtacacgcttgttagtactagacatgattgccttcttagtattagaaaactgacctgtctacatattaaagaatctgaagtatatctatttgtcagtacccttacaacttctgcttgtgcagaaaagattctaactacaatatagatgaaattgggttgaccattcaatacaataatctgacatcaagagctaccttttcctgaagatacattttcttttgttgttaatatctgcaggccacacctttgctgttgactgtggcagtgatcgaactaagtgatattgctttcgctgtaggttcctttgcaatctttttcctgtgcaaagtttcattttctattttatgatcacatgaatggggattgacatttctgatttatagattgactcaataccagcagtttttggtgtcacaagggatccacttatagtgttatcatcaaatatttttgctatttctggtaatccttctttcttttgtgtttatgaacacatcttacaacaatcctttctttttattcatagcacatatcagcacttaccaatgtaagaaattttacaagagaacttttaccactagctaggaacttcccgtgagcttgctatttatcaatgaatatttctgcagcctttacttttgttagcacctgcagcctgcattcattcagccagttgatgctcagagttagttttcacaattttgcagttatctgttccataaaagtactgtttcttgctgtaggtatttgggctgcattcagcttgattgtttcatataaaatttaaatatactagttatatatctggatattacagacgatggtctaatgtggcacacatgaccctattatgtcctctcgataacgccaactctaggtttctagcaatctttgatgtttatacctcagtttgcagacaagtgattgatttggtaattgagtaacttctaatgatgtaattgggtaaatgataaattgataataacatacatcatagttacatactgaaagttgaatgaagcatgaaagaagacattagatatcagctagttttgatgctatatattttatatgtcacacattttatgcactcttcacacattgttaagtgcttaccttgaaaaattactctataggtttgaggtcactctacgtactcatttctgaaagcatgtctgaattggactatttgcaggtacaaatccacttgctcttttaaatatagtagagttatttacctatttatgaatactgtggtgtacctaatacttatcaattcctttagctatttcatagttatacttaataaacaacttggcattcatcactattgatattcgttgtatagcagtgattactagcaggtgttactgaaccccatggacattagcatatatccatatatttctcaattatctacttcttgttcctcttattgctattggcttttttttttttgcagcctgcaattggtatagttttgggcttcatagggacaaagatggtctttgacttttttggtgagcaactagaaaccacattagtgcacgcaattgtcaatactttcttatatacattgcggttcaagctatgttttggtttctccattagcaacaccagatgacaatgttgatctgtggcaggttatcatataccaactgaagcttcgcttgctattgttaccacgtgtctaagtggtggagtaatattgagtcttaggaaagcatcaactgaagaaaaggacaagtagccggcttgctggagaggaggtaaaagggataaattaacttggtgtttctttcacaggtagtcatactacaacaaataaattgtatcaatcatttaataagctagaaaaaagtacatcttttttccgaatgttacttgtatgcctatgtcaaagaaccagaccgacgaaacatgtaataagtcatgtatgtaggattaattcagtctt

SEQ ID NO: 80846 - DNA, 10730 bp, Oryza sativa
tcagcaggtttctcgtcccagttcaaatgacatcgagaaaataatactctatatcccataacccgcacaacatgtagagctttgatgccaaataaattgaccatataaacaaggagaaaaaaaaatactgaacttgttaatcgagagaacacaagatccatccaaggagaaaagatcacgaagtatgtactattcagtcaaaagctaaaccacatggcggattcaaagaaagatcatttgtgtgcactactgaacaagaaaaattcagaaaacagtgagcctatcaacttctgaactgggaaatttagtctcacaagatactgacatatctacttaaatctcagaagctactagtaacgagaacatcgaaatttatctccccgagcaccaaaagccaaaaagtaaagagaactactacatgtgacttatcactaaatctgaaaatgcatgtaaaattcagagcgagaacctatacatatgaatcttgccggtaaaaaatgggaggaaaatagttcaagatccacagaaaagcagcggcaccagaaacttccggtgctgcccaacagcaaactgaaccagaaggggtataacccgcacgatactttaattttgtgctcttatttaaattttgtacacattccaaatgacatttcacaaatgttatctacttaaaatacataatattctatgcatgatattacctcatttcttttaatttgccaacaatataactctagacgacgataagagcatgacatatctataaatgacactctgggtttgatattacctgtaaaaatagggccacaaacgatatatcgtataatgaactagaaacccaaaacaaaaatttgcagagtatatgaaaaaaaaagatagatatatgccccaatcagaaatcaggtgacagagatcttaaaaaaatagatatatggaaaaaaagcacatatactgagatttttactcgtggagctgacaggtgagagagaccagaaattagttagtatgactaaccaccaatcataaatcaacaatcccagctcacttgatctgttcctctcaattgaatcaagaatccttactaatcccgaaattaccaatcataaatcataattcatgctcctttgcaagtagctcaatattttgaaaataagttcacgacagcatgcacttgcaagatggaagaaatataatatgcaatattgctttccaaaaataataaacaaaaaggttgagcagatgtctacctgctttccttagagacgaacatgcaacccaaatcagaaaacttaaaaaacccccccaaaaaaatcaaatcagacagtagcaacaacctccactgccgtcatctatactctagcacaaatcaccaaccaaaaatccaagaatccaatatcacaaatcacaaatcaccatccaaatccttgttaattatcttgcaggcatgcagcccctgctcacctccccacctcgccgcatcaaagtcgcacagacgtggccggccatcggtaggatttactgctacctacttttaagaagtataaggtgtattttgatctattaggatgtctcgatacagtagcattttctacattcgaaaaaaaaatctcatcttaagacacgatgtgatctattttgatacaacagaaagcctttctccagtccagaccttcggtcagtctagattctaggcctaggacaaaacctcaaaatgttgtctatgctacctatgaagacaactccgacgaaccttcaatctcagacttcgatatcaatgttatcgagcttgatgttggctttgttattgccatagaataagacgagtttgaaattgacaaagaattgcttatgagagaactaagactccccaaaaatagaactaaaactaaaagatatctagaagaggttgacaaatcattcagaatgaagataagagaagtttggcataacgaaatgagagaacagaggaggaatattttcttctttgactagtatgagaatagccagattatatattttgaagaattttttaagacccagaagaaaggaaaaggggtatgcaatgaagagagaaaacaagaacatgacaagtcagtaattaaggtcttttcagattatgggtcaaccagtaaaacttatattacttattctccttttaaacttattcaacaatctcaggatatcagaggaaaaaattgtcttccagaaagcacttatgagaaatccacagagaataatttcctagaatatttagtagaacaacagaaaactcaagatctatcccctgaacaacaagattccaaaacaattcctatggaacccattattctaagaagccatgaagatccttcttcccactctcaatttgaggtatctagacctcaatctgaaacctatcttttgccttattcttatcctattacaactatacttattccaactgccaacaacgaacagcaaaagggcaattttatcaccactcctaaagataaggtagccaaatcctttgatattcccaacaattttcctaatactaatgaccagatgtctaattccttgacaaaaatccaagcgtcatcttacgataaattgacgctccaaaaagaagtttctaccttttataacaaaatcgactcttcggtaaacagagacctcgagagttatattaccagagtcatcaatacctctttctacaacataatcgatgatcctaaaggtattaccagatcaaaatttagattgttccataatgttctcttctccaagatctatatccaacctaaccaaataaaacactttgttaccattctcgaaccaaaaactcctttgaaagaaaatctcagaatcaaatctcggctgaagccttctgcacaaataatgaaatcctagtccataagcaagatctttttggaagcatatttgttatttctgatacaaatcaatttggcacttttaatcctgaggaagaaaggaccaaaagaaaacttaagattaatgacctcttccaagaacaaaattatactaaaaaggaattaagagacctaaagggtaaatttcgaagtctagaattacaaaataatagttgcatgggccaagatgaagaggttgtcaactccatcaacagttatgttaagcagaaatggtatgcagaagtaaggtacaaattcaatgatggattccaattcagctataagactttaattgattcaggagctgatgtgaactgcattcgtgaaggtattgtcccattcaaatactttgaaaaatcctcccataaaatccatgctgcagatggaaatttactaaaagtcaattacaaaatcccttctattcatgtttgcataaatggagtctgcattaaaacttcctttttgcttataaaagatctaaagcaaggagatattttgggaacgccattcttatccttaataaaaccctttattgttactgaaaaaggtatccagttagaatcagagataaaaatgtgaagttaaaattttcttctaaacccgagcaaaccatgttaaactatttaaaggagattatcacacaaaaagagcaatttgtgagtgacatatcttctgaaataaaaaatgctaggatttcccaaaccttaattatccaaggtttcaagaaaaaattatactattagaaaaaaggtttataaaagatatatgttctgatttcccatcagctttttggcataggaaaaagcatgttgtaggtcttccttatatctctaattttaatgaagataagattcccactaaagcaaggcccattcagatgaatagttgacttttagaaatttgcaagcaagaaataaaaaacctgctagataaaggattaataaggaaaagttcctcttcttggagttgtgcagctttctttgtagaaaatgctgctgaaaaagaacgaggagttcctcggctagttatcaattagaaacctctcaataaagttctacaatggataaggtatccaataccttataagcatgacttaatacgaaggattcagggttcaaagatatattctaaatttgatatgaagtctgggttttggcaaatccaaataaaagaagaggatagatataaaactgcctttactactccttttggtcattatgagtggaaagtaatgccgtttggtttaaaaaaaatgctccttctgaattctcggttataaaattcaatatgatcaagttcaaccagtagcaagagtaatagaatttgcagaaaaatttccagatgagataaaagataaaacagagttgcaaagatttctagggtgtttaaactatgtctccaatttttataaagatcttgcaaaaagacagaaagattttaaccgagaggttaaagaaaaagcctccagcttggacagctaaacatactcaagctgttaagaagatcaaaagtaaggtcaaaaccttgccctatctttatatcctagatcaagttgccttcaaaattatcgaatcagatgcctcatattatggttatggaggaattcttaaacaaaaaaaggattccagagagcagttggtcaggttcacctctgggacctagaatgaggctcaaaaaaattattcaaccatcaaaaaagaaatattggccatagtaaaggtcatatcaaaattccaaggagaattattgaatcaaagattcttgctgcgtatagattgcaaggcagcaaaagatgtcctccaaaaggatgtggagaacttagtctccaaacaaatttttgccagatggcaagcaatattatcatgctttgactttgaaatagaacatatcaagggagaattaaactccctaccagatttcttatctcgtgaatttttacagggctatggcacctaaaagggacttatcagcccaagggagaactacagaaagttcaccaaataagcataaatataatgaactaggaaatatcattcctagaacccctacagttcgagaaaagtattggaataattcatcttatatcctcaatatagaggaagtaattctgccattagaatttggagactctgatctcaatattatcaagattatgggaaagtatttcccacaacactaatattttatccctgaatatccacggaaagatcaaaattattatgagactattatgcgagacaagaagtgcacagatattccatacaaggaatggtgatgaattgggattcacaaaattattgatccaaaaaattataagtatcgatgattgggataaatcatcaaattcttatgtagccaggaatatatattctacatcctgtgcaaataaaagatatactattgggattatcagaggcctgagaaagagtactcctcatacaaaattcccagatgaagcattcatggtttattcgcttcaaagaaggatgtgaggagataccactgtggtttttcagcaaatggtggctgaaagcaggggccattcctggaatcctaccacaagaaatcatcaaagttattacacaagaatcaaaaaaggatctcaaggaatatcctttttttcttatgcaattttgtgccgaaacacggatgccttggatactaaagtgggatctcaatattcaaagaatggagttcccagcaaccttaaagcgaaactattatgcaagatggtgggataagtttgcaatcacaccagtaattgaagaagaaagtttcgagccaaaaacaagaaatctcatgtggctcaattaaaagaagatataacaagagaattattaaaggcaagacccgagttgacaaagggagaattgcaacttcaagtatatgaaaccatgtttaaaagattggaagaatcaccaaaatctagttccacatgcagaagtctagacgaagatatggtacaatacagccaaattaagccatcttcgccaatacctccttattactcaattaagcaagataatgattcagatgaaggaacatcagatttcaatccaacgcacatttagtcaaggtatgacgacagatcttgtcaccaagataatgaataaagatcctgtcatccccgacaaagatcactattcaagataaggaatctacactattctagataagataagcctatagtcaaaaggcgatattatgacatctttattgaaggtcaaaagcgtcatcaccaaagattctctccatgaagtctaaagggatatcataaactctttgaagtcaagaagagatatcatgaagattctctaccgagtgctatataaggggctcaccatcgcattccacaagcatcgcattattcacaagaacaacaaccacaacacatctcactcaaccattcctctcgcctctccaccagccatcacactccactccactccatctaagtgtttgtactatagtataacctaaataaaagactcatgagagtctaagtgtgagagtctatgtaagagtccttgtgagagtcctgtacctgtataattacgaacgtgttgtaccaagtccttggtgtaatcttcagaaggatctaccttcaacttatcaaggtatatgaatgaacacctggaccgttctatataaacctactatgttctaagtatctaatttacattatatcttgtacataattcatatttacagcttgtctttatttcctgtactgcatttatgtttgcataataataataataataataataataataataataataataataataataataataataataataataataataataataataataataataaattcaacaacctggattaccatccaattgccacataccaatctcacatccaagattgcatatagatactgcattccttatatatatatatatatatatatatatatatatatatatatatatatatatatatatatatatatatatatatatatatatatatatggaatttatttttgaagtggttttggaaatgattggaatttacaggtgaatctacaggatactgctgttatttcatgtgaccggtcagaccgggctgtgtatgccggtcaaaccggcgcaacccgcggactgaccggctgaccctgtgtcagtttcggtttcggattgtttgtttggatatccgtgattgtttcatgattatggcttctagatggatactatatgtatgtaatactattgtttgctactaatgagtcaagttggagatagcttggtctcggaatatggtttctttgtttatttcatgtgtaggtgtctcgatgcctcgggagagtatttgcagtgatggaccgggagtcggcttggggataagacgacgtccgtggtggtcagagatcatgcgggatacctaggctagagttgatgcacgtggttgatggagattccatatggcatacgatggagttattgtgtgcgtatgggatgcggagtcgaatttggaaggagtccaaatttggtatgattggttatgtaaaggttgtgtcttgtactagagggtttcctaaggtgtttaggactcttagtatgagtttggtttgtggctttatactgccgacctcatgtataaatagagggggagcgtgaggcttccctgtatcgcttttgagagcaattgagttgagttttgagttagggtttcgagtttagtcgagatttttgtaaggagtgctgttggtgcactttgtaaacacagagagaatcaataaagtcgtcatctactttaagaattcttcgatttgtgtttcaccgggtttcggcggtctaaccggtaactcatcggcggtcagaccggcgacaagtcggcggtcagaccggcgggagcacggcggtcagactggcggcatccactcggtcagaccggcagttcaatctcggtcagactgacttccgtcgatttcgagggtaacttttatttctgctaaaagttttttggtttttgggtataccaaccattcaccccccctctgcttggcttagttcttgtgtttcgatcttacaagtggtattagagccttgtttttttctttggatttttatcgatctagagtttttgccatggctactcctattaggttttcaactaagcctcatgttttcgatggaacggatttttctcattggtgtagtaggatgcaatcttacattatggctgaagattatgatatttggagaaaagtttctcatccttatgtgattcctgaagctattaatactactgctgaaaaaactgcttttgaacaaaattgcaaagctcgcaacattcttttgagtggtatttctcgttcggattatgatcgtgttgcgcattttcgaactgctcatgaaatttggaatgctttgagtaactttcatcaaggaacaaataacattaaagaacttcatcgtgatattttcaaaaaggagtatattaaatttgagatgaaacctggagaagctttggatgactatctttctaggtttaataaaattttgagtgatcttagatctgttgattcttcttatgatgctaattatccacaatctgagatttctcgtcactttttgaatggtcttgatatgtctatttaggagatgaaagttacatctattcaggagtctgttaacatgtctactttgactttggattcactttacacaaaattgaaaacacatgagatgaacgttctttctcgtaaaggtgattctaagtcgagtgctttggtttcttcttcttcctctttggatgttgatgcttcttcatctaagtcttcttttcttgctgtttttaatgccacatccgatgatcaactcggacagattgaggaggaggatttggctttggttgctaacagaattgctcgagctatgaataatgctaggaacaggaaaagaggtgatctaaatcgttgctttgaatgtggttcaattgatcatcttcgtttgcattgtcctaagtttgggagaggcaaaagagaagacaaagatggtgagaagaccaacaacaacaagccgaagggtacatcccaagggaggaagttcaaggagaatcttaggagggtttttgatcaagtctacgccgcatttgagccatcaagcgatgtagatggtgagagtggagatgatgataagggaaagaacatctccggtgtttacgtcatggtgcgtggtgaatcggacatagagtatgaagatcatgaggtaagtacttttgaagaagctattaatattttgagtgcaaaaaatatgaagtgtgagaagatgtatagaaaacaggaatttatcattgaatctcttaattctgaaattgctaggttaaaatctcttattcctaatgatgatgattgcaaaaattgtgtggttttagtgaatgagatttcgaaaattagagatgttaatgttgcacatgatttgaaaaacaaatcttctcttgcttgtagttttgctttgcacacacgcactttggatgagttgtttttactaaaaagttgttgcaaaaatatcaaattgcttttcatgctagtttgatgtttaacatgatttctctaaaaagttaaaacaacctcatgatgttttggattgctcaacatgtaatttgaataagatgaaactaaaagatgctttaggtcgtgtggacatggaagatgttgtgaaaaacaatgaagtgcttttttgcctcaaaagttgtaaaaaccaaggggtcatggtagaatgggaaaaatgtgcttatttgggaaaaaaaggtttcttatttgaaaaattctttgctaatattttctgatggtaaaaagaacctcaacatgattttggatcaatcaaaggttagcacacataatcgtggtttaggttttaattcttatgcacataattctagatatcctcctgttgtgttaggtgttggtgcaaaaaggggtgagattttggttaaacctgatgctaataaaactgtgtttaaatctgctggtatcatgtctaccttgagtgcatcctcttcaaaatccaatgttgtccatgcaaaacctcctattgttgcttgtgttgctaaatcttctaatgctaccaatgtgtctaatcattgtgaaaaatatacttgttctttttgtggcaaagatggacatattgttggtttttgtttcagattagctcataaacagaaaaaggagagagagagagagattacttttgcaaaatcaaagtggcaaaaatctggttttccctcgaggaaaccggtcagaccgcagtgggtcccgcggtcagaccggcgatcggtcagaccggctaatgtgcctcggtcagaccggacaccggttagaccggcggtgaagcctcggtcagatcggcccccagtcagaccggctgcacaccctctgtcagaccggcctcgaagaaatttttctgaaaattctcgaattgattttgcacgtggatatatgcctattggatcttctggtcgtgtgtctcagtactggattcctaaatttttattatcagctaacccctgtactgaggcttcgacttctgcttgtgtgttggctttggtggcaaggaaggagaacgtgtggatcgtggattccggttgttcgcggcatatgaccggtgataaaaattggttctcctctctcaaaaaggcatccaagactggatcgattatctttggtgatgcttctacaagtgccggtctcgttacaggtttgggtaaggtaaataaaaatttgaattgaagaatgtagttttgtttgaggacctaaaggaccatttgccttcgggttccccaaatggt

SEQ ID NO: 80847 - DNA, 1041 bp, Oryza sativa
  unsure (1)..(1041): unsure at all n locations
aggccaattaaactaaagtttgtggtatcgaagtcccatttttccgggtatcgattaatgtggctgtttgtcttcttaacctctcctttttccccatagaagggtaaaaaaggaagcttcggtaacagctacccctagcagcccatgtccgcctgttcacctaggctcccccgctgctgtgcgtactacagcggtttacactagccatcttccccttggtgggtccctcctgtcaatctgttttttgtctcgtgttgctgcagctcccgctagaaatgttgcatgtgctgctacgtctcctcccgatctcccgttgttccgctttgtgcgttcctaaggcttcctgtgctatcggcagcacctgcttgttgctgcacaattccagcaagaagtaaccaacggaatattagcttggaaagagagaagtttgcgggtttggttggatattgcccaattttttgtttttctcacaaaattatttgttctatataaacggtttatagcctgggtttgtcccatgtgagaaggggtgtagaataggttcgaaatatatatatatatatatatatatatatatatatatatatatatatatatatatatatatatatatatatgtaaattaactggtgctacatggagtatgggctccaagattcaaattgcgtatatacccaatttgaatgtttaaatgttttttttaaatgtttagatatgaatattaacttctttactaacaagttcaaacaagtttgaactgagtttgaacttttttttttagattttggttctagatatataacatctaaacatataattcgttatgtatgtaataatgaattgtgaaatgaagttgagtttgagttgttttgttgttaggtatttgtatgaattaaattcatatacctagatatctacttacaatttgtaaatttttaaaaatttgagagaatttgtgttttttataccttagagcccggacaccataaagtcccctatgnnnnnnnnnnnnnnnnnnnnnnnggagtctatcatggccac

SEQ ID NO: 80848 - DNA, 1160 bp, Oryza sativa
gcaaacagagccaggttacagctgattctccctccaaggattggtaaattagtatgtgctcatctctgctcttagaaacaggaaatcagcgaactccatgcagtttcaattccatccccagtacgctagcatgcgcagctcaccaatcctgtgtaaatctcagctgatttttctcagtgcaaacctcggccgtctgattagtcttaccacattgttcgaatggcattgtaaatgaccactgcaggccttttaactatttccttttttaactttttaaccttacccaggatgcctagtccggttgatctatgttatgctgctaccaaagtaagcaaaccagcacaaactatataattaagaccttcaactgtccacattaattatctctgtttgctatctctgtataaattactgtgaaccgtgtatattattgaagaattaaacaattcgtatatgcgaatagtcagagagcccaaactcttcgtattggttctttgtgctaccgtgttatccttctgtttcctcaaaagtcaaaaaccaaacgaatatctgaaattattggtgcattgttaagtatttgattcacctaattgtcacattgcagtttaccactgaccaattgcacattcattgtgtaggagtaatatttttctgaacgtttcgcgctctctggagataaatttcataaccacccgcactgatccttccctaatgtgattcttcatccttcatctgtaatatatttctaaatgtgatcgttcatcactaatctagaagatagaaaaaaatgttaattgctcctcccatcgtcaaaaagatatagttacctttagcattcaaaatttatctcaaaatatatttacgtcttcacatacccatcatcttaaccaaaccacacaaccattttctatttaatttcaccacctactacattatctcagccaatcataactttctttctcaattttatcgctcttcttaatccattaaagaaataaagatactgagagagtgcctaattaattaagttgctcaagttactaccaagcatgcttacatatgtgtttgggtgagcatctttgaatgaacaattgaaaacgttgattatgtatacataaatctataatatttaaatctagcagttttcacgatgtgtcggg

SEQ ID NO: 80849 - DNA, 918 bp, Oryza sativa
aaaaatgcatatggggagcatagtgagatttgcataagttaccttggcaatcatgtgttcatgtggtacaaaaggtttgtggcaaccatttttaaccaggatttaactgattaaatgcttctgctgcaacttatgaaaaacaacattataaagacttacaaaagcatcaatttaaaaattatcaagtaaatattgtaccacctgcacattatctggtgtagaatgtacatgttcacatgattcttcaacattggattcatgttggatatcattaccaacttgttcagaaatatcaacctgcaaaaaaagcataatccatgcatatgtactgatcacatagtgtattcgttaattgatctttagacaggggaagatggtgtacagtgacacttacttctttattttgttctgcaaccacaatatttctccaatcctctccagggaatttttgttctatgaaggcacgcatcagagtcatatcaacactcatagcctctattttattttccattgcattcatttgtaacttaagcattgcatattcctcagattgtccaacaacatctagtccctgagaaacccttatttggctccaattcttatgatcgtagtaccctcgaagttttgtctcttttccaactacacgtcgaaaaacttcatcataatctttggatgaaagaccactgcaactagtagatttctttttagctaattcatggtaagccgattcctacataattaaacatgcatgaattagtttatcataaatgaaccaaactacatttgtgataacaactagcaaggaaagaaatttaccactaccgccttaatgcgctcatcctttttcttatgtgcttcatcccatacgtcaatgtcatggaccttccctttaacttttgcttcctaggcaacaaagaa

SEQ ID NO: 80850 - DNA, 646 bp, Oryza sativa
aggattggtgagctgcgcatgctagcgtactggggatggaattgaaactgcatggagttcgctgatttcctgtttctaagagcagagatgagcacatactaatttaccaatccttggagggagaatcagctgtaacctggctctgtttgcacctaatcgctcttgcccggatgccacctatttccatggccacatatatgcagttagttacatgcatgcaactagacagggatgaaagcctttgtactgcttgcaaattggaaggaagaataggcacaacataaatagcatttgctcttcaagtgtttcttgtggaggtattgattgcaatttggaatgcaagagccaacaggtgaattggcatactagcttagataggaaggagatagcaaatactcacctgtttgttattctgtctatttggtgaaacctaaaaggataatgatccaagcctccgcgtcgctccggccccagcttccggtgacgggcctctgcttcgcttcgtccgaagtgggccttaggtaagtgtaaataaatttggatcacaactcaagatgacatatttatcacgctgcactagaggtatgtgataacaatttacttctattccaggtgtggtctcatgaaatttgaagtgaaaccttga

SEQ ID NO: 80851 - DNA, 11571 bp, Oryza sativa
tgacatgtgtaagtaacatatcaacatcatttcaggttaagaagagtccaaatataatttttataaatatttacatgcatttaggaaagggaaacacatataagagataagtcttactaattatctaaaataatttgtgcaagataaaatcacgggaaaattcttgtaggctattctcactacattcaactcactgtaattttggtataatttaataactacatttgatacctcaaataaatcagacaaaccagtcaaaaactagattaactatagttcttaataggctaaaacaatagctaactaaaatatgcattaaactgcatagaagtatatagaggaaatagtttattcaaatactaggacatttatgatgagtaaatataaattttctataatttatcttctctgtttagttctcctaaaaattcaaactatttttcaaagagctcatcttctcataatttctgtaagtaatctatccataatttttaagtgcaaccaaagaaaatggaaactaggtacatacacctacctccagtaaaatccacatgaattgatatgcaccacaaattaatctatgaattaacaaagatggagaagataaataatcctgaaaattcgtccaaaaccaagttcaccaacctttctacccacctctctcactccaaccttgttcccttcgccctgggcccacctggcagtatccctggcttgcccacacactgtccacttcctcctccaccgctctacccgaccagcagacgagataacagccgggagagagagggaaaccgagagaacgatctgctcgacgcgtggactcgatgtggcgtcgccaagctcgccttcaacctctcccagacgcgtcgccctcgtctccacttcatttccacaccgaggaagccagggagagagcttcagctctccctctccacctcttgctcgtcgtcgaccgccaagaaggaggagctcgcattcatcgtcgagccatcgtcatcaccaactctttctcgttccatattcctcacttcatgcctaccactttaccctttgacaccatctcatttcatccattgcagcgacggaaacgccgccgtggcccccggagctctgcgcaccgccgcagccgacatcgtcgtcgttccgaccgctgtagaccaagccgagccgagccatcacgccaacgtcttctccttgaagtcctcttcaaaacccctcaataatcccaggcaatggcgcagcaagtacggagatcggccaccgtcttcttcacctccggtcgccgtcgccattgtcgattccgcctcctccggtgagccattgtccgattcttcgcgtatacactatccctgggacctcactaacctcatggacacacatgcacgctagatcttggagtcttttgagctgtcgccgtcaacccgaaggagtttgccgccgccggacctgttcgcgagctattacggatgaccaagcttcgccaaccttttctagaatctcggtgagcatcctgcagcctataaaacatacatgcatgcatttctttgggtagatcaagtctatagcacgacatgcaccaccacccgaaaacgttttccgcccggactcgccgccggcgttactccgatgtccactaaccgagaaaagtagagggatggaatcgcaataatatgaccttcattttgtcttttggtcgcaccctcaaacgagccaccgtttgtcgctggcaagcttgagatcgagctcggccatggcctgccctgtctctgcccgactggagaggaaggcagggactttgttttgaaaatttgaacaatcatagggttaaatatgaaaacatacaaaccaatgacatgtggatccatggacctaagtgaacttcacatgaagggcctgttcactttgttgccaaaaaaaaaccttactaaattttagcattttggcaactgtgcagctaaaattttggtaacttgtcaaaattttgacagaatttcttatatagttactaaaatttggcagcaaactaaatgtagccatttttttgacaactttaccaaaatttggtaaggttaaaaatggcatcaaagtgaacaggcctaaagtctagggacttctttgaaagatggtaagagactgacagtggaccgcctggagataaaatctgagaatatacaagagagatacctagaacttgtaaaatccatataaaatcaaatatagattattttgagatgattcaaatttcagtgaactcaccagaatatgaactttaaagctatgaaataaaaacttgcactcacggtacaaatttcacctctaaaatttatctaagttaaatcagacataaagcatgcacaaacttataaaatgcatagaaaattaatttcaactcaaattgaagcaaacttagtttctacagatacaccaacatattctctaaaaacaaagtaaaataaaacatatacacactttatatcaaatgcctctaaaactattacctctaaaatgactagttttagataagctgaactttagaagtttatataaaattcatcttagatcctttttgagtaaactcaagttctgtagaatcaccaaaatatttatttacaagttataaaataaaaatatatacttgctgtataataaaagcttctaaatatttatataaggaataaacaacattagagcatacgttaatttgtaaaatgtgtagaaaattcatctttagtccaaatggagtgaaccaaatttctatagaaccagcaaatagtaagcttcaacatagtaaaataaaatatagcaccttttgtacaggttatagctctaatatttaaatagataacctagaagttaatcacctagtaatggttaagcaaaaaaaatgtgtagaggtatttaaaatgtactctagctatgaataaaccaaaacagaacttgttagaccagagaggtcatatttccagccttagttcccaaaaacttagcatacttaactcatataacaatttctaggttggtatgttaagtaactaacatagaacatccctaattataaaatgtgtcgtaaaataatataaactctaaaattatgaactaagattagattagtcaactaaaataatcattttaaacatcactagcaggatggagcaagttatggacctaaatctccaaagccatgtacacatagcggactatatgcctagaacacgttataacttgcaaaatacataaagaattttggaaatacagatgagtcgtataagaaatctctgtaaaaaagacttgcatgataacttgacatgattttctagaaaaatatatattcaagtgaattctcatagtgaactaataataagattaaaatagccttcactcgttgttttttttgcatgctaacttgacatgattttgtaaaaaaatatacattcaagcgaattctcatagtgaaataataataagattaaaatgcggaggggggagacgggtatgtttttttagttactagcaataaaataaaaagcgggtatgtttttttttttaaaaaaaaagcaaagtggggggggggggggtttgggtttaataaaatgcagtgtgagagatcgatccctagtcggctggatgtaatggcaactcacccaccagcatgctaatctggttgttgtgaaatataatgaacagttaataaataatacatagaatggtggaccgggaacgtccggcccgagtccgagtaactcggggaaccgaacccaccaccggttcaactatgtattggagttgtattagctttggtaacatccacaacgtactatttgaagtgtcaagccaaaccaaaactagccctaaaactcaagggtaccccaaattccccatcgccgccgcccccgatccggcgatgccgctgcgcccgccgcccccgcctcagggattcctcaccgcgtatccatccgcagctttccctccggtgaagcggccgcatgaggacgacctcggcgccggtgacgtgctgaccttcaggttccactccctcgccgtcttgaaattattcgaccgcatccgcgagtaccgtctgcacgattaccggtaccaggcaacgcgaggctggtacagctccgggacggcgccggaggatgctcttcttccctgtgcggttgctcgaccaccgaggatgtatgggtgcgtgatcggggtgcagcgcggtcggacggtggaggtcgtcgacacctccgacatcttgctcgacaccgaccccggaaccctcgaccgcgacttgttgaagaagaagctcgagacctgtaagttgttaaaccctagctaggactttgccggtgcttaattgtttgtgttgtgatgtacattgtttggttatgcagacaagaaggcgttccctggcttggccattcttgggtggtactccattgacactcatgtgacgaacaccgatatggaaaccaaccaggctgtgagtatttacagccattcatttaattcaactatatttgttcaactgcttaatctgtcagactgtcatttggcttagtgtttggtcatattatgaagaaatgttgctgttggtatgtgagacgttggtcatattatgaagaaatgcaaacaatttttttcccctaaggttgcattcaaagtttaacattggggataaaatgttcactgactgctgtacgaatgaaaactcaaaaatgttgatgaggttacaggacattgggatatagttttagcatttgcttgagctcttatagaatctgagtaatatttggttttaaacttgtacacggaatgattatggctggtgtaacagccagcaataatagacaattagatatgctatgctgggatgtgcactgttcttaaactttatgtaaagctctagcttgtttgtgtggatggatggaatggttgaaatttggttttagcttgagaatgtattggaaatatttatcaaatgtatgtctgtgtgatctgtgctatacattttgattttactccttgcatgacatttcttcccttgtactatttttatccagttgatggatgctagtggaacaaccttttatcttctattcaatcctgcaatgaacctttccctgaaggatctcccagtgactatttatgaaaaaggtaagtgaagtttgaaatcgttgaatatttcctaccgtgtaaaccaccaagtttagcactcagcttcttatttaattgctatgttcattaacttaactgtttagagcaataaatggttgttgtttagtgatatgaagattaacttttttgtctctgcaatttttcaagtgcactctaccaataggagtcccactccgttaatctttgtccaaggcaaatataaaactgaggttggttttctcccttttgtttgttttgttacaaatgttatgtacttatgtactaaattacaaccttctttgacagactgtagaggcagagaggatatctttagaccatacgtgtcctgtagtttctgatgttagtgtgccacctcttgttggaaaagggtaagtaaaaaaatctttttcctttttctgagatgacttgaatcacttagagataaatgtggggtatacaaaatcacaaacaaaaaaaataaatgctgtaactttggttttgcacttgcaggcaacatgcaaatattatgcagacttctggatttaagctgatgctgtttgaaattccttctggtttcgcgatgtttgaagtttcacaggaactgattgcacgccctaaggtactaaacttgtcctccaccaccctaatttgatgtaaccttaacttgtcctccaccaccctaatttgatgtaaccttatttctcataatcaatttttttttttgcaggacatatgggcacgatttgcttatcaggatgacattacaaatgtacattttacttttttcaatgctaatgtgtttatttctgttctcgatctcttagtttttaggccatattttgatgtgtttcttgccatcctatttgcaggttattgttaccctgggttctattcagatccataacaaatctgttgctagggatattattgttggtcctggtgacgaactgaaagaatttatcctaagcttttgcactcacaactacttaattgttcaagatgtagagcttaaagatgttatcgagaagaaacttgtgagtttatttctatcgattttgctaaatctttgtcgacaaaattctcctttgaaatcacttgatttttccacctccaactggtgttgagattcgtgctaataatgctccaaaaaattaaaggtagcttacccaccaacatcggggcagtaggattcgattcgatataattacaatgtaacttctatagatatgttgataagttactagttcagcgttcttttagtagtgtcatggtttcgagtttttggctgtccacgtagggtgcctgttaatctgaacctggacgttgcttggtagcgtcaagtagtttgtagatatataattcatctattttagtctgaacagtacgctgcttgttgcatgtttggtggttacaaaaatccgggtgatttgattggaaaaaattgtcgagtgctatatagctagtcccatttctataactagttgatacccttgtgctttgctgcgggatatgggatatgtggatgaatgcatattatatattataaaaatggtagataatgaattgacattgcttcatattgagttctgaaaatacaataaaattgtaaatgatatgtcatgtttgcatgatatttataataattgctagtaggtcataatgtggcatacttacatatgatttaaatactttaaataatgattgctaatgggtgatgatgtggcatacatgtttagctttaggagttagtaagcatcaactttataatcagatacttatgggtggatgtgatgatgttttgggatggagggagtaggattcttttgttttttgtggaataatcattgtttacctaatatatcatattcttataatttttcagaatatctattgttactgtaatccaactgttgtcggtgaattgacatggggactgaactatgtcctacataagttgttacctcaagagcaaagtttaactcatgagccttatcttccactaagcaaggcaatgtctaagcagataaaagaatatggattcaaaatctcgccacgagaggtaattctcttttctacgatagtttcattttgattggtgtgacttgaggtctagcaaatatctaaatatctaaatatttcagtggcggatccacaggtgggtggggcttggtgcgcaagccagctccatccctttcctctaattagcgactaacgactctaattaattagccattagatgtataccagtacggcaaagaaactagctgaagcgctcattgtctaaattacgttgcaagtgtgaaatatgctcaccatacaaattgttcataggtatgtgtgaatataatgtatagctgcaaattaaaacgaagaaattataagcaataggttgtcttttgatctaatgtgttttgggtttcatctaataatatttgtttggtatatgttagtttgtttcaatcacataactatttctatacacgagctcctcaatcacacaactattatatatattaattgatgtctcattatttcagattgacagagagttcctaagagctatgagttttttaaattatttggggtatatgtcagagcgttattcactgctgctagatcatttgtttggacaatatcgtaagaataatatgtccgacattgaatttgctaaatcaattgcatctcatcttcattcctctgaggtcagtgggcaataaactgatagttaactgaagatttaatttggttattggctaatatgatttattttctttgatttaatacagggaattgtaccaagagatgagagatacactagagcagagattatggagttcattgacttcataattgcagctcctgaaaacagaagccggacgctatcgttcctgcggcgcatcgaggcagcttctattgatgattctcctccaccgccttcactgccaggagggatgggtgtttcgttgttgaagcgtcttcgtttggattggataactgtttgttgtctaggatgtgcagttgctctttaccctttctaccgcagagtatgaatgactttgttataaaattcactatgttttgaggacaaatacatattctctgacctgcttgattagtaccaaattaatccttaatcaaagaccattttatgtagattgcattttttttattctggccctagtattaattaatttggtgctccaaagcatgatcaccgtttgcattcaggctatatgaacttctaatctgtttttccttgagacggaagatccataaaaagcaaatttgtctcctagtcaatctccacaaatgacaaacaaacagggcaaacgacgtatataaaggagcagcatacatactgtacacaagggacgaatcatcaattaattaaattaaagaaataataattaatcaattgctaatgacgctaattaattaattaattgcgcgagtttgtgaggtcccgaggacttgccgtattgcaccgttgccctccggtggtaaacaatggtatatttatgtcatttctttctaaatgtgtatatacctataaaatcattaaaaaaaggtgtttttttttgaaaagtaggagagatgaacaccaaacaatttgtggctcgtcaaaatcaatgggagcatgtagtttaatataatgtgccatgtaattgtgtgatacttatatgtatgcctggacccaaatgcctgcacatgttcgttgctgtacatgaccatacgagtagatttagtgccataaatatcgatttgaagtttaaagagttgtatgaaaaaaatcgatttttgcatgtgaagcttaagtggtccgcatgtaagaatgctcggacctcttaagagagctgcatgcgaaaatcgatttttacatacggatcttttaaggatcggccttgaagtttgattggcctcccccttccctctccacccgttcaaaatttcaccccaaccttatcttctcctcatctcctctcagtcctctctctctctcacttattaatatggggcaattataaaatttaccactgctttaaattgttattgcaagactgctactagaaaattgcaaaaatgccactataactgtcattcgagtggcatctttgtaaaattgaaaaaaccggtggcaaatttgcaaatacccctaataatattatcccctctcacacacttgctttctctttctctctctctcactcactcacctagaacggcatggctagagatggcaacggggaattcaccatcgagggtcacatccgcgtccccatccccgtggtgttaaaatttcaccgtccccgtccccgcgaatcaccacggggctacatttcacccacccccgtcaccacgcggtgaattaatccccgtggttacccccgtagagagaatcagagaagggacgacagacggtggacggcggatggttggaggtggccggcgaagcgatgacgactagaggcggcgggcggcacgacgaggctggaggcgatggcgccgcgacgagggctggaggcggccggcggcgcgacgaggactggatgcagtcgacggcacgaggatggctggaggcggcgtgctcgtcgggacctcgcacgtgcgagaggatgcggcggcgtgcgcttctggagtggcggtggcgcgcgcgcatcttgagcggcagcgacggctatgtaggcgtcgtggagctttggaggggagagggagatggttgactagggttggaatctctactattataaaaattgaagatgtttttgtctgtactttggtacgtcatccgtgtttgagtcgatttttttaattttgttgttctctactaaaatttacgttgtctattaaaaagaaaaaacagtccgactcaaagaggtaaaaaaagaaaaaaatgtgtccgactcaaaagcgattaaaaaaaaccttctgtcgtcactcgtcagtaaaaatagaaaaaaaaatctagagtccgacttccgtaaaaagtctcgccacgggtattttttccgactttttttttttgcatgcgaaagagtttttttcgcacgcacttacgctcttggtttttttgtccctttttttaatccgatcgcgcctcccgggcgcttttattttttttcttttgtcaatttttttgtcaccggttttttctcccgtgcgattctgttttttctcatctgtttttttaatccgatcattcgccgcacgcctcccgagttgaacctgggcgccgtgccgccaccatatcgattgtgcgttttctcctccaatttgattgcaaaaatcgattcctcattcctccctcatcattttctccattattttccctttcgattcggttttaatttgtcggatttaatctcctttaacaattgcgattcctccctcatcattttttccattattttcccttccgattcggttttaatttgtcggatttaatctcctttaacaattgctgatgatgacggcaatcttcctcgatcatttttatcccaagttttacactatgattttagaaaaaaaaatgaaaagaggagatcgtggatcaaaaaacctcaaccaattttgggtgatcgaaaaagatttggccggatttccggatttgatggggaaacaaagagttttacactctgattttggaaaaagcgggaagagaagatcgagtggattaaaaaccctcaaccaattttaggtgatcgagaaagattcgaccagatttgatggggagatttgctccggcaaccgtacggccacgggactagcaaccgtactgccacggatctatcttcgggagactggcctaaggctaaaatggaaggaaggctattgaccctaaacccaggaaaaattttcattaactttttcaattataatgtatatagcgatcccaatatttcaatttattactcagctcttaatatatcagtaaaaaaacgtctttacccgttacaacgcacggacattttttctagtatatatatatatatatatacatgtggttattgggcttcaatttgttgcgccaaaatgactataaagtctaaaacatgtccctagctactgtgaaatcgggtcactgcggtggacggggacagggagtggtgcaccgtccccacctccgccatccccgatggtgatgggttttagacctttagattccccatggatggtagatatcagccatgccatcccttaatgtgtgaattcaccgcggggaatcagtgatcgggtccccattgccatctctaggcatggcgcggcgggcggcagcggcggcgtggtgggcgacagcgggcgggagcggtagtgggctcgatggcagaggggagctcgacctagagcgatgggcgacgtgcgtggatcggccgcccccacctccctccgtcgtcgccggcgccagatcccccgcgagaaggccggcgg

SEQ ID NO: 80852 - DNA, 9850 bp, Oryza sativa
ccaccgtccgcatgtccgccgccgcccgtctctccgccgccgctcgcctcgcccgcctcgtccgcctctctaccgccgctcgcctcgcctaccttttccgcctatccaccgcctcccgcctctccgccaccgctcacctcgtccgcctcgtccgcctgtccgccgccagccgcctgcctctccgcctcgttcgccaccgcccgcctgttcgcaccgtccgcccaccgtcgcccgcaccgtcgcccgcaccgccgtgcgcgcccaccgccgtcgcccgcaccgccgtgcgcgccgtccgccgctgtcatgccgactgccgagagagagagagtggaatagagagagagaagagagagaggaagatgggaagaagtgtatgacatgtgggtcgcacaatttttttaagatagaatgctgactagactgccacgcgtatgtcacgtagaccaaaacagctctgggttgggtcgaggggtgtaatttgtccggtattgaaagttgagggtgagcgatgtctggttttgtggtttaggggggtaatttggacgaccgtgatagttcgcggggagggggggtggagggagtaattcgtaccttttccttccctctatggtttgccatcttttaatttgaacgagctgcatgctccaatttcaacccttagaggtttttttttctcataatgcaggtcgcagatggctactagaaattctaatcagtttgaagtcttctatgttattactggctaagtataggagtagtatttactactgttgaatttcatagcaatctgcaagtgttgcagagaggtatatgtcctccagacaagtttactccgtctaattagttattgcaaattaagatgtgcaggaaatcacacattcacacttgatagattggtagctatttctattatgcaaagccgcataaacatcagtagagatagattgagctttgatggtcaaattgcacattctttaaaacaaatgttttctaatccacgagtgcttttctaagacttatcacacaactctctcgctaagtcactctaagtcattatcttagagtggcttcaagcttgattgtagaagctttgttagctccctccttgccgtttcttcatccatctcggggtgcctcttttgaaaacgttctaaatacgtctccactgaatttttgacatcgcgttctcgcttttgagattctgaaataaaggaagaagataagaaagaaaccagataaaactcgaagtgaccatgaaagcaacctaccggtcagcttttcctttctgttcttattgtcctccgaaccttcgccttccatcttctcttcctttttcaccgagactatttatttcctataaacgctatcgacgagaacgagctaggaatgttcttaatattttctctcttataactcttattactagtattacttatcaactcgattactgccatgtggcatccaaaaccaaccacaaccagaaaatatccatgaagtttcttctagcaagaggttaaatatttgctttgaatttttttcttcatcttattttaagatataggaaatatcttctatgaagaatatcttctcatagtacaagggcccattcgttccagcgttttgattttgattttcagcggcacacaaaacaagacaagctattagcgcataattaataaaaaaataattattttaaacttgaaaaatggagttatctgattttttttaaggcacgactacaaaataggtttttgcatacgggcgacaagcattttcgcatgcggttgggccagccgcatggacaaaaagatctgcgaaaatcacggtctttgcatgcggccagcgcaaccgcatgcgaaagagaaaaaatagcgaaaaaaattccaaaaagaaaaaaagaaaaaaaaaactagcgccgtcgcagcccaagctcgtctaaagtagtgagagaactaatctttctcatcaccacaatgagccacatcacttaaaatattacagccgttggatcaaactaacatacaaaactagccttctgatctttgagcagcggttcaaatatggttaagaaaattcatgattcttcaggaggcctcgaactgaacactccggaaaatccaatagccgaacaagcaagcgagaagagctgagagagatcatgatcatcaattgttatttaaccttttatgtggacttctatttacttcagtaaattgttctgcctgctgatatgctttgtgtgagcctcttgtcactcagtaaaagaaagaaaccagataaaactcgaagatgatccaagaaaacggtaaaacgctatgcttatgatcgttttcttggatcaatataaacattgcaatggagacgattattttggcatccttattgtaagaaagaaagttccttattgcaatggagactgcacatatgttccttgaaatatgtttcagacttctgttgcttaacagcttgcgatatgttcttttactatggtgtaaacttctattcattagatttaaagaggtagataatgattgcactgagctctgactctggataagcagtatgttaaagcataatcaccttgaatatagcactgtataatgctgaaaagcaatagatacattttgactaccattctttagttctccagaatagttttttatcttgtggaacactgacaaacaacatgttgaatttgctgtcagtattgatcctaacaattcataatcaagcagtattttgagataattcccaccatgtatagtagctgttatatgggctttcctttccctcttttacacatgtgacagcccacatatacacacttttgaaacaggtattaagagtcgtgcaacgcacgacttatgtggctagtcatgatgaaactagtaaataatatgaattgacgatgaacaaatttctcagatgttacagataagatctctgctattccccaatgtgcatctctaaaaataacaccttttactgagtaacaagaggctcacacaaagcattcagcaggcagaacaatttactgaagtgaaactgatctactaggttccatggccaaatctacaagttcaacatctgtgaagtcaactagaatctgaaggtgaaaccgtaaagtcactagaatctgtaactgaaacatatctactttctccgtttcacaatgtaaaaagtcattctagcattttccacattcatattgatgttaatgaacctagatatatatatatataacatcaatatgaatgtgggaaatgctacagtgacttacattgtaaaacggagggagtactaagtttcatggccaacaaacaaatctacaaagttcagaataaattgacaaaccagtaaatacaaatactgcaagagcaagttcagggtttagcatcatgcagaaactgtaagttgtgacaattccctggagtactaagttgagcatcatgcagtgtgcggagagttcagcgtcaacatgcactaagttcagaaaccagtaagattcagaaactgaaagtacatgttcatctccggcgacttgtgcctccagaccggcctgaatgcctgatcatcttgttcatcacctccagccacctcttctcctccatctcccttctcctcgtcttcgttacctctacctaggaaaaaaaaaagacttgagtatgaaacgagatgcagggcaatcggttatattaatacctccccccgattgaagctcccacagcgatttggagtcgcgtgttcgatcgccgcgctatccacgtcgcccctgaatgcccaagtagccagtagaggtggccaaatgggccgggccaaacgggcggcccgcggcacggccgttcctgtagcaggcacggcccggcacggcctgctacagtaacgggccgtgccggcacggcccgtgtagccgtgccgtgcttgggccgctggccgagcccgcgggccggcacggcacggcacggctcctgtagcaggccggcacggcacggcccgcgcacggcacggcccggcacggcccgtcaggccgaaagcgccggcggcgcgtgacagggcgggcggcggtccaacgggaaggcgacacgtggcagtggcactaacggctatttgaccgttcaaatttgaaaataaccgttgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaacagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcaacctttattttgtgtgtatgctcaatcttttctactccatcagcgttgtgcatgtcatataattaatttgattgttaagactggcatgaagagggtaggtgaccacatcaatgctgttcgtcaagcaatcgcgtggttaactgcttctaacccgcggattgctgcatggaagaggttttgcaatgcggccggtgtggaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacatgtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgtccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccacttcgagcaactctacctggatccagaccaaccccagtagaattttgttagaagtaagttctgacctttgagctgtactcttttctttgtcatggttttctcattttcccctatgagtttttacatgacaaagtttttaacgaggcagcatgtatcattgtatcctgtaatgatataaacattaataaaggtcattactatttttaacaaattcttttgcaatattttcgcaagtgtggatttacctttaaattatttcaaaataatgaatcacaatctatatttttaaatttttcaacacaacaaaaaaataccattttttctttttttttaacattagcaaatcattacttttttaaaaaacttttatttccattttttaaataccattttttcattttttaacattagtaaatcattacttttttttaaacattttatttccatttttaattttttttccttatacatttcctttccttttttttaaaaaaaaaaacactgtgcttcacgggccgccgtgccccgaacggcccgtgggccgcgggcgttccgtgccggcacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggccacctctggtagccagatttcgcgagcgagcgccgggctgtgggatctggtcatttttcaaaaaaaacctctattttacccataatttgttatagatccctagacgtacattcctcagccatgtattcttacgctccggccctcttaaatatgaaatatcttatgctaagaagagaaaattcagaaaacaggagtgcgctctgaaaagcgtaaagtgaggggtctttttgcgaaaccgaacatccctccaggctccacctcccccaaaacctagctgccactcgactgctgttcccctcttgctctctcccttgccctcacggcggcggcggccggccatcgctcgcttttctccgccgtcgacgaccagtccccttcctcctccatcgcccctctcctgcggatcggaaatgatttctcctcgtcccgatttgacctctggttcaaccgatatgaagcaagcggcggccgcgcccgcgaagagcaccggttcgtgcgaggatgctggccaagagaggtgatgattttctttttctctttttggtgcgtgtgtgttggtgggatgggcttgggactgagctattaggtcttgatgctttgttgcagatcaaggaggagatagctggcggtcactgcggcggagtgaatctgcctggaacttgttcgttcttgatgtcattctcaagagcactgcatctaggcagtggattttgcttggatccgcttgtgctttgactccggtctgatggtatttggttaaaaaatgtcaggtctactttcttccctttcccttacctcaaatgattctcttatggtttgtggctggaatggagcaatcgatttggtaaaaaatgtcactcagtgcaagctacaagacttggccttgtgctgctggagcagaggttggctgcctaccactgctgtgttgtgtgctgcgacatttaatcaccaaacaagtactaataatctactgatttatcttatgttaaatgacaggaactcctattatctatcctactgttttttgggttgcacaattggaactgtcaaagatgggaggatgtgttggttgatgttctaatgctatctgatcattttcttctccaatgagaaaaaaaaatgaagctggcattgcaactcctgcaatataaatctgggcaaccgttcagccttcatatatcataatgtgttcccagatttcgaatgatatgttacacatgaactgattaggatggctaggagaaatttggttctttctccagatgacgcagtaacgatgtaatgacctgataagcatgtacttatacaacagccaagtagaaaattgcatttcattgttcataacaactgatttggtaaacattttgtggacctaacttatgtctcatttttgccttgctgcatctaacctgctccatagaatcatttcgccgatgtcctgacttgtgcgctctgcttactttgatgtctcaggaacattatgctgacaaagtgacaattagtctggactgtagtcttggcctgaaacatatttccctgcaggcttagaatgcatattacaacccataacgtatatttgcaactgttgatactttgatttggtttacttttagaacataacctggaatttttttctgttcccaaattttggtaagttaacatgtttttggagtattttcttattttgaaattttggtccaactagctcctaccatttctaactttcatctcttattaattaacattatgattacgttggaaaaacatacctgtttaacaggtagttgccaggtcaacaatgatgcctttgttttaaagattctagattagaactgaagctacatcaagttacaaactaggcctcttgcagtatatggtcaagaataagatccactttcatgacatcaaattcgtatttcaacaattcaatgagggaagtatttcatcgatgcgaccaatcagacttatttctatgcttttgacttcaaattcaacctgctactcaagattcattggattgacatgagcatcaaaattagtgtaattagcaaagcattgctgagaatcaattcattttatatattttgcaccaaaatttgtatcctgttattgcttactattataatgaagcagttgtcctaagtgacattgagaatcagtgttatttgtaataacaactagatcatgttcatggtgcttgctgttacaataatgtgatgatcaatttttattaactacaggtttgattttaagccgccgacattgtgtctatgcacaacttgctgttacagtgatgtgataagtaatttcattcactactggagaattttgtaatatttttttatacatttttgttttgatacacgattcgtctaaatgaattgatacatttgggttttaatatcgatagggcgcatcttgtgcgccaaaatgtctagtaaaccaaattccaaatgaagaatacctcatgtacaagggcccattcgttccagcgttttgcttttgattttcaacggcacacaaaacaagacaagttattagcgcataattaataaaaaataattattttaaacttgaaaaatggagttatctgatttgttttaagacacgactacaaaataggtttttgcatacgggcgacaagcacaaaaaggtctgcgaaaatcgccgtctttgcatgcggccatcacaaccgcatgcaaaagagaaaaaatcacgaaaaaaaattccaaaaagaaaaaaagaaaaaaaaactagcgctgctgccgccgccactactcctgtcatcgacatcgccgtcgccagctgctggtacaaccgcaccacccagatccaccgctgccacggctgccgcggcagatccaccgcccaccgttgtcgtcgccctttagtcgccgcctccgtcggtggatccgggtgggggagggccgccgccgtcgcccacgtccacccccaccttggccctcgcccaccgccgccgctggagtccgcgttgccggaggtcgtcattgtcgccaaggtcgttgttgtcagcggggctgcag

SEQ ID NO: 80853 - DNA, 2204 bp, Oryza sativa
accccccctcggggaaatcaggaggagggcggacacctcaccctcgggcccgacgtccccgaaggtgccaggccacgtgggcgattccatctgcctcaagcctccgggcgcaatactcccggtcccatatcaccgacagcattgttcctaattgatttatttttttaatcgaactctatccttaagtctcagtggctgacatgtgaggccatccctatttcctttttctgtctttatttctctaaggaaaaatttgtcgtgtcactgactggtgggcctggcctcttttgaccgaggtcaaaccggtattattaatcccggtgggacccacatgccataggggtaccatataaattgtttttttaattagattcctgattgctcgggcccacatgtcattgtttcaactaaccatcattagcatggtaattactatgcgctaatagaaagtagggcttacatctctccaactctccctctctatctctttcatacccttcttcttcctcacgctcacagcggagcagaggagcggcatgcggccagtgcggccgacccgagccgggacggctcggcgcgcggtcggtgaacggcggcgcgcaccgctggggacccacggctggcgacggcgaagcgcggcggcctcccagcacacggcgcaacggcgcgcggtggcagccggttatgcgtgtacggcgatggcacaaatggcgacgagttgaactcggccgagcacgatttcaccatctaggatcagtagggttgccatttaatcaaaaatgtagcctaggttgcatttgaattcgccctctccacggggagctcgacggcggcgcggtggcggccggaggtggtacggctacggcggcacatagcccaaattgggagggccgccggcttctaggtcactaggaggtgctcggtgcgtgagggcttaccaaatgatggagtaaggcgaaggtcaacgacgcgcggtccgggccgggtaaagcagaggcgaacggcgtcagcggcgctcgaaggtgttcgacgcccgttcctcggcttccgatagcctccggctcgttctaacaacagcagcagcagcgcctcgaggccaactccacaccccgccagtccgccaccagctctagccaagtggcaaggtagcggcagcgcagtccccgcccaccaggtgttcgacactcgtcaccttgggttggagagagaggtttgagtgagaaactgtttgagaggttgtggaaggatgggagaacgctttatatcgcacgtccgacgaatcggaaatatcggacgcctcatctaccccactggaaatgctgcaaatcggcagatcggatgaaccctatcactgtaacatgtatgcctagctatttcttttcattctttcctcatctctttaaatatttggtcttctaaattacttatccaatctacaaactgattacgctgttgtattcgttccaatgaaatatttacatcaagatatcatatgattatattatgtcgaaagaaaaatatgtgtttcaaaccgttaaaactaaatatttcatacgtgatagtgatatgtttcaatgtgcgtcttcagtgtgtttcattacattcctgaaactgcccgctacttctctctctcctctctctccatctcatccatgcacacgtgcatgtattttagtaagcttcaaaataatttttctcttaaattatttatccaatatatgatccaatcacaccattgtattcgttttaattaaatatttacaacaagatatcacatgattatattttgataaaagaaaacacatgtttcaatccgttaatacttgttgtttatacgtggcagcgacatgtttcaacgtgtatcttcatcatgtttcataaaataattaaatgtttcacttgctaatttttttgtttcacaatatataacttaatgtttcatttgttggtcaactgcaatatttgaccgtccgatttttttttagcatcagacatccgatgggtagcttcctccggaaggatgaggccgactagagggaagcttaagaagctcaaacaacactcgaataagggcaatgaggtggccgacgcagataagagtggatttccttctccattaaggttttgtaggtaatcatcacatctaggacctatggaatgggtgttctagtactagctgagggagagggctctgttttatccat

SEQ ID NO: 80854 - DNA, 12591 bp, Oryza sativa
tggaaaacaccactgaagctaaactcaaaggaacggattaatgttgatccatgccttagcctttttatttgtgtaattatggtcaaaccatcttttaatagtttttaatatacctttttcacttctctgcagcccaagtgaagcaggacattcaaagtggaatatgctagagcatattgttttgctaaataagtctaaagcatgtggttgctatatatttctatttttcctgttcctaactttttttcaacctttgtaagttataatatttgtagaaatataagtaagttccttaattatggattttgcaaattgatgtttcacatgggtcccatttatatgaattggcgttcaagttcaggaagcattcagttcaaactgaagaattcaaagcatttgatcaatttaaagtgatcttgatgaacttttgtttggagtcataagaaataatcactgatttataattttatattctcattagttccgaaactcattagtctcattcaaatttcactcggttgtaaggtcgtactccctccatccatatttcattttctgattttttttttcaactaggatgggcatatttgcattcttcatacatctaagacttaaatgtcctagaacctgggcaaccatattattacttattggttgcatgtatccatacaatttttttttgtctctacacagaatgaattgatttgtccttggtttcgctgaaaaaagtaatatgccttggagggtatttgttttttttttaatttcatcgccgcattagaattccatgtgcacttgtgttttggttgtaatgagtgaatttctttttaatcttcattttgtatggaaataaaatgaggtttaatttcttctttgttttagtgatttatttattgttagttgtattattagttgaatgcaataatatgttgtatttttctttttcatttcgagctagaatggaaataaaatgaagctggataactttaattcaccactaaatgaaaatgaatatcctgtatacgtatggagaccataaaatgtaaggttgatgttagatgtgacatggaaaacgtgcattgcacgtgcatgattactagtggtaagaaaaggtggcacaagttgcaatttactcttaacaataataccgcacttagaagttcgatcagcgaaaaaacaactgcagtaccaatagtgctagaagacaacttcagtaacaatagtgcaagcacttaggagagatcgatcacctagacgataactagtactataataatggtgttgctaaactattacagacagaaaggtacttaggagatcgatcacataaaagacaactacaataatagtggtgcaagtatttaggagatcgatcacctagaagacaactataataattgtgctgctaagctattacagacttatcagaagccaaacatacgagtgaagcttgagcatccacaaaaatcaacatgcagttccaatctgctgctccaacttttacttgtagaaacttatggatctgaatctctagctgcattagagtcctccaaatcagtcctcactggcttcagtgtcttgaggctcttttttctcttgaacctagcaaagaatgtatacactgatatataagaaaaagtgtgctcatggatcacgaatttcaaagtaatataaaaaaaatacaagttgctataggagtgagaaatatacctgaacatagccttctcgtactttgttaatcatatccggaagcaaattggttgcaaaataatcaaaccccaaactatgaatagcttcaaaagaggccttcttgtcaaaacttatcatttcttcgattctgcgtttccatacatcggacaaatcgtcctgccaaaggttcttcaacatagttttgtcctcgcgagacaaacgtgagtagttggtctcagacaaattcaactttatcatgtctgaggatgacaatccaacccaacaaatagatggcacggaaatattgaaattgtcatatgctgaattgcaagaccctctagcatacgtagcaagaatacttataccttcaggatctggatcacaaagtccaaagacaggtagtccagtgcgttgtttcaagaatctgaggaaatcccttgtttggagggttggcatgccacatcctgtcagaattatacagttgttattggtgtgatagtccatctctagtagataattcaacattgtatgcttttccacaacaagaatatactctatgttgcgtgaacctatttcaacacaaacatctttgatctggtcaagcctgtgtggtatctgcactccaatagaacaactaatcgatttgccatttgtcaattccaggaaaatgtttccaactacaattcctttttcagctgctattatacccaaagagccccttctgatatttgtcaaagcgcagatgtcattgatcgcttgatctgatttactttgatccccaaacagatccttgtttgtgtataagacagttctcttcgagatgttcaatccagccccaagtgtccgttctattagatcaatggtatagccagtcctagatgcaacttcccgctgattcgcattgcaaaaggaacggcttatggtcttgcctgcttttgctagagaaaccttgacttcctcattaaactccatgttatctgtatattttggaatattgaatttatatccatgtcccctttcaattgtattgatgttcccctctaacaacctattcagagtcttcctggcttcaactcgactcttgtcttttgcaataaagtacctatcatgaaaatcttggaccttctcctctggcagttcccatataggaaccgggagttgttcacctttgaaaatcacgtaagggttgtacttttgaatctccggaacaaagtgtccttgaacttgaggatcattaccactgccagaaaaataaccataggaatatactccagcaggtggatcctgtccatcttgagcactctcagtagtatgagtttcggggccgggacctctgatatactcgcggctggtacgccatctgcttgaagaaacctgacgatcataagcatagtgttttcttggatgatacgaatcgtcatccgttgaatcatccattggtgacctcaaatctgcatcgtaagcaaacaatagatattagatagggaaaaaaagataggcaagatttaaaaaatactccaatttcatatggagcaatagggagatgtgtacgtttggatctttctcccaccttgcttagccaggtaaggataagttaactttgatcattttctaagcacccgtataagcacttggcacttatcgggatgacatgttgccattttggctttctataaaagccgggctggtgagcctttgatctaaaaacttatcacttatcatgggcctacatgaaaattacttcgttactgattttgattgctaccctgagctatgcctgagaaaaagtgctgcctgagagtttcgtgatattttgatgtttgttgcctgatgaggcatatctgagttggttctgtttggttgaagacctgaaactaaatgtgcctgaggaagattaatagtcacaaaacaatgtgtagggtaaaaaatgtgtttaattctctcattagtccaagacagtcgatagctcgctcattcggttgaagtatccccaaaattccaaacacaaatatcttctgccagttgcttcatgcaacagcatgtggccggccagattggaagggctttcggcttctttgcgcaatgtggcagcgacggcaagatctggcagaacagcggcgcaatgttggcgggatctgacaaggcagcagcccagcggatcacaaggcactgcgctggagatgaagcaaggctaggatttggtttgccaaggatccaaacgtgcccgattcaaaatcacccaaatggaccacagggcacgcgcacatcaaaaccgtagagaagagagcaagagccaagagggagagaggaaaccgcaggatgaacaaaggaagggaggagattcacctttgctgcgcggtcgggaagaggccgcagcgtcaacaaagtcgccgtcgcttttcgccggaggaacggatctgagcgagaggcaagaaattcccctcctctctctctctctctctctctacagtacttgtttcattaactgattttactttctttttttttcttttactgtttcagtaaagtagctttcatcgtccgagactccgagttcaaatggcattcccttcgtcgcataataatcatttttagccttcttcctttttcctaaaataagctggctttaagttttttttttaataatgaaatataacatccggtctgtgcttaaaagagctacaaccaattattacaaactaccactctagaaactaagaaactagtgtaattcaaataaattgaaaacaacaaactaataaaaggaataacccttatatgaaaaggagtacatatttattgaagtttgagaatctccattcataattggcaaaaagttgcataaccgtcgtctcgagcttacaacatgtaacttttagaagttcttcatcttcatcatacctttgtaattgtacccaacaccggagccaatatgttgccttgaaaattacctgcatatatgaaatagataatgatttgtcaaaaatcatatcattcctactcaaccacagagcccaacatattgcagaagctccaaccaacagaagtttactctttttcctgtccacccctaaaagccacctataaaaaatatgagatatgctaataggaaggtataaaccaaaagagaattgaactgctatccatataaactttgcacaaagataataatagactcatttttcatacataaacaacaccttaaactaccattccaattacgtctagccaaattatttttagttaataccatccctttaagcaagtaccacatgaagatcttaatcttaagcggcatcttaagcttccaaattatcttatttctctcgatacagccattattaatcaaagctaaatacattgacccaaccgagaaccatccattctgattataattccatataaaacaatcagaagattgattcaactggatatgaataatagaagcacacaaattatgccaagatacaagattctgactaactaatgccctcctaagagaaacattaagcggaacggaaccaataactctagcaattgaagagttcttccttctgacaatagtatataaggaaggatacttatctttaaaagctaagttccctaacctatctttccaaaatcttgttttttccccattattcacaatccaataacccatatttaagaaagtactcttgactttcatgagatctgacaaaaatgagaatcaccttgtttcctatcaacttgggttatagactgattataaagatattttctcttcaataagtcctgccaaaccgcttgctcatttattaactttgtcgatgtttaatagtcacgactaggatattttgatggtatggggatcgttggtactagggtatatgcgagattgaggtaaaagagatggagacagggatttttatataggttcgggtcccttatctgacaggtaatagccctacaacaattgggataacctatcctaccgtcgtcgacttggcggcataaacaccaactcgcagtcgatgagggggtagtcttcctcctcgaatatgatctcgtcgacatcagagatggtgctagatccctcttgccggcctctgtaggtactggattgggtttatctaggctaatctgcgatgtcgatatctggcagggtgtgttggcttgcatcttgtggcttctatgttgtgtcttgtggtttgtcccctctcctcctggggggcttgtatttatacccataggtgcccctttgtccaagtaaaactagggagaccaatatggacacaatccgagtagtccttatcgtttccatgtagaactatatttgtccttccttatccagaactccctctatgtatgaggtttgtttccatataataagacatggtatgtggtgggccctgccgagtttagtcgattactattgggtatgtggtatctataaccctgacagtagcccccaacttcaatacaaatgaacgagttgatgttctcaatcgaagactttggaataactattgtcgtgctcgcttgaccgttctcggtgtgatcagaaataacgctagattcctcttatcagtctttgtaggcactatattgggtttgtctaggttaatctccgatgtcaaccgagaaggtacggagcatgcgactaagtctcctgtcttgccgtaatcgagaatttggattgaagtcaagaaattccatctcgacgggtacaccatcgcttcattccatattacttgtcaagctccatcaaccgttctcgagtaatcgagaaggtgcaaagtttgcgacaaagccttgaaaatctgacttgactgttttgatgtctgactttcctgaaatcaattctcagaacagaatattaaatagaaatagcccctgagcgaacgctcaaagggcaatatgtatggaaaaattgaaaataaattgaatatatgtgcggcaataaaaaaatacgctcgctagagtttccctcagcaaacggagtttggtacccttcctagcccccaactgttttttatggaaaaactattttccacaaagacagcttgaatcttataacaaaccaagctaaagttgacaaatcctagcctccggccgtgaagttggaaaagtcaatttccgattacacggcttggttaatacgcatccattgagcattcttacatgaccaggttttacatggttgttcggctcttataatccaacaagaccttatctgctctgggcgtccccagccgaaattcccttaggtttctcggaggtttgttagaacatcgtaaagggacagtaggactgacttcaagacgaaggtgatataagaaaggaggatcaccagacaaatattgcacatataaacacttacagaagttgacgtatatgaagtgatgagatgacttccacaccgggtaaagacctggtgtatagttgctggtcgaagaccagtcgtagtcgtaccttgaccattagaagtcgtggtgcgaggaccgctatgttgctggtcgaagaccagtcgtagtcatacctcgaccattataagtcgtggtacgaggagcgctactttgctggtggaaaaccagccgtagtcataccccgaccattagaagtcgtgatacgaggatcactacattgttaatcgaagactagtcgtagtcgtacctcaaccacttgaagggaatccagagtaatggattgacgacgttctcgtgacctgcaagaactgtctcctaatgacaacaaagacaaggaataattatcgtagttggaggtttggctcctcgacctactaactcgttctcaggccctctagaagtctgggatctcgagtttcgtcgtcgtcatgtgatgtcgttaaccttgtccattgtcgtcctgatgtcgttagtcttggacgtcgtcctggtgacaacggcgatctagtcggtcttggttgtcactatcacgacaatgttgattgtcgtgttagatgtcgagagattgcagtaaccgactggtcaagtactagtagtaggcgtatctcgatcacgcgaagatgaatttttagatgatgagagatcactacgatctactggtcaaggaccaggtgtaggcgtatctcgatcagctggagatgaatttttaggtggtgagagatcgctacgatctactggtcgaggaccagatataggcgtatctcgatcacctggagatgaatttttaggtggtgagagatcgctacgatctactggtcgaggaccaggtgtaggcgtatctcgatcacctgaagatgaatttttaggtggtgagagatcgctacgatctactggttgaggaccaggtgtaggcgtatatcacctggaggggcgctagagtttctgattacatgtgtatctcatgtggccagcatgactcacatacccaacttgtagcatatccggatgtctgttcgcaaccatgtcgggtgatcaagccgacaacgttcatgaggaattatccattaacaaccctttctcaaataatccagccgtagctggcgctatatatgagataagtcgtcggtcttcattggtaggttgggtgcgacaactcaacatttgttgagaacgttttcgataatggggtgtactcgaccacatcctactcgagtgctcactgctcaattgttcctgaagaatattttatagaagacaagatatatagcagagaatatcgagtatgtactcaaaaaactacatgaatcttctagtattatcaggatataatgagaagattaaatattgggtattatgtaaaccatgaacaagcatgatttatacagaagaagaaagagcgagccccgtagtcggtctaacactggaaacactcacactgtagatattgtataaaaatatgctctaggtaaacataataaatcatacatctgacaatattgtattgatttgaagaataggtacgataaatcacatatagagtattgcgtacctatgtggatacatgccggatgtatctatgaaattagtagattaaattaaaaaaccaatctaccaattaccttgttacatactcgtttgacatcatataatctgacatctttcgatacgtcgagtatcttgaggcttggatgatcttgatagatcaaattgttaacgacgatggttccgatcttatcagggaatgtactctggtcgggtcaaatttcccaggtccaaagtagttgaagtatccctcgtcgaaaagtccgctgctttgatgaagcttgagatggcgaggatcccggtccgccagataacgcacttcggttaggttggatccccccatagccgaagtcgtcgagtagcttgttgttggagaatccatctcttaaacccatctcgtcgaaaccttgaagcaccaagttcccctacctggcgcgccactgtcaacgtttgatagtcatgattagggtattttgatggtatgggaatcgtcggtaccagggtatatgcgagattgaggtaaaagagatggagacagggatttttatacagattcgggccccttagctgacaggtaatagccctacatcctgtttatatgggattgatatagaaaaccacatagtacaacaattgggataacatatctaaccgtcgtcgacttggcggcatgaacaccaactcgtagttgatgacagggtagtcttcctcctcgaatatgatctcatcgacataagagatggcgctagatccctcttgccagcctccgtaggtactggattggccgattgggtttgtctagactaatctttaatgtcgatatctggtggggtgtgttggcttgcatcttgtggcttctatattgtgtcttgtggcttctatgttgtgccttgtggcttgttccctctcctcctagggggcttgtatttatacctataggtaccccctatccatgtaaaactagggagaccaatacggatacaatccgagtagtccttatcgtttccatgtataactatattttgtcctttcttatccggaactccctctatttacgatgtttgtttccatataagacatgatatgtggtgggccctgccgagcttagtcgattactattgggtatgtgttatccataaccctgacaaacttaaataaccatttactcaaaagacatttgttttgtatttccagtagcaaaaagttatgaaaatatgagatatacataaaattatgttggaactcaataagtgaaggtattatagtctttattgcttttacgttcccatatatggagcgaatgaaaagcaaacttatttttttactatcttattagtttgattggtgctggaacaaacgattagtccatgacaaattagcccatgttctaaagagctaattgagcttagctatttctcgttttctgttagcacgcaaattgttaaacaataggtttatgcggaaactttctatacacgaaggtgcttaaaaagccaaacaaatcccattttccaagattttaataattaatagttacctaaacatatgctaatcatatttctcattttgcgtgctacaaaaacccatgggccgaaaagaacactcccttaaaacaaatgaattgtcatttatctcagaattttttcacaaatttaccttttatataaaaatattgcgtttgaaaattttatataggcagaatattaactgcatgacacctgtcatgtttcaaaagtaatgtttctctataatttttcttcattgccattgcttagataacttttttcaaactttttgttagctttcaaaaatatatagtatttaatacatataaacaatcatttatgatctcttcattatgaagttagatttagtttgtttaaatacaaaatgtgtgtaacatattaagtataaataaaaagtaaggtgttttgtcttgtttaattgaatgtttagtaactttttttttaacaaatcctaaaaaatattacgagtaaaatacattgccggtccttaaacttgagagcgagtgtcacttaagtacgtgtcgatggaaaaacacgcgcggcctgagagatctgcttaactccagtgcaggtccaaggcttgcctcaagtgctaagggcgtgccagctgatttgatcttgccatcagcaaggaaacagaaaggggagaggttagtcagccgatagtcgatcggccgatagcatatcgttggtagtccctaaccgattgggccggctgtggactggatataataagtgataatagcaataatgccctaagaacaccctatcggccaaagcactgcctataagaataaaaacgtgtaaaacaggacaatgcaagcaagatatcggccgataacggaagaacagagcaaagaagatgataacgtgccggctagtactccgacacacacctatatagataagccgataacggaagaacagagcaaagaagatgataacgtgccggctagtactccggttccgacatgaggttatagcgaggcccacctgtataggtggcagatacacttgtaacaattaaagaaacaggcatatcatgtaagatcggctgaaaccccgatactatttctaattatgactagttccaggttagtttttagggttctaaacattactagggatgatgcatctcaaagtgtgtaaagaaacttagagtctaaacaatcaaagagctaggcacttttcaaatagcaataatagactctcattcgccttgactaatctaatctggcaaggcaatttggctgataccggtgggatctctaaagcgagaagcaaccaatagagccaaattaagttgccgaggctagattagccactctcccaaaaatttttacacaaacaccacaagagagagaattttttttcctaattagtatgccatgtctgcaagagagacttaaaatgaccattttgcccttggtttcatataatatgagagaaaaaactaactaaagccttttacagttccaatatcttagtgagaaaagctgcaactaaagctgattttttttcatcagatcgccattgtcaattatcgaaaatacttgtaaaatgttgtaagaaatatacatcgtcacttgggctcgatggcatcgttggctccgccactgactggatcgatggatgcatgataagctagtgctaagctgtggggcacattgaattcagttcaggatcagccatgaatatgggcatatggcgcgtgggtttcattcacaaaccgctgcttctgcttgcctgcttgctcggccacttgatgaaacagctgctggaaaccaaaaactgttgcgtaggaaaaaaaaaaagcctggaacgagaagagtagtattactttgacccaggggcaaaaaggccatctcaagttactcttgctgacatggcacactaattagggaaaaatatctctattgtggtgtttgtgtaaaaaattttgggagagtggcatatagatagtggcaccatcattcgcttagcattttaatttaacatcgtataattatggcttattatgttctgaactaggcatttcctgtgtttagtctttgataattccctctaggaaaaagtatgaattaccctctcccccgaactatcgcagttgtccgaattaccctcctgaatcacaaaactggatattcttcacccccaactatacaaaccggacgaattaccccccctcgacccaatccgcggtggttttggtctacgtggcatcctaatcagcgttttttaataaaaaaattatgggacccgcatgtcattctcttccactttcccctctctctcactcttcctctcttctctctctcactctatctcactcttcatctgtctctcacggattgacggcggcgagagacacggaggggcgggcgacggacggcggatggtgacgaagggggcggacggcggctgcg

SEQ ID NO: 80855 - DNA, 897 bp, Oryza sativa
cttcttgaatgcctccgtgaactccgcccaagtgattggttgtccttctgctctgttcatccggaaatgatcccaccattctgatgcaggtccttgcaactgatgtgaagcgaaaacaactttctcctgatccgtacactagagcaattccaacttcttctcgatagcgtgcagccaatcacctgcttctactgggttggtagtgctagaaaaggtaggtggcctcacacgaagaaaatcagctaacttgttctgcggcggtggagcattgttgttcccttggttgagctggttctgcatctgctgtatcatcatgttcattaactgagtctgttgagccagaacttgagcaagagttgggttcccttcattgttattgtttccacttccactggcgcgagtgttcaccatctattgcatattagagaagatagaaggagaggggttacactaaagacaagaccttaaccaggttaacactgatctgatgtgtgtagaccattatattgttcaagttgattaagcaagcaacctagtatagttacacactcatcaatgaactactccaatgatgggaatgcaactatacctacacacaaagcaagcaacaaacgttctaccctactaactattcttcaaagatagtttggcggcataggttctaaggtaggatccaaacttcattccatcttgaacacttggcacttcagatcgatcatcaccttcatattcctcgatccactttacttaacctccgtaagtagacctcattggcgtcttcaagtttcaatgtctcagaactactgaagttgaaagagagaggggagtagacaatgaaacaatttgcaaagaattctagataaggaagaaaggagaaattttcacaaatcatatttt

SEQ ID NO: 80856 - DNA, 17708 bp, Oryza sativa
  unsure (1)..(17708): unsure at all n locations
aaaagaaaacagtgggtctctgtgtgtggggccctcggtcaatgttgactgttcaactcgtatgttgaatggtagctgcatggaccgggcatctttgctgctgcttgttgttgctgtaatatcacattttaccaccttcgttttacagtaatcatgtcatattggcgtatatggctgttagttttgacttttgaccaggccttggtgggcccgggatgagagccatcgccgagatgcagaacggaggaccatacacagtgaccctgcagcatcatcggcagtacagtacgtgctgccgggcagagagagcgtacggaaaattcgaccgcataattgcaataaatgtactccctccgtccccgtaatataaggggtcccctaatataagggtactgtttgactactcgtattatttaaaaaatttgtacaaatataaaaaataaaaagttgtgcttaaagtgctttggataataaagtaagtcacaaataaaataaataataattccaaatttttttaataagacgaatggtcaaacagtgtaagtagaaagttaaaatttgttatattatgggacggatggagtaacacagcgcttccgtaactcgcaatttgcaaacgattttttttacatacaccaccatctttttgctatggatgcagaacgtctgcaatgctgatgcaatagcagaagctgacaactaatgcatcagcagcactacacagataatcccattgtttcgctatgtatgtttataaaccaattttgaaaatttaaaattcaaatttgaagtttattttatggttttatcattgtagtttatttggcagtatttactttttaaattgctaaaaatacgtatataaacttttcatctataaattattatttggttgctaataagtaatacaaatatgcataaatataagccaaatgatgactccgataatttaatcaacatatatgtcctgttgtattggagcaaaaatgattatcatattattcatgtcgttttcttatgtcgtttttattagatagtaatactttgaaatttataggtttaaatcaacagtaggtcaatactgcaaatatatttaccgtataacaattgtaacattcaatactaaaaatgctttcagactctgattttataactactaaaagcatattttgaaagaaaatcaacagtcaagttttaattgtgaatactcttaaaattaaaatactccgaagtatccaaaggtattttgggataatatctttgaagtttttcacgaagataaaaaactagattatcctttattattggcagtatccagataaataattaccttagttgatataagaggtgacggtgttacacctacaaatacaatgtttaaaagactaagggggtgtttagatccaggtgtataaagttttggtgtctcatatcgcgtattatatagggtatcgcatggggtgttcgggcactactaaaaaaactaatttcagaatctgtcagtaaaccgcaagacgaatttattaagtctaattaatccatcattagcaaatgtttattgtagcatcacattatcaaatcatgcagcaattaggattaaaagatttgtctcgtaaattagtcgcaatatgagcaattagttattttttagcctatatttaatacttcatgtatgtgttcaaacatttgatgtgacatgatgtaaagttttgggatgggatctaaaacaatgcctacaataatcttcgctttatcacatctcgatgtatgtatctaactttattaaattctaatatatttgattgtttcaaaataaagtctttgcggcgataaatgggtgggggaagttatgttattttttaattggaaaccccggcgaggantaatagagaaatgatatatcttaacataaagttaaacaaatcaaatacttcatctgtatcacgatataagtcattctagaatttttcacatttatattggtgggaatgaatatacacaccaccgcaccgtatgaagtagggaccacgacacgttaaaataaataaaaagaaatcccaaacactctcgcctcgtctcctctcacaccacacgcctcgcatcgcatccccacctccgccgatcccgccgtctccggccatctccgccgccggcaaccaccaccacctcctcctcttcccctctcccccttccgcccaattggttgccccgaccaaaccctacgcgcggaagggctcgctcgctcgatccggtgcgggcagcgcgcgcgcggggctcgacgcgggcggcgacggggggcgggctcgatccggcggagcagtgggcgctctcttccacgatgcgtctaccctcttcgcgcgagcacgacaaggtttgcagtagcagagaattttgtttcgtgtttatcgattgggcatcttcggcgcgggagaccggggagtaggttggtaggtaggcttgccgaatccagcattttcgcgtgccccctcgtagcttccgccctgctactgctgctgcaatcggtgtggagagagataattgggggcattgtgacctgcattcccgcagggcaggggcaacgtcgccatcgtgcgcggcaccgtcgtctagtctcccatctttttcaagaaagaataatcgaagattaatcttgaccaattcaattcatttgtgctgcaggttctttttgcggggtcaacaataatgaggagaatttgagttggtctggaattactctgggatgttatcattggcgaaaagtatagatcccttttggtagctgaggagagatctcaattttttcagagagtagatgtcgtttcgcagcatcgtgcgcgatgtgagggatggatttgggagcctatcgaggaggggatttgaggtcaggattctggggcatcgcagggggaagtctcatggtgctgtccatgagttgcatgacccggtgcctgtaatccagagcagctgctgggctagcttgcctccggaattgcttcgtgatatcattgagaggttggaagaaagtgaggctacatggccttctaggaagcatgtggttgcttgtgcgggtgtctgcagaacatggagggagatgtgtaaagagatcgtcaagaatccagagttgtgtgggaagatcaccttccctatttctctgaggcaggtgatcatgcaaattgtgttgtttttagttttatatcctttacaagcaatatcagttcgtccatgttaggtgcttgtccttcaacatattgttggaatttcgaaacacaaaaatagaaagaacacccacatattgcaggattaccgtttgcttatatgctaataagttcatgttattccgcttctatgtacagcctgggccacgagatggaactatgcagtgtttcattaggagggataagtctacgcagacctactatttgtacctctctcttggctctggtatgttacttgttacatctcatatgctttatgttgtatgcgcctatgtaccagagcccatatttgcttctgcataagaagattcatatgtagttgtatatacttgtgagctgctgaatgagtgcatatattctgccaaaactatgcttgtattgcatagcaaatgaagagctgttctttcttatagcccttgcatagggtagatggtgccttgggatggtaattggtgccatgtttatcatttgacatgaatatgctagaaacatattattccttatttgtcattgtctatcttccacaatcatgcacaagcgaacttgtgaacagatcattcagcattccttggctttcatacagttaagttaggttctttataactacaattctgtaataagttgtctcatttttgtaaccaaaataataggatacagcacacaatagttgttatgtataattaagtgctattttttagtattgtatacctctgtcatgcacttgttctactgttttacctgacctataccacttggtatttactacttgacttgacaatctggaaaaaaagttgacctgatccatgataatgtcaattaagcaacagtacactaataaaatatattcccgttgttatgcacaagtaggttgttctcttgagattgtttgcattcgaaccacttcaatagttcaatgacacccatatggtgcgagtatattcacaagtgggactggttctgtgcaattgtaatttgagctgctgtgtcctttgcttgattggaattgcatgctatctgtttgctgtgtccatgtgggtgtgcatctgtcattgttggtttccaattataggtaacatagtgcacatcagatacaaagggcctcaaggctatactgttgtgcacgcatgcatcgtgagaatgaggcgatgagctcagcgtgcttgcattgagctcctagctgcacaagctctgccatcggccggcacgggcctcaaagtcgaccactgctagccctttgagccctgttgtgcgaactcaatcctcttctgttgccttgcgtccgcctgctagtaacatcaagtgagcttagctaattgccgactagatatattaggaaatgacgacgaaacaaaataggagggaatctcgggatgagatgtatggaaagacatttactaattttatgtgtgtaaatgcaagacatatttgagctgctttgatgtcggcatatgttcttaacttctcataatatttttatgcacaacgaattaatattatatggtggaaaccgttgtttgtttgttatttttaatcgtcttatgagttgtaccgttttaatatgcaagcattgtcattcttttacttcagtatgtcttgtgtgtctgacccacctaatttttgcgcgtgctccgtcactggtgcacatatatgttttgtttccttgctggaatacttttagtatttcagtaccagcatttactaattttagatgttttgatttcccttttctgcagctgtgcttgttgacaatggcaaattccttctatcagcaaaaagaaactggcatgcaacatgtacagaatatgtgatatctatgaatgctaacaatttatctaggtctaccaacacaaacattggaaaattgaggtattaacccgaagaaactacaaccttatttcagaacttaccccattttaatctaaaaattattgctgctgctaatatgtctccattttgaattgtaggtcaaacttccttggcacaaagtttgtaatatatgatacccacactccgtacaatgcaactagtgattcacagtcagggaaaacaagccgaagattctccaacaagggaacagcaaagcatccctgcagcacatatagcatagcaaacatctcatatgagctaaacgtctttggaactcggggtcctaggcggatgtgctgtttaatgcactccatccctgcctcatctcttgaggctggtgggactgttcctagccagccggatagcatccttgcccattccctcaatgaatcctcctttaggagtgtctccttttcgaaatcgtccgttatggaccattccatgcatttcagcagtgctcagttctctgacatctcaattggagatggcccaaggattgggggccgggtattgagcgatgatgaggagtgcaaggagacacctttgattctccaaaacaaggctccaagatggcatgagcagctacagtgctggtgcttaaacttccggggccgggtaactgttgcttctgtcaagaacttccagctcatcgcagccacgcagcctgctgcgggagccccaactccatcacagcctgttccaccacccccaccagagcatgataaggtcatactgcaattcgggaaggttgccaaggacatgttcaccatggattaccactacccgctctcagccttccaggcatttgctatctccctgagtagtttcgacaccaagctggcctgcgaatagaacttccaggcaggccagaaacatcatggatgcttcttatttgacgccctgagggcatgcccctggatggagctgaccatccccaagtttagcctgggacgccgttctgttgtatgttactgatgatgtgttaactcagaaacacccaagcaacaaaaggcaaattgttattttagcatttagcttatttattctgattttgctttgtaattgaatgttatctttatttctttttgacccatagctctctctataacaggtattctgtatgtgcatcggataattttcgcagaattcatttgactgttctccagtgatttattaactgagaaagctaataatttggtgattcaagtccacatgatttcagttgtgaggtggataattgtaccttgtattaggctcaagtagtccagtgtcaccatcagaaagcgcatactatgtttgcttccaagagtgaccaatagttaggcttttgcaacccaaatcatgcagatcttatcacggcaggcactaaaataaaccgatcttgtacaatccatgtaagcctgcatctccatccaaataaagattcgaaagtgacttcctattttagatacagtgcttctctttctagagttaggtggccagaaagggacagtagaggatacaacatctgcttctattacaatcaacttttaccggtataaaaaaaaaaggtggctttaccctgaattaaggtgaaatatatcttgtttagatcaggaggtatctagtagcagtgactgaactgtcaaatgtaatcgatcaacttggcaagcatgaacacatttcctgcagcccaagaaatactaaagaattgggaccaaaaacatcaattcagatagtatatattcctatcactgagagcgaaccattctgataactgagattactgaccgcctcattctttcgcttatgcttaaattcttatctttatggcttattagaaaacaaataataatttatgaacacaacttttgtacaggtgtccctaccagttcaaaagcaaatcctgtaaaataaaactatggtgaaaaaagcataaaattgatttcaaaattagtttttaaaatacaaaatttgacttataagcttaggcgaaacgatagggttgtgtgagtgaggccatgaagcatccatccactttaggagagaaaaaagaaagaaagggaaccagcagatgctccctaatgaatgcaaacttgatgtatcctgaattcttcttgattcccaagcaaatgaaatgacgacgtgtcagtactcagtaccaggtactgtaggtattttatctgatactcttagtactcaggttcagtgcatgtgtctctgcctatatacaagtgccaagtgtgtgtgtggtcaggcttcaagtctgaacttttttctctggttgaaattagcttatggtctgaacttgttcaacgaacaactaccaccgctactggtatcgcatggtcaacacttcagctggaattttgaccggttcatgagaccaggtccatctgtacgttcccttttattttcacgtattaagagtatcagatatttttcttcgaatccattactatgtttacattattaattttatagtgaataattaaattcctacttgagtgacgaaatttaaaatcccccttgtcaaaactctatttttaacacatgactagttaattgcccgtacattacgataaaaaaaattattttcacacacaacaagtagaattatgtaaaaaagcataacttccatgatgggatatatggaaatgtacctctagttgtttggcttctattggttagtttggcttctattggttgtgcctagctttccacagctaaatttgtcataagtatggggctttgccatacaaaatttgggcatatggccaataatttgttcatcacaagtatggtaatgtttggctataaattgtatctatgatatgtgggtctataaagtagtaaaatgtgacttgccacaatttcaacaaccaaccaaacactaacctaacaaactacaactagtctaatagtatttggtttggcaatatgtgacatgtaaccagacagatccataggctattttatgatcctgtgttcaacaggtttaaggttttcgtgaagaagtgtagttaaggttaattttaggacggagatagtatatgttaatgctaaagtaatatatggtaacaaactattgcataatttaagagtaaaatgcaccagcggtccttaaacttgtcaagaggtttcacttaggtccacgaacttgcaaagcgcacatcgaggtccctaaacttggtttattgtatcatctcggtccaaagccgtgtttgaccgtggtcttgcctacgtggcacgccacgtggacgatgacatggattttttatattttttttctcccttcttacttcttttttctcttttatgaaaagacgatgacatggacgatgacgtgtgcgaggcattttcgtcttttcgacaaggaagaaagagaaaaaaagaaggaagaagggagaaaaaataaaaaagggctatcgaaaagacgaaaatgcctcgcacacgtcatcgtccatgtcatcgttttttcataaaagagaaaaaagaaggaagaagggagaaaaaaatataaaaaattcatgtcatcgtccacgtggcatgccacgtaggcaagaccacggtcaaacacggctttggaccgggatgatacaataaaccaagtttagggacctcgatgtgcgctttgcaaattcgtggacataagtaaaacctcctgacaagtttaaggaccgctggtgcattttactccataatttaacctatgtttaataagagcagatacaattaataatgggcagtagtagttccacgtaggattttgtgatgatctggaggagagaggggaagagagagagagagatagagacaacgactaatttgttgtcgggctgcatgcgccgcttgaggagtttgtggggcctacctagatggagaagcatcggccatgccttgcgttggcctgcctccgttgccaactcccgcggccaccagaccgctgcccttagactcacaggtgccgacgcacagccgccgctgtctcccacatccgctgcacggcccccgtcatccctcgcctgcacggttgccgccgtcttccgcctctgcagcgcggcccggccaccgctatcttcgacgcccgccgcacggccaccgccgtcttccacctccactgccatctcctgcgtctgccactgccgtcttccgttgtcggtgacagcgaatcgaagctagctcaagaaagaagaagacatgaagacatgaactaaggggataggagggagaaagagaatgtgaggtaggagaagatggtgggtcccacaaaacaataaaatattcgtgttatagtatttctattgtagacattagctacactgcttactatagatgtcatggctatttttttgaagccaacagcgggctatgttattgaccttgctctaagcatgtcaaaattggccggtagaagggacactaaacaatgtacatagactgtgtttagttcgtgtgccaatttttttttaaagtatacaaacacacatttgaagtattaaacgtagattaataacaaaacaaattacagattcctcttgtaaactgcgagatgaatttattaagcctaattaatccgtcattagcaaatgtttactatagcatcacattatcaaataatggtgtaattaggctcaaaagattcgtctcgcaatttacaatcggactgtgcaattggtttttttttcgtccacatttgatgctccatacatgtgttcaaacatttgatgtgacgaaaaagttagaagtttgaagaaaaaaagttaaaatctactcgaaacatagccatggaagcaggggttaccttaccgccgataactgcgcggttactgcggttaccgggcttatcacggggtacggtaatataaataccgcggtaacctccttaaattcaaataagtttaaaaaacaatttaaatttttgataaattttacacggttttatacagtggtaaccgtgcttaccgccgggacgcggtaaccccggccacagtggtttgggagaccctgcatagaagaccacatgtccatgtcataatccatcggaatggatgaacaaacagtagtgagtttgtccaattagaacatgccggctagctaggcatgcagcactgagcatgcaagagacaagacaagcaacaagtcctcttcccatacgatggcaacagcaaggcaggcttggatttgccttccctcacaagtcacaacaacaacggctgccggccgtgtgttccccggaaaaccaacccttggctatgctatcctctcattcgctggtttacgtgtccggccacgccacctgggcccactggcagaattgttttcttggagtactcccctttacactggagtatttgcaaattgcaagcaatggttttgtgacttttcttcttctagaacaatttaatatgtttttttaccaatcataaatatttgcagggtatttgtacacctaaaatttaatgtattggtgcacagaccgattttaatttgctcggtttttgatcggtgaatcgagggagagtagatgagttcatctggaaacgataaggtaaaccctcgattaatacgagactagtaccatgtttgttaacgagccattttttatgcgttttgggttctggccaccacttctccacgtcattgtagtagcattttcaatgccccacctttgctttttttgatttatcgtacctagtgtttttttatttcttgcatcacctcttatttttaagtcaactctcttctcatgatttgtgtagttaatctgtgataaaggaattctccaaattaattccacagcttcaatactttaagagatgtattaaccgaacaagatctaaaataaagttccatagcttaatacgttgattattgaatcctgtcttgaaaaaaggagacatatctgggagtatatgaattgctcgatcccaattattattagacaatagatgttcccggtgacattttcataatagaagtacttatatatgctgtttttttttaagaaagaaagaaagaaaaaaaaatccacaccggctaatatcgaatgccaccatcggtgaaacatttgctgatagtgtggcttggagaatgacaaaagtcgtacaagatcgagtggccaaaaagcatcgccgatttttttgtaatttgacggcctaccaaacgttaggcacaagtagtgtggatccccgaagattgatgcatgattgcgaccacttcgcccactgttgcttcgattagtacgggttacaaagcggccaagaacttcagaacattccgatgcaaaacattaacggtaatataagcacacgtagatttaatttatttcataaataaatcacgttattgactatgtatactaacataaccacgatatacgatctagacatatatactaaacagtaaaccctgagcacatcgaatagatgatacatggtgaacacataacgaaagctctggtttgttgtggattagattgatgaggagcagcgcgcactgcaggaacaacggcggtgctggatgtccctagagtgtagaggaagacgagccgtcgtgaaagaccagcaagcagtcacgcgagccgtttccaaaaagctaattatcgtcttctcccgatacagaatgtcgaaggacgaaggttccaagaggggacctttattgatttttcaaaaaaattaatctccatatgagccttagtagcccacgtattaattccaacaaaaatattgtacagaaatccgtacaaatatatgcacacttatttgtataaacgaacagtcgagcacacacaacatgacactatgaccacatccactttccgagggactaaaccagtgcgtcttaaattgattgcgtcattacaaacatctcactatcgatggatataaatcacctaccactaaaaatataattagcagtaaatacgagcacccatcttaaatttaggacttaaaattgaacaactatatttccatggtaagagaaattgtttacatatttatggttttattggttggcttcagctgataagccgtaaaaaaaaagtgagacaacagaaactaagattgaaaatttgaatttcagcttataagtcaacaagcaaacaatcagattccatttaaacaatacaataacatctcactgtacataaacaccactgagaatttagctaggacagaacttcagagtatgaaaaatttcccttagtccaggagaggattgagaagatttgaaagagatttattccacacctattataatgtgaaactatttcttctcaactcctctaattcatctctctaaaattgaaatgactgagtttactgattttttttaaaaataaaatcctgcaatataaaagagcatatcacaaaactccaaccataaccagcagcctctactacgtgccagctcaccatgtcacgcacacgactccagtccctgataggcttttgtacacctcaccccgtttcaccggcaccaacaacggccaggtccggtccgtccgtacaaccacccgcacgcgccgcaccacactccggctccgccaccctcacctcatcccaaccgtttccgacccgcgcccgtgcggccgcttgaccgtttcccactgccacctgggccccacctcgtcgggccccgcgccgcgcctcaccggtggccgcgtggcacccgcccaccggccgcgcccacgccccgcgtgcgccgcggtagtcctattcccaaactgcccccgggtcggtcgccggcgcgagcactggagtgcggggggtagaaaggtaaaatcgtgggggtggaggtgtgaacgcacgggccccgcgtgggaggggcgggttacgcgtgtcgggcccacatggcagggactctcgggccgcgtgtaccactcccctccccgcgtagcactagctttttgctgattgattcgtctcggctcgaggggcttaactcggtttggtttacttttctcttttgatttgatgataatgaattgatctaatgatcccctctgcaaatggcgactggtcaccggagtttgatcggatttgtttagttttgcgatttggttaagctaaacctcgccaattaatctggctgctgatcctgcccttttgcagaaaagccctccaggattgatggtttttgtgtctgcctcaaattggccatgcatcaacatgaagtatggccaattattgtgcatcatgtcagattgtcagtatagtcagctgatcactgtagtagcacagtgagaagaagatgaatacacaaacaacaatctttgctgatatttttcatatccacaagaggggcctggcctatttggaaggtatttctatggctacgatatataaaaccaaaatacgcgacgactgaaggaatgaaagataattttaggataaaaactatatgattgtactcttggcagtcaaaaagttcaaggttgagaaaacccattagactaattctagaattagggtctgaatttagctacagcttataagtcgtagctcaaacaagcatgctcgttaacgtattcaaggcaatacatttttaacaatgataagaggagaccggccgatttggaaggtatttctatggttgcgatatataaaccaataatacatgatcataacaataaaaaaataggataacaattttgtacttctactcttagcagttccaaagttaaaaggtcggcaaataaaccattgaattaattctaaaattacgacgtaaaattagcaacaacttagaaatcgcggctcaaacaagaagggctcttcaagtattccactatagtaaaatgctcgtacctcattctatgcaaaagatgacaatatttcattttaactttgtaaggacccaggagtaattacaacccttttagagcccctcctaccaaaaccccctgagagagaaagctaaacaaaaactagaaacattctcagttccagaagaatatttgcacccacagaaagaaatcatttacaaaccaaagattaaacaaatccaaacaatcatgattagctaagaccacttccccctaaaccccaaaatatcattaaactaatcccctccctaatcacaatcccatacatatatacacccatccatccatccatccacacatcaccacctcaccatctccatccatctcacccgttaacccgctaagctctctctccaagatccgcttcggtttcctctccggcgatctcgccggcgaccatgccggcgaccgactaccagggctcctcctcgacccactcccacccgtcgcccttctcctcgttcggccgctccctcctctcgctccgccgcgacagccccgccgccgccgccggcgcgtccccggccatggcgtccggcgaggaggccgacctggaggcgttccagcggcacgtggcggcgcacctcgccgatctcaggggcggggaggacgagctcctgtccatcgagtggatccggcggctgctcgaggcgttcctgctgtgccaggaggagttccgggtggtggtggcgctggcgcgccgccgcggggcgctgtcggcggcggcggagaagatggtgggggatttctacgagcgcgcggtgaaggcgctcgacgtgtgcaacgccgcacgcgacggcgtcgaccaggtcaggcggtgggagcggctcgccggcatcgcggcgtccgtgctgctcgccccaggggagatccacgagggccagctccgccgcgcgcggaaggcgctctccgacctctcggtgctcctcatcgacgacgccgcggccgccgcgggtggcggcggcgtcgcctccttcctctcctcccaccgcaaccgctccttcggccgcgcccgcgcgtcgccctcccgctccgcgacgctcgcctcctcctcatcctcctcgtcgtcgtcctcctcctcctcccacttccgctcgctctcgtggagcgtctcccgcaactggtcggcggctaggcagctgcaggccatcgggtccggcctggcggcgccgcgcgcgcacgaggggggactcgtggcgccggtgtactccatgggctgcctgctccacctcgccgcgtgggccctcgtcgccgccgtgccgtgcccggaccgcgccgccgcgctccaggcgcaccacctccccgccgcgccgccgcgcgccgcgttcccatgggcgccgccgctgctcgcgctccaggagcgcctcaccgaggaggggaagcgcaaggacaggcgcaactcctgcggcctcctcaaggaaatccacgcgctggagaaatgcacgcagcggctcgccgaggcgatcgacgccgcacccgtcccgctctccggtgagcgcgaggccgaggtacgggaggccgccgccgagctggctgccgtgtgcgccgccatgagggccggccttgagcctctcgaaaggcaggtcagggaggtgttccaccgcattgttcgcagccgcatggaggggctcgattcgccgatgctcaacgccgattgaaacatggagaattcacatttgatcgcgcaatgtggtggtgataggtaatgccgatcgaaccgtcgagaatttggatttgatcgcgcaaatgtggtggttataggtagctctcctgttcttggtttttttcctcacttgtggtggtctagtagtaattataaaatgtgtgccgttctgtaaaggaaggggggaaaggaaaggaaccatctttatgtaaagatgattccttcttcccatgttttgatgctgcatttggtgtatatcatggcatttttgttagtcctccatgtgtgcgcggctaattctgggagtaacttatagttgaaaaatctgtgaggtcgctatgaaatgtggcctgttgtcgagaatgtcgacaaaaaaattaaacaagaaaaaaaaatctactgtggtttagttcgattgtgttgtgtcataattcatgtttggtcctgatatttggatggtttaatcaaaaggtcaaatcttgaaactatcatgcgtgcaaaattcagcaatgtttgacattatgaagtactgctgtagcggtgtagactttttccatcctttcagttctacatatggttctgtgaaatccttaatttggttttatattcaatatgggaatctttttaagagttcctcattgtggattgcagtttgtgatggatcagttctgttgtccaatttatttgaaggcttcttgccagcagaaaatataatatattaagaattagattaggagatcaacatggatagagtgcggagtaacagatttcacattacacacacttatgagttaaattctagtgccaataatgataagacccctgcaagattgtctgtgtgatattgtcaataatctatatctaggtgatcttcttatctcctgcataattctatctgacataaaagatcaggtcaaactgtattagtgctgctaccaaactattataaaattaggatggaaaagatactagtgcagatcttgtcatatgttaataaacaataacctgattcactgaataggtgcatgtcggctttgtagttcagcttggttagatgtactcctgtataatatttctactttggttgatgtacttgaccctaatatttcagtcttctgtgcaatctttttcatggttctggacttgtagttgtccctgacaccaaaactcaggcctgaacaagtgaacatttccacttgttttgaactagtgaatgcttctgcatgtcacaactcacaactgaaactcctgagagtgtttgctaatcttgtacataaccaatagaggaaaaattcagcttctgatgtacctaaaaaacccactagtttgagatgcattttctcacagttgtggcaaaaggtcaataatgatgtgcagaagaagcacaaggttggaagaaaagatctgatgatcctcaattatagtgatcatctcctccttttacctctgaaaatgtagtattgagtttccatcatcatcatccagtcactgtcctgtatcctttgtaacctaaagtatttctccaattagtgacaacattataatggcttccctgctggttcatctgccacgtgttcacattataatcagtgccctcctttcatgagctttttgttcacaagatgtgctcacttctgaaatgagaggagcttcttctgttgtgctcacttctgttcttcatgtgaatcatatatcatcctgatgaacaatgattcatcatcagcagtagcagttacagagaccttgtgcagatgtgtggctggtgtgatgatgtgagctgtatcattcggaaggcctttttgtggggttgaattgcattggcttgatgatgaggtgtttgtttcttggcgctttttccagctgttgctgaaatggaagaggtgagaaccggccggcgcatgcatgtcgcctctcacctgctgctgcgtctgcgtgccatttggtcccattccccgaaattttgggcgtcaccgcagcgtcatgctggcgtcagcgtctctctgtataagggcccacttgtcagccatgggaagattcaataatctggttattattatagtttggaatttttcagagattaaggcccatgccagaattttgtccaggccggccttaccggagggaggtctggttttgggctttttaagcccaacct

SEQ ID NO: 80857 - DNA, 2637 bp, Oryza sativa
ccactatacaatcgtgcaagttaaaagaaaaaccaaaatgtatcttcgttgtacaggtgatatccaccgcttgatttaattatttttgtttgtcgagttgtaaatcaaatttaatcttacatgtttgtctatagacatatagcatcccaaatgtttagcaccgaagaacattaacctatgccacatcgtgtcaagagcattcttagaaatgttgatgtagatataggcaccttatgggcctcactatttaattaaaaaaaatatgttgcactcaacttgtcatgttgttccatcagataaacgtggtatcgtttatgtttggacaattacttgacagttatttatttgactttattatgtacttagctataaacactcatgtattattttttgttaacttcgttaaaaatatcaaaccagtgctccataaaccagttcaacgccagctggcagctgcattactactattgcatgtgttagctagctgtttcgcttcggaaaaatattttctacacttggtatcatgtcacccagatgtatgcatgtagattatatagtataaagcactatacaattgtgcaagttaaaagaaaaaccaaattttatctacgttgtacaagtaaatatccactgcctgattttattatgtttgtttctcgagttgtagatcaaatttaatcttacatgtttgtctatagactcatagcatcccaatagatgttacttttttttaactttttataactatttaagtcgtatagaaataatggttgccatgatatctagataaaaaacctatccgccctctacttctactttgctgctcgctagctctttcatatttttttccctcaataattcagaggcgttatggtgctcttgctctatataaaccctccaagcctctggccgacgatcaagaaccactttgcccacgtacatacaccgacagccatggacaccccggcgttgctcccgttggcgcttgcccttgttgccatcccgatcaccatccttcttgatcttcaatcggatccgcctcggcaggctgtcccccgggccccgggcgtggccggtggtaacctgttcgacatcacgctggtgcggtgccggtgcttcatggagtgggcaggcaagtacggacccatcatgacggtctggctgggcacgtcgccgacgatcgtggtgtcgacgtcggagctagccagagaggtgttcaagaacgtacaatgatcagcagctcgccgaccgcccgcggaaccactcggcggagcggttaagccgcggcggcacggacctcatctgggcggactatggcccgcactacgtcaaggtgcggaagctgtgcaacctggagctctttgcgccgcgtcggatggaggctctcaggcccatcagcgaggacgaggtcaatgccatggtagagtccatctacagagccgtcactgctcctggtaggttgtacagcacgatgaatgaatttaatgtgttttgcacgcaacatcatgtgtcttaacaaacgctattattagattgattcataattacatagttgagtgtggcccgtgtaattgcgcggcaagcatccgtataaaatattttgtttacatatatttttctttaaaatttgttaagtagccatatagttatattaggatttcaaaagatcaaattttatcattgtcaagttttttattttataatttttaaatgtcacgttagccgccaatccttttctcctgcccgacctgccacagcttttattatactttaaaaattggatagtttgtctagttcattgtcttgtcgaattttgatttgtagttttggaagtccctttaaacgtcaacattgtactcctctacggtgtactaactttcaacctctttattatcattaggatttatgaaatggaacatgattatagttggattttcgttttctttttacttccaagaagtcctgtcaaccatcaccaccgttctcttttaatttacagcctacccaaaatctttccttctaatcatcctttggtttctaaatattgaatctagtaatcattaggagttttggtttttatttttaatatcccatcaacctctaccaaccctatctttatggtttgtctgatgtcccttttgcatttatggtcacttaccaccgttatgttatagatgtaatatgttctattaaaatatcttatctgttatttataatttatattcctactcaaccctcattttagtttttctaatcacataatttaatttatttttatttctaactttagttaattccgtattgtagtctatatgaattgttatttcatctatttcctatttaagttatttgtaaataatattcattctcaaactctcatttttatttgtcaactttcagaatttataaaatttttatcccggtttttcattaatcttgtgttgttttaatagtttttatttttatgatgaatttagttgttgataaattgtatacatgaactcatattttgatttttctaatttcgaaatttatttatttattattctaattttaattaatctcgtattttgtactacgattgactattcttttcatattacactttttaattttcaaatttcagttatttctaaa

SEQ ID NO: 80858 - DNA, 2182 bp, Oryza sativa
accattgctggacggctaatcgccttgccaagcgtggactgccacatcctgctacttgtatgctttctgaccaggctgaggaatccattaatcacatcctagttacttgtgtcttttcccaacaagtgtggtcactaattctccaaaggttggggctgatttccatttctccaagtcaaaattctacttgcttatgctgttggtggcctaaggcagtgtaagaggcattgatcaaaactccaaaaaaaaagggctcaatacagttatcattttggtggcttgggaaatctggaagcataggaacgactgtttgtttaacggcgtcaatcctaatgtaatgtctgtcatccaaacggtggcaaatgagtatgacctatggtgtatggccggagcttctaagctcacatatttccctagtaggtcgctaaccccgtttgggtaaggttgtttttgttccttttcatatgtaacctcaggtcctgtttgtttgtagggtgagggagggtttttcttccctcctcgtttttttttcctgtcttaatgaaatgatacgtatttctcttgcatattcaagaaaaaaaaggtcaatgaaccttaaaagaatccaaaggataagcttgaagattttgcaggatgctagtagaatcattaccaatgggcacagtgttagcaatattctaaaatacggtgcaaatgtcatcacggaaaaatcaaaatgtaacatcagcttttgctaatttctcccaccacatccttcttaagaaatcaggacaaggaaataaaagcaaacatactatattgtacatctagaaaatatttttaaactgaagcacatgaatatcgtattctaggtacgctatggacttctgcttgcttcttggacctgttcattgaactgagaatcttccatttgacagtctatttaaaactagaaactataatttacaaattaagtaagaatctattgtgtgacatgttccgatatagctttcatgcatttggttcatttcgcttggatttgtatgatagctattttctcaggaaggaatatgctaactaggagtgtgtggtattataaattgagtttcttaaatggaaaatcacatcgttacaattttgtcacacgtgacttctcatgaaaaaatattaaccacaaattgagcatcaaaaatttttagctgcactacaaatatcggccattcaacatggcttttgtcacaaggaagagaccattcaacatttgttttttcaatgtcgtgtttctcgcttggtatggtctgttgttcatatggcttcgaacatacaacctcctcaaaatattactcacttgtttgggcgttggcttacttgtgttcctaaagacatgagaaatctgcttttgatgggtgcagcatctctttgttggtccatatggctaagcagaaacgaggtaatttttgataacaaggtggtgtcttctcctttgcaggttactactttagtcacccggtggctacgctcctgggccatcctccacaaacagggacttcgggatactattgcggtggtatcgcaacgtttggattaggtggcacaggagttttttacccaggagcatgggtggcgatctagtctacggattgatagccactagtttctatgttttgtgatggggaagtgttcttaggtccagttttttggttgtgtgcattctatgcagaggccgggggtggactcagttggaatgtatcatcttggtgtatttaactgagtcttaataaagcttccattatctaaaaaacaaatatcggccaaatgaaacacattgcatttagaaaattttaacttcaattccatctttctacatcacaagtgtaatccactgatctaataagtaataaccaaatatacaattaggttccataataaggaaagcggtataaatcatgtgaagatgttgaggacaagctatagaagcttgcagattatataagaaaggataaaaaagatcaggaatttcatgcacaagcaaaccacggaattatgtaaggagctaggcaacaaacctgtctccaaagtggaagtgacttaaactgatctcctagatcatgcagcctctgtgaactacaacatataaggggcagagataaatgcttaaccaacttaaaacgaaagaagaggaagataacaaaaaaaaaagaaa

SEQ ID NO: 80859 - DNA, 25301 bp, Oryza sativa
actcccgaacaaagcctaatatattctcattctttcgtgcatgcagttacctagaatcgtacgtcgaactagctttaacgatgaagacattaaaaatatgtagcggcatctctgccatttcatccatcgcgattgttgtcataaagatggatgggtacaagttctttcgagagtggaacaatgtgatgccataatgcattaattagataatgcattcggaatgacaattgtaaaaatattgtaacgtattgacgatacttttcacttgtacattgtacgtaattatgtcaatattaaatgtttgttagtgcctaatagtattaatgtattaattaactaattaattacaatattattacaaaatttggcgggagatttaaaattttgtggcggccttgactattaccgctggtggccctgacctctacccttcttcctagggcggggccctgggttctcttcaatcttctcaagcagaccggccgtccaccaatgaaaatcggtgatttttgcaggccttggcctacaggtagaccaggcgtctgtttgagaagaccgatttcgaccgactacaagtactttatttttctaagtagcgtactgaaatacttcttccgtcctataaaacttgtcattctaggttgtttagcatgcattaaggttatgataaaaagactataataccccttattaaataatgtacatttggatgtaggatggtggttaggggtagaatggggagaaatttgaattgaaagtggtttatgtgataggtagtactctaaggtgacaattattttggaaaaacttttgattactatacagataagtattttggcatggaggagtaacagagttggggcggatagatgctgcttccagccttccaggcatttacaactagctaggggaatcatcaagtaattaaaaaccataaaaggccagcttattcgctctgcccagaagatagcttaattattcggtgcagcgggattaattctgacaacgtgcttgtggttccatatagtgcctcaagcacaaaagaaagaataagcgatgatgcgtcatgctggagctggttccggggatgatttttttcacaagaaaataaaataaaataaaatgctagatattaagaaaatgttatttcatttcactgattccaagagaaggtgcatatcgatcactaattcaacagaattcaatagtttcatattagtggataattaaaaaacatcatggaaaaaaaaaagaacaacatccacacgtccacgtccatgtaacagaaaacccataccggctcggtgcaacggaccattgccctttatatatatgtactcatgccaattcgtgagcatatggttttcgacggcatataggcggcggggcaggagttgaggtgggttccaaaagaatatataaaaggcggaggatataatttacttccttcgtttcatattaatatatacaatttaatatgaaacggaggaagtagtatattaattgtaatcaaattaaaggagcgttgagacgggttgattgatacctcagaaaacaaattagcataccatatgcttgctgatttctgatattttattcattaccacacatatatagttgcattatacgagccaaacaaccaggacggacgatgtgtacagctgataagcagatacaaagcgcctggtgtacgtacacacatacatgaaaaggaaacgaaagccacaccaataaaatacaggagccatgcatgcgtgcacacatgcatgactatactgacggcggaacgtccttagctgcatgcgtgcatttacgattattgtcgtaattaatgcacacatgtaagtagacatttacttatattaatatatgtgtgtggatggatggatcgatcgatctagggggtggattgctggtaaggggtaccaaggatgtagacgcccagagcgttgatgtactggtcggtgcggccgaagaacgccacgatctggccatcctccaccggcacgctgaaataatcgccctccttggttttgtccccgagccaatcgggattattattgtttttcgtcgtgattctgagagacttgatttttgtacggccgtcagtcctgccctccagcttattcacgtaatcatcatcatcttcaatattaatctgcaagaggaaaaaaatattagtgtttttatttatcgatgcgtgctaactattaattctctctccgctccaaaacgtaattaaggtgtttgttaattagtttggtgctaagccaaatttttttttcttaatttgaataaatttattcatagaaaaaatgtaatagaatgaccaaacaaatgtgttataagaaatagagttaagtgcaagaacgctccctaaagttatgtaggtatatgtcatctagtttcctaaattcttaaaatgcattttcaggtcgtcctcaaacttgaacttgccctgtgatgtataggttcaaacaggtagcaaccccgctttacgtgttaacgcagcaatatatggtactgcctacatacccatatatatgtcagtcacatagaaagatataaaatttaaaaacttcttttctacctgcttccatgtgattatgaaaagatgttttttaattttagttttttcccatgtgactaatgtgttggttgtccaactgatatataagtgccaccgtaacaagccatgttagcgcacggatcgtattggagctcatttggatctatatgacaatcagaacaagtttgaagatccgaaaatacatttttagagttcaaaacctagatgacatacctagacaagtttagagaccgatatcacttcatacttgtaaaaaatattaatgatatttaataaaactaatgtaatgttacaaatattattattatttctataaacttaattatattagtcgtgcttaaaaattttgattctatacaaaatttaaacagaaacatatttcatttttgaaacaggggactagctaagttaacgtttgaccactcccaccatttcagaattaatgtcgccgttaacgtttcacacaacgttggactatttattttattcaaaaatttagtgcaagtatgtaaaattataagttaagattttattttatttgatgataaaaaaaatcctaacaaaataaattatttttatataaatattttaaataaggtgaaagtttaaacgttagaaaaaaaaattaacggcatagtacattttaaaaatggagaataacaaatcagaaagcaagcagacgcatgcagaacacatatatacatacctcatcgctactaccgctatcgtcgccccaaacgcgagtggtggtgagctttcttttgttggcggcgtggaggtagctgaactttaagccgttgattccatcttcgtcgtaccagattttgatactcttgaggtgatctggcggcaaggtgtggtcaatgtcgacaggggtgccacccgcaccgaaaggcccaaccttcgccagcgtcgtcgccatctgcactgatgatctcttgttgctggtgtcgtcgcctgaaggaagcctaacacatgcaaacggcatcaaataacgacagcagcacaagtgcacgcaaatatactaatcaggagtaaaagtttttacttaaagtaacattaattaataagtcttagatgtctatttcttaaaaattttacgatagcttttgggttcgcattgatcgatctgtatttcttttccggttatgcgtacgtcagtttggatcacatctcgatcaggtggcagtttatcatgcatgcaagatcacactatatccagatcaactaaaaaaagcaatatatatatatatatatatatatatatatatatatatatcgaacttactatctcaagcatatgtacgtaccctgagttaacaaatcgtaagattcactggtggagaaaccctttgtagtcccggttcgtaacccccttttagtcccggtttggacaatccgggactaaagatcgctatctttagtcccgggtgaaataaccgggactaaagatcgagctgacctttttttttttgcatggccctgttgctgcatggtttatatatatatatatatataaaccatgcatatatatgtttcaatacatatatatgcatacatatatatatgtatatatattatattatattatatgtatatacatgcataatatatatgtatttatacatatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatttctctaccggtggcgctcatctccatgtacagctgatggaacttgtacatttgtgtgggtagggactgcagcagctcaggcttgataagcggtttaccgagttcgtacatgtatttcacttccgccttttcgattggtgcgactcctagcaattgatccgtagttagaccagtgtcagtaataaattgttctatcgtcatttctttaccggtcaccaacggctcgatctcctgatttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtggacaggcggtggagctgggggggcccttgactttgaaggtgccggaagaggagcttgcggaggagtaggtgtaggagcccgaggaggagtcggtgcaggatcctgaggaggagtcggtgctggcggagcatgaggaggagacggtgcaggatcctgaggaggagatggcggagccgaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagaaattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccaactcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggttggaacgtgccctgagaggaggcttccactgcatctgttagtcgtcgcgcagcctctcgtatctgatcgccgaagaccagtgagccatcagctgggttgagcgttccaccgtaagtatagtaccagaacttcgatcgttccggccaattggctgttgccggttagatacccctctcaatcaagctagcctccatctgctcccacttcggcatcgcgacgctatagcctcctgaccccaagtggtaatggtacttcttcttggcggcattttctttgtttcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacatctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattatgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccataccgggtggtttgctgcaaggaatcgacgatgacccatgtatacaaccttcttacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtatttcctcttcatgcatagccaggggggaaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcatgttgacgctcttcagcgtgccatcgcaacattctagcattccccttgttcctgaacaaacaccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccacgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactctagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacaaactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaaccccttttcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaacttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagtaattttgaagcttgctcgggcagctggaggaggaagaagacatatatatataggggtgggactttagtcccggttggtagcaccaaccggggctaaagatcaccgggatctttagtcccggctggtattaccaaccgggactaaagttaagatctttagtcccggttggtagcaccaaccggggctaaagatcaccgggatctttagtcctggttggtaataccaaccgggactaaagttaagatctttagtcccggttggtgttaccaaccgggtctaaagatctcgggggggcctgacaggtcctgacagcattcgaaccgggactaaagatgatctttagtcccggttggtaacacaaaccgggactaaagatcaaatatgcccgtttctcttttgaaccgggactaaagatcatctttagccccggtttttattgcatccgggactattgtggaaatcggccgaccgacgaaagatggtttctccaccagtgaaggtaagctggagttcgccgccggtgtatgtggtaagcagcagacaaaacaaatattgcatgctttaacaccccgcgccgccggcgccggcaacactgtgcttgaaatcacctggtcaccggacttcccaaggtaaattgaactcgcagctagcgccctacttgaaatgttgcatgcatttagttatattacttcgtcttctgtactccctccatattttaatatatgacgccgttgattttttgtcctatgtttgaccattcgtcttattcaaaaaatttaatgtaattatcatttattttattgtgacttaattcgtcatcaaatattctttaagcatgacataaatatttttatatttgcaaaaaaattttgaaaaaaagaatagtcaaacgttgatcgaaaaatcaacggcgtcatacattaaaatatgaagggagtatatagctagtaatattgttttttttagataatggaatataatatcccggcctttactcaaaagagctacagccaattattacatagtagtttttatgaacatagtgtaaatctaaatgaatagaacacaccgaagagaaaaataaagaaatcagcctaacataaggagatcacaattattgaagtctatttgtaaatctccaaccataattggcaaaaagttgcataaccgtggtctccaactttcagcatgcaacattcagaaactcttcatcttcatcacacctttgtagttgtgcccaaaaccggagccaatgagttgccctgaaaatgacctgcatataggaaaatgatggtgatttgtcaaaaaccatatcgttcctactcagccatattgcccaacaaatggcaaaagctccaacaagtatcagtttactcattttcttatcaactccaaaagccacccattaaaaatatgagatatgctaactggaagattaaaaccaaaagagaactgaactactctctatagaaacttcgcaaaatgacaatccataaagagatgttgaatagactcattcttcaaacaaaaagaacacctcaagctgccattccagttacgccttgccaaattatccttagttaacacaacccctttaagcaggtaccacatgaaaattttaatcttaagtggcaacttaagcttccaaatacacttgtttctctcgatatagccactattaattaaagctaggtacatagacctcaccgagaataagccattctgatggaaattccatctaaaactatcagacgaatcattcaactgaatatgtactatagaggcacacaactcatgccaacaaacaagattctgaccatctaaagctttcctgaaagaaacattaagcggaacagatcccataacagtggcaatagaagatgttttcctccgaacaattacgtacaaagatggatatttatccttaaaagctaagttaccaatccatctatcttcccaaaatctaatttgttccccatgattgacaatttaagaacccatatttaagaaagtacttttgacattcataagaccagaccaaaaatgggaatcaccttgtttcttgtcaacttgggttatagatttattatagagatatttccttttcaataaatcatgccaaaccccttcctcattaattaacttaaacaaccatttacttaaaaaatatttattttgtatctccaaattatgaatcccaagacccccctggtccttgggttgacaaacaacatcccacctagtgagcctgtattttttcttatggtcatccccttgccaaaaaaaccgcgatctataataatcaattttacgaagaacccctttcggcacctaaaaaaagatatcataaacatggctaaacttgaaagaacagaattaatcaacaccagcctaccaccaacagataaatgcttgcctttccaactactaagttttttctcaattctctcttcaataagtttccaatctttattagaaagcttcctaaaatgcatcggaattccaagatatttaaaaggaaaggtacctaacttacaaccaaaaatatcagaatattgttcataacattcctttgcctgaccaaagcaaaataattcactcttgtgaaaatttatttttaggccagataacttttcaaataccgataaaatcagtttcaaattctttgcctgttgcaagtcatgctccaaaaagatgatagtatcatctgcgtattgcaagatagacaaaccatcatcaacaagatgaggaataaccccattcaagagtcccgcctctttagccctcttaatcaatagagtaagcatgtcagctactatattaaaaagaataggagataaatgatccccttgcctaagacctttgtaagtttgaaaaccattaccaatttgatcgttaacttttataccaacatgaccaccttgaacaaaaaaaagctatccactcacaccatctagaagaaaagcctttcattctcaaagtttgttgtacaaaaggccatttaactttatcataagctttctcaaaatcaatcttaaaaattacaccacttttatctttgcgatgtaattcatgtaaagtctcatgtaaaataaccaccccttccatagtatttctcccaggaatgaacacggtttgagtaggcctaattaacttttgagcgatagctagtaatgttgtatgcgttacttacgtcgtttttggacatatggctatagcattcgtctttcacttttacagggagcgctgaattgtatagagacgatcgaggattctctgtagcgacaaccacaattgtggcttcaaggagatccaattgcatcgatccagaacatctctacacgttgatacccaactaagcgttaattagtttactcaattatttccatacaacgatctcggtgaaaaaggatatttgtgtgctactatgatctgtactatctaccatatgtgctcctacgttgtatgattcttttttttttcgagggagatctaacctatagatggttgtacgtgtggttgtacactcaaacataattattcaatccctcgaatagttgcctgttttaattatatatgtgagttgcatgtcaaagttgttatttttaatgaaaaactataattaattacggcacgggactcggatggcatatttgtgaaaccacaaagtaaaaagcttactgcaaaaaaaaaagctgaggagagcttgcgcaggaagatagcttccgccccttcaccacttgaagataggagccaacggtctactaggttccagggtgaagtgtcatgaccataacttgtactcaaccccaaaataaatactactacttcgtacttcctgtgtttcacaacccggtctcttttttcaactcacctcccttattttccacgtgcatatactctccaaactactaagggttacttttttttataaaagtttctatagaaaagttgctttaaaaattatattaatccattttcaagtttattttagttaatacttaagtaatcttatgctaatacgaactttgttttgtgtgttggccaatccctcctctcgaaaacagccttggtgtattcccatggtcttggaaccagctacgaccatccccccttttttgttagggttaatcagatccatgccattgcaacttttatggttttgaaatataccattactattcatctacttagagtaatgccatttcaattttactgttatttgaaatataccactacttaccccttcaatgtattttctaaaacttttagaccaatttacccttgtcttcttcctccgtctcctcttcttcttctccaacatatgcatcccctttcttcacccagtgatgccgaccagccggtgcactgatgctgctctctgcgcgagccccttcctgcggggcattttcacacgttgggccgtcgacgcgatgggtgacagactagagctgtgggagatatcctcgtcagcgaggaggcggaggtcgggtacgaggtgctgcagctggtgctcgaatccctcccgttgccgtgcccgtcgcaaagccaagccgtccgaggaccaaccaacgaccggctagtaacttaggccaccaatttgattccgctgcatcttaattcttctatgggaaatcaagtgctttggtggatattgatacatgcaacactgtagcaacatgacagctaattcatattgggtccttgtcctggtgattggagtagttgttggtttgacccatcgttgctgcgtatgcctagataattgggtccacagtagctgctccgcttccacatagtaggcatgctacctgctgctttgatgttcagcttagtagctgagggatctagttggtagagaagatgaacaggagagaggggagaaaggaggaagaagggtaatttggtccaaaaattctagaaattacattgaaaaggtaagtagtggcatatttcaaataactatagaattataatggcatgcctctaaattgataaatagtaatggcatatttcaaaatcgtcaaagttatagtggcatggatctaattaaccatttttgttacttccgacaacatcacgaccacctcacttgctacatgtgctccaactgccctagtgccctctcctacccactactacagaaacatgcatctatgacggatcaatgtgatccatgtcacatgacctcatctttgatgggttggacatgtttgagatacgacgaggacgacatgctacagatttaaggtcatatctgaatgacctattaaagataaaatattatctctgacaagccaatttctcataccatcacatgcacctaacatggccttcaggtctctcttctttctctctagatcgacctcatcttcccatctcgaactctctgttttcctctctcgtctatctgcctttctcccgaaagttgcatgcatccaagcgctaccaccccgtcctccaattcggagcactagccatcgtctcctccactctaagtgtgggtcaccatctcctctactgcgagcacctaccctagctatctcctccacactagagcaccctctatgccgagctgctctgatctctatatcaagtccccaaccgtctatggtgtcagttatctttgacgggtgaaataagcacccgtcacaaatatgcttcttccttgcgacctaaggttttatcacatgtgttggaggaacggggactagggtcctcagccctccggggtctttggggcaatagaggttttgaactttttgaagagatgtacaagatctacaccttctagagacccacaagatttagatcaccaaggtgccaggaagagaattgagacctacaagctctatatcaaggtgctgaggagacagctggtgacttggtgcaccctccacaggcggtgtacattgagaacttgttcatcaatgacatctttgagaagcttatccgaagtaacgagaaaagctataaatccaactaccctgggccaaattcgtgccccggacacacattgtgccataggcatgtggctgccccggggtatagcataggggtctcggggccctagcatgcatcctgctccgggctcgccttgggttcctccgcctatccaagtgggctcagacttttgaatccaaccaatatcatgatttatgttgcaagatgaaacagttggagaacaactcatctgcatataccacaaggacgtggccctgcatgcagcctcctacatgcccacgtcaaccgaaataataggaagggtgcggcatgtcgtgcccacatcaactcccatacaatatcaccttgctacctcacagggactgattggtgtaacccacggtgaccggcatgcccgctgcctccctctcccgcttcgtcccatatggttcaatcgaacctagaagatgagtgacggttattcagtaaagtctccttttcaaatggtaagaaatgataagagcaccactaatagtgattaacaaattgctctactttggagtgctctcagatgagtagctatactagtaaatggtcatgagggcactaccaagggaagtccaaccatgagattgtcacttggatctcatgaccacccattccaataacacgttccacatgttgatcactagtcgtagggtcaaactcgactgcagctctgacaatctcatcaccggaagaagaacgcaagtccaacggcatcatagctggcactgcaagcgcacgcctcgccaatgggatcaacccgtctgatcctatgtgtgggatgctgccaaagtcgctgtagaacaggacacaaccaacattgaggagcttgctgcgcgtgatgatcctcccaagaacaccggtgattgcagtggggtcgttgtgttcatctcgacggaccagcttgactgtgacctgtccttcaacggcgttggtcagcacagcgtagctcacctcagcgggaccatacccagtgttgactgtctcgattatggtactgttgtagttgttgaagagaccgttgcaggtattgtatattacctccacctcattctcattgttatcctcttcttggctaccgtcatggagacaaagggtaaagatgatgggggcatatgctgaggtggcaaacgatggaccagttagcatgatgttgccctgttttgggagaaaaaaaatccaattgaaactagcatagacattatttggaagcatgaattttgcaagattttcataaaaatatattgaatcccacaaaaataattttaagagtgaaaatttcaaactggactccttacgaagttcaatgttacaccaccatttagcccatatttttatttttgcctttttttatacattttttgtttcagtttggactccttttttttccacatcctcaagattactctccgtgtaccaccgtaaactgtgtaaaatcaaaggtgtttttgattattattctgtgatgaacaattggcattggagattattggttttgatatttggaatttattcacgaagtggttttggagatgattggatttataggtgaatcgcaggttctgttatttcatgtgaccggtcagatcgtgcagtcagaccggcccagcccgcggtctgactggccgacgctgtgttggtttcagtttcgggttgtttgtttggatatccgtgattatttcatgattatggcttctagatggatactatacgattgtttgctactaatgagtcaagttgtgatagcttggtctcggaatatggtttctttgtttatttcatgtgtaggtgactcgatgcctcgggagagtatttgcggtgacggaccggaagttggcttggggataagatgacgtccgtggtggtcagagatcatgcgggatatttaggctagagttgatgcacgtggttgatggagattccatatggcatacgatggagttattgtgtgcgtatgggatgcggagtcgaatttggaaggagtccaaatttggtatgagtggttatgtaaagtttgtttcttgtactagagggtttcctaaggtgtttaggactcctagtatgagtttggttcgtggttttaggctgcctacctcgggtataaatagagggggagcatgatgcttcccggtatcgtttttgagagcaattgagttgagttttgagttagagtttcgagtttagtcaaaatttctgtagggaatgctgttggtgcactttgtaaacacagagagaatcaataaagtcgtcaactactttaagagttcttcgatttgtgtttcaccgggtttcggcggtctaaccggcgatataccggcggtcagaccggcggcaagcagcagtcagaacggcggtggcgaggcggtcagaccggcggcggcgacagcgagcggcagctgatcttggtggtcagactggagatctaatctcggttagactgacggcaccacttggtcagaccgacagatcaatctcggtcagaccaacttccgtcgattttgagggtaacttttatttccgctaaaagttttcggtttttgggtataccaaccattcaccccccctctggttggcttagttattgtgattcgatcctacaagtggtatcagagccttgtttcttctttagatttttatcgatctagagtttttgccatggctactcctgttaggttttcaactaagcctcatgttttcaatggaacggatttttctcattggtatagtaggatgcaatcttacattatggctgaagtttatgatatttgaagaaaagtttctcatccttatgtgattcctgaagctattaatactgctgctgaaaaatttgtttttgaacaaaattgcaaagctcgcaacattcttttgagtggtatttctcgttcggattatgatcgtgttgcgcattttcgaactgctcatgaaatttggaatgctttgaataactttcatcaaggaacaaaaaacattaaagaacttcgtcgtgatattttcaaaaaggagtacattaaatttgagatgaaacctggagaagctttggatgactatctttctaggtttaataaaattttgagtgatcttagatctgttgattcttcttatgatgctaattatccacaatctgagatttctcgtcactttttgaatggtcttgatatgtctatttgggagatgaaagttacatctattcaggaatctgttaacatgtctactttgactttggagaagaccaacaacatcaagccaaagggttcatcccaagggaggaagctggagaatctcaggaaggctttttaacaagtttgcgccgccttcgagccactaagtgatgtagatggtgagagtggagatgatgacaagggaaagaacatctccggtgtttgtttcatggcgcgtggtgaatcggatacagagtatgaagataatgaggtaagtgcttttgaggaagctattaatattttgagtgcaaaaaataagaagtgtgagaagatgtatagaaaacaggaatttatcattgaatctcttaaatctgaaattgataggttaaaatctcttattcctaatgatgatgattgctcaaattgtgtggttttaatgaatgagatttcaaaaattaaagatgttaatgctgcacatgatttgaaaaatagatcttctcttgcttgtagttttgccttgcatacacgcactttggatgagttgtttttaactaaaaagttgttgcaaaaatatcaaattgcttttcatgctagtttgatgtttaacatgatttttgctaagaagttaaaacaacctcatgatgttttggattgctcaacatgtaatttgaataagttgaaattgaaagatgctttaggtcgtgtcgagttcatggaagatgttgtgaaaaacaatgaagtgctttcttgccctaaatgtcgtaaaagcaaaggtgtcatggtagattgtgaaaattgtgctaatttggaaaaagagttttcttgtttgaaaaattatttgctaagattttctgatggtaaaaagaacctcaacatgattttggatgaatcaaagattagcacacataaccatggtttaggttttaatccttatgctcataattctagacatcctcctgttgtgttaggtgttggtgctagaagtggtgagattttggttaaacctgatactaacaaaactgtgtttaaatctgctggtatcatgtttaccttgaatgcatcttcttcaaaatccaatgttgtgcatgcaaaatctcctgttgttgctggtattgctaaatcttctaatgctaccaatgtgtctaatcatcgtgaaaaatatacttgttctttttgtggaaaagatggacatattgttggtttttgtttcagattagctcacaaacagaaaaaggagagagagattgcttttgcaaaattaaagtggcaaaaatcgggttttccctcgaggaaacaggtcagatcgcagtgtgtcccgcggtcagaccggcgaccggtcagaccggtactgagcgttggtcagaccgggcaccggtcagaccggtggtacagaagcggtcagaccggcccccggtcagaccggccactatacctcggtcaaaccggcctcggaggaatttttctgaaaattctcaaattgattttgcacatggatatatgcctattggatctactggtcatgtgtctcagtactggattcctaaatttttattatcttctaaccccagtactgaggcttcgacttctgcttgtgtgtaggctttggtggcaaggaaggaaaacgtgtggatcgtggattccggttgttcgcggcacatgaccggtgataaaaattggttctcctcacttcagaaggcatcaaagactgaattgatcatctttggtgatgcctctacaagtgccattctcgctacaggtttggttaaggtaaatgaaaaatttgaattgaagaatgtagctttggttgagaacttaaagtacaatttgctttcggtttcacaaattgttgatgaaaattttgaggttcactttaagaaaactggaagtaaagttttcgattcttgtggtgattctgtgttgaatatttctcgctatggaagagtatttaaaactgattttgaaaatcctgtttcacctgtgataacatgtttggttgctaagtttgataaagatgtgatgttttggcatcgtagacttggacatgtttgttttgatcatctcactaggttaagtggtttggatcttgttcgtggtttgcctaaacttaagaaagatcttgatttggtttgtacaccggtcgtcatgtaagatgtttgcttcttcacatgctcctactgtttctgtgataatggatgcaccaggacaactattacatatggacactgttggtccagctagagtgcaatctgttggaggaaagtggtatgtgttggttattgttgacgatttttctagatactcttgggttttctttatggcaactaaggacgaagcttttcaatactttcgtggtttgtttcttcgattgaatcttgaatttcctggttctttgaaaagaattcgaagtgataatggtggtgagtttaaaaatgtttcttttgaacaatttcgcaccgaaaaaggtcttgaacacgaattttcttctccacgtgttcctcaacaaaacggtgttgttgaaaggaaaaaccgtgttttggttgagatggctagaacgatgttggatgaatataaaactcctaaaaaattttgggctgaggctattaacgttgcttgttatatttcaaaccgggttttcttgagatctaaacttggaaaaaattcttatgaacttcgatttggacatcaacccaaagtttcacatttgcgtgtttttggttgcaagtactttttcttgaaatctggaaatttggataagtttgaggcacgttctaccgatggattgtttcttggttaccccgcacatattcgtggctatcatgtacttattttggagactaacaaaatcattgagatttgcgaagttttttttgatgaggctagtccaggaactagacccgatattgcaggtacacagtcacaggttcagggggaggatggtcgtatttttgaagacgagagcgacgacaacgacgacgacgaggtcggctcggccggtcagaccgggcgtcaggccagtcagaccgccggcaaaactccggtcagaccgcctcaggaggagcggtcagaccggccagggacgtcgggttcaggtactgttgatgctgatcgagatggtcctccagagattactacttcgaccagtactgatacagaacgtggatcaacttcagaagtcgctgctcctttgcacattcaacgacaacatccgccggaacaaattattggtaatataggtgagcggactacaaggtctaaggtaacaactcatgatgtttgtgcaaattctgcatttgttgctttttttgaacccaaagatgtgtcacatgcattaactgatgaatcgtggattaacgccatgcatgaagaacgtgaaaattttgagagaaacaaagtttggactttagttgaaccaccttctagacataatattattggaaccaagtgtgttttcaaagataaacaaaatgaggatggtttaattgtgagaaataaatctagatttgttgctcaaggttttactcaggtggagggtttggattttgatgaaacttttgttcctgttgctagaattgaggcaattagacttttgttggcttttgctgcttcaaaaggttttaaattgtatcaaatggatgtgaaaagtgcttttctaaatggttttatacaggaggaagtttatgtcaaacaaccaccaggttttgaaaatcctgatttttccaaccatgttttcaaattgtctaaagctttgtatggcttgaaacaagctcctagagcatggtatgatagacttaagaactttttgcttgtgaaaggttttacaatgggaaaggttgacaaaacgctttttgttcttaagcatggtgataatcaactttttgttcagatttatgtggatgatattatctttggttgttcaactcacgctttggttgtagagtttgctgagactatgcgcagggaatttgagatgagcatgatgagtgagttatcgtactttttgggattgcaaattaagcaaacatctcaaggtacatttgtgcatcaaacgaagtatacgaaggatcttttgaggcggttcaagatggagaattgcaagccaatttcaacaccaattggttctacagctgtattggatcctgatgaagatggtgaagctgttgatcaaaaggaatatagaagtatgattggatctttgttgtatctaactgcttctaggccagacatacaatttgttgtgtgtttgtgtgcacgctttcaagcttctcctcgtgcttcacatcgtcaagcggtcaagcgaataatgaggtatttgaatcatacacttcaatttggaatttggtattctacttcttcttctatatgcttaagtggatattctgatgctgattttgggggttgtagaattgataggaaaaatactagtggaacatgtcatttcttggtacatcattgattgcatggtcttctaggaaacaatctagtgttgctcaatcaactgctgaatctgaatatgttgttgctgctagttgttgttcacagattctttggcttttatctactttgaaagattatggtcttacttttgagaaagtacctctcttttgtgataatacaagtgctattaactttgctaagaatcctgttcaacattcacacacaaagcacattgatattcgttttcactttttgagggatcatgttgagaaaggagatgttgaattgcagtttttggacacaaagttgtaacttgctgatattttcactaaacttttcgattctaatcgttttgcttttcttcgtggtgaattgggaataattcatccttttggcatggtttgagggggagtttgtacctcatggttttatcaagcaataatatgacaatgagaaaaattgagaaaatagagctttgtttatgcatatggtattttcttgtgcatgctaacaatattttgaaggtttatttgtctctagcatagcttgtatgtattctagtcttttcatgagatttagattttgcttttaagggcgatgatgcatggcacttaaattctatacttgaattaagtaaatatgcaatgttgatgctagcatatggtttgatttataaatgctctatatatatgctttattgaattgttattcctcaaatagctttaattgctcattgtgaaaaagagaataaaaaatataaaaaaaatgaataccgaatcctcggaaacagtcttgatgacaaggacgtattcgatgtgagcaaaataataggtgccgaatccctggaaacagtcttgatgacagggacgtacccggaataaaagagaaaaatataagcaaaaaggctcaagaaaagaaaaagttcaaaaattctctttgttgttttgtgctaaaggttatttgagaaagagtgataaatgcaataggtatatgtgtttagtgtttat

SEQ ID NO: 80860 - DNA, 1051 bp, Oryza sativa
cgagttattgcatggcagaacttttagtcccgtcaatttgaaaattgcatgccccaagtaggatccaacacaatcacggccagtgatcacaagaaagtacgaccgaactgcaagtttgagcactccaatcacaccaaaaactattctaactttaggatttgtagagggaccacgaggtggcaactcttccactagactcattgatccatttgtccgatcaactgacaggaacaaatcagcaagaccgtcaactggttcaaatacgtaacggtctgcaaactcccacagccttagtcttgtgtgtagctttggtgaagggcatgcttcagttgcaacactcatcgtgtgatgccctgatagaggaatacatgagtaaatgttaaatcatcagaatgataaatatgggccacagatataaccagtcaagacatgtgatgcccataatatactggaacaatagtaacagatgaatacctgaataatgttatcgtgctcttaaaataaccaataacagtacaagtgtcaggattttcctagtaaggataagcctattgtaatcatagaatacaaacacatgcacattaaactaacatccttaaaaaactaattgggatttgtgggccatggaaccaacatccttcagcatctagaactgttagatagccatggtccgatgatcatatcatatcgcatatagcaagacaaaaagagcatatgagacaagaagccaaacaagtatgacgaaaagggccagggaaggtaccctgccatgtatcctttttatcacaatagatagatagggaaatcaaaccggataactataaatgtcaaataaacaagaaagctattacataagaatgcacagataatataatgtgaaaagaaaatccataacctgattttaatactcatcacatgatcctgaccttgcatcataaagaatgtacacagttttctatcaatcatgccaacagtgcctaggactcacattttctttttttctacaaaatgctattccatgatttcatataattatgcactgacaagtcaa

SEQ ID NO: 80861 - DNA, 1095 bp, Oryza sativa
gtggtttgaagccgactcggttgagatggtcttgaagtggctttcagccgcgttcgggaatccaaacgggaccgaaagccggttctctcccgactggtctgattccgagtcgaggagagaaatcttgccgaagttgttggtgatgaagtcgaggctgccgaaccgaaacgtctgcccgggtgggaagacgaggtcgtcgatgccggagacggaacccattgcactgatcggcgagaagcttgacgctacccctacctggcgcgccaactgtcgaaactagatttcggcaataataaaagggggtggctatcaagctaggaaagtgtatgggtttggagacaaaggatttatacaggttctggccttcttataaaagaagtaataccctactcctgtccggggatgaatccgccgagtgtattattgattgtatgattcgggaaaaatcatcatctgcccctagaggcgcccggaccccccttatatatgggaaggagtccggattacaaaagataatctatattcctaacggaatatgaagatacaggtaaaatacagtcgtaaccgactaagtctctgggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcatagccttctcaaagataataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcatacgcggcgcctaaataggcatgctagccgactgctttttagccacaataaaagaaatccgagtggtttacactctaaaaagttcacgaatgaacacacttgacaggcatccgaatataaaaactctaaagattacccatca

SEQ ID NO: 80862 - DNA, 2661 bp, Oryza sativa
tactgctagatataacaattatacccctccacatgtttttttacaacaatacccctccgcgtttctactaccaccaccactaactaggatggtagcataaataaatctaaaccctttgatcaaatcgcgatcaacggctcaaattgctagagaacatcttagtgggactactaatattccttttaccttgatgctttcttattgggtctgacatattgcatgttgcactaggatatgcaaaaataaatttcttttttctccatgttatgccatgatatctgagtgaaaccttatgaaacttatgtggagctttgaggtactccataaatttttaccatgcctttaacaggaggtatgttagcgggtagctgatatagggtggaaaaattatgctaatatgtttaagcgattacacactttgtggatggactaatggcaggaacgaatgattttagagtgaaataatgattgcatatatgtaacttgtggaaagactattttccccagtgcatgcatatcattcaagagccaattgactttaatttgctcacctggtgagaaaactttataaacttggtctgagtaacttgaagaaaaaaaaagaattacttaggttcttaggaaaacatgatcaccaacataacaacctaatattcttcttaattttgttattttatttcttgtggtattcaatgtggaacaacacgacaattcatattggacgttctctcctgtataattcggcagattattgatcagcagtttgcttgcggtgtgcagagttcatcactcagggtccgatcgagagtgagggacgaggaataatccctctggcaccgaaaacatagcaggccattagcgcatgattaattaagtattagctaatttttttaaaaaaatagatcaatataaattttttaaacaacttttatacataaacattttacagaaaacacaccgtttaacagcttgggaagcatgccctcaacctgtctgcggcctcgaggagatgctggtggcagttgatacatcatacaatgcgtgagcacacgacgacgaatcgcagtgctagctgccggtgttgctacagctgcaagctgatcatccgctctgaacaattgcggagctagcaatgctgtgaagctcgggcgactagtagtgttttcgggtgaccgatgactgaattttatgcgcgtcaatggctaacagcaatggcgatggcagcggcagagctcaggtgactgccttacctacccgggagctatctctcgctggtggctctggatggcgatgatcgagtcactccacttactctctgatttaccatgctgctcctctcaagtactcaggaacatcctacatgtttccagctacctctcattctcagtgtcatcccctttatctaaatcaaattgatacatgggctgaacatgtaaaaaccaaacttgatctaataaaaaacttgtgaaactaaaaattattttaagaaataacaaagaaggtgaacaaggatatgcatacatgagtagttgatcactaagaagattgcatctcgccgcttcttccctgtattttctatgtttatttgtagtgataataatgcatgcatgcaaagatatatagatgttgttttactagtaagctaggagacaagtttaatctaaagtaaaattcactgttggctctaaatgttttccgcatcatccacaacgaatcttaaagtcgataggtcaaataatcacccctccactctagcaagtcgttgtccaagtctagtggtttcttgatatcaccagcaaccgccatccctattatacccagtgaatataatttcggttcgaaatttcgacaattttggaccccttggaagtcattatctcagccaaaattttcgcttttctctctcttttttaatttggttaaactttattcaaattcaataaaattgtgttgaaatttcaaaaatattcagttcaaaaggtgccgaaaatcacaaaattctgggaatttttcagtgctaccgaaacggccgaaattttaagtgaaatcaaaagtacttgaaaaccctgatttgtacctgctctaactaatggtttaacgtggctacattgagcaacaaacacaaagctatgaagcaactcctttctttattactcgatccattgttctatatatgtttggcagccatctagatttaatgaatccatgtgttgtccaagtgaagccaacacacacaatatgaagaagaggctcaactagtagctgccgtctcacgctgaggtaacatatattagtgtgaataataacggtgactcttcctctctggtgatcctatgttatggagctcttttgctgtccataaaaaaaaatctccagttttccctggtgcctctcgttcccatagtcacccatattgaacacaacaacatgtacatataatccatgtcctataaaaaataatatttagtttatttcgaagtcaataacttggacagcacaatactcaaactagtcatgtagctcatgatatgatgcatgtttgattctttaatgtcacccaatatatgaatgatgatgaccagttcatatagggaacacatgaggctacagttttcggaacagaagttatatggtttacatttagactgatgagtaatttgt

SEQ ID NO: 80863 - DNA, 943 bp, Oryza sativa
atttcaaattcgagttcaaaatttggcttgaaagtcttaaaatttgggtttgaaagttttgacatttcagacgaaaattttgaattttcagttgaaagttttcaaaaatttgagttgaaagcttcaaattttaggttgaaagcttcaatgttttgagttgaaattttcaaatttgagctgaatgtttaaaaaaaggggttgaaagttttcatatatgagtgcatatgttaatcacgttacctaattaaaaaaatagaactaataatgaagaattataacagtagtcacattgtagattgatttgcctcacatgccgtactgcctctttgcctcgattcctatactagcacatatgcacgtgcatgcgccggcgctgccggatgaaaagaagatagaagtatgcttgggccttgggccttgctaatgatggccgaaactgaaacactcgctagatatttatccagcgcgtctgcaccaattagcaatttcgctagaaaacagccacaatgctaacatgtactacctcagtgtcaaaataagtacagctataggtatttaggtccaacgtttgaccattcatcttatttgaaaaatttatgaaaaattttaaaaaatagtcacacatactccctccagtttcattttaattgacgttttgggcaatgacatggtctacaaaatatatctttaaccttatttttctattataatatatacaatcaataaatacatgtttatttttattatagtgttttgaaagataaatctatatatgttgatctagtttctttaaattaaatatttttaaagttattgttggtcaaagttgtaaaagtttgacctcaacctagtctaaaacatcaattattatagaaccggaggggagtaaggtactatttatgttttatctgtaggatcgaacaacaagaaactatctacatta

SEQ ID NO: 80864 - DNA, 10349 bp, Oryza sativa
ttggctaatgggaaatggaaatgatttccaacccaccaaaaggtatctttaaatcctaaccattcattctccctcttccatttaatcataacccttcattcatttcccaatcccaatcccaccccccatttcccattatccaaacacacccttatattatgggaacgaaaggagtagttatcaatcgttaagtttttcttcacatgttacaaagcacaaccattttgctagaaagaaaaagttagacaacgcaacttgagcctgatgtggttttgtgcattagattgcattcgagattcatgcaaagagagaagctagcgggacagttcatcttcctgcatcggatcacagccaagtcaccggcaactctattttttatagtgattttaacatattgtttctttacttaaatgagatgtatttcacatgaaatatggtgtttatatcaatagccagtaaaataatacattatttcttcatttaattttactataggcatttaaattttaaatacgcccgtatttggacatacatgtatgccggtgcgcgtatgcgcgagggcaaaaaggctgaagctttccactgatgcatactggtcaagatcatctcccataggagtcagcagaggtatggggaacaagtctctcacttcctttcgcaaagggtgcaccgtgcacaacagcagagggtgaaacaagtttcgattcaagggaacaacacaagtgtgtcctccctccgtcccaaaataaacatagtcatgagccaattccgtgtccaactttgattatttgtttttttagaaagctaaaaaaacataagtcacgcataaaatactattcatgttttataatctaataacaatagaaatactaattataaaaaaattaaataagacgaacgattaaagttggacacggaaatttaggttgtatttattttgggacggagagagtacaaaggaagctatactgcatgtctaacttcctttcgcaccagcaaaagttgtgtgttttgcaaagttggctgtgtagcctctcagcatgcaagttgtttcttttaatttgtgtcactataagtagtccatgcccccagcccagaactatttttgtactgtacataagtagtgtattttggtaagtttgtttcatatgtagtgaactttcatcgatgggattaagcctgtcgttttattttatctaaatcgtcgtctttataaattgttgtctctgaaacgttagatttatttaattaagtatttaactaatttgcctctcagaaaatctgacatattataacatgtgaataatacagataaagttagtcgacacaaccaaaccagccagtatattcgtttgaaaatcgatcgttagcacataattaattgagttttaattattttaaaattagaaaaaatggatttatctaatattttaaagcaacttatatataaaaaatctacgtctaataaaatcagaaacgaacgaaactaagggcctgtttgcattggttggtaactaaatttgctacatctaaccttaggcaagccacaattttagtagacagtgtttggttcttgccacaagtttattttttcctaactcttagccacctggtccacacaccggtggagaaaccctttttactcccggttggtaaccctccccggttttccaaccgggagtaagaatcgggactaaagaccgctatatttattcccggttcaaatacccaccaacttctagtcccggttgatacaccaatcgggactaaagatctaaattttttttaaccagaactaaaaatgatctttagtcttggtttttattgcgaccgggactactgtggaatttggttgatcgactaaagatgatttctccagtagtgacatgtcatacactctattttcttgccaaacattatccaagtttagtttgtcattttacaaaaagtgtggcaagattaagattagctaccttagtaaaaaaaaaatgacaatattagtccccaaccaaacaggtgactctaagattcacaatgtcaaccacctgctgctagctaggtatgcagacgatgagcccatgctctccccgtgcaggccgggtgcagcctcgttggactcctgcagatcatagatcgaggctgcctgcagcatgcgtatacgttggttagttcattttggccaatggtccatacagcgtgcctctccctcattgcttcgtcgcatgatcagctagctactgtccgttggtcgtcctagcctagctcgccatacatggacgacgatggtcggtcgacatctctaatcggagaggggcaatcgtactgtctatgagtactactcctgttttacacactgtatatacaatgtacgtttgaccataaatcttattcaacgattttgacgtaaatatgcaaaaatgtactcccacgttaaaagatgttttcactttagttaaagtcaaactgcttcaagtttgaccaaatttatagaaaaaacatagtaatactttcaatccaagataaatttattataaaaatacatttaattgttaatttaataaaactaatttggtaatgtgaatattactatatgtctataagcttagtcaaacttgaagcagtttgactttaaccaaagtcgaaacattttttaacttgaaacagagggagttcactaagccatgcgtgtttaaagtacttctgagatggtaaaacatctcacaataaaatgataaatggtactctccggttttatgttcgacttggctgattttttaaatatatttatcattcattttattaaaataaatacacaattaattatcatttgtatatattgttgttatctgttttattaataaaggtaatttgagcatgattttttgcttcttgttgttatatttgcgcaaagtttttaaatatgatgaatgggcaaacatatgtaattatgtacaacattaaagactaaaggagtaattatgtaatttattccgaatgagacgaatggttaagttgtatattcaaaagtcaaagacgttgagctgaatatatacgtgcataactgggtatccacaaggttatttgttaaaaaaatgcatgtgcaaaagagaggcagacatcgcaagtatgtatatatgtcttgtgccgtagttgtaggatggtaacgctgtcaaactctaacatttctgatgtcatcttcctttttcaggaaaaaaaaagcatgtgcacttaatttggagtggcatttagtaaggaaaaacttaatttataccggcagatttctaattaaagcaaacctctcacaatcatattactactaatatatggaaggaaatcaaggaagttcgattgaagacattaattaattattgcccgatgcatgcatgctcctgcatgcttacgtacgtgcatgcgtgcgtgacggtcacatgtaataacgggatcaaatcttaatttcttagttctaaaaaaaaatcttaatttctttgttgtatataatggctgatcagacgaattactagatgcatcgtaaagtttattaagatgtacacatgcctatccttaattatgaatggttaatttggaagtgcacctaggtatctagctccttaattcgattgatcgatcgattgtgtccatagctagctgcgcatgtgattgatgcaaaggaggaacggctggtccaatgctgcctgcctctgaactctctggtagccatggtgacaacatcaatcgactgatcagcaagcacaggcatactcctgcatacaccccctcctcctctcacatacactgatacacacacatacacgaaaaagagtagccgctagcctgcaatccccgaaaggtgcataccttttgccaaagaaccactactaccttttgcccaagaacaaacaagactagtattgctctagctagctgctcagatgaataaattaatatatactgtactactatgtaatatgtacctagctaggcgaatatatgtatagatatagcgtatataatacgttaatgttacactaataatacagttaatataggcaaaaattaactaaaaattcaaattcgttgatcccaggtagtataattatcttgaatacttgattttaatattttatggacatgcattttaatttcaggaatgacggaataccacctcgcccaccctccggtatatattgaaactatttcaccgaacaaacaaaaaatcaaattcggtcaaactttgtttacatttcaaataacttggtttcgagctaagcgagagcaggtgagagatggctaaagcgagcaggtgatggctttggcgtactagacgacaaaacacgaaggccagcagctaaacccttcttgcgccctcctcctcctcctcctcctcctcctcttcctctcccgcagcggcgtgcgaggcggcggcggcgggtgggtggaggccggcggccggcggcgcggaggtgctagaggcgatggggatcctagcatatctgttcctactggtggtcgccatcatcggtgtgttcgccgttctcgcgtccctgctcgaccccatccacggcttctacctgcgatcgatcaaggaagcactcgagtgggccgagttcatattcacttggacaagctcgctgtactttatactgcccatgtatgtagtactatatattatccttctctgatatatatcgatcgatccagatgcactgggatgggatggtttaaatatattcctgataaagctttggccttgcatgatgcactgggatggtttaaattcctgataaagttttggccttgcatgattgaatgttcaaaaccccaatccctagctagttgcatggctgatatgtatcttgtgttgttttcccctgcctcaagaacacgcgcgcgcgttgttggtttgttgttattattgctcctgtttgattgatttatagcgggttcaaactaggagtgcagagtagtacggttatatataatcagcgggcccatacggaaagaaaataggtagagaaatggggagggagaaatagatcattcttttttcgctcttagatcatttcgcaacataatatgatgctagcccgtgtaatacacacaccttgtttgaagtgagagtaacattaattatattgtgtttttatttgatatggacttctggactacattctttttcttacatgattgtttgattatatttttacacatgtcatgccatttttttcttgtgagacctctatccaaatctgatgtagtacgacttgttgtttactttccactgatttcttctctggattacctattttattcttcgtgtgtgtttagttcacgccaaaatttgaagtttagttcaaattggaacgatgtgatggaaaagttgtaagtttgtgtgtgtaggaaagttttgatgtgatggaaaagttggaagtctgaagaaaaagtttggaactaaactcggccttcattctttcattactaacttagtcatgcacgtgcaatacacgttttccacaaaatatatcagtgcattgaaattttgaaaattattatctgctaaaattaacctctttaacccaaatttataaaatatatacccctttgtaactggaaaaacaaaattaaccaacattatcggtacttggtattcacttaggacttcatcaacataaacttccatgtactgatcttaggcatattactagtatacgaaccacagccaattgaagtaaaatattcacatttgctggaccttgaaatgggagaagcacatagattatacatacttcaaatttttttgtgtggttgtatatgccatcctaacaaattcaggtttgaatcaattaaatagcatgatatctttgcttcttattgttgcatagtttgaatagattaaataacacaatatctttgttgagagacattctataactaaactaaaaaacaatctctgcttttttttccgtgctacaaataacgtgcaaaataaagccctatgaataaacaatgtgcaattattggagcggagaacagtgaggatggatggcctaggcggcgagtagggcaacagcgggcaacgaggaggatagttgtgtgggctggcggacggggttgcatggcgacgatctcttggtcgtcaagagagcgtgtcgagggagccaagggaacttggaggaggagggagcttggagggcgtgatgatggcagggtaaaacagtcttagggtctgtttggtagaattccaacgcctggatcctaactcctaactccaactccagtaggagctaactcctataggatctgagaatgatctaaaagtgtttggttagattgatcagttccaaaactcttaaaagagagaagggaggaaagatggacaatactgcccatggcttcttatatctgataatttcatgtttatttatatatgataattcatgtttgtgatagaatcacccacatgcatgcaaaatcactatttctcttccagatctgaaattgaaaaaaaaaaggaaaaatgcaaaaacaccggccgtgcgccgcccgctcgcgccagagagccgccgcccgcgcttcgcccactcgtgtcgaagggccgccgtctgctcgttccagaggttcacggcccgcacgccacccgcctgcgtgtcgtcagcccactcgcgccggaggtcccgttgtccgcccgtgtgcgccggagggccgccgccgtcgccctcgtgccgcctacccgcaccggatttgggagaggtgagggttacaggaaagagagagaggggtaaggaggtgggtttgaggtcgttcaatgacattttttgcgtaaataccttaaaaattaaagggtaatgtgtgttttggggtggagtggagagatggagcagcaaaaacccagctccacccccatagtacaattttgtggagcaactctgctagctccgctccaaaaaatgaaggatctagaccgtttgacacggcttcttctctaggtaagttggagttgggaggtagagctgtgccaaacaggtccttataatgtgtttgcgagggtccaggggataggatcggatcgagtgagttcacttgttggattgcatggcacatggtggagcttgaaatctggaccattggatgacatggttgaaaatgactaaggatagcatgtatacacttctcctgggtgaagctagcaaagagtatgaccggtgcttttcatattggaatagaaatagaaaaatacaaataaatagctggtttttaatgtttgacttattttgtatctcaatgttatatacttatatctaccattagttccttaaaattgtttggttaggcagttaaggcttgttacgctaccttttcaatctaccatactctgtttattgatggactaaactgctatttatatgtgcatcatcaattaggaactcttttaattgccatttttaaatttttatgtttaactatttgccatccatatgtcaattacatgtgggccctcgtatatctgacacgtgggtctagctagtggctaatagttaaatatctctagtatgatgtactctgtgatgcatgccccttttttttacttcttttgtatccattcatgtataattggtgaatttgtgaatacagggtcttcttctcgaatgccacaaattgggcttcaactttctatgattgctttaccccgctaacactgtggttagaggggatttactctggaatcgttctgctcctcttcgtgctctttattggaaatctggatgaaaactggggccgcataatgatagagttttctggggtggccatacagatggctggaatattttgctttgtgatgataaaggtgtcacgtgatgacaattacacgatgaaagaagctcaaaaacaggtatggataagggttcaagaattctgttatttcacacttataagaaacatgagattcattgaaaaaaaatctcctatgcagagtatcatggcccttgtcatcttcaagattttctcttttattatccttacgttcatcaaggctaagttggtgcccacagaagataacgtcgtgatcccaagagcatttgctgccataggttgtctgatccaatttgtgctaatgttgagttcgcctatcggccgttgggtaggtgatggctttctctcatttaaactctatatgtggttgttgaataagctttgttcttatttagtctttcttccttttcagttggacaacaattttaatgatgatgagcctaccacccgcaagatcaagttgtcggcagctctgatcaggctaatcacgctatcattcgactgctggcttttcactgtaagaggatactggagctcgccactgaagaagccattggcggtaagtgattcaaggttttaacccctctagattctgccaagaatggttcaagttattatttgttcaagtttaaaagttagggtgaaaaacaattagttttgtcgttgagggtgaaaatggacttccagcaattcaagggagataatggaatctactaaaagaatggataagtcctttttttactagttctattgttaccacttcaactttactcgatgtctatttgtcacctacacttataaaactagacaaacttcatcttaattatgattgtttctattgttagcttttgccctataaagaatcacactattatttttatgctatatatgttgctaacttgcatttttcccgcacatcatgtgcttaacatatctttactcctcacatcccttcactgtattatgcgatagaatgatgggagaaatgtgtggcatgtagagtcactgccatttttctaatgtttggggtgaaaattttacttggaacaaaattaagggtcatatataaatgtatttatcctagtatttctaatgtgtgcatgcaggaaatgacagcaaccaacttggtctttaccagcattgtggtggtctgtcgttacataggccccaacaagctcaggaacttttgtgttgatatttggaattggcttcgggctgtcccggaaaagcttcaaggcaagtggaatagcttcatacagtggaagaccgacaactggactccattcacgaatacagtgaaggtagcattacagagtttctgtactggctgttgcgctatgtttcaaactgggtggaatgcattgaagaacagggtgagtcaatgcattgaggacatgtggaatatactggctggtccgggtggaatgcattgaacatcaagatgagtcaatgggttgagctgtgttacttcagcagtaaagcagagtacaatatgcacgattttgttaatcgatctttacttatacaaagtttgttgatctttacttactagctgggttacttcagcagccggaggctgtgttcggacttttttttgttgagtgattagattttgttgaatgtattctcttccactatgacttccccggctgtattcatatagcgtttatgccaactgtatatagtcactaggtcagatatattaatatatagtgacacgtttgagtggggacgtatctaatgtaatttctgcttccattttcccgaactatagaaagcatgtttctacttactacttccaatattctgatattgttcttgtttccggcatcagaatgattctggtttgaaaaggtttaagaaatgcttggaacagttttctttcttttctcgatgctggtcgattacatgccaaaacagaaatgacgatccatgtccacaatgctcagaccgaataaatccacatgctttgatatgggaaatggtggcttttattacaagtcatgaaacccaaacagtcacaatagacacaattaactcattcagtttcaagtgcgaacaaggttacgcaaatagaacaagtcactgatccaaaagtagcagccggtcatcatttgagcttctcaaggagtttcggtgctacctgcagatgcaccccacagaaaatatgttattaacctagcttatatatgcagagcttctccataaatcatttgtttggttccagatatgcgatattgcacacacacatgcagatacttacacatttgtcaatgcatgaccaatagtcgaaatattgcccagtgcagtgtttatgcccagtatcatccttctccactctcttgacgcacttctgcaaaccatacaaacaccattaggatttaagcgttgaattcatcatagcgcatatcattgctaagtcgtcgcgatattatgagcctagggtgaaagggaacatcatgatggctggcaactcgaaatttagcatagaagattactacaacacaatatcaaagaaaattgaacatatatctggtttt

SEQ ID NO: 80865 - DNA, 1537 bp, Oryza sativa
catagcaaccaaatctaacaagtgaagagaactaccccactcccgagaattaacatagtcaaaccagctaacttttccatccacataactgcgattgactcccattccacagaaaaatccaccatgatgaatctcaattgtgaaatgcttcgaattagggcctacccatggcaaataaaacaaaacgatcaacaaccaactaaaaccctagctgcaaccctaactacccaaatagcatttcataaaaaaccctacttcccagctacaaaccatgcagatgagtgctacaccacaaggaagtgcggtacttacggtacacgggcgccgcctcagcttctcccctcaagctgaggtccatcgtcgcctgtgcgccgacgccagcgagggagccggagcacgccgctgcctatcgcccgccgacacttgcgcaggtggatgcgccgcccgaatcgcagccgccgccgatgatccccggagtcacctactcgccgcttcccctccctcctgagctgaggattggggaaaaataggagagaggcatcggatttgggattttagggtggtgtctaggctttactgtagcaataaggggtatattgcaattattccaagcctattggttgcggaggagggtatctgcaaaacgggtgcttgcgtggcatgccacgtcggcagtctgagccagaagtggggtttgaacctgccatgtatcattaaactaagatggtggatttgactctgcaatttacaagattgtggacctaagtaacacccgcgctcaagtttaaggaccggccatgtattttactcaaactaaaaatatacactggacggcacagttgatccatcatcctctaaaaaatatagcaaaaatgttggagaaacatatcgtcacgttcaaaactaaatttcaccacgaagaaattgagaattcactgcttcaagagttgaaaataggtagaaaactaccaagctttagtgacaaaggaaaataagcagtgaaatcttaagagcgtcagccataggtttactcagaattttacatttcagtgcaattgaagtacttttgaaagaaaatagaatagatcacatgttaacttgatcaaagtccaatttccatttattctgcattctgaactttttttatgttgtatatctacagtaatgaacattggaatcataaaaaaaaactgaaacaagctggaatgctgtaaaccagtaactgagccatcacagtagtatcaaatacacaagacctcaaacataagagagtacttcaatatttgatcacaaagttagttcaacaacctcatggttcccatcaaaacttaaacatgtttaataggacggtactccgaacaaaagctaaaccacataaatgtagtattatactaaaagatccatttctctggttcaggcggagttctcaggctcaacggcgaggcaaaatggccttcagcggtactgcaaggagaagacaagaaatttagagcattttcatttaaaaaaatttctagactatatgtaagttgattga

SEQ ID NO: 80866 - DNA, 30540 bp, Oryza sativa
  unsure (1)..(30540): unsure at all n locations
atggcgacatacatagctggcacattgaaagtctcaaacatgatctgggtcatcttctccctgttagccttggggttgagcggggcctcagtcagcaacacagggtgctcctcgggcgcgacacggagctcgttgtagaaggtgtgatgccagatcttctccatgtcatcccagttgctaacaataccatgctcgatcgggtacttcaaggtgaggatacctctcttggactgcgcctcatcaccaacataggcatccttctgccccataccaaccatcacaccggtgtgacgggggcgccccacgatactagggaaaacagccctgggcgcatcgtccccagcaaacccagcctgccagcaattcgcaagaaaagtaaagtatacgattaaatcacataaacatggggataactgctacaaagaaatactacgaatgagcaccacgaaccttgaccatgccagttccattgtcacacacaaggggctggatgtcctcgccgtcagccatttcctcctactggttctgaattcctgacgcaaaaacagaacaacaggcatgcgccgcaacacgtcacgaaatggccattttccaacagaaactagacgcaaaccctccaggaaatcaaaatctcaaaagatcaactgctaatatttggcacatcaaaacttgcagcgaacagaaaacaaaacagaatatgcaaaactacatatcgatagtccgacacaccgagatctagaacttgtagagcaaaaagagtacgcgataatcaaccgcgcacaaagaatcaagcactaaaccgtgatgcaaggcaaactcaggtggcggatctagacgtggagcatgtgattcagttccaccccccacaaacattttttgcgcgcggggaaaaaaacacaaacaaacaaactgctaccagcatcaaggtttaataaggcgaatgaagcgaaaagtatccagatctagaacagtgaacagaagctacgagtacgtgcgtgcgtgcgtggggagggagagatgaggaagaggacacgcagatggatgctcaccggggatgcggccggaggagggaggacggtggcggcggcgcggcgggacggggagatcggcggcggaggcggtggcggcggtgaactccgagtcgcgaggaggcgagagtggagtcgacgcggagtcgagggggggagggggaggggtagataagagaagagaggggggttcctcgactagggccacacaatcattttttggacacaattaagcgcgctctgatttttcttttttcacttcttgggtacggttacgctctgaatctgagaactgagaagttggcgcctgtctgtcccaaaacaaaaataggaccctctatggctctatgggtttgtctatactgaatcccgcttccaaaatttaaagtttaaggtttgctttcaggttctttttcatctaagtttatcttttacattcaattttaaatcgctaagaatacatacataaaaaatttacctataaattattttttctctaatacgttgtacggcatttggcaaaaaaaagaaaaaaaaaaggaggagcctacgagttctcctaacacgatctctcatcaacttcggttatgtcgagctgaaaaacaaactagatggtagtatttcttttcacagtccagcatggattgaaataggagcacctatgaaaattttcatacaagcatgatgaagaagacgtcatctttatccacatatttggtcaatgaccattttcacgagcgtaggcaggtagtagagtgctcgtcaagggtgctagtgcatacctcaaggtgattataaccggttcatcacctataatatctcgacatggtagagcatgtaacttatttgctatacaagtaaaccacttaaaatgtactaatataacttagttttataatgcaaacaaaaatttattctttacaagaacacaatttaaaattaaaaatgtgtctctatattcttcctttgtgccttattttacttgttttttctcactcctcttccataattatattgttagcctagttgacagctaggtcgtatgccagtgttttgtaatatatatgatcggttctttttacatgagttagtagtaatattgtacttgtacatatagtctacatgcatccatccatatgcttttttaaaaataatctgagagatttttttaaatataatccagtatgatttgaggtaacgatatatgtgtaatttacacctttttatatttaagaaaagaaaaaccatgttaggcctcgtttggatcacattaattttcttcaatttcgtgcatgaattgattttcttcataatgctgataaatttgtttccaaacaaatcttggtaatcaatgctttttcaaaaggatatattatccttccatttgaacatttcttcatagaaaaagaaaaccatggtgtccgggctcttaactaattatcgcgttaacggtgcacatacattaacacacacgggcaatacggattaaaggtgcgattagtgcgctaatcaagtgggatcagcacaattaacctaagctaggcatggcagcaacacagccaggaacagctgttgcctgcgctgtcgtctgcctgactgatgatatgatccgatgggatcttgattttggggaaggatggaagaatttcaggctattttagtacacccccatgtgtgcctgaaaagctgcttgctgttcttgcgctgtttgatcaactcgctttattaattttgttcctcccccccagctgtgttgatcatgaccacatgtgggcaacccctggaaagaaaagcaagtaaagcttaattgggttggaatcataatcagttcatcaatcagagaactcaatgtattgtagttttgcttgctagatcatggcgacagagaaaaacattccatagtgaaattctaaaattttgggtgttttttttctaataatacgtgctaagtgttacgtaaaaagagattggtcatctggcaaacctatggctgcggctgctgcagtccactccttgcctcactgttggtgctggctgcactgccgtagtctcaagcaactaaacaactctaaacatttcacaaaacctttgcatctatagaaattcttattatttcgggttgtcttcaccaacaccgccttgaacttatgtgtgtttaataatataaaattaaccgtaaagttttttcttttattgtctaatttctagacaatattcaaccaaatgttagaagacatgcaatttgatgaaaaaggatgggtttctgtgtgatattatggctaaaatatgaggccccggttattccgcaatcgattttgctatacatcactcgggtgattctttacctgatatttgacgttttttctggccgctactatctccagggttggggtgggggcccatacggccaggataaagcattgcatgcagcaactccagtgggatcattagacgtgcgatttttttttctctcatttgttgttttttcgcgctgctctctatccttctctctcatttgaaactaaaataaaaataaaatacaaaattacagtcctatataactaaaattacatttgtaaattcagttgatacgatatgtaagtgcgctgtaattttgataacaatgatgtgtcagtaaatatgtatttgttattttctttaaaatataaaattacagtcctatataactaaaattacatttgtaaattcagttgatatgagatgtaagtgcactgtaattttgataaaaatattgcgtaagtatatatatatatatatgtgtgtgtgtgtgtatatatatatatataaaattttcttttgtagtccgttggatgtaaatctaagggtagaaaaatctggatgatttcttgttaaaaatcacccgacaaatggatagacagtcccccaagtagacgtctacttattcattacatgtctcatccatagagctatgaaaaaaatttaattagaagttgacaagatatattaatttataacataatatatatatatatatatatatatatatatatatatatatatatatatatatataaacatgtaatttcaaattttgcttgtacaaattataacaaaagtaacattttttttaattcctctatgatttcggctagacgtgcattctgcatatagtccctcaccacagcacgagtagtcgtctcgtgtgtatgatgtatctgggtgtgccttcattgtggcacaacaaaagtaacaattttaatttacctgtcaatattcgtatactaattactccctccgtttcaggttataaaatgttttgattttgatcaaagttaaactgttttaagtttgatcaagtttatagaaaaaatagtaatattataaatttattataaaattatatttaattattaatttaataaaactaattttggtaatgtaaatattactatatttgtttataaacttagtcaaatttgaagcagttcaactttgaccaaagtcaaaacattttataacgtggaacggagggagtataacttatggacaatgaatttgaacttgcatgcttatatattgatatattttatcattgtttttaatttttttttattgatatgcaatagacaagtagatgtccatctagttgattagaagagtttgcttgataaggagtaactatatgatattcaatcaggggcggagctagaacaaaataaaggggttccactcgcttgttttagtctggtttgaatcaaatttagcttgatacgggtgcctaagtttaaactaacggggtatatatatagtgaaaatagataaattgtagctaaatttttttttgaatcaggttactgggcacccccctagctatacatagctccgccctgtattcgatagttgttttttatgaaaactactccctccatctacttttaatagtcatatttcaccttgacacacagaccaagaataagtaattctacttatcatccatttaaacatgctactagttattcctcgtaaacaagcgattcattaatatttacatttctcaatacccatgtaaccaatcatgtgtggtagaatggagagtcacgcattaaattcgagaaagtcattaagatgatgggtcgttggattgaaatatgactatcaaaaataaaattttcagatttggaaatatgactatcaaaagtagatggagggagtattatataaaaaaaatatctatagtataattagtttcatgctggacttgcaaacgtcgtgagcctccaactgaggttgggagtgctaattttttttttctctcttcgcatgattggcatgaatctctaagcaatttaacggtcacaaatccaattctccacatgtgtgctactgagtattttttgggagtagctatatttatggcgccatatttttcacgaaaaaatagtcggcatgtatttacattgtaacttcctaaattacatatgtaattttagtgtatttacaatataagtctcaaaattacatatgtaagtcttaaaattacatatgtaaatcctaaatttacgtactaattacatatgtaaatggtatgtaagtagggtgtaactactatataaatcagtataaatgtaattattaattttacgacggaggtgaagtgctaatgaggttggagcttgattaggtgcagttggttcattcgcataagctgtacgatgggtgcaggtgcttgaaacgaatctcatcggcggatcttacggttaaaacatccgactgtaaattgccctaaaatatgtcgacacaaatttagcaaaaccttatttttttttctctgcataaatctcaatacaatttaacaaaacttagatgtgtacgtagagaaattacaatgcaactatgatataattgcaatgtatcgaagatgtaattacaatataactatatatatatattataatttttttctggaactacattattaattataatgtaattagtctaatcaccttgtagtaccatattttaatagcacattctctgaaatatagtaaactctcgcagaacacatgcatgtaaaatccaaaatatggttgtcacgataaaacaagaaacccagcgtcctagcccatgatatttttttttgacacgaacccatgatatattgacacacattgaactgttttgtcttgaaaaaactgtcgccacaaatcagcaaatcccttgtttttttactactattccgttttggtttgagttacgtgtcgccgaacgaacttttttcgtttttagattttttttaatatttacagaaataatctatcggcgaacaaaattgcaaaaatagaccctgccgcccaccattggggcggcaagctggcgtggcagacggtgggtcgaccgcgccgtctgccgccgtcggccaaaattacgattaggcccttgccgcctatacagagggcggcaagggacccagatgtaaaaagtacggccaaaagatttttctatgcaatgttaataataaataaagaagtatttgttggtaaaacttgttaatattgttataaaaatgtattgaagttggttgttgcgcaatttcatatgttaagtgaggtattattttgtaccttattcgacgtattagtactcggataattaatataggcctatcgcagtctcggtcgtagaaacattatatggacttaaacaaggagaattatgtaacatgaagaaatagtagtacaatttgaacatgatacaactatttccattgcggttacatagatgatattagatttgaactaggagggaggtagtgcaatagttgaacacaacgacgatatagtaatgggacaaggaagcatgacagcagaaatttcaatatgccaagttgtccgataatagctaacccctacgtgaggatccctctcctctctcaaaccgcgctttagtaaccctgtattgctctggtagttcaagctgcacaacacggctaggtagagttagaacccttctggtgtctatccattctctgtattgacatctcattggtggttcctaggaggaaataatagatgtaaagcgagctaagttagtaaatgttgtgagaaaataaggattcatgtaatcaaaatattcttaccatgaaatcgtcgtccagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgactttcttgtaaacaagtggttaggtcgaggacgggattttctgtatcgacccactcgatgtatgcgcaagccgtagtgcgggtctgccgaatagagtagtgttacgaagaataaagcgattgcctatacggaataaatgagcatatgcagataataaaataccccacggtcatagttagggcacctaaaaaagcgccttcctcgaatatcaggattcctcgaagccattagttggcatcgatcaccgcataggcagagaggacgctggcaccaaggtggtagtaggtatacacaaggatcgctgcgccagtttggatcctcaacaccccggcgtctaaccattgacgaaagccggtaggatttgtaatgaagaagtggggaagagagtactgaatgtgattgagttctgaaagattgtgaggcctcactcgttaaggcgacttatataggcgcaattcatcgagtgatatccttgacatgtgaacgtggtggggcatggtgggtacgcctgattggcgccgaaagttgcatgcttgatcggcgccgaaagttacattggtcgtatgcggcaaatggcgggcaaatactcgtatcgcacgcgaataaaggaggctgcatcggtgcggcagaaagtagtcgtgcatgcgccgaaaggtatcgtgcatgcgccgaaagatatcgtgcacatataacaacaacgtagtcattacacaagcatacaatactgaaaagtgaagcaagtaaacaaagagaagactgctctactgcccctgccccgcgccgcgaccacgcttggtcctccgggcctgtgctcgcacgtggtcctgggagtaggtgaaacgatccggtggcacagcacgggtagcacgagtgtctggcggaggagtggcctgcgcctggtcctgcgtctgcaccggcggtgcgcctcccagctgtgaggggccgatgacgtcctctgccgagcctgaagcgaagtcgaagtcagtgatgtcgaagagcacggtggaagacagcaagcagtccgacgaggtcccagcatggtccagtggtggaccctgactcgacgtgccggctgcctgtgacgaagtcccggtgtactgctggaactgcgctgagtgcgaggtcgacgcagctgcctgagacgctgaccctgcagcctgggagaagtgggcggcctgcgtcatagcgaactgggcgaaacctacacatcgacaacgggaccttgtaagctaggacataaaatgcatgtaaattgattgtcgaagtaatgttgtttttttaagtacttgtggggggcacaccagaaggcctagccgaggaaggcggggtgctgaacggtgcacgaaaccctgaatcaatcggcaagtgaaacggctcacatatatgtgcgagacatgtacagaaaaatccttaaaaatacttacctctgtgcggagggggagtcggcctaggaacgtgcgcagctggacggggaccagtcggtacgggtggccgctgtacagctgtgtctgcccgagcaacgtcgtctgcacgacaggtgagcactcggagaatcgactccaccatccgcgtgtacgtcgtccggtgttcctctacgggtaccggaatccccgcgtctaaacgttggctcgtcgttgaaccgtcaacgacgacccggttgatgtcgtccacctgcatggttattttgttcatacatattcgtaaaatttgacgatgagaaagacatgaaaacataaaggaatggtgcgatgcatgggtactcacacaacgagcgaagtcctggtcgcggtgcctggcgtagaggtctctagtgctcgcaatgtggggctgttgctccaagggagcgaaggtgaccctagtacgggtgcgtggctggtaccagcgtaggtaggcctagtacgcctcctcagtgtgtggctctccctcgtggtccacgacctccttggttgcgagcaaccagttctcaacaaaagtcgccaacttggcgggccagtcgccagctgactgctgacccttgcgcgagtgcctgcgaattaatgtactagtgcgaaacgtgccgtcagatcgtcctgccagtccacagccgtggtcactggcccaacagtgtctcccgcgagcggtagccccaacaagtacgatacgtcctgtagggtaggggctacctcaccgcatagcaagtgaaaagtgtgcgtctctggcctccatcggtcaaccaaagctgctaggagggacttgtccacagtccatcgtctggccgggtccacgtggccggcggcagcctccaccagccgacacatcggtaggaggccggcctcacgcagcctgcaataagaaattaatatgtcattataaaaaatattacagcgcaactaatttatagtaatacactgttcgtacctctcgacaaaggagtcgtgaaccgtgagtagctcaccgcacgtccgtgcccggaacgtcccaagctgagccccctgcaccgcagtaaggtgagaccggtgtcgctgatctatcgccgggtccaacagctgaggtgtatcctgacgtgccatctctgaaaaatatagtgtttcgtgttagaacaattcaaaaagtagtaatgtaaaacaaaagatgactcgcaaaattatgaaatagtaataaaatcatgagaataattatgtacaacaacagtacaggctatttaaataaagcaaacgttactaatggtacataacgatgacatgcaatttaacatatatgtagagttcgataatataacataacataacataacataacattacgtgtcgaagtccgacatacatcagcatacctaaagacactaggtgccttagtctgacgttacatcacgagacctaaagaaatgacatgccgaagtctgacattacacgacgaaacataaacacatcgataagttcgaaataaattacaagcaaacccacatgccaacatagaacataagaactacaccacgtagccagacgtggcacgacgacacctaggacgtggtcgagtggaggtagtgccttcacccgtagggcgagctccatctgctgctcatcctgatagtcctgcctccgccgcacttggtttctccttgtctttaggacaatgcttgtaggtgtgcccacgttcatcgcatttgctgcaatgcttcaccctgccagcctccgactcgtccatatcgttgcagatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactaaagtactgtgacacatatactgcatctggtatgccacactccgctgcggcagcaatgacatgggtgcatggcctgtggagcagcttcggctttgaacaagagcaatgacatgtgccgtcggctttcagaacacactcctgcttcactctcttgcggtagatacccctgcctgccttatcttgacataatatctcaaacctgtgttgttgggtaccttgcactagagctcgatgtttcatggcctttttacgcaactcctctagctttttctgcatgaaagttccaaacaaaatgctgttgttcggcatagagggaagaactgcctggaaccgatccctaagatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaaagttggactatccgttgggagacgtccaagagattgaggagggtcatcaacggcggtagatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacacatgcaccacctactttgtacatcgtcccaaacaccagggtatcctggttccatgctcccaaactgcaactcttctatcactcgcagaatgccagcgtgcctatcatgtatcaggcacacatttggcctcataccaacaacttttgttttaaccaaatttcaggaaccagtaccagctgtcggtattctcactctcaacaaaagcaaatgccaagggcaatacctgattgttcccatctacccctattgctgtcaatatctggccccgatactttcctgtcaagaatgtcccatcaatgcagagaactggacgacagttcacgaatgccatcttgcatgcatgtagagctaagaacgccctttgcagcacactcttgccaggatgttcaattgatgggaatttcttcacttcgtaagagctcccagggtttcttccctcgataacaccaagcaggcgtggcaaattgtcatacgaggcttcgtatgttccaaatctcatctctattattttatgtttggccctccaggccttggcatagctaatagtatacttgtatgtctcctcgatgtgtcggattattgaccttggttcatatgtgagattatcgatgacatgcgcatacatctcagatgcaacaaatgcacatgtaatgttcctgtggtatttctgaacaccaggtaaaaaacatgtatgcttggtaacgactgacactgtccaataatccttccatttccccttatacgcgtgcactctccagggacaaccatctttttccttaacacactgaacttcatattgcgaccgattggacttggcaaccgaaaactctctatgaagtgacactgcaaaatgttttaccgcctccttcatatcttctgctctactataaatcgctccctgaataacctcattttctttgtactcccatctcacactatcctctttagagacgatcagcccagaaaaatcctgactagcccattctgctggattaatatccgtctcctcatctgacgaatcaccttcctctacacgctcgttatcagaatcctccctctccatttcatccacaatggctgcgacagtcttcccctcgtcggccactccacctggttgaatgcccacaggagctactacgcccctatcctctcctgcgttgacctcctccacagaagtctcatttacttcagcacttggtccctcgccatcatccatgttcatctgcacacctggatccttcgggtgcacaaacggaaccaaagctagaggccacccacgttgcattgcattttccacataccatctccacacttgagagttttgaactggaattagttcccaataaaaaccctcagttgcccgacttactacaacattgattgttatgtcacttgtctgtggatcaactctcaagcccctcattaaccatccttttatagaaggtacactcctctcagccggtctctcaatttccctttctgatacaataaaatctgacagatctaccccagttggcccgtaacggacgtttcctggtccatggtaaacttggaatattggtttgttcgacatatctgtcaacgaattaactagatcatattactctttcatgcaataaacatctacaacgtaatatcttcttgtgtaagccaatgcaatggtaaagtattgattccaaactagcagatctacgtagttaccgatatctacaatacgcacttctaaattagtacaactaaaaccctaaaaatataatgcatttattcaaacaaatttttaaaaaatacacactatttaactcaatagtcacatataggaactatgaatattacctgaaatcggcatctgaatccggcagggcttcaccccttcttctcttctcctcccctctcttcttttttttttcactggatttgagaggggtgaggaatgagggctgggggctgggcggcaggccttttataggcagcgaggcctgccgcccggccagagggcggcaaggggcctcctgcaaaatggacggccccctgcggctcttttgcattctgcacccttgccgccccaccagagggcggcaagggctttcatgcaaaaaaaaaaccaccctccgtgaccgcccgttcctcccccgtttgccacgtcagcttgccgcccaccattggggcggcagggtctatttttgcaattttgttcgccgatagattatttctgtaaatattaaaaaaaatctaaaaacgaaaaaaattcgtcgccgaacccgagttgggccagaaggatgtgggcttgtccgactgcgaaaagaaaccatcatcatttatccgagccaataaatcttactacttcgctacctaagaggaatcgacaaatcgacacagccaaagccgtcgtcgtcctgcttcctcctcccccgcagtagtcgccgtcgccgccgcgcaatccccaatcccttggtgttcttccccgcctctcgccacccaaaaccctaacccccctctctcactccacccgtgctgtgcacatggaaatccccaatcagatcagcggcggcggcggcggcggatcggttgttatagaaatcccggccgccacggagatcgccggagtggataccgcgccggcaaaggtatgtgacgatgatccccgtgctcaacccctccgcgaccgcgagtgggtgtcgcagctgcccccggaccaccccctacgctacacctgcggccttccgaacggggtcttcctctccatgtccttcgtcaccatcatctacgccgtgattgctccatggatgctgtggcgcgttgctaccgatcatgtgtccctcatgtggacatcgtcgatcctcgcgtgttcctacggcgcactgtggactatagccttgtccgaacggctagcaggtgccttcttggctatcatcttccgcgtctcctatgttgccttggtggccttcgcgtccacgcacctgattggtaccgccaatgggatctcgatcgtgtatctcgacacgttctacgttgctgggatgctcgggtacgccgtcgcggagtatcgtctccgtcgtggtaccgagcaatgccctagcgccatcttagccgccaaacctcctccattggaggaccaagagcgaggcgacgaggaggccgggctctactacatgggcttcttgtttggttcggtatccctctgtttggtggggaggatggcgtggctgcttctctacccctgcggcggcaagtgtctcatctcttacgtcatcgaggagctctcgtttgaggcatcaatgctgatctacatatgggttatctttgtttcccttactcagttggaaggggctctggtctgttacaacactctgttctgcaagatgccaatttgttttggtgcatggttcgttcttggcgtgcttcttggcgtacctgtgagtggtgctattgagatgctaatcttttggattggcactatggctctggctggattctttggatactgtctcgcggttcacgcatattgcaaaaggtaccatctctgttcctggcaagattattttacttttacgtttaattagctgatcagatttatgcagtcaaatataaaactagttgtgaatcatgttcttttttttctatggacaattacatgcaaactatgttttcaacgcttttcaatgtgagctgatgagatttagacaatttgaatatgctgcatgtaccattgcatgtctaacactagacttgttcttggtgggattgtgaggagccaaaatgatatcaatgtttatatcctagactgttctttatactctctccatctacttttgatagccatatttcatcttgatacacagaccaaggataagtaattctacttatcatcaatttaaacatgctactagccattcctcgtaaacaagcgattcattaatatttacatttcttaatgtccatgtagccaatcatgtgtggaagaatgaatagtcacgcattaaattcgagaaaatcattaagatgatagattgttggattgaaatatacctatcaaaaataaaattttcagatttggaaatatgactatcaaaagtagatggagggagtaattcagaacactagacccattcttaatgttgaactgaatatcagtttttgagcaaattgttctgttttttttacgaaacttttaataattagactattgcaaaactgtgcatgattatttatgacattgttggtgtctcttgtggtttttttctgaattttgaacatcatgattcacgaatgccccttttttaataagctgtaagtttgaaaacatatatatgttttagttttcttggatatgttgctatagtaatcttctatgctgaacttaattgttagcgatcatgttgtttctgttcacctaggtaggttgatactattctaaagattttaccatgcatatattatgtgttcaacatttcagtgaatcttgcgtatattgcttaagacattgaaattttgttgtcgacgattgaataggaatcagaagacaccagcttagagatttgcgggagctttgatgaccgttttgagaagccaggctttactctttgttgctcttagagaccaaagagcgattttaaagtatgatcaagatctcattctctaggtgtttggttgagtgctcttagaggcagagtaacgccaatgcctattgtgtgtagtattaacttacattgtatggtaaagtttattgtaaatgttgctgattgtgcataattggaaggtggtgactggatgaagaaatacactgtgttaggttcaggacgaaaaaggttaaggatatgcagaagtagcatatctgatgcaggcgtatatatatattgcaatatccgtcttttgcatttgttgtgttcgatcttataactgctttgacacggcgagaagcacgcaaacacgtttcgacttggctaggctcctagtagttagctagcacgttttgcccggtcagtgttaatttgccgcttggtttgcgtgagtagttaagcatcctggtaagagcaggtacaataatgggcggtagtagatccacgtaggcgcgcgtaattggccgtacatcccacgctattcagagcaaagagatgcctaataaacacatcccctaaagctatattttgggaattaagtctaaatcacaaattgagatcctaatatttcctcacgcccaataccagcccaaaggtgagactcttcaggagctgtccgtgctcctaatcgctgcatacgcaggagaaatcctagaaaatttggcaactctgtacatgtattctgaatgtgggctatagcgtgctgttatgcagagaaagaattgttttgttcatgaaatcagctgtcagttttagtctaattgataatttacttccaacaatcccctatggaaatattgatattttgcttggtagaaaatttgagtgaccaattcctctcaaaggggctgccccgagtagtctctatgcaggatttcttgatttgcttcttggacatcgcatcatatttaagcatgttttccttttttatctatactaatataaaaaggaggagttgtccccctctaatcctataggtgaaatcatccggattaatccgtaccgtccatccgcgcgcaagaggtctccaccgcacgattgagtactgccgcgaagactactctccattcacgcgcggagacttcgctcctcctcctcggcgtcctcactcgctcctctgtactgccgccgcgccgctgcatcctcgccgaagtcgtcttcttctccgtccgccgccggagccgaggtccccttccgccgctgccggatcctaccatccgtcgcggccggcgctcctcctcctcgctcgctcgctcgctccggattactgccgacgcgccgccgcatcctcgccggagccgaggtccccttctgccgccgccggatcctaccatccgctgcggccagcgccgagggcggccccttccgccgccgccgccgacgcagtcagtgcctccctctaccgccgcctaggcccccgcctccgtgccgtccgggagcaggagtttcggcagggtcgtgtggtcgccgtcgtgccgccacagatcgagactcgctgtcgccccgccgcaaatgcctctggatctcgcctcccaccacagccacgtgatcttctctcccaccggccttccactagctgcctgcacctcctcagtcgggtagccgccaccgacccttgcccttcgctgccccgtcatcacggtcgtccaagccgcgtgccgccatcgccagccatccttcttacactcacagaatgtagcgtatcttagcagatgccaatgtgaatgcagtgacatatgtgggcttcagtaattaggaggaaccaaatagcaaagaaggctcctaagctcctggtgcatattttcagttatttcattttctggatctagcttgattgattgacttgaacattccatttttccaggtgacatatatgaggttatgctcctataggttgatttcatatttttttcccctgtgaacgcaactgacctctcggtcaatagttcttccttactgtgattcatgtgcttcaagttaatagtctggttctttcaaaatgagcagatcagtgcttcttgaggtattctactaataacctttgcctttggttttactcacactctgtgagtgtgtaaaagtagctttccactggacttccttgatttccatggatatgcagttagacataggtgtgtgacgcattaacgtgtctttctgcaggttggcacttgataattttgtattgtaatatataaataactcagttgcgcaggtgattaatggttgacagaaaattgccttcaatttagttccgtcaataagatactgtgatctaactcaattctcttccatgcctgacagcattgattcttgctgtaaatttgtatttctctacaaatcaacttttattgctgaaaaaatattcacttcaaatacatagatgtgctttaatgactatttatgatgaaattcattcaaagctttggtttgccatcgtttggccaccagtttttaattccgattgctacagaggaattcgctgttagtttttatttgctatgcttgtttctaatttaccttgcagttgcaattacggagccctcaccaagaacggcaacaacagcaggcaaagctcaacagatttgggtttggcgctgcaagctggaagaagtaggcgcatcaacagcataatcctttcagttttgggatacaagatgcgagtgctcagtcacgaaatgctcttggccaatcaaaggttcgtcatctctaatcacaaaacaacttttgattgcacaacattttcctatataggggtatttttgtgtatatgactaacaaattgttgtattagcttttccaaatatgtgaggtaaggaacagatggacatggaagaattggaggtaaccaatattgttacgcatatattttcctatctgaatctgttgtagagaatggcagatttccttctcacaggcataattgcagacggtcaatactttgaaagggtagcttcggttagaggtttgtagtacctttgctagcatttatctactcatcttggagatattagttaattgtgaatcgatgagcagtggtcaaaaagaagaaagagcatgaattccataactaaatcttgtgggctattttgtcaatccataactaaacctcagtaaaacttttagtacccaacctgtagatcataactgaatattcacctaatattgtggcctacaatttcatttcccaattcgatgctctagaagtttagaactataacatgcataatttcatttttcttgcactgcataattttgtaattacagcatgtattggacaaacctgcatcttttgcttgtatataaagattatgttgtagaaagcagtggaaatgatttttgatgtttcggttcagtatgcagtggataacgctggtgaaagctccaaaccaaattcgtccgcacgaacaggtaatgatacatttacatttattcagctgatgcattcacgtttccagttcactaattatcaatatgtcaactagaccatcctaatatttatttaattgtttctatacatttctgaatagttgtgccaaccctgactaatctgataccacatattgatgggcctgtactgccaacttttttcatgccttgtgatgtgctgtgcttaaaactcctacactgctcctgaccattgaatcaggcatgtgttttgaatgatgactacttcatgtaagcctatggaaaaaaaaacatttcagtggacggttatattactcaatgtgattactcaatgtgattaaggatagcaccccaaggtgatttagaactggtatttttctgcaggaaatgaacatatgcagtctgtaatgatacctatgtgtttccccgtttcagaaaatgacaatgtatcttgcatccagcatttgtttcttcagaaaatgtacaatgcctataccattcagtgtcacaaaatgtttcttcagaccacacaaagtatgggattgccacgattaaatcttctatccctataagctacaattgatgtacaggtaagatacatcaacctgggatttgttaggtgaattatgtccttgcttagtaataaatggtcttcctgaaattatttttatggacaccattatttgcactattctctatttccatttccgcactgttttacactaagttttctaccacatttatctcttgagtttcataaagttgctgaagtgattaaaatttggttgtattgtacatggagtctaatagttacatatattcttgacattctcaagaatttgttcggtcatcagcagcatatatagtacaagactttgagtttgctagaggcagcaataggataatgatttttgtaaaaagtataggacactaagtttgacaaggatgaaacccataaggattgtagctgaatttttttgtgttgtctatgaaatactactactatgtaatgtggtatgatcaaatggttaccagatttaatccttttacattatattatctacagatttattttgccaggcaagatacttttttttttcaaatgctggaagttactctcttagcaaaatataaagagattaagtctgttatatatatatatatatatatatacttttttttttcaaatgctggaagttactctcttagcaaaatataaagagattaagtctgttatatatatatatatatatatatatatatatatatatatatatatatatatatatatattagcacaaaggtgctttttagtatgtagatctagctaggttctttcagtatgtagttctagatggtgttatgacacaatctgtgccgggttatcctctattaaacatagtttttcatgagttacatttttttttaatgggaaccacaaataaataatgtttgaatgtgctttcttttaaagagaagaatgtgtgttgcagataattgaatcaacatatacttcttatgaagaagaatcactattggtgcacatttcacatggtttggtaactaatttgattgcggctatccatgggcgtgaagcagcatatacagttgcagttctaggagaaccatgtcatcatgtaaaaaacatggcaagacgcaggaatgttggctggatcaatttttcattgatccattatttggtcttgatatgggtaactttcagtcctattttgcatggtcaagtacattgttcattgagttattctctttcatgcattttcgcaggctaattcatgagtttaaccataccattaagcattctctttctatccaatctgtttcattgatgttaaccataggaaatccatttcattatttgactaaatgttttataaatagaaaatgtaacaagatgctacagaaggagctggatcacacaccaacacacaccaacagtaaaaactgacccttcatactgggtggcaggacgagcagctaccttgaataactctattgatacatgcaagaatgtacagtatatttaattgaaagcatgtcacgtccatgacttttgacaaactagagaatgttgtaggatgaatgtatgtgttgtatagtcttacctgaagctaatttgacctttggtatttacaaaaagtgcctgcaaagagttattaagatattgcaatttacactacaatatatatgtaatttttgaactttggttgttcacatgttgggtgtgatatatattgtggaaaaaagcaataatcttcgggtgattttacatgattagtgtgacatgatgtgggaaacgtgccttgcacgttcacgtttactagtatctgtaatgctagaagatcagcagcatcgacctttttaacctgcatattgtaacgggggaatttcttttatatatatggtacacttttaaatcaaagaacagccatgttctgctttgaaaacacagtaatttctgttattatcctgtaattaagcaatcacaatcagcatatgtggctgttgctcaatggcatatatatatgcacctgcctatgactcgggcggaggtagagtatgtaagggggttaccaggaatctggtcaaaaaaattttttaagctatacttcacatatcttcaccatgtgtgcacctctctcagtgtaaacttaggcacctgcaccaacttaaacttgatttaaagtaaagtaaattaagcaagaggcacctccttcatttcgttctagctccgaggctatgatactactagaaaaacgatttttcatggtgtttggaaaatattcttcatggtggctacaagaaaaaaccgccatcacagaaaattaggggggtggggggtcacgggccgccagcgaaaactgattttcgctggtggccacattaagaggtccaccataaaaaatacttatttttcgaggcgaacctcttaaatgtccgccagcgaaaatcagcgttttcgctggcggctactaaagagatccgccaacaaaaaaacggatctgccagcgaaaagcaaaggctcgctaaaaacttttcacggcatttaaaactatgcgcgcgcgagatcgattccttcacccacccacgcatttaaaaccggttttcacccacccacccagtgcattcatctctcctctatctctttctcatctccacccaccgcatccctctccttctcccccacctctctcccctactcccggagcccccagccctcctcctcctcctgtcggtgacgacgacgactgcgtcgacgacgggcgcggacggcgaggccctcacctctctcccctccccttcctttccctctccctctcccagatctagccggagggagggggcagcggccgccgcggcggcgacggcaggcgggtggcggcggagctgacgcagccgacgacgtgccggacctggcgggcggcggctctcaagcgcgggtggtggcgctcgggcgcgggcggggaggccggcaccgacctcgacgccgttgactgtactgcctggctccctcctctccgacctcgacgccatcgaccatgctgcccggctccctccttcgtgatgatttttgtgatgcttgaatgcttgtgttgatttttgtgatgcttgaatgcttgggtgaacgaaaacagttgactgtaaattgttgatgtaaatttctgtggttttttgaatgctttggtaaatttctgtgaaatttttgaatgctagagcgttgacgaaggcggatggagcggtgtcgctccgtccgccgttttttttaaacttggccagtattaacactcccggctggcacaatgtaacccgccagcgaaaaaatattttcgttggcggccgtcttaagccaaccgtcagcgaaaatggatctttgctggtgactagcttaagatgaccgccagcgaaaatgaattatcgctagcggtcgataaccgctagcggaaatcttgatcttcactggcctttgttttgtggctgctccaaattccgccagtgaaaacctaaaatcatcaccaagaaaaatggttttttagtagtgtgacgagatgtgtatatttgcttgagttatctgctcttgcacttgtatattttgtatatggtgagtttgtttctaaatcctatgcatgtgaagatatatggtgaatggtagcattcctgattcttgtcaagatgaattctactgtgaagtatcaaatatgaaatgttgtgaattatctgtgaaccctgacatatatgcactactgtcaagacgttgtaattttttttctaaatctttcaggttaataataagagaaaattcgacctatagcacaggaaaaaaagcggtaccaaaaaatagcataaaaagttcccactttcgatctatagcataggccaccgtttttttcgcccggtagcacttccgtcgcattttgaagtaacggcgttagatcggagtggagaaaatttttgtcggactcatttacccttcgttccccacttgtttggccgcgtgttcggtgacgcctgcgccggcggcggcggaggtcacggaggagtagaggccgctgcttaggaggctgttcctcgaggaggggcggaactcgtccatcaggttgtcgtcgtcgtcgttggacatcaccgagctggacggcatgtcgccggacagctactgtgtctgggtgtcctcgccgtcgccagcatcctcgccgtcgcgccccccacggaagagcgggtcgacggggtccatcacgtggtggcgctgcatcagcaagctcgtcatcggccgcaaccacagcgacggcaaggagaagttccgcgctgtcgtccccggccagggagcaccccaaaccgaagcccaccgacgaagggcgccaccgccaccaaaccgcgttcttcactgacggcggcaaagaggccgcttgaggacgaggacgacgatgatgacgtgggcggccctagcgtcgatgtggatggatgtgggccgttgtacgccctcgggctcattagctccgtcatcgccgatggcgctggcgaacaacgccatggtggccgtactcggcgtcgcagcccacacctccgctgtcctatccctgctgctactcgccgtcgaggttgctgcctacctccaggggtggaacctcgaggaggtggcgtcactccccgctatcgacggcctcttcgccgcgcctccattgccctcttgctcgggaaaaagggcaaatgagtcatttttcatgtcgactcacatgtttggatggcaaatgtgacgggagtgctataaatcgcaagaaaattagtgtcatgtgcttctggtcgaagtagaaaatttgtcgtgctattttttggtaccgggttttttcctatgctacggatcgaattttctctaataataagcactactggatcgtagcagcgtcatgcacagggagaaagagatcgtaaagctagggatcgtcttcgccttccttctccacatgtgcaacccgacgtacgatgaactgtagcggcaaaaaggaaaatcagatagcggcgacgggcgaggcgtcgaggtactgtagcggcaccggcaccgtatgcacagcaagaaaattagatggatcaactgaactaggcccacctgctgactccagcctctaaacgggttttgggttttgagggaaaaaaaaaggttaattggattcatgccatcgtaaatatgcatacttagataaataccattacaattcacctattcgtagctatactattgaaattttataaaattaggatacaagccactgcccgtcatgtttccatccatctcttttttttccgttttctcccggccggcgacacgagttgagctgtcccccggcgtgcatgagccggcgacgcgccatggtcgcgagcccgcgcatgcgacaccacggacgagagtccacgctggtaacgcacaagtcacgccacaccgagcgccgacaaggctgcagcgccaaggtgccgcccgccgtgcctgcgtcacgctgtcgcacggcctcgccgagcagcgccatcgttgcagagctgctgcggctgccaagccactgggttgcggcgcaccgccccacggcgactggcaccatcaaagaagaaaagaaaacgaaaaaagaaaaagaaaaaaaaaactgagagcagcaccggatgaccgagctactagcctggtgcgcgtcgccgttgctcgcgttgtgccccggccgccgcagccgcacagccacgccagcgccgtcgatccgggcgttccccggccgctgcagatggcagagtcatcaggggagaagaaggaaaaggaaagagaaggggaacgcgggaggcagtgtcgatggcgacgccgttcaccgtcgcccacgctgcgccagcacggaggccactgcacccgcgccgaggccgccgccccccgagctcgcgctgaaacgtaggcatcgatgcaggcgtactcgaccttcgccgcgtcgagatcccgtttctcctagttgcttatggtgacgcttggcttctccgtgagtccgtgtcgaggccgagccagtggttgcaggcatcctccaggtccaccggccggcgcggcgcacgagacaccgtagtcggcgtccagcttcgccgcgtcctctccaacgccaatgcttgcgtcggggcgctgcacgccatgctttcttgtgccatgccattgtaaatcggtagctcaggaagaagacgggagaaaaaaaatggaagaaaacggaagaagatggttggaacgagacggaagtggcatgattctaattttgtaaaatttcaatggcacggttataaatagataaattgtaatgacatttatctaaatacgcatatttacaatggcatggattcaattaacaaaaaaaagaaaaaaagaggtccaacgtacagggtccctactactagagtcctaggaatatataggaaggccctcaagtcatactcccgccgcatcccctaatccccatcaacggtttgtatgcgcagaagggaaaaattctggtcccatgctccttcgagcctgccgcacacacgagcttactggatccctagctacggcatctagtttcgccgtttgtggttgttggatccacctgcatctagtttcgccgtttgtggttgttggatacagtggtggatccagaaagaaatagattagttcttagcaaactagatagtgttacattccccctcctatctacatatggtaaaaaaaattagtgggctcttcgtggggctctcatagttttcacggcagtagtgggggctcgagagtcgagaccccgccgcccccatgctggatccgcccctggttggatcctcgcctgctctggccactgccctccctcgcgacaagctatctatgaatgacaaggtctacttcaggagcttctgcaactaccggactgtttagttggcaaaaattttgccacacatattacatcagatatactgacacacatttaaagtaaccgtagtctaataacaaaacaaattatagatttcgccaagaaactgcactacaccagattctcacacctgtgacggtatatctgtgacggacataagtgttggtcagtgataagggtcacctttgacgggtcctacggaatgccgtcatcgatgagccatccggcggcaacccgtcacaggtaactagtcacctgtgatggtccaaaaatagaacccgtcaaaggtgaggtaaagtcacctgtgacgggccaaaaatatttagcccgtcacaagtaactagtcacctgtgacggtctaaaaattaaacccgtcaaaggtgaggtaaagtcacctgtgatgggtcaaattttttgtgtccgtcaaagatgataaaaaaaaagctctcataaccctgccctctttccgtgcaactgtatcgatccatccttatcctctcccaaacacacacagccacacagggatccttatcctcttctctttcaattactccccctctctctccctctctcatcatcctccctctcagtcatatcctccaaccctttctctcatcatcggcgccggtgggtgcgcgggcaggaggggaaggtggcaccggcgggtgcgagggccgcagggggaggcggcacgggcaggtgcgcgggccggagggggaggcagcaccgacgggtgctggggccggagggggaggcggcacgggcgggtgcaagggcggaggcagcaccggcgtcggcgccagttggaggccaggagctcggggtcgccgcctccatcgcccaccgcccaaagtcgcctccttcacagccatcggcctccaggagcttggggtcaccgacgccttcccccgccttccggccgctgacgccgtcgcctcgaccgccgccttcatcaccgacactaccgtcgtctcccgaccaccggtcgctagatctggccgccgggaagccggatctggccgccggtgccttcccccgcctcccggccgccgacgccgccaagtctagcctccaagacgcggatctggccgctagccgccggatctggcctccgggatgcgaatccggccgtcgacgcctcccctacctcccgaccgtcgtacatgatcgccgcggcctctccatcgattgccggacgttgcttcctcttccaccgacagctgactgcctcctcctcccgactgtcctcctccaccgacgcctcctcctccgccaccgaccgtcggccaccggatttgtttgtgcttgattttgtatgttcattgccaaatttcaaattggggcttttgttgcttgtgtggagatcgatacttgtgtgatgtatattgttagatgtatcctgcatttttttgcttcatgtgtaattgtttgttggatgttggatgctatcagatattaattaaaatgcaaagttgttgtatcgtgtggatgttgagatatatttggtttttcttcatttcgtacgttcggggctgaggcatttcttttttgtttgggacagcttattatctgtgacgggccgaatgtaaggtacccgtcaaaggtaagtcacctgtgacgggttgtaaccacgtgactgacctgtggagacctcacctgtgacgggctggaaaatacaggctcgtcacaggtgactgtcacctgtgacggcacccgtcacaggtgactgggactcaatagtgaccactaatctgtgaccatgcccaaatccgtcaaaggtgatagttagggcccgtcacaggtgatgtgatccggtgtagtgctgctagacaaatttattaagtctaattaatctgtcattagcaaatatttactgtagcactatattatcaaatcatggtggcttaaaagattcatctcgcaatttcctggtgagctgtgtaattggttttatctacatttactactccatacatgtgcctaaatatttgatgtgacagcgtgaaaaattttaaacatgccctatgtcctttcgtcataaggtcgtcataaaacacggcttattatgatgttatctcattggttcttgatgaaagtgcctcgtcaataaaggttagaactactccctccatctacttttgatagtcatatttcatcttggtacacagaccaaggataagtaattctatttatcatctatttaaacatgctactagtcattcctcgtaaacaagcgattcattaatatttacttttctcgatgcacatgtagccaatcttgtgtggaagaatagagagtcacgcattaaatctgagtaagtcattaagatgataggttgttgattgaaatatgcctataaaaaataaaattttcagatttgaaaatatgactatcaaaattagatggagggagtattacggtgcacctacctacccgccaagggagcgagcagactgaccccttcccggatgcaatgagtgtggtgggcacatccatcgacatccccaacagcgtcgatggcggtgacaacaaggcaattagcgtgaaatccacaccgcggagattgttagagatgaggaggacatcgccagagagaaggagaagaatcctccgctcactccctcagtgagtatattgcatatacacgtaacatcagataattttaatccatctccaggttgagtctgcactaattctgcaccatttccgacatccgaaacaatccactctacattcgcatatgctccaaatccattatggtgtaggatatggtatgaccactatccatttgaacactcgatgttttcacctctagatgtgtgacatctcaaacgagtacaaagttaatcttgcaaacatcaattaatcctcagcgcttatgtgaatttcaagtgattctccaaccatggatattgtaacaaagttatgttgctttgttccggtgaaatactcgtgcgttagaacacagactcattaaataaagttattattatttaaacttagtagtatgtccaaaagaattttattttgagttggtatatataataaaattatactccctccgtcccataatataatggattttggagggatgtgccacttcctaatantatgtgtttagattaattngtagnantagnaagtggnacatcccctccacaatcccttaggcaatgtttggctaatgggaaatggaaatgatttccaacccaccaaaaggtatctttaaatcctaaccattcattctccctcttccatttaatcataacccttcattcatttcccaatcccaatcccaccccccatttcccattatccaaacacacccttatattatgggaacgaaaggagtagttatcaatcgttaagtttttcttcacatgttacaaagcacaaccattttgctagaaagaaaaagttagacaacgcaacttgagcctgatgtggttttgtgcattagattgcattcgagattcatgcaaagagagaagctagcgggacagttcatcttcctgcatcggatcacagccaagtcaccggcaactctattttttatagtgattttaacatattgtttctttacttaaatga

SEQ ID NO: 80867 - DNA, 38404 bp, Oryza sativa
  unsure (1)..(38404): unsure at all n locations
aagggttgtttgggatctgtgtgacttgccttgctggccttggaactcttcaaactcttcttctgcgaaaacggactctccggaaacgacggaatctaagcagaaaagagcaaaatcaccaaaacagcacctaaacaagcatgaacagtatatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagagggtttattgcgtcagcgggctagggtttggtggaccgggcgcacgggcggcggttcacacgaacggacggccgagatcgaaccaatccaaaacggacggccgagatcgattgggtccacggcggctcacggcggacgaccccgataacgtcagcggtgacgtcaccgacagcggcggcggctcggcggaggagacggctcgaacggcgcacgctcgccggcgaacggcggcgcgaggacgcaaacggagggcaccaagacgaagcgggcggcacggcgaactgaccggcgaccaaaacgacggcggaaggtcaacggacggcgacggcgacgaggaggaagcggcgaagctcttcggcttgacgacggcgacgaagctccgacgatctccggcgacggcgaaggggcggacgaggacggcgacgacttggcgagcacgacggtggtcttcccgagcgacggcgacggctgaaacgacggcggcgcacggctggagcggcggcggcgacggcaaagctagggcacacggcgctagggcttttccgacgacgagaggcgaaggcgaaggtggcgacgggtagaggagacaccgggggtccttttaaaggggctcagaggcggcggcgaaggcccaaggcggcggcaacggcgaaggaaagctcggcttggagagagggaaaccgatccgtaacgaactcgattccacgaacttccaaaacgatttagccaaagattccaaaggagaaaaggtagaggagatcccggagattgtttcccctcaaacaattcggccggagaaggaaaggaacggccggatttggaaaggaacggcggcggcggcgcgctagggtttcgggcagcggcggcgcgacgaagacgatgggtccgacaggtgggacccacctgtcagcgaccgaacgcgcgcgcgcggcggctgcggactgggccgaactgggccgaggagagagagagcggttttgggccgactttcggcccaaagccaaaagagactttttaaaacctttttcaatttaaattattccttaaatgcaattccatttattaaaaatacttccttagctcaaataaatcccagaaaaatctaggaattatagaattaagcaaagtatttaatgaaattttatctggccccattttatattggaatttattaattaaaattagattttcttttcaagacttttaaaattatttctaaaaattccaattaaacaacaatttatatattttgaattttcagggtgtgacaatccgctagagccataggcaagtagtttgccatggctttgctgtctcctcctgctgcatgaattgcgagaccgtagacggtgagccaagactcgggattagtggtgccatgatacttctcgattccagtcggcttgaagccggctggccaatcgactcgacgcaggtcgctagtaaaggtagcgactccatccacatcgtcgtcatagcggtctggtgaatggtggtgggggtagcctcgtgctgcacggcactggttgattgtatcacgaagatcgacggggcgcctacgaggtggggagcgaggccgttcaactccgcgctccctgtgtcgttcgggaggcgagtggacagatcgctcatcgtaacccctgctcctgcgattggatcccgcgccggcgatgctgaggcttggctggtgataatcttgagatcgaagatggggaactcggctgccagtcgatgtgcggacgcttgcggagttaaccgggaccgaggcggcaatcatggtcttggtctggttcaagatgttgacgacgtgatcagcttggttgagtgcgtcttccttgaggagggtgtcgaggagagtgattgctgcaaccgcgttctgttgaggggtgcgaaagaccgccgttccctcaacgtcttgctgtccgataagttctcgcgctcgtcgcccggcttccaaggctcgttgtcgtcggtcctcagcctcctttgcagcccgttcacgttcctgttgctcgcgctgcagccgttctcgctcttgtgcctggcgctctgcttccagtcggcgtcgttcggcctcctgttgtacgcgtcgtccttctgcttctcgagcttggcgctgttctttagtctcgttgtcgaccatgaagacgccgaagtagagaggggtgtaattatcttcgaagctttcgtcgaagtcatcgaggctgcggttgtcgtagcgatagccgaattcatcgtactctacgacctcagttggtcgtgagtcgatgccaggggagctgaggtagccttccaattagtccgtcgaaatcgtgcctagtggtggagtatgatgccgacttccctggagctaggccggatcggggctaaagccagatcccgcctaggcctacggggagaagacgcccttgtagtaaagacggcagccagatcgtcagggagtttcatcaggattggcggataggccccatcgtcttgatctggtcgtgttggagtagattgcatctcgtccgagtggtttgaagccaactcggcggagatgaccttggggtagacctcggccgagttcggaataccaaacggggcggagatccggtctcttcctgagtggttcgaatacgagtcgaggagagaaatcttgccgaagtcgttggtgatgaagtctaggctgccgaaccggaacgcctgcctaggagggaagacgaagtcgtcaatgtcggagacggaacccatcgcacttagtcggcgaagaacttgacgctacccctacctagcacgccaactatcgaaacaagatttcggcaatactaaaagggggtggctatcaagctggaaaagtggatgggtttagaggcaaggaattttatacaggttcaggccttcttaatcaagaagtaatacgctactcctgtccggggattaatccgccgagtgtattattgatcgtatgatctgggagaaaaatcgtgttcctagagggacccggacccctccttatataggggaaggggtgtccgtattacaaaatacagtccatatccctaacggaatatgtaattacagataaaatataatcgtaaccgactaggatctcaggtatttccttgacatacaagtttaaaacctaacccgagtcctcttaaagatattctatctatacatggtaccctgtacccagtcggactatacatgccgtgtagatctagggtatctataatctccacacctctctagcgcaacggtcaagcataggcattgcatgcatatatgtcattaccactcatactctctcccgttccataatatattctagatggttcagataaggttgaggtcaaacatagaactttaactatcaattacttttagttgaagacactagaacacgagtatagatttctcttacaaatgactttaataaaattaaatatttaattatttgataatagaaaaccctagtttaggatatgttttggagaccgtatcgaatgtttaccaaaacgttaagagttatgtaatgaagggagtaactcataacactggcgccaaccatctatacttaacatacaccaatagcgcaacaagaaaataaaaacaagaagaatgtcaatggatatgttatctgtactacagtgaaagggactttcgtccatccacaccccctcccatcgtgtcacgcatagcggataattagtccacctggcataaaactcgcccctagagaaaaactaaccaaaccacatgaaaccgacctgcaacattctcgcctatcaaactcaggtggtggttggagtaaaaactacttttacatatgtcaacacagatgtttctattattttgcataactaagttgagtataaaatttgggtttctgttgtgacacaggggcagttaactaagtatgtattaggagagtatcggggcctaaaattgttttcgttatgatctagtagatcaggagtgagatagcaaaatacatgcccttaattagctaggcaaacatgtccctggatatgaatgttggcctttgagaaagggggcggagtaagctgggcaagtagttgcaaggctcatcttaagaataaaagataagatgggccaagtagtgtaaatggctaggaaaaatgtaacctatttggaattggataagattcattcctagcacctaaatttttatcaaagtccattcttttcacattaaactcaaaaactgatctcctctaaattttaaaatccgacatataacaccctaatctatgcttattggtagctttcatcgatattgttggtgtattttctagtcaacacggactcgccttaagatttacagtgttaacgagtcaccaattcgtgttggtgcattttttggccaacacaatactcacctaataatttgcagttttaatggagtcaccaaccactttgatttagaaaacctcttgacccttgtgctaaatttaggtgtcaacacacacacgtatgctcttttgacaaactggagagccaaaaagcatagaacttgtggtattacaacgataatctctatcggccacacgggtttagaagcacctagaaaattgttctctttgcagtagtgtcttgacaaagaaatagttttctaaaaacaattcccacaactcaatatagatcttcccaactaagggattatccactgagttcctagcacatggatcataatccaaaaatagttttttaagccatgtctctaaacttgaaacaattttactcaaattctaatcattgaacgcttattagtcaaatcatcgtcactaatgctcattgacaaataaattagcttgctcaacctaggagagccaagcggcaaaattaattatcttccaagcccattgataaattccaccaatgctgtatatcactttatccatagcaactccaaatcgatcagcataaaaattccacaaatctctatgtttcagcaatataactctttattaaacaaagtttatttagatgcttaccattgaactcttcaatagatcttctccgatcaaccctcttttttgcatcctttaaatatttaactagtgaaatcctccaattggtaacttgaaatcttgaagcatcactaaatttggaacaatcaagaatgggttgtttaatcaccttttgagcctatgcccctagctatatactgtgggcagcatttttcagtcaagccagcattagagctatagccaaattgtccatgtgcccagtaaaaccattaatgaagtcgcggtcagactagcatttgaagcatcagtgggaccagcagtgaggcaccggtcggatcagcatgtgtttcggtttgaccggccatgtagttgtggctagttcggtctagtccacaattacctctcacactttctaatgaagtatcacctttgcaatacacaaatattgcctttcctatcgttgtaaccagatgcttattgtgtcaaatgtttagataacatatattttctagacatacgaaaaattgtaatatccaaagatactaatatgactagatatttattcaagtgactattcaaaaataattatgaaggcaacaaaaactcctagccacttgatctatgaatcacccaaaagcaagtctctcacacctatgagttataacaactatatatgaacataacaatttgacttaagcatggatacaaaatattctaatagggccaatgttaaactaacatctctaggtaatatcataataaaaccaatacattggcctttcatacacgtcaaattactataaagcaaaacttccatggtgcaatataaaattgatctcattgcaagactaaatatgatgcgccatcaagacagatatgatttggcccttcaaggttttctcaaactcatgaaactgttgatgcaaaaaaaaaacacacacactggcctgagagatttgctttactctagtgcgggtccaaagatttgctttcggttcagagcatgctagttggtttgatcctgcaaccaacaacaaacaaagaatccaaagttaaatccataaacgatagccgatcggctagattgccgatgacgtatcgtttaaatcgagctgatgcaatatgatttggatcggcaatgaagtatataatgaataaaagattcaatttagtttaccggctgtagataccaacgatgtatatctatacttccaattatatttaaaccaagtgattgggatagatcggacagttgccgacacagtataaatcacttaagtctaaatgtacttaagagtaaagattacataagatcatatcatagccgattggtaaatctagcgtgtatcggatattgctccaatactcctttatactaagatatcactatagattaaatatgttaaacatgaatcaatctattgttagtttaatctaagcatattgatatcaagcttaatatattttatcttaatgagatcttgatataaagggcagatttaacatatcaagtagatagattaagaacaagacagctaaaccaggtaagatcggctgaaactccggtactatctctattaattatcatgaagcaagctagagattatggttctaaatattacttaatagatcaaacttaactgatgtagcattaagcattaaggagaaacataatatctaatgaataagccaatgaaaaccttttagacatggtagatatgctatataatctaaaccgacaaagttacctaaccctatcgggtgatttcgataatagagataccgacaaaactagataagagtatcaatctagattatatagcatatatgataactcgacgatttacataaacaagattagagtgtcataaatatgtaagcactaatcccgagaacgcaagctgccataacaagttttaccttttcgtcgaagatcacaaccgatgcagcccaactcgaaagcaagaactcgtcgaaacaatgaaaatagaaaagggtggcgatgcaccgaaagtgttattgaactgatgttaattgtttacaaggtattgggtcatatttatacccaaaatacataatatgtccttgtcggacgcgactctatttttattacaactctaaaacacgaacaagtccctttggtggactcttaccgaacatatctataaagaaactactagaatatcctaattaatagatacaattaccttcttcggactcaatccacacttgacaatacttgtacaggacctcagtcgatcccgacaatgattctataattatcctgccgaaatcggctacatcggcttctccctatccgatttggtatcagccgatgcagacagtagccgatgcaatctgtagccgacgtgcactctgtttcaaagaataacgaactccttccaaatccgcttaggctttgactccaaatccaatctatgatttaccaaatttggtcgttaacagaaacaaaacatatttaattgacgtatatgctctcttgccaattccaccatacagaattggcttcgtgacatcaatttgaaattattgatttgacaagtaaaaatacaggttctagatagcaagcaatgccttaactttgtataaacatgtcataatgtaagatataataaactcacaccttgtcttcacatgtagcaaacgacagctcagagatgtgttcatgtactctttgccattcacttctcttaacctcttcatcaaaatattgataccttgtcccttcatgcaaaattggctttcctatttatttcacgattttgaaggtaatgcaaacactatattgacatccttctcgctatgtgaattagaaccatctcttatgtccagtgatgactcttcattcaataaatcgtatttatcatggcttggggaaatcaccagtctttcaatgtttactaccttgggtctccactctttcctatgtttttattagaggcttaaatttatcaagcaatccgccccacaagtctttgtacttttttcctcgttttgttgatgcttggcttgaagacattgtaacatactcttctgagagtgggataagcgggaaagtacctacttcggctatgggtgcctctcggtcagaccaaccatgtagacaggacaggtgccatactacacagtctcaggccattctagacaccccgagtcggaccgacgtgatctcgaaccagataatgtcattctggtcatgcctggtggctggtcggaccagcctcagggcccagttggcacagagtcatgctaaaccgtcctagatggttatggtcttccctggttagatcagccttagagcctagttggaccggcaataccggaaattgaatcatcgacttcggtcttctttgcttgtgggatttctgttgtatttccagtaggtactgggacctcgtttggcttcaccttagcaacaatgacctctaaagctttggttcgtttcatcacccatacgttcttcatatttttcacctttgattgactggaccaatcctttttctgggaaatgcacttgactagagttagatggacaacttggtgatgagtacgaaaacgacatcagtaattgaggcatccactgcatttggaatataaaagtatacaaattagggttaattggatcaatgccatacaaatatgctatnttagataaatgccactactattcacgaaatcggttacgtgccactggaatttagggaaattggaactgtgccactgtaacatactagatttttcagggtaaaatttttgcaaaaatatttaaagtcgatgttctttgttctttcgaattggagcctcccaatccttatatttcttttgttccctctaagtttccgactcccacataaccttgtttagtttccctctccaaaccaaattcgagatatcccagagaaaattcccaaaaccatcagaagagcttgtgtttattttaagttataccggagtcatcgtgcaaatattctaaaatccccaatctcatcgatttcctattcaaaaatatcctaccaaagatctattcaaaaatttcttgaaaaattcaaatggatcactatctctccctgggctgaaatcaaccttaacccagcccatcaccttttcttttcaactcctttgcccatctccctctgtttgggccgtgcgaggccacgactattgttggcccagccgaggcagccgccccaactaaaccgctgctcgcttcactcggtccatcccgaaataactaatacgcgaacgttcgggttaattcctactcgcgaacggctcgacaggttggcatacacgaccgtgccacgcgtgtgaatgcaaccgatttccttttgtagctaaactgtgcatgcatatatatgacttccttaatcaccgagctaatctcaatagctcggtgattaaggaagtcatatgtatatggtttcctttagtcaccgaacttttgagactaatcacattggtgaattatgttttataatttgttacacgggacatgtacaaagacgagggataatttttgggaattctcactcaatgcatgtccacatttgctactttgtttttgcccaattgaaacttatttttttttggaatttattttaattttgttttgaaattcatctatatataaaaagtttgtataacgaaagtttttatatataaagtctgtgtatcaaaagtttatctacataaagtttgcatatataaagttcaattttgtgttaaagtttgtgaatagagatattagtaatttgaataggatttatttaaatgaaaagtttaaaaatttgggtaaaaaaattgttgagtagaagatgttgctataaaataaaaaattatgtataccttagttacacattaattatgtggtaatcaatgctttaattataaacatcacactgattttttcggtagcaaaatatgtacataccatcgacatatgcagataactataccctaagtacatgctagctaattaaagtgtcggcatgtatgcctacatgctagtactctagttcttatctagttgcaagatgtgtgtatgcgatgcgcttacaaatcgtgctgctaattaagagcatataagcacgaactgaatgatactaaaggtctgagcatgttcgtgatccgcgaacgttcgcgtattagcctcacccggtccagccaccgctcgcactacgcgcgcgtcgcctcgcgccaccctgcgccttgcttgcgcccgcacgcgcttggcccgcactagccgcgtgccgccttgtacctgcctgctctgcgccgcatgtcgccacgcgcgcggcacacgctcgctcgaagccgcaccgaggaactcgatcagatggtgtagacgttgtcgcacaaatcttaaaaaccgagcaagcaccactgctaccgtcaatctcaatctcccactacccaactatttaagcaggcaaggtagccatgctcatcctttttcccctctctttctcctttactcagaaaggaatcgagttcccaaaatttcttcaaactgccgtggtcgtcggccgatctgtcgctgcaggccaccggtcgtcgtctcctcgcgccaccagactcttccagagccggtgaggccatctccttgtttttcccctcctctccatgcttgtactgaggtcccatcgtgctcctgtccgtcaccatggctaccaccgtggtcagtttttttttccaacgtttcatctctatcaactaaccaaaaaatggaaccttctcatccgggaacacgttttgacgcgctcacccgcccgcgttcgtcaccggagctgccacttccatgcccggtgtcaccatagctccagatctggaattcgcgttccggccagcatgaacatcctctcagagaaccagcaacagcttcgagttcgcagcacctggggacgaaattacctcaagacgttcttactgttccgccacgataaccgtcatccaacttttctctttttatctctctgtctgtgttcgtggttcacagtggaagaagaacagtactagattcaatactgttccaccatggtccagcctgaccacaccacctgagccaacccaggtagttgttaaccaaaacaaaaccgattcatatcaattcttccatcagttcacctccagattcaaaccaaatcaattctagtatctgtaacaacaataatcccaaagtgcaaccactaaaacacatgctatcgatcataaccctaggataaatcgtttgacatccaagtcaattaactcttgatttaccattttcttttgttctcgctccgattcataatatttattttatcgtttatttgtagtatttttattataggcttatttggtcgtttcttcgtgtgcgtacgttagatagcgttgaagatcccaccggactcacaggaactgaagtgggcctagaaggatacgctgaagcttccgaaggccatgttccacaaggcaagccacaatttccaatctttgatcatattgaaacctagtagagaaccacttagttattttatgcattgagtatttataaaactattttgcttaagaattattttcgaataaacttgttagtttagttattacccattgttacattgttattattggccaaatccatggattgctatatcacgccctttgataacctaggtgtagatttatatacttcacaacaatattctagtggataagaccaccaaatatctatactcacatacatggtttacccgtcgtcacgtggtggcgtgtcgggtgatataaaatgtgttatttgatatgagtcactcgcctggagtgatatgaaagattaattctgggtgaagatggatgttgtggtgtgtgaggccgtgcatattgttataattattttgtggaatgtgtatattacacttgaagtatgcacgggcctgtgctagttttggtggctttccccggatataaggactaccctcttatgccatggaaaatgatgtaatttgcgcccatccacagaactgagtaatcagacatagcctagtacattgtcccactatatgaaagactgtagggcggctttatgagcaggtttggggtggacatgtggaaggggcttcggccaggttaacatgatccacgacggtggaacccgtgaaagcagcgaccgtctagccttgcttaggcctagcaagtgcccgactgctaggacggatcaatatcccactgggcagtaactagtagtaagtgggactctcgaatggctatgttgtcctcagcctagctagctgttgacatcaggtgggtaaagctgagcagtctctgcagagatgagtcttaaatcattcgaatgtgccatgcttccggttaagaagctatgtcattgggtgattcctatttatcatggtatgagtagattttaaattaaaatatggaatatgatgaagatgaggatgaatggtgattaatattgctaccattttaaaatgatgatttacagttgtttgtgaataaaatgtttgataaagtagggaaaaactatttataataggcttgttatgaaacctccttgatgaactatattctttgtacgccttgcatatattctatttgtattattatgggtgtggcttgctaggtacctcggtactcacctcttgcataaaatgtggttcaggcaatcaatccttccccgaggaggtgcatgaaggggaggaattctacggtgctaacgagttcatgttctaggtcgatctgctctcaagcattgcctgtggtgtttttatcctattttgtgtttgggtcttttgtttgtagggagtgtgtttggcctgttggcccctaaaacctgtcttagttatcttttatgtaataatttctgtaaaaacttgggtatatatatcgaaagctgttctgtttatcaatttgtgcgcgatcgaaatcctgaacggtcgcgggtggtttcgggataccgtactcaaaccgggtacccccacagccactccgtcttgttttccatcagaccaatagacgtgggacccacatgtcagttccatcttccaccatcctccctcttagggatggcaatcgggcgcgacgggtacgggtagtgcctacccatacccgtgcccatgagattatttttgcccgtgggtatacccattactacatgacgggtaaggatggttgcccatgcccatcgcccgcgggcgtcttgtgcccgcgggcgtgcccgtttacccgccacaacaaaagtagtggaacaaaaagtctacaaccttctaagttcgatatcgaacttaaaacatcaaatattctctgcctcggtgtggtgtctctcctttgacggcgacagagtaagagggagagataataagggaaataaaagggaaaccgtagaaaacaaagaacgtggcttatgtattctagtggattttgcttctagcctacatgtaagttagatttcgcgggtaaacgggcaaagcgggcatgggtagtgattacccatacccatgcccatttacccatcgggcatagcttttaacccaataaaatacccatgggtataaaatggagaacaaacccaatcctaatagggtttttacccacgggtaaacggacaaacgggcacaattgccatccctactccctcttctttcttcctcacgtgcaattgaggctaacggagatttttaacggaaaacgcaacgggacggtacggttctagtttccccaaattctagtggcacgtagctgatatcgtgaatagcagtggtatttatctaaactggcatatttgtagtagcatggatccaattaacggctcactgagaagccacttttctgcggggccatttgttagtgagaatccatatttgtacaaacaacccctctagatgctatattgcaggacacaagatatataacatatatcaatttgcataaatgatttaaattccacatatattaatttcatcagtagacttaatatataatttaatttgcacaatgttaattggatccactcgttatactctgaggtaatacttcttggtaatatattaaaaaatgtattttcccttaacaaaattctactcgggctcacttgtcgaacactagtctagaaaaactataaactacatctaattagttgcggtggggctaattctcttttggcttccaccaccgtcgtcaagcaggcgctcagggtcggccccgtgctagagcacacactaggggcctgtaccggggttctgttggctggccctgttccggggtcgaagatgggggctggtgtggtgccttctcctccagctccgatttggtcggagcctcctcccagctagacgacggcttggcctccagcgttgccacggtcacgtaggcactcacctcctgcaacaccggccgccacgtagggcctgcctcttgctcctcgggagcgttggggttgactctggcatttcacctccgcaacctgccgccgctgcgtccacagggatcgaggcattctccttgaccctggccttcacatggtcctcgggcgatctatggcccccgtcattgtcattagctttgttgctactcttgtcgtcattacgggagtactcctctgctagcgggtcatcgtcgaagtttttattttgaggggacctgctgtataccagtgctcaaaatcattgtccacttcatcattaggtgttttgcctagcaatgatgcaagcgatgacggggttatgtcgctgtgagagctgctcctactgttgttttcctactcctcgttggtgggataaatggccatggctagagagagtggataaatggccgtggctagagagagtggataaaggtaggatggaaaagtagggagagcatagcgagataaaacccattgtttattggaaaattgacatggcatgggagttgaggagtcaaaatgtggtagtggagaatgtgatgtcacgccctgaagttcccctccttgctttaaaattcataaaataaatcgtccaaagaaatgatttattttaacctagagtgaatccttaattaataaatgcaaataataatcggaaccggtatatggaatttttcttggattctacatgtcaaaatatgctaacaggatttttagtggaattttcagagccttggaaataattttaaccaattaaaataagcaaagtgcaatatttaatcccagggaaattccttttcttttttttctttttcttttcctcctttttctctcttgttgggccgtcggcccatctcctcccacgccaccctcctccttgcagggccggcccacgtctccctccctcctctctccgggtcaccaacaggtagggcccacctgtcggccccttcttcctcctccggccgttggagtcggagctccaactgcccacgccactggcgcctcacctcctccactccgcatcccgcgcccactccgccgtccgccttacccgtgcccacgtcgtcgcgacgccgccctcgccttcccgcccacgccgcgtgcccacaaggggcggatttgaattttgaatcccccccaactctctctccccactctcccacgtcgccagcgaaatcaggagcaccctagccacgtccgccactcccgagccccaataaagctcccccgcactcccctccacctttttcctctttccgccgctctctcccgcgccgctacacccatcgccgccgccctccggccgtgctccggctgccgctagccaccgcgccgagcctcaccatcgacgccgccgcgttcgccatccggcgagccgccgcgtccgctgtccgcctggccaaacccgtcgccggagcccgcatctcctcgcattccggtgagcttccaccattgccgccgccttcggctttgttttccgctcaccgtggaccacctttctccctctaatccctcccattgtgttccctaggtggttccagagctcgtccgcccctcgccgccatctctcggtcgctcatcgtcgccgttcgtcgtcgcctccctccggccggccgaacccctcggtgagaactccctctcctccctctttctctccctcccgtgtccgctgccatccaccgcacacgcgtccttgccttcggccgccgccaccgccttccgcgccattcactgccgttggttgctgttgccggcgaccgtgcaccgccgccgctcgccgtagccggccggccggcttggagccgagccgagcccggcagatgccaaccccccttttggagccgttgccggtggcgcccgcctgccagtaccccctccctctcccttgtgcctatgacccgtgggtcctgcctgtcggcaccgccccccccttgggtgacgttagccctgggacatattgcgcaataaatacattaaggctttttctttattagtaaaaacacagataatattctaaaaatcatatctaattcatccgagctccgattaagttcattcaagtctcagtaaattcataaaaatacatagaatccattaaaaatggttttgtttcctatttcagtagtcttatagcctgttttgcttgtgtgctttgtttgtcgcgtagatttcggctgtttcgtcgatctgcagtttctcgaaggcattgttatggtctcatcagtgcgagagtaaggcaagtcatgcattacgattgatcatattgtacccaatttacaaatgtcctgcatttctattaaatgttgcattgttttataatattatgtgggatggttcctactactcagccatatattgtttaccttatgccattgataacttgggtattaaaatgactagatattggtttaggaaatgcttagccatgcttagttcaactagtacacaaagggggatcacattaaagcatagacttcgattattggcatagctttggattagtgccaccgccagggtgttagttaattaaaatacactacatggtgggctgtgggtgcatggttttgctagtcgcacccatggcaattaaggaccggttcgcgggatgccctggaagaagttatcgtacttaccacaagccagcgtggacaatggctgggcttgtagtgtagcttcctctagccgacgtacccaggcgagggtgggcgtgatggagttgggtcggccggggtgtccggttgatcggcttccggattcaccgcgacacgaaaggggggctgcccgttgcctactggggacgggggcgaaccctaaggtgtggtgcgatcggttagagggggttatgcgaagggtcctgtcacggcctctttccggtatgtcgtggtgatatgtcggcgcacgaaaatgtgtcgtggggctgtgtcttgtgggtacagttgtacacctctgatcagagtaaaactattcgaatagccgtgcccgtggttatgggcggtcgaccagattcaccgtgattagtctcacccctagttaggtaatgaactggtgtagttcaggtggttggttgggcctgttgcaacgtagtgtagcgttggacagtgattggttaatactgattacttactacaactattttactgctttcaactactgcttttaaatgctagctttatgcaaaagaacctttagcctcccttggatatatcctgcatcataccttccctttcggtatgacttgctgagtacagtgggtagtactcagtcttgctatcttttccccacaccagagttgaagtccctctcagttgaagatgtctcgaagaagttggtttcgtcgctgccgtcaaggatgcctgtggaatggagtcgcctcgttgtaggagtcaagtcttcaggcttagctcgcttttatcttttctgctacatttgtaatcttttatatttttataagacgtgaatctgtatgtcaacaattgtcgtttgtgtaccctggctggtcctggacaggggtttaatacacattcagcttagaaattctggttcgtgaatttctggacgtgacatgtgaccagcgcgcttcgtcttttgaagaggaagtaaccgaagtctatctgaaaattgatggtagtgggtgtggttgatgatttgaagtaatgacacaagatgaaagggcaataccacaattgggcctgaaaaattaatgtagtctaccatgtcccaaaattagcgtcagatagctgtcggaaaagaattgatattagcttcagaccatctgtggcgagaaggttagtgtcagatggtccgttggtagttcattttaaaaagacagactgtctgtcggcaatgatactaatttatgggaacagatggtctgttggtagttctataactaccgtcaaatcgtctgtgggcatttctcggggcccgccaaaaaattgggtcaatgagtttgcttgcgcgcgagcgaaaatttgccgcgcgcgggttgggctaaaatttgccgcgcgggctgggctggccgagtcagagagccaaataaaccctaaaaatcacacaactatcgatctacccatccccagcctcccccacgcacgcctccaatcgcgccgccgctgctcccctcctcccgtcgcgccgctagtcccctcctcccgtcgcgccgccagccctccccatctcaccgctgctcccctcccatcgcgccgcgctccctgcctcccgtagcacctccgccattccccatcgcgccgccgcatcgctccacccatcgcatcaaccctgcagctctccaggtcaggaggaatagatgtccccttcggccctgtcaattccaccaccactccgtgactcctagggctcgtagctccaggaaccagcgcccacgcaccctcccacgctcgcgtgtccactccgctgtcactcttcttggtatcgattctttacccatgcctcattgatgcaatttgctttcttgcgttttctgttcttgcgtgtacgttcttggatttctgttacatttgtatggtggtttgatgtgtcacgattgggagtaattgctgaggttggtgataatatgggataaatctggtattgcttggttcaattcggggtggtgctaatgttctgttcctaaattacaaattacagtggtttgatggcatgtagatttagaaacaactgtatttttgaaattttaggctgtatccaccacagccactaatatgttgccgcagtctatgagctgctgccatcactgatttccactttgccaaggaaccagtagggtggataggtggacagctgctcacctcttggtcgacagctcctccattgcgtgtgtcttgcaaaaaggggatttttatagccgtattgtgaatctgtgtgtatgtttgtgggtttctgtccattgagatatattaggtgatatttttgtgtaaataacaattgatttcccttttgctactggtgatatatatatatatatatttttacgttttggagatgagaaatttcgctctttgttctggatgcagctatcccttgggcttgagtgctgttcgaatgaaccagttggtgtcgcggaagtacatgggctgaatttattaaccaaggtatttggatcattttgatattgatatttagaattttccagggtgtacaagtggcagtgaatatagcactctctgaatattaaattttgaggcagtttacaatgaaatattgtaggtcatcaacaaggcaagcatcagaggaccaaggggatctccatggtagaagtttgaactttacttgaggaaaacagccatatagctggcaacaagcaaacaccaggttagtaatgagatgctttctatatatattatgttctactattgaatattatctgcatgcttggtactgaatgcttgggaaaaaaattatagttgtttgaataggcttcatattttgtgtgatgaaaataattgattgcagcagtagtggttattttggcaagattgccataattttaattgggaactatgtttactgaattgcctgaatgtgaatgttgtatatttgcaattgtttaaacacttaaaacatgcattatgggtctgtatagctgatctgtgaaaattaacagaggtgcaccatggataaacagtggatggataagcctaggtacaacaaatactttcaactattttaggtctctatggtccataccctttttttatctaacctggccactcatggatgtattgcacgtaggcactctagagaatattcagaagggctggacatattcctacaacatgaatttagttcagcagtaggcaacaaaatacaatgcccctgtaaaaaatgtgctggttcattctggagagatgaaagcgaagttcatgagcatttgatatgtgagggctttctacgagggtacaaaccattgatgtttcatggagaaggtagctcctttgtgaattctgctgagtatgatgaggttggggatgtggagtcaagtgaacatgatgacatctctgatttgcttcgagacttggcatgtggcttagatgataggggggaatttgaggatgagggtaattcagatgtaacaaatgaagatctgaatgctcttaaaatgctgtcagatgattatgggcaagaactgtacncagggtgtgataaattctcaaagctgcatttcatagttaaactactacacatcaaattgcttgggggatggtctgataagagttttgatctattactaaatctacttattgaagctttccctaaagggtcagcactaccaaagaactacaatgaagctaagaaaacagtgaaatgcttacggcttggatatgttagtattcatgcatgtaaaaatgattgcatcctttattggaaggatgatgctaatgccaactcttgtccaaaatgtgaaacctcaagatggaagtcagaaaacaagagtctaaatggcaaacgcatacacaaggttcctaataaagttcttcgctattttccaataaagagaaggtttcagaggttgtttgcatgctctagaacagcagctctaacaagatggcatgatgaagagcgcacacaagatggtttggttagacatccagcagattctcctctttggaaggattttgaccataagcacccagaatttgcctctgatcctcgcaatattagatgtgcattagctaccgatgggtttaatccattcagatccatgaatatttcttatagcatttggcctgttattataattccatacaactttccaccatggatctgtatgaagcaaccaaacttcataatttctttgttaattcctggtcgatatgctcctggtagtgacatggatgtctttatggagccactagtcgatgatatgtacgatatgtttgtccatggtgttagaacttttgatgcctccaagggtgagtatttccagttgcgtgctgctatattatgcaccatttcagattatcctggtcttgggtatgtggctggttgtactacctcaggtgagggagcatgcattgagtgccatcaatttacacgctctcttcgattgaaaaatggcagcaagacttcttacatgggacaccgtaggtttctacatgcaaaccacccatttagatttgatgctgattcttttgatggtgttgttgagcttgagtcagcacctgttccactttctggaaaggaaattttgaagcagacagaagggatgcaaacatcttttgggaaggatccatctggaaagaaggtaacgaaaaagagaaagcgtaaggagggggagccaattaatatttggaaaagaaggtctatttggttcaaacttccatattggaaggacttgcttttgcgtcataatcttgatgtaatgcacattgagaaaaatgtatgtgataacataatcaatacactcttgggtactgacaagaagtcaaaagacaacttaaattcttggttagaccttcaagctctaggcataagaagtgatcttcatcctattgaagtagaagataaattttatttacctccagccccatactcaatgaattctgaagagaagaaattgttttgcaaagtgttaaatggagttaagttccctgatggttatgcctctgatatacggcgcaatgtccaggttaatgagaaaaagataatcggacttagagccatgataatcatgttatccttcaacaattgcttccacttgctgttagaaggatattaccagaaaatgttagtgcagcactgattcgtgtgagcaatttttttaagcaaatatattcgcctgttatccgtgtaagtgatatgcaaaaactagaggcagaaatagctgagaccatatgtcttcttgagaaaatattcctaccctcattttttactattatgatacacttgatggtccatctacctgctcaagcaagaatagctggtccggtacattttcgcaacatgtaccctggagagaggtaattttctaaaaaaaccagtaaaataactgcagccatgccttagcacaaataaactcactttcactccctatttatatatgtataggtttttgatgagatgtaaggggtatgttcgcactagaagtcatcccgaaggatcaattgcggagagctatttatttgatgagagtcttacattctgttctcgttatttacatggtgttactcgttttactcggcgagttaggaatgacgaaggcctgcccatggaagttcagagtaccactcctttctttcgcaacattgggcgagggttagctggcaaatgttgcgtggctttagaccacaaaaattggttgcaggcacacagatatgtcttattcaactatgacaatatcgatccttatttgaagtgagctattttctttattttaacattgagaaattttcgtttttttattattgaattggcttttgaacacttgcagcaaacacattgactatctttcctcaactggccttcaaaacaaacgtgaaattgaccgtgtgcaccatgaaacctttcatgagtggtttagattgcatgtaagtaggcaaatggcccaagtaatgtgtgatttttactaaattgtagctttatcttgacaaatattatctcaataacaggtcactgagatgggtgatgatgaaccagaagagataaaaattttagctaaagagcccatcatggctgccaataaatataacagctacaccataaatggttttaactttcatacacagtcttatgatgagggaaggcctgttcaaagtagtggagtgtctctaatggctgagaccacatgttttgaaagaggcaataatgattgccgcgtagtaggaaacaagatctattatggtattataaaagaaattattgagttgaattatagcaacagaggtaatatagtgctcttcaagtgtgattgggttgataatcgcatacaggacaagtgggtaaagactgatcagtttgggataactactgtgaatttcaagcatttattcaataccggtgacaatatatcagatgagcctttcattttagcatctcaagctattcaggtttactatgttcaagatcctgttgatactgaatggtttgctgttaggcaatcaaaaccacgtgacttatataatatgagtgaaactgaaaaagatgatttggggaatgacactgaagtatccatcattttgcctgatgtgcatcccaattcaactatgaatatctctgttgaagaaactgtttttgttaggacagacatagatggaataattgttgaagcaaacaaacctaagacgtaagcatttttgtatatatattattgttgctgctcatttctgcttgtacaccaagtaatcttagtacttttcctgttccttctactgtactgatgttcgttgaagcactctttactggttggtaatttttttttatcatggcgcaggaaaaacaatggaaaaggcaagaggaaggtctaaagaaaaggttatcaatggaatggcagttggaaagaataaggaaaacactcttactgattatgaaatacgtcgcaaaggtgtcatagcagcaaacaatgaaatgttacaatctctaaacctcccgcccatgggcagcaatacgcatgttcaacaacgacccaagaaaatacctaaggttatgtgtcttgaacttctggttctaattttttagtatccaatatgtaccttttatttgacatcaaacttctgttaggtaactgatggtagaaacatggtgccatgtggagatcataacttgcggtctaggtcaagaaataacctagaggaaaatgtagatgaaaatgttggcgatgatcctgaataccaaccagaagaagatgccatggatgacaatgaaggtattaaagaaactgagctgtgctatttatggcaattcagatcgtgctagtgttatacatgcttatgcttgtttctgttttgttcagtagatgtagaagaaattcttgaacttgaaaaagttcagcagaaaaagaaggaaggaaggggtatcactcaaaagctcaacataatttcaagggtgggtgaagctaaaatcaaaattactctcaacgaatttggtcagccggtggggcttgattctgaggaatttgccactactgttgggacatttgtgagaaagaaaatacctgttgcatgtggtgattggagagatgttgacgtcaaagacaagctgaaagtatgggaagatgtacaggtagattgactgttatttgtcttgttccattaattttgtatatcctactaattcaatattttttatattaaaacagaaacattatgagatcaatgaatatggtttacattttgtgttggagacatcacatatgatatggaaggattataaggctgatttgaagaagaaacattttgatgcaaatctgactgatgaggaacttatggacagacgtgacttaagagtcaacgaggcacaatggaagtggcttattaaccattggagatctccagaagctgtggtaaggcatccagtgttatttgctgtactttacattaaaatagcctacatattgtgttcataactgttgtgtaggcccgctccataagaggcaaggcaaatcgcggaatgttgcgcatgttacatacagctggtagcaagagccacgctcgtgttggccatgacatggtaacataagtatatcatgttagttcattagatgtatgacttacaaagctttgtgtactctaacttcttgttttagggtgtgaaaactgggcgtcctcctagaagggatgaagtctttgttgaaacgcacaaacgaaaaaatggagaaattattccagaggctgcagaaacagttgtatgctttcattttctaaaacagatttcatgtgaagaatactacttgctaatatgtttttccaacattataggaaatgctaaaagaggctgcagaagttaacccagagttgaagaacaaaacaatccaggagggcgatttgtattcacgtgtttgtggaactaaggaaccaagaggccgtgttcgtgttttaggaaagggaccaactcctcaggatgtgggcacaccaggaacacgtagcagaatgccaacaagacttcagctagaaatagaatctcatcgacagaccaaacaagaagttgtatgtctgaataaacgcatggacgacatgcaacaacgttttaacataatggagcatatggttatgtctcaaggtgtgcagaatatagaaacaagttcccatcatgcttctaattctcgacatgctgaggtaaagtgccttgcctatctagatttatctatttgatttcatgttatttggaaatatgtgttgtatttattgcctacaaaagcttatgtcattatgttgatttggttgtagagcccaaggagtccagtacttgaagagctgcatcctaatgagcctaccaataggcacttgctggaggagcctcatgctgagcctaccagtaggcacttggataatatcctatcgggtgatgactttattatccgcaaaaaagctataacgccaagggtgccctcaagaaacacagccacaggaagccatgaagccaccattgctgaaggagaaaatcttgtaatttttctcatccttctaaacctagcttttatttaagtcatttaaatgctattggtattaattggtcaacatactgaactgaattgtgtcctttaggttggtaaagatgttatcttatatgctgtcttgagatctgacacccctgtggctaaagcaacaattgtatcaattgatccaagttccttggtgggaggtcaacctctaggtgttgaattctatgaagttgttgtcaatgtcgtgcttaaaagagatgcattgcttcctcgtccatatgatgatatgcaaactatggctgatgctcagtacacatccattgcatggccaaacaatagggtaaaaatctgctgtcaaatccttactacgtgcttattgtttctatttttgttgtaatggcttgccatcaaatactaactgtatgctattttcacctttcattttggcagttgaatgttagcaagaggtctgctatgtccaaaagtgctaactccaaaagtgcaggtatttacttccagtgtttacttcccaatagatgaactgagttgttagtaataacctatgcatttcagaatacttggactgcttgttagtaataaccctcacttgttaaacatttctgcatggttcaaatcctctagtgcaaggttcaaatcctcgagtaaagcaatgtgtttgtgtacaactaactagtacagactattgcaagaatagttaaacttcttttttagttttgaatataatgttagagtacctgagaaatatggattatgattgacctaaaatagatttggaagattgtcctgatttgcacctattatgactcctttcagtcatgggagctttttccaccttattaacttcgtaaggattattttgcaggggttgtttagtctggataacaaaatgctggctgcaaagggagtattttggtcaaatggtggctgatgaaaattaccaacttagggtagtgcacttttagaaaccatgtaacttgtatgccttttgtagtaaacactgcttgtcccttgatcgtttcaacaactgatgttagaagcatgtaagcttttggagtaatgacttgtagttgacatgaacctgtgacaacaaactgatgttagaagcatgtgaacttttggagtaatgactcgtagttgacatgaacctatgacagggcagcaatatacatgttgatgtaatcttcggggctaatgtctggaatttggtgtctacttccactcttttgctagttgcaattatcagtaatttgctattgaattggaatgtgaaaagttggttgtattcttgcatgtcggcagaagcatattaaccacagattatatgtgggcatgtgatgtgtgcggcgtctgtggacaaaactttgtctgtcggtagaactaaaataataacgtcaaactgtctgtcggtagaagttctatttgtcggtaatgccttatcccgacaggctttccaccgacacaccctctctgtcgccaaaggcctttgccgacagactatttgatgataaaggtggtcttcgccgacagattaattgttgccaattttgggacatggtgtagtgtacatgggtaatagtgtacataacatcgtcatgtaaatatatatatttttaaggggatatcccaaggcaaccgcctatgcgcatcgtgttattatgagcggccacttaagccagccacctgggtagattgaaatgattttcatgggtggctgctgttagctgtcccccacagtatttgtttacatgggcagctacttaaagcaacatttttttttattcttgtctgcccatgaaattaagggggaggggcctttgaaaatcgtttttctactattggttgcaagggtttcaaaaaaatacccatgtaaatgggttacatactgcttgtacacatgttttctgtaccggtgcaaacaaaaattaaacttgagaaaaaagtctaattcaatattgggcctttataggtacaaataaagatcctcaattgtgagattgtgggtttaaaactagttcctttaaaaattaaacatgaacaaaagtcaattctatgctatgctgattatcgatccatgcaaacaaataggaaatacaatgtcctaaaacctttataaaatatataaagtcatgggcttgatcttgagacatgtaaattctatatatttttttccagctcgtctgtttgccaatttccatatatttgggagttcagtggtcatctgtacaattatgtgttctcaatcattggccgttgtttctcctaactcactgatccttttttccgccaatattgcctgcaataatcttccttcattaatccatatgaagctaatttccatgtaaacaaataaactttcatttattaagtatggtacctgtgcctcccactttgttctcatgataatgaaaaatagtatggccatctggagtaatgttcctgtcaacatgcccatccatatcccctggaaagttgaagaaacatatagtcgtacttaatagaagtgctgatcaatggggctaagacaggagtacagcgagaaacatcgtaccaatgcaccaagctttagcttgaagccaaagagaaccccaaatgggatccctaccaagtagtagcaaccgatgttcacaaatgccaccagaatttgccaacctgctcctactgccacacctgcaaatttagttgcatagttgctcaaatttgttggtgttcatgcatgttcaggagcagcaacacaagagttcagttcttgagcttttttttttcttcttcttaataagttaaatacctgaaagcacaggcccgatattgccaaaaaagacggtgacagcaagtagataccccaatcttgcagctccgtctaccacctccttgtcgtcgctgaagaggcttggcaagcttgttctccaaatgaagaagattgacatgaaaatggcaccaatcatggccgatgttaatgatgccactgccactgagaactttgcctcctttggtcttctcgcaccgagctcatttgatactctgacgctgatgatgtagaaaaaaattggttcaaatatttttcatcgtgctctttgaaattcaaaactattgcataaaaagaaataaaattgacacaccaagccaagtaaaagtatttattaattactagcaaaaatgcatatgcgttacaacatgtgaagataattttcacgatcgataaaaactctaccaatttaaacgacaaaccgaaataagacaaacaaaacaatagcaaaaaaaagtcagaaatcacgtatagcattgaacccggttgcactcgattcatgtattctcacacaaagaatctcttatatagactattccatagcctcataaatcgattaggtgtctatactataaggttatgcatgggtatttttctatacctcgtcaaccaaatattgaaattttgattatttaattagtgaacgttgttttactgcagaaagaaagcatttgcaaaataacaaacttgccgcatacacaacttaaacaataattcaaaaggaaaatatttatgaggatcctcaaagactgggccggcaaattctgtagagattgacgaagtcttagtgaacgttgttttactgtagaaggaaagcatttgcgaaataacaaacttgccgcatacacaacttaaacaataattcaaaaggaaaatatttatgaggatcctcgaagactgggccgacaaattctatagagattgacgaagtcaccacagacgcctcggtgtcgacgggtacgtcgcttaccactgaaagcacaatgccgtaaaatcctagaaaattcgctcccatggggagtcaaacccaagacctcaagtgctactgaggctcttgtaaccactaagctataggccctttcgctatgaggagagaaattggaagagaaaaggaggagaaaaaagaggtgattagaaggagagggagaggatgaggatgattgggagaaaaggaaatgagaaagaaaacgggaaaaaagggagaggaaaaaaaagacgttgatcaagggagcgtccagcgtcgagtgaaggagcgtgggacagggtggcagaatgttgtaggctagttggattgggccaggagcaggaaggattgggctagaacagtagtgtataatagttattttagactcacgttaaattggattcaggtgacgtacaagcaactcaaatacggatgacataccaaaattccgacgaaactatattcaatttttataatagttaagatataatttattccgtcaagaacaaactatacttattattcacacaatatgcaacttttaattagcgttctaaaactattaaattaaggggaaaataaaataatgaaaaaactttcagaatgattttataggtaattttgaagccataaactaattgtctttttttgcggggaagccataaagtaattcgaaagtatgcaactgttaatagacttaaaatgacttattgtgaaaataaaaaatattatttaagcaattaagagtatcaccattcatctgtgcatgaatagttcgattaagtaatatcttaaaaaaggagaactatgatatccttatatatataataatctgctaaacttttgtatgtaatatcgatagcatgtgcaaatatataatacgagttaatggccattattgtgtatgtacctgattgcttcgctgaagcccatcgcaaccatcatggtccagaactggtaattgatgctgtaaattaaaatatcactcttgtttttatagaaataaaaaaaatcagttatagccaaagcttgcatttgtgtttgcaggagggctttgtaaattaacaacacttaccaaattgacatgatatcaagctggagtctggcattcttaaggagacccacaagaatgagtagtgcagcgtagtaccaaaactccaagcttaataaattaaaaaaacagtatcattaaattatttgtatcataatttccttataataataattaataacaataaaaatagtaaaaaaattacaataataataatgacatatggcaaattattaattactagtagagtaataaaattttgagcgaaaaactttcagaaataactataggataattgaactataattacaatacaactaaactgtactttcactgaactacatgtaactataatataatttatatataaattatatttaattatatagtttggttggttagcactgggatattacgcgtgatatgtgtgaaaatttctttgtagcaatttttctcttcatgcacaaatctttagatgattcgctaccaattagaaagttttaggggaaagaaacttgccaaggttttttttagcaattccgtaaacaaatccgaggcgaagggttgaattaattgttaccgaccagatcatgatggccgacacaagtgacagcttgacgaacgcggcgaggttgctgaacgccgtcatggtgaaccccttccacgcgtccgggaagcggccggagacaaggtagacgaactgcgcggcgtcgatgagccagtaggacaggttgccggcgacggccgcaccgcgcaggccgtaccggagcctgaccacggcggcgtaggtgagcgcggcgtgcacggcgagcaccgcggcggagatggcggcgagcgcccagaccctgctctgcgtctggaagaacttctggagcgggaagttggcggcgtgcgcgaacagccgcggcagcgaccacagcgcgtacggccccgccacggcggcgacgtcggccggctgccggaggagcgaccgcaggatcggctcggcgaaggcgtacgtcggcgtgagcgccaccgcggtggcgccgcacacgatccacgactgctgcacgtagaggccgagcacgtccagccgcccggcgcccaccgcctgcccgcacagcgtgtccagcgcgcaccccatgccaaactgccatggacgcgcatctcacgtcatcggtaccgtccgcgacggctagcggcggcggccggccggaatgaacaatgccgaaagaaagctcgaggctacgtaccaggacgccgtaggcgaagccctccaggatgctctcgacggcggtgaccgcggcgagctcgaccacgccgaggtggccgacgaagctggccgtgacgaagccgatggagaactggagcaactcgacgagcacggccgggaaggcgacgcgccacagcagcttcgactcctgccagctccggctcacaagaccttgcccctccatgctcaccgtaccacgtataccaccactattatttacagctttaccaccatctgcatcttgcaacaaacaaggagagcatgtgatgagtttgttgggaaatggccgtggtcctagctagcttccgcagacaaattattgtcagataatggataaaatatcataggaagattatcagaaacagtaagaggtttgcagctcatcttccagcagagcatattgaatgaccattttatagcatgggccaccgaaaactggacagcaccggatgataatgctaaatgcaacgccctttcattttataactaatttactagattaccccgcgttgctccggaattgtactatgatcgatggatcgatggtttaagtaccaactgaaaaggagttacataatcacgacgaaattaaagcaaattggtatcaatcaaattggtgcaaaccatgaatctccaagaacagaaagatgaaaggcagatttagtcgacaaataattatagcatacagtaactatgattgtgatactcgatgacgaaagaataaacataaaactacaaatgtaagtgcaaagagtaggaaaagtgatagacaaattatttaattaccttaatattgaatgccatattcttcgcgtggtcccttcatcaccttttgatagataagtctacgctcaaaaggatgaagtaaataagcctccttttacacataacatttagaaccatgctatatgtccgacttgtttgttcgaccggtgtacgactaaacgggaaatcagctgggcacgtaacgccgtgaggcaaagtcctgtagagatcgacgccatgcattcgctagtgttacggtcgtacaagagtcggacataatggtcagacgtatagcatttttgtaacatttagtggagccttaacaaacgattagcagtagcgctaaataagatactccctatgtaattataaaggaagtcgttttagacaacgatacggtctccaaaacacaattttgatttcttgtttctataaaaatatttattgaaaagtgatatatgtatacctttatgaaagtatttttcaagacaagtctattcatataatttttatattttcaaactcaatatttattgaaaagtgatatatgtatacttttatgaaagtatttttcaagagaaatctattcatataatttttacattttcaaactgaacaacttgagagttattcatgatttatattcccaaggtttgacttaaacatgatcctaaacgacttcctttacgagtacggaaggagtatggtcattgagttcttagttaaatctatataaataaatatagctttgtttgcctttgagctgccatataagattataagtgtgcacgggcagatatagcgtgagtgctgggtgttcaagcccccatcacgctggatcactattgatatagaaggagaagggaggaggaagaagtgtgtgtataatatttatcacagtagtacatgacctcaacaagtcatgaatggccaaatatcccaaaggttcaggataagttagtagttatatgaggaaatcccatgtatacctctaaaactttgcctaatctcttgtatgtccctgattttactaattcctttgcatacctcaatatttagtttggatcacttccatacctttttattagttggccatatttttttcctgtgtacggagaatcatatacatttataaagtatattatgggaatattgatattcattgtatgcgactcttatatttatgggatatattatttacgaaaaaatttatctttacatatggcataaaaggaataatatttacttttaattattaaaaatgtatatgtagcattttttctatgatagcagtgtataggtcaaatctatttatatgctacataaacatttttttaataactaataaataaatattatttatgtcatatctagagataatcttttcataaaaaatatctcccataacaaactcataatataatagtcttatacaataaatttctaccctctaacaatatactttacaaatttatatgtttctttatactaaagggcaaggtacacttttttataggaatttaacgattaaatcacggtcaactaatgaaaaggatatgaaagggatccaaactaaaattcggggttacatatggggaatgagcaaaatttaagagcatataattgattaggattaggtaaaatttcaagggtatatagggatgcatagacaaaattgcaacaatctgtatatatcaatcattctttttagaaaagagaccaacaaaatttatctagcttgtgtatgagagagagtgtgagaaatcacctgccaagagacatatgggaatgttttatcccgtagcaataaaatatgacagaccaagactctttccttcaatcatatatatgaggggcaatttctctcccaaatatgattgctgagcatacaataaaattgtaaattgaacaggtgatgtcgatcaagcggtaggtgtctcacaatctttgaggtgatgttgatcaatattaggtggcctaacagaagctcccctgatctctcgcaaaaaaggaaaaaaggaagctcctgtgatcgttgtgtggatgaccaaaaagcattaaaacatatatagtggagtcggcagtttcattgcacattatttggccagaattacttgatattaattgaaagcaaaacggcaatgctattgtgcgtttgggtgtcatttacttgatattaataggaagtagcaatgccaatgtgcaattaaaggaagtgtttcattttccaagtgaccaaaggtaggcagcggccaggaatcctaattcgcgagctatacaacctagtcatctcgcatgcggcttcccgaccatgtgacgacaagcatcggggtagggttagggtttcgggagtagggtgggggagggtgtcgctgggaaggggaagtgcgggatcgggttagagcgatgatggtttgagaagcggtggaccgatggtagatggcaaacaagagcgggctgcgcagcggcgatggtgccactagagctgtggggatggcaacgtgcagtgggccagccaagggcaaagcgaggtgaaggggagggagaggaggctgaccagacaaggccacatcggcacgttgatgcctttcggtgctggcgaggctcagtgcctgcgtggttggtgtcggcgacgaagaaaaggagctgacctaattgctggagggaggatgagggggctcgccggagaggtcttcgttgtcgtcgtcggcggaggaaggccactcgtctacatctcctcttctccatcggaagaagctcgccggaggaaggaggaggtgcgacttgcacccctggtgcgaatgcccgaattaggaagctccgatagtggcaaagcttagttgtcattccatagattccatagattggccaatgcaatagtgggctattgttggataggatctggtggcctcctcgtatgcacatgcgtatgaagaaacatgtgagccaattttgtggcccgatcttcacgatggaccaaaacacttgatataattgttatcaccacgtgacatgacaaaaaggcaatgcaccacgagattttgcacacgggacgaactacaaaggcagtcgcccttccaagtaccgatgaaactagcccacacaatcatgtcgtatagacgtgagatgaacagatgaaccgcagttcaacattctacaactccctcaagaatcaaaagaacaaagcttgtaaatccctctagactcactataattcaatttttataagtgttcagttctgaaatcagaatgcaaacttctctgtacttagctatttaagtgatggtccataggcgttatccaagaaactgacatgcatgttctggacatgtccacgcatgcaagtggtgatgagaaagataattaagacataacgtttattctgatttattaactccatgtaacagccacagtgctaaatggacttcattagatgttggcttctctccttcacatgttgaatgcctttgaataatccatcatttatgagaattataaaacacacgaatgaaagcacaatattttctaaaacatcggtattaagtaaactagaggatgccccgcgcgttgctgcgggacttggttaacatcaatttgttagataggaggtataatcttaagaagaaacagaagaaacaaatagctttcttggagaaattatttttagcagccctatccaaaatttgtagataatttaggtagcacatgtcaactgaaggggcgttcagtcataaagctcttttatacggattaacgggcttgatacatgtagatgtgtacggagatgggccaatgtgttcatgtgggctacatgtcactgaggaggcgaagagactcacccggtgactaatgggttgggctctatgctgcatagcatccaacgtctgagaagcgatctaatgcattcatccaacggttcacaatttgatgatgacgtggaagcacgagttttaaacttttggccttaactttatagaaagaaggaataaatattaggtcactgtgtttgcattttcttctctagtttctatacatgcttctaataattggaccaacaatgtcaacaacacttgtattagatttagatattgtatatgcattagacatttcctcattacctcccatataggtgttcagatatggaccacgctcaagaagcggtttgagaagtcaaagtacaccatcctaccccaagaaaatcagcagagagctcgcttgaggctcgccgactacaactctaccttgcacctgatctgtacctacctctccctttgtggaaaagtagtcacaaaattggacaagattgagaagatgctctccaccttccaccctaacgtaacgcagagctctcgtaactataggcatgtagcatacaagaagtttgatgggatgatcgacatcatataggtgtccaagtctcatcacaaggttctccacgagaactttgtctcctaggcacttggcaagagcattggccttgatgtcaatgctagcagttacaaggtctgcaagcccatccaaaagaagaggggcaagcaaggtgggagaaaggcagccgagaaggcataggaaagagctccagatgcctagagacgcaacgacaagcaggaaaccaagccgcccgcaatgacaagtcatacgacccgcaggaccagacatgctacaagtgtggcacagggctactggaaccgtatctgtgaggagccctattgatagtcgttatcgatcagtttcgcccgtcaatatcaccaaaataaaagagaactagttatgcttgcaatgcatatttgtgttagaataagttgttttccactagcactaggattctaacctcttgcagagaatacaatacaaaatggaggagaatcgacagcaaagcagacgataaatcaatcggacattgtcgagaataagacttatcgaaagatgggccaagaactcagaaatgacacaaccaaactggaccaaaattcaaaagtctgcggagagaagaagtcaaataggctgccagcagataatggataggattgggccagcccatggttcggccgaacccccaccagcgtcgttggatgcagggcttagcgtggacgtctaggattacatcccaatgacggttggagagcatttccgaccattccaatcgtcataaccgtcattgggaggctatttaaggagctctcatccttcactcttccacacactcaggcaat

SEQ ID NO: 80868 - DNA, 1069 bp, Oryza sativa
tagtcttcaaaactaatatctgacttcaaattactcgtatgctataatatttctagcaataaaattataatcatataaaagtaaatttacatgacatgatattattttcatcaaataaaacttaatctataataaaatatttattgatcaaatatttaaagagttgaattttaaaacgcgtgcgcaccatagtgagtgggacggaggaagtatatatttattaacaaattttatcctaaatattttatggatgtaattatagtacaatctagtgtaattacattgtaacttatatgtaattaaaatataacttgtatgtaactttcacataattttgaatcattagatttgttttaagatttgtgcaagcaagcaagaaaagaatcaaagcgcgcgcacacaagagaggattaagtctcacgacgtttgctttacggaaatagcatgttacaaagcgatttttagttatattgtagttacaacgtaattatattataattgtactataataatatctatcaaatttatggaggaaaatttatcaataaatgtatatgtagtctcaaatcctttattagaagtttgactgcttagtaagctttctctcttcattgaattgcttcaaacaatgaaaaatggtacggttagttctattaaattttaagagagtgacaccttttactactcgtcttcaaatatacttcgcgttgaagatgtactccctccgttttacaatgtaagtcattctagcatttctcacattcatattgatgctaatgaatctagacatatatacctatctatattcattagtatcaatatgaatgtgggaaatgctagaatgacttacattgtgaaacagaggaagtattatttaagataaaataagctttattaatctgagacaacgacacgtaaatgctacaattaatttaagaccactctcgaccttgtatagtgagtgtgtacacaacctggaagtattgagaaaaaacggaaagaaatatgaaaaagaatgtcatgacaatgaatatcatgtcgctgccaactataaagatgaccttcaact

SEQ ID NO: 80869 - DNA, 1528 bp, Oryza sativa
tcattaatcctttcccttctcctctgttaagatggtcagaaacgccgtcagaaaaaatacttcagattcaaacattagacaaattaataacacaattaggtcctaaccttagcatagaggctttgtgtatccttggagcactgcttatggcctcttgaattgtcactttgtttcagcactacagatccatcagttgcagcaattgaatcctctccgacgctgctcccggaggaacagctaggattgacaagttcagagctagtctcatagtcagtaatggttgaactacttgatacctaaaataaaatgaattttagtcattacaacagtttaagcatgaaccaaaattctcatgccaaattgacctaccgagcgagaagttcgggttttcttcttcggcttcttctgctgctgctcaaagtgctcatccatggggaacatcctcttgttcccagtgatgacctgatgctgatgatcagaacacatatccatgccagtgctaaccatcaattgcactgtgccaaatccctcatcatccatcagaggaagaaacagctgctaggcattgtgctagttgtgacacaagaatttacactactgtcaggagaataaaagttgatttcagcatcagtgctgctccagaacatggactttagttgatcaatcatctcagattcctcactccttgcatcagcagagctccagatgtttgcacaccttgcatccatcctattgatctgaaacttccaagctctaatttgtgatcttttgaaaagagttgtaatgtgtgatctcttggaattgtttctgtgagcactgtgcaggtaggggcacaaatttatactatgtttccagagaatcatctgcagatataaatttgactaaggttccatcataatcttatctttatgtacaaatgacaactaagagctagtactttatatcgcaagttccatgacccataccctcaggatcttcaaatgatagaaagattatatggggaatcgattgcccattgagaaatctaaagaggcatgctatatagacttttggttgaggtgagagggaggaaaaagaaaaacaactaacaaggttaattatatgataacattaaatgattcatatgatcggcaattaagtcgcaagatcaatagccgataatacgacacaaaaaaacatcaacaccacttataagaaaataataagagctggccacaaataagaaatttggagggaggtgatcatggagaagaagtgctggcaatgttataaataaaataggacacaactgatatcaaactcagtttggcagcttcacattttctttcttggtgacttaaagaggatagtgaagaacagtatggcatgccataccctttgctataataatgtacataagtaactaatcctagttgtgcaattcagtaattcacattgtgcaagtctatctacatactgaattgaaatgctatgtgaacaaataaggtgaagccatgaatatgatgtcacttaatggttctttattctg

SEQ ID NO: 80870 - DNA, 535 bp, Oryza sativa
catcagccatgttaatctcagtgattatctccaacaccagcaactctatccgcatgcatcaggtggccggcatctgcatgcgtcgcacttatctgcagtagcagatcgatgaggccaaaacagattatgcgttatcacgctcgattcgcggaggattagcgaggccgttgtggtcgtcgctgcctatataaagcagttgacccctcgtcgcggctggggggaagaagaggaacacacggcacaagtgctgcgccattaagcagcaatatgccctagagaggttcacacatgcacccacgtatattcagagagagatcagaaagaagatgcacgcccatggcgcaagtcgcggatcagcgatctgcagtcgccggtgctgatggcatctctatcggtgagtcctcaacaagaagccgatcccgttctccgtcaagctgcttatccaagataacacaacaacgtcgttgtgctgtgcagatattatgcatagccaggcattatctcctagagggagcaaatatacaccgtagtgttg

SEQ ID NO: 80871 - DNA, 621 bp, Oryza sativa
cgaattcgagctcggtacccataagaatacttgtgtttagacataatgggttaattaaatactagagttgttgaccattgattagccactttttcaagcctatccctacatgtcagtcaattgttgtatcataaccttaatctatatgttgatgcttccgcgatgttttcttgtctaagatagttgttgccgaaatttgcttgttttggcacttatgtgtggttgtttagtggcatcccaggcttatgtggttttctggggtgttacattctctctggtcagcaacaaatttaaggtattttttattaatatttctccattaaaatgaatctgcagggttcttaagcataccattaacccttcgatccgtggcatgctgttcatgtgaaaacacggcggcctaggggattttcttaactccagtgcaagtccaaggctagcctcaagtgtatcaagggcgtgccaactgatttgatcctgcaatcagcaagaaagagaaaagcagagttagtcagccgatagccgatcggccgatagcgtatcgttggtggtctctaccgatggagttagaccaaatcggctatagactggatatattaaagaatattaaaccctaaatat

SEQ ID NO: 80872 - DNA, 719 bp, Oryza sativa
ccccgaggagtcctaaccctacggagcgacatcaagcaagctgtcacatgcgacaaggagagttgcgacatggcccaaacccgcgagatggcgtctgcccgagaggaaatccgactggctgcaaccacggcgagcgaaggagaagtgcccgctgccaagatttcaaaaagtggggaaaccgaagccgagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggaattgaccaagctgttagcagcaggcttcatcaaagaagtccttcatcccgactggctggctaacccagtcctagttcggaagaaaacagggcaatggcgcatgtgtgttgattacactgatcttaacaaatcttgccctaaagatcctttcgggttgcctcgcattgaccaggtagttgactcaaccgccggctgcgagcttctcagttttttggattgctactcggggtatcatcagatccgactgaaggaatccgactgcttgaagacttc

SEQ ID NO: 80873 - DNA, 612 bp, Oryza sativa
tgcacatgatttgaaaaatagatcttctcttgcttgtagttttgctttgcacacacgcactttggatgagttgtttttaactaaaaagttgttgcaaaaatatcaaattgcttttcatgctagtttgatgtttaatatgatttctgctaaaaagttaaaacaacctcatgatgttttggattgctcaacatgtaatttgaataagatgaaactaaaagatgctttaggtcgtgttgagtacatggaagatgttgtgaaaaacaatgaagtgctttcttgccccaaatgtcgtaaaagcaaaggtgtcatggtagattgtgaaaattgtgctaatttggaaaaagaggtttcttatttgaaaaattctttgctaagattttctgatggtaaaaagaacctcaacatgatttggatcaatcaaaggttagcacacataatcgtggtttaggttttgatccttatgctcataattctagacatcctcctgttgtgttagatgttggtgctagaagtggtgagattttgattaaacatgatactaataaaactgtgtttaaatctgctggtatcatgtctaccatgaatgcatcttcttcaaaatcaatgttggca

SEQ ID NO: 80874 - DNA, 922 bp, Oryza sativa
taaatatgtcttttttccctgagaattaacggtcaacacacagtcaactgacgggagtggcatgagagggtgtgcaaatttggatcaaaggcatataagggaagagccaattttcaatggcatataagggatcaaaccaattttcagtggcatataagggattctctcttttaattaaccaacaccggaacggtggcaataaccaacatcattagtagaatctgatacctatgcattaatgtagtccaccattgtgtgctagttgaactaagcaaggctaggaacttcctaatccaacagcgaatcattttacaaccccaagctaacaaaggagcgaggtacaaaaatagcatggctgtaacagtaggtaaatatcccatagtaacaatttaaaacaatgcagtatttaagggaaaacggtagagcatttgcaacataggttcaatatgttcaagtgataagcatgacttgccttgctctgctgctggaggagcctcggcgactatttcaaaatacaccggagcgttgggagagccggaatctaagcgacatacaaagcaaacaatacaaacaggccataatactactgaaacagagaacaaaaccatttttaatggattctatgcatttttcttaatttactgagacttgaatgggcttaaacggagctcggatgaattttctatgaattttagaagattcactgtgttttactataaagagaaaaaccttaattatttattgcgcaatatatcccagggctgacgtcatcaaggagggggcggcgccgacatgcgggacccccgggtcagtgacttcgagagagagggaaggggccccggcacttcgccccacttgcaaaggcacaaagcgggagggacccggttggtggctccgctcggcttcaaaacccgccggccca

SEQ ID NO: 80875 - DNA, 1043 bp, Oryza sativa
aaattcttgcttcaccttatctgcctttgtgactcctgagtcgtcttccttttcatagtaatcaaaccatgaggttgctggacggctgctgatgattacaccattctcatccttctcttcaataatgccagggtattctcgtttaagaataattcccatatgtgtaccatatttggggtctgatttcaatagagggtatgttacgtactcaaattgcctaaagaaaacacccatgtgagaattgttccattaagaggagaaaaacatagacaacacatgtacagagcttttgtatacatacacatattagatttgaagaacttgtatgctactcaatttatcacgtcacaaacatatcggctttgaacaatataaattctacagaacagaaataaagacagcctctaatttattggagcagttaacaaagtaataagcattagtagaaaatctgtagggttctagaaatgcagatacttactcatcaccccgaggtttcagcgcgatctttcgaccccgcggaggtacttttagtgcagttcttgagcccttcttcctccctcttttatttggtggcgcactgctcatgccacttccagcaatattggtggcttgggaggcattatcagtattgctactattaccagcacaaagtctttgggaggagttagcaccggagttactactgccacctccattaatcatttccgggactctgttttttgcattagtagcactagcattgctccttgtagagatgttcctgcattgttgctgtcttgcaagccgcttccgatcaatgccgttcatttcttgcaatgttatatccatttattagttttagaagagcaccatcggtccataaaaaaagaagaataatagcatatattttcatagcatggaatcattcaaacaaataataatccatcagtgcttaatataaaacctttataaagtacaaaatgaccttaggtacttaaagcttaaaaagtcatatgaaagttggcagctgcattaatataatttacagaccccaaaatcca

SEQ ID NO: 80876 - DNA, 632 bp, Oryza sativa
attatttttttattcttacaactgggtcataaacttactactaccacttctacaatgcttattgccagtcataggaataatttattgcctaataccttctttttcttaacatcgtggacgcccttatggattctaaattaaatggttttggtctaacgccaaaattccaactagtctgacttagaccttggatcttgtaatagtgtcataggctaagccaagggtggacaccctaaggctaaccctaggatatcccagtagccgtcacagtttagagtcgggttttagttagattatttctaccagtgtagtttcgtcggtagtttggttcgtggaccccaactttgagatcttaatcattcatctccaaattaagttgtaatctaccttattcttgtattcttcgatttgcatgcagggattggccttctcggttataaggtcacctgggcaatgcatggttgataaccttaggagacgtggtattgcaatagtagtgttcggattgtgtattaatcataagtcgaatcatgtgtatcaagtttttaccaaattgatagttatcaatgcctatcgaaaattcgggacctagtttttcatcaacgtcaacatgagtaaagcctttacttcta

SEQ ID NO: 80877 - DNA, 1017 bp, Oryza sativa
gatgttggtgctagaagtggtgagattttgattaaacatgatactaataaaactgtgtttaaatctgctggtatcatgtctaccatgaatgcatcttcttcaaaatccaatgttgtgcatgcaaaacctcctgtttctacttgtgttgctaaatcttcttcctctaacaatgtgtctaaacaacgtgaaaaatatacttgttctttttgtggcaaagatggacatattgttgatttttgtttcagattagctcataaacagaaaaaggagagagagattgcttttgcaaaatcaaagtggcaaaaatcgggttttctctcgaggaaaccggtcagaccgtagtgggtcccgcggtcggaccggcgaccggtcagactggctgaacagcctcggtcagaccgagcaccggtcagaccggcggtacagaggcggtcagaccggtccccggtcagaccggccactgtacctcggtcagaccggcctcggaggaatttttctgaaaattctaaaattgattttgcatgtggatttatgcctattggatcttctggtcgtgtgtctcattactggattcctaaatttttattatcatctaaccccagtactgaggcttcgacttctgcttgtgtgtaggctttggtggcaaggaaggagaacgtgtggatcgtggattccggttgttcgcggcacatgaccggtgataaaaattggttctcctccctaaagaaggcatctaagattgaatcgatcatctttggtgatgctgctacaagtgccgttctcgctacaggtatggttaaggtaaatgaaaaatttgaattgaagaatgtagctttggttgaggacttaaagtacaatttgctttcagtttctcaaattgttgatgaaaatttaggttcactttaaaaaactggaagtaaagtttttgattcttgtggtaattctgtgttgaatatttctcgctatggaagagtgtttaaagctgattttgaaaatcctgtttcacctgtgataaca

SEQ ID NO: 80878 - DNA, 1642 bp, Oryza sativa
atactatacgtatgtaatactattgtttactgctaatgagtcaagttggagatagcttggtctcggaatatggtttctttgtttgttccatgtgtaggtgactcgatgtctcgagagagtatttgcggtaatggactgggagtcggcttggggataaaacgacgtccgtggtggtcagagatcatgcgggatacttaggctagagttgatgcacgtggttgatggagattctatatggcataccatggaggaattgtgtgctatgggatgcggagtcgaatttggaaggagtccaaatttggtactattggttatgtaaagttttttcttgtaataatgggtttcctaaggtgtttaggactcctagtatgagtttggttcgtggctttaggctgcctacctcatatataaatagagggggagcgtgaggcttcccggtatcgctttagagagcaatagagttgagttttgagttagggttttgagtttagtcgaaatttttgtgaggagtgctgttggtgcactttgtaaatacagagagaatcaataaagtcgtcatccactttaagagttcttcgatttgtgtttatcgggtttcggcggtctaaccggcgatctaccggtggtcagactggcagcataagggcggtcagaccggcggcagcagcaggcacggcaggcgacttcagcggtcagaccggtgaatctataccggtcagaccggtggcatccgagcggttagaccggcagatcaatctcggtcagactgatctccgtcgatttcgagggtaacttttatttccgctaaaagtttttcgtttttgggtataccaaccattcaccccccctctggttggcttagttcttgtgattcgatcctacaagtggtatcagagtcttgttttcttctttggatttttatcaatctagagtttttgccatggctactcccgctcgtttctcaactgagcctcatgttttcgatggaacagatttttctcattggtgtagtaggatgcaatcttacattatggctgaagattatgatatttggagaaatgtttctcatgcttatcagattcctgaagctattaatactgctgctgaaaaaactgcttttgaacaaaattgtaaagctcgcaacattcttttgagtagtatttctcgttctgattatgatcgtgttgcgcatcttcaaactgctcatgagatttgggttgctttaagtaattttcattaaggaacaaataatatcaaagagcttcgtcgagatattttcaaaaaggagtatattaaatttgaggtgaaacctggagaagctttggatgattatctttttcggtttaataaaattttgagtgattttagatctgttgattcttcttatgatgctaatgatcaacaatctgagatttctcgtcactttttgaatgatctcgacatgtctatttgggagatgaaagttacatctattcaggagtctgtaaacatgtctactttgactttagattcactttatactaaattgaaaactcatgagatgaatgttctttcttgaaaagttgattctaaatctagtgctttggtttcttcttcttcttctttggatgttgatgcttcttcatctaagtcttcttttctt

SEQ ID NO: 80879 - DNA, 1918 bp, Oryza sativa
tttaaagtgcctctataaagtgtctctacactataaaacttctgattttagaagcaatttgcaaaacgtctctacaaaagtgcctctatacgaggtttttgttgtagtggatggatggtcccaacaagtgtaaaatacggaaagaagtccataaaaaaatacggcccatatggaatccaattcatgggacattattttggggaagcaaaggtcccacatatttggaaaaaaaagggggaaaaatccggtccatatgtgatgcgtcaacctaccctttagcagaagcctgataagataaatgttcttgagatcaccaaacttcactattgcaccagtgagaaggaaatggtaaatttattgcatatccaaaaaaattacccctgctctgccctcacattatatttcctctagcttcttacatttttttttgacgaagtcaatatatatatgctcctatatatgcatggtagaagagcaaagaaaaaacagttaataataccgagcaaattgctaccacgggtaaagcttttatatatatatatatatatatatatgcattttcgctcttctgccatggcaaacacttggagaaactgaaggctatagttaattttatttaaactactcgcatatactaccatggttggatttctacccattatcaagaaatccacttgcatatacatgcgggggaagatgagacaggaggatgagaatgagaggcaaggaggaaaaatgaagtgcaacagaagctaatgcgtcgagcaaacctatgcaatattcagcaatgataagcatctcatgctgttgataattggagaaatgcacctaatgttatctttactgcagttcgaggtgcctctaaagttggtctaatttccccatggcagcaagacgaaagttgtactgccctgcaggcatctccagaaatatttttattctaaccgaagaaaacaaaacaagtggaaaattccaaagatgtacctctgtggaatctggtactaaagtgtgaaggaagagggtgggtggcaacgtcactggcagcggcgaggtggtgtgcgcggaggaggagcgggcctcggcaatggttgcctcccgggtcgccctgcagagagcgacacgggagtcttttcttctctttcaaatagtacttaattaggctgtgcatactcttttgtgatgaaaaattgtatagcataaaacatacacaccgttcaagatatattaatcatcactatagaaattgtgtatatagccacccaagtgtacgggactaactggatgaaagaataggcgagtcaggttgtaggtgttcacaaattaaatgctttcactatctagaaacaaatgaaaacgagttgttcttttaatttcccagctggtagaattaatagaccgacaaaagaaattctctccatgcatggccctaaagaaaatcacaccccaaatggcttccatgcaaatacctatatcagcccatgcgattgatttgcacacctgaatactacctccgtttattaatgtgtttttttaatatatgatgctattgactttttaattaacatttgatcattcgtcttatccaaaacttttgtgcaaatataaaaatatttaaatcatgctttaagaaagtttgatgataaatcaagtcataataaaataaataataattacataattttattgaatagtcatacgtatctcgaacagtgaacgccatcatatattaaaaaaaaaggaggcggtacatgagatatatatatatatatatatatatatatatatatatatatatatatatatatatatgtgtgtgtgtgtgtgtgtgtgtgtgtgtgtgtgtgtgtgtgtgtgtgtgtgtgtgtgtgtgtgtgtgtggttctccatataaccagcttactagctggtactatttgtt

SEQ ID NO: 80880 - DNA, 3517 bp, Oryza sativa
aagaaaggcttagtgacactatccacattagtatagaacacaaaaagtgtttagtttgcaccaattaatcgtttcacatggttaaaattttacttaacttgggccaaggctactgttagtaaagcaaaatttggttaacactgagaatggagttatgattgaattacagtgagaatgtgaagtacggcgttgatcatggtactgaaattatcgaccaagatttctgctgggttaaagaattttgttaaggtgccaaatggaatggcaaaataatcaatctaaaattacagtgtgttacttttgttgcataatatttttgagaattaattttccaatgagtttaagttgaaccaattattttttataattttcttagacactcaaatgaatatatgaatcctagtgcatataagagccaaaaacaattaaaataaggcatgcacatggagaggtgctgactttatttattgccacattttcatacacataatttactgggtacacctatagtggtatgttacaaatataaaagtacaagtgttttaacaacgataatacatgttttctaatgcaaacatgtatatttggaccaacgcttgtaattgggcagtgaatgcagcaagtttgcaaattatttatttaactgcattggttcaaacttgtgtaaacagagtagccctccaagatgtaaatcatcaagctactgactgatagctattacatatctaccggtaatggatggcgaatgactggaacaagcgaaagatcatggagccgtcgtgctattgcccccatctcctccttcatatcaaggttcccaagctccgtctcatcaggaagctcccagttgaaatggtacaagagacttgctagcacaagctccaagttcactagaccaaaagctattccaggacatatccgtcgacctactccgaacggcatgtacttgacatcggttccatagtaatcaatgttgacatgctcgaatctctctgggatgaactcttctgcttggtcccagtacatagggtccctacttatagcccacatgttaacgagtatcatagttccttggggcacatcgaatcctaatacctggcttgtggttcggctttctcgtaggagcaatggaagacctggagggtgcagccggagcccctccttgatgaccaagtgtaggtaacttagattttttagggcttcctctgtaactttgtgatgtttgccaagcgctcttcgaacctcgtcttgtgccttttgcatcactctcgggttcctaacgagctcagccataatccatttcagcgtcgtcgccgttgtctcgctgcccccattgaacaagtcctgtatgacacatagccgaattttcattttttgcttagtacatgaattttgaacttaattagcttggtaaattttatggttttaggatgcttactccgattgttgtcttgatgttatcagtggatagcgggaagtcaccttttctctggatcctcaggagtacgtcaaccaagtccaagtcctcctggtcatcggaggaagatctgttctcttggtgctccttgataatgatgtccaagaactcgtacacttcgtcgcgatgccgcctcatctggcgaggccttctactgatcagctcggcgaggcgcgacgatgggtaaagatctggcaagctcggcgtggcgaatagcttcacaccgcgctctagcagcatcaagaacttgtcccggtccttgaaccggctccctatcagggcgcgcatcgtcgagtcggccgagtaggccgaaatgagctcgctaaggttcacggcgcgccgcgccggcgaggccgccgccaccgcccggagcagccggccgacctcctcctcgcggatcggccggaaagactggacgcgcttggcgctgagcagctcgacggtgcagatcttgcggaggttcctccagctatccccgtagggcgtgaagacgatcccctgcgagtaggggcgtaagtggctaacccgcgaaacccgcttataaactaaaataagccgcgagcccgtttattttaacttataagtgagttcgcggctgacccatttacacccctacctgcgagccctcggggaagaccagctgcattactcgggtggaggggcgcgtcgcgaaggcgaggtcgtgcgtcctcatgacctcgcgcgcggcgtccaccgaggaggccaggatgacttggaggccgccgagccggagccgcacgagcggcccgtggcgcagcgcgatgttgcgcatggcgtgctgtggcgggagcgcgcccatgaggtggtgcaggtggccgatcaccgggagagcccacggagatggcgggagccggacgctaccgccatcgcgacgacgcatggaacggatgaggaagaagaagaagaaaggggcgatgaaaagcaagagaaccagtagctgttgggggaggtgaacaagctgatccgccatggcttgtgttgtcttgcaccagatcgatacaaagttgccaaaatttttgtatctaagcaaaagagagttcacttgcatttggtttgctcttgcagttcagcagcttggttgtttatatagtccattcttcaatagctcgatctgcaccatcaacttgttgggccacaatttggtttgatgctagagtttttaaaaaccacactttgcaaccacataatcgcacatggtaaatacttaattatttgcttgtgtcttgcctatgttgtggctcacaacttatattagaagccacaccgtacaaaattagtgggttattagcaagtaaaaaatagctacttccttaattattagtcgcccggttttcttttatatatgtaccagtatctaagtacacttctagcattcacgcacaaatgtcataacctacgcacacttacacaatctaaattaaggtttcaagtttaattaattattagtacaaatgatcgaagtgtaattttcagtttgcgttgttttttttttattttctgaataattatttaagcattattatcctgcttcatatatactgataagaacttatgccaatacacttttttaagttttaggacagaaccttctcgctccttcaccacgagataattacactacgccagatcctcacacctctgacggcatatctctgacgggcaaagaaaacggtcactgatgaaggtcacctttgacgggtcctacgggatgccgtcatcggtgagccatccggccgcggcccgtcacaggtaactagtcatctgtgacgggccggaagtggaaaccgtcgaaggtggtgtaaacctcacctatgacgggtttcattttcaacccgtcacaggtgattagtcacctgtgacggatcgcaacccggatggccgtcaaaggtgaagtaaggccggcttctccactacttctctcgattttctcccaacggggcccacacctagaggagataagaccggttctccacttctctcgattcttctctccctctccactcgctctccctctccctc

SEQ ID NO: 80881 - DNA, 1302 bp, Oryza sativa
ccccgagatggccgggattcgaattccaaatcctgcctctctctccacctccacctccccacgtcggccggcgaaatcgggccactcccggctgttctcgacctctccgcccctatataatccatccccacatcctcttcctcatttttcctttttccgccagcctctcccaagctctccaccgctcccgcaccgtgcacccatccgccgccgcctcttccactactccggccacctctagccaccgctagggcctccgccgcaccgcaccactgccaccgtcgggttcgcgtggtcgaggtccacctcgtccacccctcctccgtcaaagtccgccgccggagcccgcctctccccaagcgtcgatgagcatctccattaccatcgcctttggccggctatgctgtgcgccgtggactccctctctccctctaacctctctcatcgtgttccctatgtctctcccgacgctgcccgctgttcgccgacctccctccatcactagtcgccctcgttcatcgtcagtaaggccctccccttcctctcctttctctccgccgctcgccacttgtgcaccgccgtcgcgtcgcggtgccgtgtcgccacggtggcgccgctagccgcggtgccgtcgcgtgccgccgcttgccgtcggtcgccgccggttgccgtcgccggcgaccgcgcgtgccgctgccactcgccatgctgggccggccggttttgaagccgagccgagccaccagccgcgtccctcccgccttgtgcctctgcaagtggggccgacgtgccggcgccccctccctctctctcgagtcactgacccgggggtcccgcatgtcggcgccgccccctccttgatgacgtcagccctgggatatattgcgcaataaataattaaggtttttctctttatagtaaaacacagtgaatcttctaaaattcatagaaaattcatccgagctccgtttaagcccattcaagtcttagtaaatcaagaaaaaatgcatagaatctattaaaaatggttttgttctctgtttcagtagtcttatggcctgtttgtattgtttgctttgtatgtcgcttagattcctgctctcccaacgctccggtgtattttgaaatagtcgccgaggttcctccagcagcagagcaaggcaagtcatgcttgtcacttgaacatattgaacatatattgcaaatgctctaccgttttcccttaaatactgcattgttttaaattgttactatgggatatttacctactgttacagccatgctatttttgtgcctcgctcc

SEQ ID NO: 80882 - DNA, 14128 bp, Oryza sativa
gaaaccgtttggatggactctatctttagtaggctggagctatgccaaattggccttggaagttctgagtaagcttgcagtagacgacaggcaggtttaggctgtgttcggaacacagggttcccaacccaaactgttcgcacggaaaacgaacggtctattagtgcatgattaattaattatttgctatttttttttaaagaagtggatcaatatgattttttaagcaactttcgtataaaaactttttataaaaacacaccatttaatagtttgcaaagcgtgcgtatggaaaatgagaggggagtgttgggaactcgctctcgcaaactcagcctaaactgttgattgtatgggccaagtgggcctcagagaaagtccaataagcaacgtcgtcactgggctgactttaattgggcccaccgtgtgctgttgtttctaatcacctgtcaggacggcactaataagcagcagcgagccagtgattctttctttttctttctagtactactactactactagtatactactacactactagtagagtacttcctcggtcgttaagtgtagttttagctagtaagtcactgttaagctaaaattaaacttatttagtataaatagagagagtagtttctactgatgcatgcatcgagaattctactagccagtcaagttgtactcctacataacgtaacttgttgtagtagcaatacgggaaggaaaagaaactgctgagaatttagtactaacacgcacgcacgccacggtcgacacgaatgacacacggctctcgttctcaaacactccttggccctggctctcccctcgtcgtcattatccagcagtcagagagtgctactacactagcaagcggttgagtgcacgcataaagaattcctcagcttacatacggccagacaaatcacctgtacgttcaactgttccaccagtaatgaccacacctcctacgcgtcaacactcgacacgcgggggccactgacccgtccgggtcagctcagttgcgtgtgcgtgccaagcattccgtgcacgcagcagcaagcacgatcgctcgcatcgcgcgcacgggaggcattcgcacggctgatttacctgaaacacacgtactccactcctctgcgatttggctgccgcgcgcgcccgccttgagagatcgatttccagcgagttagtagttaccgtcgacgacgacgacgaggttgatcgagttactacctgttgttaccgtgcggagatatttccggacggtgacaacgaaaatatcctcggttttgctcacgctccatctgggacagcgaggggttggtttgggggaggcagagagaggagggcgaccccaaaaagctaaagcaaagcgacgacgaggaggacgccgacgaggcggcccgctgcggccacgtggcgcgtggcgccggcggggatgaggttgcttcaacgtgtggccacctcgtctttgtgcttgcgccttccccgcaacctagatctttttttgtcctcacccagtcactcgtccgaacacttgtctaatcctcttgccaaactaaaattaaaacgtgcagcatgatagtaaaattaacgctgtcgtgccaataatttcttgacgacaacgacatactacctccattttttaaatagataacaccgttagactttttctcacatgtttgaccattcgtcttattcaaaacatttacgtaattataatttattttgttatgagttgttttatcactcatagtactttaagtgtgatttatatcttatacatttgcataaaatttttaaataagacgaatggtcaaatatgtgagaaaaaaatcaacggcttcatctattaaaaaatggagggagtataatgttgaaattagaggtagataaattttgggaacgaaattaggaatgacttatatctcaaatcataattatggttcagtttaacccgatggatttggacctgaacgtaatttcgaaacttcccaagggtatttcaccaagccgtacgcattatttaaccgatggtgaagtggtgagcacacgccctctcctaaaaccaaggaacccaaccccacaaaaaagcgtaggacgccggagtgcgaaatccttatccgctcgcggcgacgccatggccgccgccgcggtggtccacctctccgtgcacggccgcctccgccgctcgccggagctccacgcccggccataccaccgcccgtcgctgctccggtgccgcgcgttcaagcaggaggccgataacggcggggaggaggcttcgtcgtcgccgccgccgccgacgacggccgaggcgcggaggcgcaggaagggcccgctgtacaagctgaagcggcgattcaggggctcgccgggtcgcggtcggcggccgcggaggcgtacgggggcgagtaccagcgcgccgtcgagaaggccgaggagatcttcttctcggtgagctccattcctgaaccccctcaagctcccccgcaagcgcagtttctctacatgataatatgataatatgtttatggccgattttttcatctgatcgtgtgatctactagtacgactgcctttaattgttgccacgtatcgggaggctcaaccactcaatgcgttagcgagcgctactaccttaatcagctcttgcttagctgcatatgggaattgcacccatcagatgctacagctacaagtgagtttaggcgatctatgttgtttcaatgggtgttaggatccaatacactagctgtggcacaaatcgatgagctgatcaacactaatcagcttgtttcttactagtaatacagtaggctccagttactgtgaaattctgtaatgtcagttccctttatgtttatgtgctggagagcaaattctgcctgcgctaaaattaatcgcaggcctgtgaagcaatttgcctgggcagaggatgcggctcgtagccagaggtgtcattttgtgtagcctttgttgcttttgaaactattttaaacttctttgaaactcgctcttgattaaatttacttcgcccctcatttatatgggcctagattctctggttcttgcatctaccattgtatggggggcatgggctgccaggctcatggttttacatgtccgactgtaagtgcatgcacaggcctgctttatagttcaattgaattgcttctaggcatgctgattctttgtattgatataaataaaatctccggtatcggctgattctctaacctaagcacatcagtaattttctatttgttgcaaacctgaacagagtggttctgaatttatcactactgagttgtaggatcaactccttttctgaaataggtgttctttttttcaaattgacttatttccttctccttttcaggttgctacgcaagtaggccgatatgttatcactatgatgagcagcggtgttgtacttggagttggatttcagttatcaggttagttacattcatttgatatattgcattgcctttggatacttctgtttttttccctacaatgggcattttcagagtttcagtaatgacctagctacctttctatttaggcggagacagccaaatgaatacactaatttggtatagttggctcgggggagtaattattggcacgatgataggtgcaaacagtgtcctagaggaacactgcaaagctggacctcgcaatgttgtcataactggaaggtaacccattttgcattcttcctttcacatgccatctgaatcttttgctaggaagcatgcatactgtgagtacaggtcaaaggtaataatcaaaactaatgaatttattcctagataggaaatactatttcaccttctattattctctattttcttatttgatgagtggagtataaccataacaatcaccaagtttatacgggttggtgcatagaggagattatgaggtgcagtcatatgaacaaatcattaaagtaacctcataaacatgttaatataaacatgacttctcattgcatcaattgtgagctgatttcttattagtatccatgttctgcaatcaacattgaagttatagtttgattttggcagcacaagaggattagggaaagcacttgctcgggagttccttctttctggagatcgtgttgtaattgcttcacgcaggtggtactcatagacatgtagctcaatgtgtgttgttgttgcatatccatgatattctttttatgaaatgcaatgcgttgtcctagttttaaatatcctattttttgaaggcagccctgaatcagtccttcagaccatcaacgagcttgaagagaacatacaggagggcttgtcagttgcgaaaaagaaacagagagaaattttgctacatgccaaggttgttggtacatcatgtgatgtttgtaaaccagaagatgtgaaaaagttggtgaactttgccaaggatgagcttggatcaattgatatttgggtaaataatttacttttacatatctatccccatcatttattctgcattatttcacggtagggtactcagttggatacttggattgagtgcacaagtttttgtacttataacctttttattttgttctgtactgtggcatcgcagaatgtacttaacatgtgctattcttcttattcttatgtatagataaataacgctggcacaaacaaaggttttaggccactggtaaacttttcagatgaagatatttctcaggtacgttaattatcttcggaaaatcagagtcttttccattctaatagagttcatagaactatattcgtcatgcaacctgacttagttatttcatcttatttttctttctgcttagcctaaacaacattattgtgtccttttctgtttgcagattgtctcaacaaacctagttggctctttactgtgcaccagagaagccatgaatgtcatgcaacaccaacaaaagggaggtcacgtatttaacatggatggagcaggttctggaggatcaagtacaccattaacagctgtgtaagtacctaatgatttcaaatttttaatgctccactgttcgtgtagctcttatactggacagggatattgtcttgtggtttcttcattggctaaaaacgagtataattgtattgatgttgttacttgtgcagtgaaactaaaactgatactattttgcaaacttgcagttatggttcaactaagtgtggccttagacagtttcaagcatcacttctgaaggaaagcagaagatcaaaagttggtgtacacactgcttctcctggaatggtccttacggacctccttttgaggtaacctctgaagttatttagatgcaattattgatgatttgcttgtttagttcattctgaacttcaatatatttattgcttggtgcacatgttgtccaaactccaaaccacactttgtgtgatgatagtaaaacaagataagacttcaagtgcataagaagttttcagtaggatctttatggaaccacacatattggttaatcagaatttcacgctatcttcattttgaatttattttagttaatcaacaatcagaatgtctcctttgttgaatggggaagagtcaaaattttgagatacctcgctgcccaaatcttctttgtttcaatctcttctttctaggatttgatttgtggcaactatttctgtagaatcagcttcacattaattattaagttgcttttgctactacacttctagctctggcttttcctatctgctataatcccgatgacacggtaaactgggtgcgtggcggttaatcagaacctgaaagaattaatgttccattcttgtgcaaatactctgccttgtaaatccagttcaaagttgtgatgttgcacatactttatacttgtaaggcttcatagtttctgtcaatatataaataacttgtgagataacttccagatataattattacaaatgactaatgcactggaaagttctaacatattaatattttttattggtaatactatatacggagaataatatgttttttaacttcaattgatggtgcatgccacttcttccatatttatctggtcagctcttctgttgccacatgcccaactatgcagactgctttagttaacttataatccttctatcttttgcagcggttcttctctgagaaataaacagatgttcaatttaatatgtgagcttccagaaacagttgcaaggacattggttccgaggatgcgagttgtgaaaggaagtggaaaggcgataaactacttgacaccaccaaggatcttgcttgccttggttactgcatgggttcgccgaggccgatggtttgatgaagaggtatgtttcttctctatgcagctagtacttttcagctttaccttttatttcagcaatgccagtatatgaaatatgctgaattcctgcagaagccatgcgtgcaaacatgattgttgttttcattattatgcatcttgcatgcacttttcatgatattgaacctcaagacttttgagctattatgcttctgaaatagtgaaatatacatttctagagaaagagtaccaagctcttctaccgttgcaccaaatgtatatgaaactcattgttgaatataaagaacaatggacatagactattcaaattatgcctgtggtgattttcttgtaaattatgctaaataagcagtattcgttctaagactggatcaaccaggcgagtcagatcataatgaagcttgagaccagtgtccagttctgtcaggtctctacataagtaagagccataaatagggtctgtcttgatggttcagtttccaggttcattatgaccagctcagtccatcacctttactgctagttggccagagctcttctggaaggccttaggctggtcctcccctcaatggcggcttcaaacacctggttccaccatggcttagctcggtccaacagtctcagtgctattgtttgtactgcatgttaaatatgacatagttaattctcacatgtattgctggatctcacctagtccacatgaaatccagcaacagatttaactggagagaatgataggggttttaaaaagcaactgcacccgtcaaatgattgcactctagtaatattttggggctgaaatgggcacaagtatacatattgacgttttttttggtatctcactggtttattggctgtgattttgggaaagaaaatcacctgcaaattttggtaccgtcgaagcttctcaccattagattgacaattattaatggaaaaactgaatgaacacatgtattattttcgcaagatatttaggaaacatgacatttgagaaaaaaaaatgctgagaagtgggtaataatttaattataacgtttgtgttccttcagaatctttcacaatataactgaagaaaagtgctgtatacatcagtgtcttttgtgatggacaatgctccaatcatcctatgtgcaaggttgaaaatcaaacagatgaagtaaaagaatattatattcttacaaatgagagatcagcataccaagcgactttatgcatacttcacagttcataatactttcagtctgatgattaattcatgtgaatgtgtgactgatcataagcacattgcagggaagagcagtatatgcagcagaggctgatagaatccgtaattgggctgaaagtcgagcacgcttctctttcacagatgccatggagatgtacacagaaaacacatgggtttctgtgttctcgctctctgtcgtctgcgcattcataattctttccagctcaggtggacctcttccaggcacatgatcccaggagttgccaaactagatggctacacacaccatttttcttcagtacggggattctattatgtactgatatatgacacacgaaacttatgaaggggggaaattgaacccagaaagcttactgcgtacatacgcccaacggtgagaagcatcagctgccactcaccatttaaggtcaagctaaccatgtgctcagtaaaaatgggtaaatagcatttgttgtgtgggcattccactgtttgtaagctgacttgtaaaaacgtgtatctgagctaaactgagcacgaacagattcgatggacaatgttatctgctgtacatgcatgtagtaatgtagttttgatgactgtaattctctggtcgtcgcttccagttgcacggttgcaccgtatgttgcaaccaccaatagaactgaaagtaagtgagagtaatcaagccagcatctgctatgtatatatatgactcatcagtctgttatatatcacaaggaaagcttcttcaaagctaaaagcaaagctatcagtaagacagtaatcctgtgtttttgtccatttgaattcttgatcacaacaggggagattcagaagttgcattaaggtatactactactatcatttatgcagtttgttgcacctgcagccttgcagagtgatgattcttcttgatggggaagcaggacgttcacttcacctcgtacaaacaatgtacggatttctgtgtgcgagccattgtgagcaaggggctttcttttcttccaaaagtaaaatacaggctagtgcttttttcatgaaaaatatctgatggtgagtggagagtgcacacgctgatgagcagccgagccggagcatgcgttggcaacttttctgaactacaagctggagacgacgtgaggcttctttccgagagttgatagcagcgtgcacttccgaagttgggtgtcgatttctccctttttttctgctgagcaatggcaccttccattagttggagggtggaagcttccttcttgagtccgaggccccaatgtcaccaatcctgtctcttctgcattgttcgttgggagtataagacaatttaggggcggagctaaaacgaaatagagagatgtaccattcacttgctttactctactttaaatcaagtttaagctaatatgagtatttgagtttggattaaggaggtacatatatagtaaaaatagaaaaactatagctaaaaaaattttcttggccaggtttctgggcacccctctctcctacctagctctgcccctaagtgcattgcccgttcttctctactagtcaagttttaggttgaactttttttttaggggatagttttaggttgaactgatctatccatatatgccctttaattttccatcagcttaagcactggggttaaaataaaatatgcatgcaaactttgccttactaacacgcatttacttgcaattgcttagctgattgaaatctcactaaatctgctgctactttgattggattaaccaactacagacaagttgactgccctggccgggcagtgaacatggctggtacagtagtactcctcttggacctctgattgcagcttgctaccagcagcagccacggcggcgtttgttttgcatgtcaatgtttagagggtgtttggttgcgagccacactgctgtttactacatctaagattagatagatttaatcccattagcagctgtttgttgtagccatagctatgacaagattcttttctaataaactgagtctcacgtgtcattgacttagaaaaatgtaacaagattctcttagacttactaaggtgtggccaataatttaatcgcctcaacttagaccgtgtgacaatatttattgataaatgacaacaaagtatggttaggaaccaaacacacccttaattcacctagcaaagccacttcttggcctttttctttctagtcttcaatattgccatcatcatgtacatacatgccactgccagaccagtacagattattccaatgtggcgtggtgttcatcctgaacagtggctgatgtgccttgaggtcaatgatttttttggtttcttgacgcgactagacggtgtgagtgctctccaagattgaactcaaccgtccgatccacttgtgctgggagagggctccttttttgtggatggctttgcatgcaggatggagccatggaggaattcatgtagtcatgtattttatgtaagtggtctgtggagccctcaaggcaaaagaattattggagaataattttgcttgtcctcatggagaaatggtttgtcgcacatggacacggttagatctctcaatctagctttactatccaaccgtgcctccttcaatacacgggaatgttacaataatcggttcaatttttattggaattggtttccttttttatattttttaaataataaaaggtttattgaactcaatcaattatatcaagatgatacaaccatctgagactctcatgcataattaatatgcacaaagcggaatcgtacatccacacactaggtttcctccaaacaaaagagattactgaattttatatgaattttacaagaatcagttcaatttatatcggaactggagttctgaaaaggttgaagttgccaacttaccaccaaggaggcaaggacaaaattaacccattttaaaatcttaaagcaacagaaataaaatggatagagctaggcagagtagttgtacaatctattccacgacaagacgaatcccacactaattaagtcactgatttgaactagtatcacaaagggggattaggctaagttatccggcccggtgcgtcaccgcatcatattcatattcatatctcatatttaattggtggccgttatcatatgaggacatgatcgaggtttagcctttggaatgtttatccaaattccaaaacgatcaaaagatgttcatatggggcttgtctatagctgaaggcgatgtgcatgaatcagaatatacacaacacaacgcacgcgtggagtggagacagtggcatattcaagaaaaaaaataataggtgggtctgaacaacttagaacaaagttacagccctctcctatctacatgtggcaaaaaaaaatttgtgggggctttggtggtgttcttttcttctgaagatgatgatgatgattaagttttttacataaaacgaggtggtattaacgtatgattgattgagttttaactattataaacttaaaaatagattaatatgatattttagagcaactttcatatagaaagttttcacacaaaacataccgtttagtagtttgaaaaacgtgacatgaaaatcttaatcaatcatacgttaatacatccaactctagttggagaaaagaacagtgacctttatgagggctccaatagtactcacgtaagtagcggaggttcgagtcctcattgcgcccatgctaatccacccttgcgtggagatgatatattgcatcctgcatgaaatgaaatggcatatttttgatattgcgcgatgtgtgcatgcgtgcatggccagtgcaaagtcacacacacatgtgatgctgtgagcatgttgggggcagaaggatcgaaagcaacggccactgtcgaatctgcaacctttttatttttggcgtaatgttgtgtgatcttgtgtagagtttgcaccgagctattgctttgcaagatttgatgtcatgtttttggtataaaaaggtcgatgtaatatgtctttctttcttcccagggaaatttgaccatgcgtggaacataacgcattgggttatatgattatattttttttaaagaaaaggaaattgaaggtatagacaattatactacatataatcattgatatatatagttcgtggtatgttctggaaaatttgtgcacataaaaaaaatccgtttgttgacaataattaaaataacaattggggagatagacaacctatggtttgacgcagaaactattggagtaactaactaaactaatccataatcatgtatatagatatgcatcctctgcttttcatttcaataggtaggtaccttccgtccctctcttaaaggagaagaagcatgtgctgtccttggactatgctgctgaaaaaaaaaatcaatggcctggagcagaggtcatgagggaaatgtaccctacagatcagaattggcgtaataatgctgcaatggggcctacggtggctgaagcaaattaaatttcaataatttttactgatatgctaactgtatttttcagagaaattcagacatgaataatttgtggacaatagaatgtaaattcttgatgaaatgttaccgtggtttgattatattgtcttaggagactcaaaccattagaaatttagaactgtgcttggccatcagaattcacgtgctatgagtgctgagattcctgcatgttacctttgtgtcctacatgcatgatgaattgctcagataagatgatctttctaaaagaaaaaaaaatagttgatgattgccaaacatttccaatcattacaatgaacaaaatatttggaaggactatgatgcaggcaatgtggttaactcaattaatagagattttggttatcatgatcgaattcctttgagttagacatacatttggtttgtagccacaaccgcgatgaaaatattactttttttactatctaggtcccacgtgtcattaatgtgtaatggtgctgcgagattttcatctcgctggcaccgtgtcatgctgattatgataacctaaccaactcgagtttagacataataaatgtagcaaatttgggcaacttatatataaaccaaagacagtgacaatgttcacgagttttgtatgctaaacggtttggtcaatacgttgggctaccgatcatgccattcttttagggctcgttggtagagctcgaactcctaaattaacttcataagttaggtttagagttaaattgtggagcatcttaaacccagctccacatctctaatttattttgtgaaagcgcttcagctatatccattcttatttagatgaagttgaaactgtttgtctgagtttcaactctagaagagataaagttggagctggagccgtggcaaacatacccttagtttcaatttcgcagtaactatctaatcaattgatcatagtatttctgccaaaatcaaatgtggaaaacgagggcatcgactagcactctaccagtagcctgcaggacacacatttatgcataaaacctcccaacgggatttaatttgcaacacaaaacgtcattaatttggtgctgactttcagttgttccatatatttgctactcctacctgctgtcaatcttataagacatgcaagtaaacacagccacagaaacggtgtacagaagacaaatgcaattaatgattaactttgcttgcatacgcaccgattctagctagcttgaataagactgttagctatagtaagtaattgattaaagaataagagatcaaataaagcaaatatcaaccaatcatgcttcaaactcccatcataggctcgtagctgtatcaaccacatattaagatcaatcatagcttcattaaccatgtctacgtcatatcaaacaacactccaaatttaaccttgctagctagctgccataggcttgttgcgtagatcatctttggtgctgacacttgtatactatgtgcacacataggttgatggtttgtcaggttgtggtggtcacagaatctatattgtgactgtacatcagaccatataatcacaaaccgcgtacccgcgatacacgtgaggcctagagtaaaccacgctaacaaaatactacctttattttaaattatgaaacatgtaccattaatttaaaaaaatctgtatagcttaataacacgtgggttatattacgaaacttatttctccattccaaaataagttcttttttaagtaatcattatattgaagttagtaagaaatagttgcattgagattttataaagcaggggtattctagttctttattggtatgtgtgagatatgtaaaaaataaacttattttgaaacagagagaatatttgttatggtgaatctctaagagtttggaatctcattgtatggaactataataatttatcgaaattgatagtcaaatattaggacaacccagaacaacatgagtattttaattcaaaattatgtattttaaaaaatcgacatgccacagtaaaaaatagaaaaaataatgtgcctattgcttgaatcaccatttcccaggtatttg

SEQ ID NO: 80883 - DNA, 11989 bp, Oryza sativa
gcggaggagcaggtccggcgcgggttcgccgtggtgaagcggtcgcgggacccgtacgccgacttccggtcgtccatggtggagatggtcgtcgggcggcagctgttcggcgcggcggagctggagcggctgctccggtcgtacctctccctgaacgcgccgcgccaccaccccgtcatcctccaggccttctccgacatctgggtcgtcctccatggcggctagctactagctagcttattagccttaataaaaagagagaaaaaaatcaccgtgtttaattaattagctcagtcccaggatgattaatcactgagattagccagagtactactccatcttgcagtaatcatgtgtgttcattacttaatctttctcagagtttaattaatctcctcttgtgttgatttaattgcctctcatgtataatggtcgatcagttgggttaatttgagcttaattaattacacttgggcatgcatgcatgcactggaccgtggacactggcctctagcggtgtgtgtgtgtgtgtgtgtgtgtgatgtacctgcactgttcttggttctgaccaacctttgacttatcacgctagttttttctttttcttttttgaagactggaagaatctgatttggaaggggatttggattgaccagagagtgaggtgtggtttgtttggtagccagagagaagctgtgctgcgtttgaactttgggatcaatcatttggaaatcatgattgtatgcatacgagctagtactgttcctatttgtgtcggcagttattgggtggaattttgatcagtttaaatttgaaaattgatcagtgtgcaccttttcaggagaaaagagtaatttatcatcagagtaacatggttcaccatatggttacatacatgctccattttcctcttaatcataaactagctagggtcttccgtttgcataatacaaaactcaagtgacttgaggtaagttcagatgcatattgacaagcggctacaagtcaaaatggcacttaaattggagtaaaaagcaactataccctcactttatactctagctctgctgaaaaagagagagacatatgtactgccaaacaaacagcccaggatatcatcacaagctcattattcatccatctagagacaaccatgcccggtcaaatttcaaacgggacactataaattctcctttgagcattacttgtactccctccgtcctataatataaaggattttaaatttttgcttatagtgtttgaccactaatcttattcaaaaaatttatgcaaatataaaaaacaaaaagttatgtgtaaaatactttagataacaaagtcaaaaataaataaataataattccaaatttttttaaacaagacgagtagtcaaaccgtacaaataaaaactcaaaatcccttatattataggacggagggagtacatgtattggaggcagtacttgtactggtaatacatgaagtatcattacatcaatctcctcaaaagaacagatgcctttgccggcacaacaggtcaaagggaaaagggaatggaagatggcaatagagtatgcctttctatgctcacatcactagcttgggatttgagcctttgcatttgctgctctgctctgctctctactatctctctcctcctgcatagcctttcacctctctcacctacaaatccaggtttccaaatcaaatcaccaggtgtgttcagtctaacacaagcaaaggtacaactactagtacaacttgtatactagtagtgctccagtacaagtacaagtaggagtacgtgtactagtacatgatttgagtttacttaagtatagctaggagtattagtagtagtaagacgttggaatttcaccttggagcaggtgctgtgcatctttctccaaggacattcagaagagtgtgtggaaaaggttgaggctaactataggatgcaaatatactctaggtctatttgcgtttgaacttgggaaaaggtgggtggccttggcgcattgtccagatcatgctcttggattggatgtgccctgtttgctcgagggaattaagtttagttaaatggctgtgggattaggtttgtggggcggtgtttcaattaattgattaattaaggacaggatatgtcactgcaccaaagtcgaacttgttgctttctgcttaggactttagcgatactattacaagggacaccagccaagcgacctgaatgccatgccatgacatgcctttgcagtactagctttgcgtgtgggggtactccatattattcacaatgacatttgggaagctaattaactacttttctacattgtcttggcagcactgagttgtacttgtgtgcatatatggtttaaattacacctaacactaatagtattattttcctactgaccatgttccaaacgaattaactcggtgacatgacactgcatgttgtcttgctagaagcatacatgcgcgcctacggactatgacacatttgccatttcagatgaagcctgaccattcaaatgtccctattttcagcattgcaaatcaaatcaaatcagctcgaggtacacaattcaagtgagtgaccaacggtgtgctagctagcaatagctttttcactatttctcgaagcagaattcaagcacgctgtcttgtcctgtggctgcctgctatggtagtttgacaatgctcttgaggttaatgtaagaaaactttgtttaatgataatatttcaaaaggaaactttgtttaatgatcttaatttcaaaaaggaactttttgttgataacacaaagtgttctctcacttctaagtcaagagaaaaaaagcagctgctagtacctgtgttcccttttgactcggaggctaatctccacgttttctgctttggaaagatcgcttttagtcagcctaaaaggcgatcgatcgatcgatcacctcgagaggtagtggcctcaactgtttgctgcagaatttgcagatcaaaacacgtacggtgtattggagattggtggtagtacgtagtacgaattaaaagccaacaatgaacacagtataaaaagcaggtgtactattaatactctcttaatccctccctatcgagagaattaattaatgtctcctcgtttctctttgtatcatgcatagattaatgtgtaacgtatcactctataaacatataagttcaaatttacccttctataagttgtaaaaaaaatattactctaaatatatgagcatgatctatcgatagtctcatgtgttcttgttttctaactatctttaaagggatttctagctactattcaaatatataacatgagatatatacatgcatgtgaggccatgcattctctcgagattaggatccattaattagctaaaggttcaattgaacatatacacgagctagatacgcgtactatacgtacgtacggtgcatatatatggtgagcgtgaacagtcggattgtacattttgctggggggtgatgtactgcgtacagtggcgccacgttctttgagagattgcgagacattgtttgtagtggcgggcaggcagtcatgtcatgcatgtgtacacgtacgccccctgcccggcctctacagtgcgcgacgctgtaagcctgtaaccttgtcatagtagcgttgttgagtttcttcgatcgatctcctcttctctctgtagattcttaattatgttttttttttcctgacggtcgtttataacgatcgatctactctacctgtggctggttatgtggtcaccagctcattggtcgagctttgcaattgggtagaacagttacagatgagatgtgtcgcaccgtaaatttaggccctctttggatgcagggactatcatatcgaatgtttgaacattaatttagagtattaaatatagactaatgataaaacccattccataactctggactaattcgcgagacgaatctattgagcctaattaatccatgattaaactacgtgatgctaagtaaacatgtgctaattatggattaattaggcttaaaaatttgtctcgcaaattaattctcatttatacaattagttttattattagtctatatttaatatttcaaattagtgcctaaacatccgatgtgaattagtccctgtatccaaacaccaccttagcttcttaattaaagatgacaagtcgtcggtgatgggtgtaaacacgatatcatatcgaatttattttatgtcactgagtttactctacttcaacgatttgctatcgactttatctcctctatggctctataatatgccactgattttatccttttttacattatgctattaaggtggatacttttcaaaaaaaacctttcatgtcataccagagttgacaattgtttaaccccatggaagtttcagaaaaatataagttttttgtacttagccttcctacaaaatatagaagtttgtatgtgtattttatttctttcatgtttttttatgaaacacttttattatgtagaatatgaaagagaaatcgcatactccatccgtaaaaaaaaaacccaatctagagggatgcgacccctcctagtacaacgagtctgatctagattcattgtactaggaggggtcacatattgttttttttttaccgagagagtacacaaaagatagccgcatcagaaaaaaaaatatatggcaggtgattctattggcatataacacataaattattctattggcatataaaacataaattattttttgaaaattaatatgtgcaaaatggaaatcttgaaatttacacacacttttgtatattatgcaaggaggatacataaaaattttcatattattttttgaaacttctagtaagccaatcaattataacctcttataagccttgaaaagcatttttaggcattttttaaaaagtatccatccctaataaaatattgtacgaaaaaaataacaaagtcagtgacatataattaacaaagggaaacgaaattaatggtaaatcattgaactggaataaactcaaattttgatccctgatacactatgtgagtactaatgagaatatatccacgatgcagcgagagtgcatcgtgtcgggaccgatcgacgggtgcgcgcgagtaggcggatcagatcgacgccgccgccgacgtacgtacgcgcgtttcacagtctagccgggaccgatcccgacgcgacgtagctgcagatcggagatgtaggtatacgtacgtagtactgtatatatagtagctgagacgtgtacgtacaccgagtagctagattggctgaaagctagggcggctttgagctctgccgctagctttagctttgtggtctaaaaagctgcctgtgcggtggctggcttcctgcactgcatgcaggtcgatctctgcgacgggcgacggcgcgcgtcgaggcgttggcggcatgcgcggtcatcgctcacgcgtccgcggggatggtggcctgcggtgaccgcggagcttgtagccatgtgtacatttgcacgcaggtgcggattcataaataaatagcatgaaaggtattccctccgttccaggttaatatgttttaactttgatcaaagtcaaactactttaattttaactaagtttatagataaatatagtaatatttataataccaaattagtttcattaaatcaataattgtatatattttcataataaatttgtcttggattaaaaatgttattttttttctacaaacttagttaaatttgaatcagtttgactttgaccaaagtcaaaatgtcttataacctaaaacagaggtagaggtagtaattaaatttagagcggttcagtgggagctttcatagtcctagtgtcgatagtgagggctcaagctcccacggcaccaatagcagatccgccgttgcaagcgcttccctcaatatgttacacactagtacaaatgttctttattttccaacacctataagcttttagtggtgtgctggatactttctttgtggaagattaaattgccaacaacattctttacatccacatcacctaatgagaggattgtgtgcaggaagggattactagcttgcaccgtaaaacacacaaagaacggtctatacatcacccgacccgagtaaacccctgctcagaattaatattgttggatgtccagaccattgtcgtcaatttggaactgtgagtgtatctcctgattattttttttttataaggaggcgtcactccatttcttgattctagaaagtaagtgcattatatgtatattatcaagattcttatatggtgcgattttttgtaaaagttctatatgtgtataaagccgtggccactgacctaaaattttcatgtgcacatatttcttgttttattcttgatagttcaacttgtgttcgtgataggatgcacaggagcggcagcgatcctgattctgacaaggcgcactggtatatgagcaatagcgatgacgagtcatttgttgataaagataaagattgcagaaggggcaccgtagccccgctgctgaagaaaggcccatggacatcatgggagaactccatcttagagaagtacattaagaagcatggtgaaaggaattggaagcttgtgcagaagaacactggcctcttgaggtgtggcaagagttgccgtctctagtggatgaaccatctgagacctaacctaaagaagggggctttcagcaaggaagaagagaataaaattattaatcttcatcgcaaaatagggaataagtggtcttggatggctgccgatataagttcaccttgtagttcattgttttttcttttgctctcagaatatatatctcttgaaaccgtttataaaagtgttgttctttaatagtttttgcatcacaagtatgtttggtgacctttacatggaggggaggtgcgggggatattaatatttgtagttcatccattggtaaagttatttaatttaaagttgggtagtttttttttccaattgcattacaagtatgttttgcaaccttcacatggaggtatgggtattattaatatttgtagttcaactgttggtgaagttattttctttaactaaacgaatgttatccatttcatttatttcaattaatatttggtagtttttgcattaccagtttatcctaaaatatgattatcatcacaaatcaaatcaaccctaataagcatatataaatattgtcaaagtcccatccttgaaattatcttaaaaatgtagcctatttttgcttgtatagcttaggggttgctatttaaactaaactgctagtatcttttcattgcacttgcattcatcggcctagtttagttctactgaaaataaggagccgtgggacaagctaagttaaagtgaaacttggggtctagctttatgcatataactatcttagttgttgttttagaacattgttactgttatatgcattgttctatccattatcattgttattaacttgaccacatgttctcaattgccagggcgtactgataatgaaataaagaactactggaacactcgaataaagaaatgcaagaacaatcgttggcttttatatcctgctaatgtatgcaacgatgctttgaatgaagatcaatatgggtctgttgaccccagtgttagggagaagctaaccaataatcaactagaagatactactagtatgtattctgcaccccagttttcatatgcttccatcagtaatatacttgataggagacttgcatcaaaagattatgactccatagaagatcaaagaaaccgaatagaagttgcagcagaatatgagatttcacttcctgtgttgaaaacaaccaacaatgacatatttccatcaggtgagctatcccctaaactactctgagaagttcacataagcttttggtattgactttgtatcactttgtgactaactctaatgataagaccatgccatcttttgcagcctctatctttgccaaccatggcatttcaaatggcaatctctctgctttgtccacaactgatgctttgcagatggagctccctttaatccaatttgatccaaacaaccagttcatttactcaagggattatgcgacgcacctaacaaacttagctttattaaatgatcaagcagaagaattactaaatcatattgatgtattgaactatgtggtgatgaaaaaagagctttctggagggagtttgagtcccactattaatatgccatgtaaagcaacggcatattcttcagaactccctttatgcaagggatatcgggaacaagatcttgatttttacacacaatagtccagtatcgttgaaagagcttcatagctttgatctttctttcggttcgtatagtttacttatttcatcttttacttacatagtagtttagctgttgatttgttgatatctttttgaagcacatacctccatgactccctccaatgagctggtggtgccacggtatgaaggagatgttccacctcttcaagatgatttcacaccatatctctatttgaatggtgccaatctatccatcttcgaagacataaagtgaattgtttctggaaaacaagttggatactaaaggtgaacttgtgatgacatgttatgtttcataaaacctgcttatggttgaaatcatcgttttctaaaaatattcgttcttgtaatttcaggtaattgacgtcagattgtcatgagttgatgccctcttggacaaactcatcatgaaaccaagcattttattccatgaagctcatgaagacgatcgagccagtcgttgctatctctcttataaggatttccagtttggatattgccgtactctgttacttttcttcatgtcgaatttaccatgcgtgctacgttgaatttcatctgttgttgtgtgtgttaaactatcgaattcaaaagagtttgctgcaacacgttgcaacgttgtgccaccgaatgcagagaccgttctatttcatgttgcgtataatgtttgatttggttgcatttgcatctggttggtgtttctctgacggcttgccctgttcgacataccgtcagatgtttaaataagttttaattatttaaaattgaaacataaatttatattttaagtaactttgatatagaatattttcatataaaaaatggtatcatttaacacttagagaaacatgttaaccaatgaaacttacttcctcggtcccacaataagttcacttttagctctttccatttatctcacaataagtttatttttaaagctctttccatttatctcacaataagttcacagtaagttcatttgtaaagcaatcattacatcagaatttgtgaaattagagaataattatattataagtagataaagtgagaaatagttaagttgagatttgataaaggaatattattatagttttttttctttgtattggtatctaggagtcattgtggctttgaaaacgtcgctaaccttggtgtcgtcgcagactcactgaaactctgtgaaagtgaatcgatgagacgaaccaactccaaaaccaaaacccgcaccacccttgcgtaagcgccgcgccacctcatcaccccacccacggaatactcgtgctcgcgccgcgccgccacccccacaactccccgctccaccattgccgggggaggcgatctcccatctccatctcccatctcgcatccacgacgaactctccttcccatcgtctatcttccgtcgcggagggtggcagtgaccatttctggcgatcttcgggagggcggaggtttctcccggctccggcgacacttgactcgagagcccaccgctccgtcaccctgcgtttttggtcaggtaaaaaatggctttaggatcaccggtgtgttgcttttttctttttgttatgtttaatggtttgattggtgaattgctgggaatagtcttatgagattttagcagatctgttttttgtgggaaaagttggaaaatttgaggtcatttcaatttactttcctggaattaacaattaaacaggtgagaatggaaggttcccctccttggaacctccttattggtatcctcctttattttttttaggttaaattcttgttttttaacatcataccattgcatttcatttgccttcttttccaatataggttctataacggttccaacgacaagctttcctcgtcattcaaactggcccaccgatctcctattatcccatggctaaggtggtgtcattgtgctaacaccgcaccatcaatctctgtaaggtgggaacacctccaccctctcgctgtttggagtagttctttcccttctttcatctagctacgactttgtttttcttttcttttttcttcccctgggcataggcttgtctggacgattgcgtcgtgtaataaaaagaactctttctttctaatatattgatgtgctatccttttacgcttccaaaaaaagtaaggtgggaacacttcccaccttctgtagatttgtcgactttccaccttctgtagatccgtcgagacacgaattatagagcaaatcaaaggtcagaattcacgtgattctgtccatcatcactgactgatgtatagcatttccaaaaattggattctaacagggcctcttaaaaaaagtcatgtattcgggaaaataacgaaaaacatagcatcatgggtgtactgatgaatcttttagctgaggcgtcagggaaagctcatgaattatgctctgacgactcttttagctgaggcagggatatatggaagttgggcttgtcagaccgacactatctaactactttaccgctgacgatcaaatggctaaccaagcacgtgtgaacaaaaaagctacgagtgtctttttttcccctttccaatcgggtgtgatcgtaattttacaaagctgaagcatgattaatgttactgtaccttttattttgttgtgaaattgatgtatttttttgctgatttgagttgaacttgggatgaaagtgttggtgagaaattaagcggacaattttttttttcaaaaaaactggttaattaaaaagtactaccaaattaattccagttcaatgttcctgcaatccgagtaggaagcggtcgatcgacagcagaatctgattctacgccaagttgccgatcccccgaacagcgaagagagagagagagagagagagagagagagagagagagagagagaggataatgacaaacagatcggagtgaatgctcacattctgtgttgcctggcagggagagcttggcatcttcctgcgggcaattcgggcagaacggcgaccgaggcaaaaaaaaaaaacaacaaagccagcgccagtgaaccaaaccggacctcgtcgggctccgcgccgcatgggctctcgctgcgtcgatgtcgcgggagcggacactgccatcctgcgtacttgtacgagtaggtgcagcaagtacgtataggcgcgcatgccgcggcggacgccagcagctgctgcggtccacactactcgacgactctcgcgactgccgttgttctcgccgtcgtcgacatgggagagggcggaagcagcagcagccgaccgggccggcgtcgcggctggggctcccatccttgtcgtatactcgtctgcggtggcttgtgccagcgcgcggcttctgctggggcggcacgctcgcccctgcacggctgcaccggtttacctgtctgtcgctggaagtttggtgatgattttgaaccccttggaccaagtgagcgacaaacgaccggcccaatcgtatcgtcggctaataagcgaaacggcatagaagtatttgcaaataaaaaataatttataaataaaacttttatatatgtgttcttagcgattcagaagtataggctgaaaaataaacttcaatgaaaaaaaccctaaaatcaactccaaatttaagattgcaaattcaaatttt

SEQ ID NO: 80884 - DNA, 14371 bp, Oryza sativa
gtgcagctatcgccgcaactgcctccactgtaagaacgctggtagctgggataatggaaggacacggtgcgatcaggcaggtggttttcctccattttcttcgtaccttgatctcctgatgatccattgatcggtcttgacgacgatggatagaaaggaagctcgaggcgttgatgctgtgcagcgagtaggggcagggatggttgccgaagcttttgaccaacacgtgaagaaaccggcggttcatcgtcgccggaaataattccggccggcggcggtagcagatcgccggacggagagagatcgatcggcgcagctagcgcaggcggcggctggctgcgcggactcgacgcactctagggttttgccaatggacaggccgaatcgtctgggccggcccaattggccgaaaactgcatgttggtcggcctgcggttgagtcactcctgccgtgtgtgccccccaacgtttatccccacatgggccggcccatattgcaagaaaatatgtagcgtaaatcacgactatagaaaatgtgaaaattaccgttggttaaaaaatagacgtctcatatttatccatgtactgcctgtaaaatttttactaataatttaatatagtagtaaaagttttactgatgtgaacagccttagacacctattttaatccaatgatagtttagcattacatatatagtttgtatcacatatagggcaggttcactttgatgtcattttcgaccataccttctttttttttgcaaagttgtcaaaaaaatgttaccgtttagtttgttgctaaatttgatcaatacataagaaatcctgccaaaatttggtaaggtttattttggctataatctgaacatgctcatattctcatatatctctactaattataaaagcacagttttactgacaaaggcaggaggtggtcggctccttttgtgtgtacgtaaccatcgtagaatcctgttcttgttctcagttcatccacccacctagtcaatcaattactccctccgtttcacaatgtaagtcattctagcatttttcacattcatattgatattaataaatcatcaatatgaatataggaaatactagaatgacttacattgcgaaacagaggaagtattatataggtctgactcgttgtaaagcaagaacatattactaattgagggaaaaggccaaatcgtttccctgttcaggtgaggttaacttaaaggtagcaattaggatgcgtgcatcatcaggtgcatgtgcgattgtgcatgcacggaacgttgggtacagcgaatcgagcccctgcacgcggcgtacgtacgcaggcgagtccattgcatgcacatgcatgcatgcatgaacaacaatggattatggatcaaagcgatcgaatatatggccggccatggtcccgatcaagagagcgccgacgcgcccgatcgtgctgctcatgcatcgatctactgctatatatagtacgtacaccaggaccagtactccagtagcatatgtttcttttttccgtgcacggcctttttcctcgacggggagctacccgtgcatgctgaaacagtaaatcgaccatgcataataaatgaaacgcaacgctattgtaggttgaaaaaaaaggacaaaatcatatactccctttgccctacaataagtcattgtagcattggatattacactatctagctgtataacgaatatagacagctttctgtacagattcattgtagtatgtcagatccaattttagattgttagatttccctagtagctgtcaattaacacatgtttgtaattaaactagtaatgtatccatactctgcaacgtgtcagatctatataactaaaagttgactaggatgttagattgaggataaggcaggagctaagccttatataactgggattgttgggtgagtgaattaagaagaaagtgctggatactataatggttacgcgacctccatggtgagaaaggaataggaggatgaagaatgtgcttttaaaggagcattgatgttaatactatactacatcttcatggagcacaactttcgttttaacttgtgatgatgtgcaactagcaagtagctagaaacatactatgacttgtgtaaagaaacagctgtggacaaaaccaacactagtagatggatcagctatctccgttctcatccggctccaccacactagtacgtggctgatccccctgttttacactccaacaaggcaataatgcgtcatccgtggaccatctggtacacgccaagtctcttctggtccacgccaaagtaaagtctcttcgctcaacatatatacgtgaaccatgcatcagagccgaatgcttcttgtgggggatcgatcgatatgatcaggccggccggccggcgctaatccatcaatcacgactcatcatcaatcagttacagctgctgctgctgctgctgctgcttcgcacgtcaccctggcctctcggcctactgctacatatgagtggatcgagtaccaatcacacgcatgcatgcatcgatctgatctgatctggcgatgatgatctctacctggttcgctcctgttccgtgcacttgcctccctcccccctcgaccccccttgatatcggcttcccaggggtgttagattcacatgtataaagttttagcgtatcacattagatattatataaagtgtcgcatgaagtgtttgggcactaataaaaaaattatttacagaatccgtcagtaaaccgcgagacgaatttattaaacctaattaatccgttattggcaaatgtttactgtagcgccacgttatcaaattaatcacaatctatataattaattatttttagtatatatttaatactttatacaggtgttcaaatgttgtaaaatttttatgtgggaaagcctcacttctcatcagtttctcaccaggcggccgggcgggacgagcgaggggacccaggcgacgcgacacgggcacgagcgcgcgacaagggtagtaggacaagaggcgacacgtcagtcgcacgtacatctgcctccccctgcgtggcccggccctctcttgcacagttccatatgctaaactcttttagttctaaaataattctttaaactttcaacttttttatcacatattaaaacttttctacacacataaatttctaacttttccgtcatatcattctaatttttaccaaacttttaattttggtgtaaattaaacgcagcctttaagtctcctttggacgacttcgctgcttgattcatgcatgccgtcccccctggcctctcgagacctcttggctcttttgctcttgcatgcatgtacagcgtgtacagtgtacgcatacacacgcaatacgcgtgcatatatacgtgatgagactaggtacaggtaatgtatatgtacaattaatgtgtatgcaatgcgacagtgtacatgtcgtttgtgccaaccatacactgtaatgtggcgcttaattcactctttgagagatacggagtacagctcattgatatatatatatatatatatatatatatatatatatatatatatatatatatatatatatacatgtttgatcacagttttatatcagaatatatatcttcatgaagtaataaatttgtacaattaaaaagtgtgtagtttttcaagataaatatacatgtaccatgcatcttttatgtttttaaactatataaggcccccgttcgatagggaggataggccggggtgagcttattataagctacacataaaacgaagtgagtgattagggtataattaattgagtattaactattataagattaaaaataaatttatttgattttctaaagaaactttgacatgaagagtttttgaaaactgtatcattgagcggttcagtaagtgtgcttaagatatacagtataaacgagaaagtagtcccctagagtagattaattaattagaacggggcaaagtaatttatagccgtacaaatcaacgatatttaaatcttatatatatccaaaccgtaatgatttgtgaccgaaacgagtactacctccgtcctaaattagtgatcactttaacatttttcttgtaacgtttgaccatttattttatttgaaaattttatgtaaatataaaaaataataagccatacattaaattacttttgataataaaacaaatcataaacaaaataaataataattttataatttttagaatacgacgaataataaaaattacaaataaaaacttaaaaagatagatattttgggacggaggaagtacatgttggttgaaacggagctttcttggctagctgcaggccaagagcttgcgtctaaccgcatatgtccccggctcgaatggctagctaaactagctagctgcttccagcaatccgacacaaccaactccaagcaatcgatcacgaggtccctgctgatctcgttggcgcgatctccgaggcaagtgtatatggttgtgtttagatctaaagtttggattcaaacttcagtccttttacatcacatcatcttcaatttcaaccaaaatttaaactttgtgctgaactaaagacagcctacgtcatcagctccgttcaaagaaacccatgcagctgttccagaggaagatattcgtagtcgtagtagcagcaacagcaatttttacagcaaaattaatgatacagtatgattcgattcggtacgaacagagaaaccatttccccatgtttcaaacgggcaacagtgtacgtacgtcatcccggtagatcgatgatatcatatccatgcttgcacatgcatgttaaaaaaaactgatactacagacttattattctatccatttgcatgcgtttgattcaagatgtgggatgggttggtttggatcaaactatttttcattttatttggtttgagaataagggaattaattggatgattcttgagatcatgaggcctggtggggattggaggggaattaagggggaataactcacaccaaaataattgtggaataattttcctccaatcccttcttctcaaggattaattaaacatgacctaaaagagaatattttcataaagtctgggttgccctttatccttaaaaaaaaactaacggactaattcaacttacttttttttcctcttgataacatgctggacatctttaaaaaaatagaactattccatttcttatgccaaacgaatccaaaaacaaggatgagtacgttcaactttatctcacctcgtcacaaaccaaaacacatgagattattctatttatctactgttccggcaaaaacgataatgtattgtatactagctagtacgttcacgcatgcactgatatgcacacaactccaactcctgtagtgtggtagctaggaggaatcgttcactgtttcgtacatttgttatttgcgcgcacacactgttcttacggtgcactgcacatacgcacgcatgggggcgagcaacccttgtcggtcgatcgacgaacaaaaactgttcgtcatcactagtacgagtccagcctgccaacatgcaggcatgcagctgccgccatggcgttgatacgatgatgacgacgacgacgacgacatatgttgtcacgttgaaggccactacaacaaaacagtttatttttcgagatttagagggagagatgctgctccaacaatactttaagaaaaaaaatgagcatgttgaggattgaacacggaccggaccttggttgaaactataaaccctttattaaatcgctatcaagtacatctttacaataaaacggtaaataagggatgatcctatagatacctgaaactttagacctggggtttatcaaaccgccggggctggggttagcaaacagtatgaaacagtgtaaaatttatcaaaattttaaattatttttaaaatttacttaaatttaaggaggtttgtgtagttttctttttaccgtgccccacggtaaatgtggttaccggcggctgtgtaaaccttgatgccaatagagctttacgtggtagagctgctctccgttcacctttgtgaactactccaacaaaggacgacgtacgcttggatttggatgcatgtatatacttgatccacagcgacgtgtactatactacagaagcatgcatgcatgctgttgcacgtacgtatactgtcggctcaatcttgcgtcaagtcgatcagcatgcagctgttgattgatcacaggtgctggctggctagcttgtcacgtcaagcacaaatgttgagctgctatagctggtgtacgtggtgcgtttcatcgatcgacacaaaacttaatatgcgttcatgaacgcacgcatggttgtacatcttccattcagctcatatattactgatctctctgtttctaacatatactagcattaattgttaagttctttgaaaaaaaaactaaggtaacaggaaatattattttttttcacttcggtagtcgaatttcgaatttcaaattacttagattttcttctgaagcatctcattggctaaaaatatatagatttccgtgcattttaaaatcagtgctaagaaatcctttgtacatcaagatgaagaaggcatactttattcgtttcaaaataaaccaacctcgtattacaatgtgtcacatgccaacagcggtgaacttagaaaaaaataagggtgcctagtacatatatactaataagctagtaagtacttgaataacactacaattaacgtagcctaatacaaataaaaatggacaagttatatatccagtgtctgatgcatgcaccggggacgaggtagccgccgtgttttttttaataaattggtcatttttaaaaacttatttcgaaactagtccctataaaaaacttcaaccaaaaatagaccgtagactcggcgctgtggaccttagtgctgagctataacgtcttagcgccaggcgctaagctctaatccgaggtggcatgaattttctgagtcatcgaagcttagcactaagtaacttggtgctgaggtctctacaatttaaattaatgcggaggcatttcaagtaacatctccctgatagcccaatgggagtagatttcttctataaccgtggggagcaggtttcgatccccatctctcctaattttttttcttttttagttttccctttttcttttctctctcacacttttttttagttttccctttttcttttctctctcactctttattaatatgttttttcttttttttctctcgttttatttttctatctttatttatttttagttttccctttttcttctctctctcattctttattaatatgctttttcttttttttctcacgttttctttttctatctttatttattttttccttttttctcgtaatactatcttcaaaatatatgtttaatacacaactttttttgaatttgaaaaaaaatattaaagtggtactactatattatatggcaaatgagaatttaaactgaaattttaaatcaaatttaaaataaaacaaattatagaaattcgaaaggagcataagagtgactagtcaagagaacaaaaggagggatatcaggattcaaacccagcaccctacgactcacagcctaagacatcaaccaccacgctatcacagccttgcttctatatgttgcttgcgcgttatttaaatcgtagggaccttagtgccaaataacttggcgctgagctctgatgagtcagcaaatttatgccacctcagattagagcttagcaccaatgacgttggtgctgagacattataacccagcgccaaggttcatggcgctgagtctacggcctatttttagttgatgtttttttgcagggactagttacgaaataaatttttgaaaatgatcaatttgttaaaaaaacggctgccgtattttttttaataaattggtccttttcaaaaactttgcagaaacgcccctacgatcgagccagtggatttctatactagtggatcagttgactggtatagaatggaaccaattaatataatcctagctagtcgaatgtaggaacatccttttcttccttccaaaattgtgatgtgcaaagcttttacacattcgaaaaaaaaaagggaacatgatcgccaaagctgtgtatacacacacagtatagtaaataaccttaagaggggtatcaggctaagggtacagacgtagagtagcatgtaacatactcgtatatatatggtacaaccatagtaccatacccttttcctttcttttgctaggagtacatggaataaggcctggttagacggcactacagttgcaggctattcaggataagaagggtgaggagactatagaggcaaaagggcccaacagggttgcaggtgatttgatgttggggagaaatgcgttttcaaatcgaggctgtacgcttgccactgccacagtacctagtctccttttttgaaactcaatgttgatcaacagaaaattttccagaaattctacgggcaatgccttccaaacaagccggcctcaaaaaccctgcatgcagcgacacactgttcagagaagccctgttggaagtggagtgtgctctcttaacttcgttttgttttttcaactgttacaaaactgtcacaaaggtacacattttatactatgtgtcaagctacaagaaaacctacattctgtcctggtaaaaaaacatactcctaacattgttgagcatctgatcaaattatgcagtacattactgaatttgcttccctgaagaattgcagtggccagtgtgtatgtgttttcagatttggtttgatttctctgttcttgagctagagctaaactagttgagtcagtagaggcatggtgcctctgccccagccttagacaggaaagcatatgaatgaatggagtagtaatggccattggaatgttgcctatggatgcgaaaagcagaggctagttattggaggataaggacatgcatctgctcaaagtaatgctaggtcaaggactcctgccacgcctacatgggagagttgttgaatgcagcgtctatgattgatgctcaatgcataggagtatcaaatttatgcaccatacactgcaatttatacaaagatacacttttttcatggttggtttggttcatctccttatcggcatgttttggtagcaaaataaggatccgaaaaaacgcattcatactgctggattttactgagtcaagaaaaaaaatcacttccgagagtcggttattgtgtcaatggtttaactactccgttcgtttcataatatatggtgtttttgctttgtttgaccaagtttacattcttataatatattttgaagaagttttcgacttagattaaaaccaaaacatctgacattctgaaaaacggaaggattacgtaatattcttgttcttcttgatatatagatcagagatagtatatactcgctccctcccgaaaaaaaactaatctaggatgggatttaacctctcctagttatctagattaattgtactaagaggagtcatatcttcttctaggttgggttttttttgggaccgagagagtatgtactagaaaaataggagtatatgattttataaatgcagggtatatataggagtatgtatttgtggattgtgagatgcgttctttggctgaaagcatcagaattcagaagctgcagagggagtaaagggaaggtggtggatgcagaggggagggcgttggaaacatcctctttgccaggcgaaataatgaggccatccatttcaaatgttgcattggctagctgcctagtagcacacagaagagaagaagatgccaccgttgggtagagtactctccccctaccctgcggcgcgagacgcaatataaaaaatactgaccccggttccttcggatctgagcgcagcattcatggcgatcgatcgatccatgcacaccggtgtggatggaatgtgtatcagaggaggagaccacgcatgtctgcacatcgttttgtgtgcttcgtcgtactgtaccactactgttcattcctactgtactctctcctcctcctactcgtatacaaagcctcaactatggccctgtttaattagatcacaccttaaattttgtcggcatatcacatcgaacgtttaacacctataagaaatattaaatataggcttaaaaaataactaattgcatagattgcgactaatttacgagacgaatcttttaagcctaattgctccatgatttgacaatgtgttgctacagtaaacatttgctaatgatggattaattaggcttaaaaaatccgtctcgcggtttactgacggattctgtaattagttttttattagtgcccgaataccccatacgataccctatataatatccgatgtgacatgctaaaactttacacccctggatctaaacaccctctatcattgcatatgctactgaaactaattagtactgctactcctacatctactataattaacaagatgctgctaataataactgaaactcatgatcaaggcatgcgatttgcctgcctgccagccatgtgatgcgagtacactccggtatgtgactgaggtaacatagtacagtactctccgtctctccctcgcaatgtgatcgagactttttgttagattctactgctagcattgcgaacaaaaggcagctatagctcctagtactccatttacgcccgacgcagctgcaggaagctaccacgaatgtactactatgccagtatgcctgatgcaaacgatgcattgaatggtggagtatacggctcctccagctagcactagcaacatgctcctagttatagaggctgtgtttaccctaaaacttcactgtttaaaacttcactgtttgcctgctcaaacctactcctacatatttctggcaacctagatgagatgatcaaccgatcgatcaggaagaagaagaagacggccgggggaccatatagacgatgcagagtcctacttttttttctctcataaaaaaccaacatattatcggataagacatatatatcatatcctagtaatataaatttggatatccatctatcttgattcatattaataggatacatatcaaattcgtttttatgggacggaggtgcgaagaagacgtacgtacggggggccctcctgcgcggttgcgagacgcatgcatggtgcatcggcgcgttgcagatctgttgcagtggctatccttaattagcttatcccttctggtctctgcgacgcaagccgatcgagccagcgatctgtagtgtgtagggatggaggcaggacggaaggagaagcagagagaagggcgtcgagaggatggtggggatcagagtagcgttgtgtgtgtgcagcctcgtgttttcgttatgcaatgcaaaaatcccctgctgccgcctgcagcctcgtgctgtgtctcctcttctcctcgccccccttcacgtgcagtatatcgatccatcgatggctttgtgattaacggccccgtttttgtcagggtgatgaaaatctcagtcagggcgagagaatccatacgctaatatgcaaccaaaaactattactaatagtcgcagagtcacaggctgaaattacgctgtgtcacctgctcgctgcttatccgtacacaatgcatgcacggctacggttcaagttcacgtcttgtttgaatagcttaaaaatagaattttaagaagcaggtactacctctgtcccaatttaaatgttgttgtggatttctatgttaaatgtttgactatccatcttattttaaaaaagtattaaaaagttaaaaatttagtcacgcataaagtactatttatgttttatcatctaataacaataagaaagtactataatcattattttttttcaaataagataaatggtcaaacattgaacataaacaatgcaaaaatgtggtcgttctagaacggaggtagtatttagtactacctccatttcaaaatataagatacaaccacctttaacctaaaaattaaaaaacaattattatcatcttttagtttggatcaccctaataaatataatacatataatagaattaaagatctctacggtgaaggatttagaaaaagaatagtttagtggagaggaggtgctaattaattgcatgcatacatgcagtccttatattatgaaacatcttgtcgagaaatgagcctctctagcgggtgatcgagagatccccttttgtgagttcggccgggggaaagggcacgctgatcgagatcgagtatccgcttcgagttctccgagaccgcgcatgggagccaagattatacaggttcgggccgcttggagcgtaataccctactcctgtgcgtgggatttatgattgagtgttacaaaggttcctaaacaccaaggagcacactcgctcttcttcctctagggtttaggctcactgagcgtcatcctttttctcggcgggcaaagtcctccttttatagtctaaggggataccacacgcaccgcctctacctactcctccacgggagggggacccactccgcttagaccggatcacgattcgtgccttcgcctggaagctaagcagccgtccgtcctcgagtggggcccagcgccgccccccgccgacacgggggacacccttgtcattccctcttaaatgaatggagacttgtggcagtccttctcacgtggagggggctttagatgatgattcgatgggacggggcatacctacccctactccgccgggtacagggtggaacgtgggggtatcaccgcccgtccaatcagacgtgaccggcgacaggccggtcacagtttggtcccgcctgattgacgtgggtcaatcatgcagtgccgcacgtacgcccttgtcgcattagatgcagtgagggacggttggggcgccgcgcattgatggcagctcagcctgagtctccgtcccactcgctcccctcgccacgtagcggttgggcgagggcctcggggcgaggcagcgcgagggcccgaggggcgtgacgtagcaccccgaggccccttggttgcctctgcgtcgcccgagatgtggggggagagccaggctgtagggccgcgtggcttgatgggaaggtgactcccccatacttagcatacccccgggcccatatcaccgacatctgaaaaaataattgtgccttataatccctccgtcccaaaataagtgtagttttgtactattcacgttcaacgttacgtcttatttgaaaatttttatgattagtatttttattgttgttagatgataaaacatgaatagtactttatgtgtaactaaatatttttaattttttcacaaaatttttaaataagacggacggtcaaacgttgggtatggatatccacggctgcacttattttagaacggagatagtattataaaatggagggagtagccagcttctgataattgaagaaagctcgattggtttcttagtttctagattttaattcattttctagattctataaccacatctttttagaatttgaacgaaagttaaaactgaactatttacaaaatcttatgattttgaaagaaactgcagctaacataaactctcctaagagcaagtttaataatatagcccactactagctccaaaatttaaatcatcatctatagtcaatctaatagctcactcatataatagttagctgtagaaatatactgcatcattaacatggtttattggacctcgtgttacagctagctataaatccgtagcccgtttttgctatctctcctccacacaaacataaatctgatgtggtaacttgtatagcccgtttatgtcatcttattgtacccgctccaaacgcgtactcaatggttgaatgtcacctagctagcacgtgacccgccttttccccgcacgtccccttgcctgcctgcggcccagccagtgcgcgtacgcgtacacacctccccctccccgtttcaaaatcgcggcgtctcccgctatatataacgccactgcctcgccgccgctgctaccacctctcgccgtgcgactggctgagctactggtggtagctgccaatggcgatggatcatcgtggtggtggtggtggtggtgggaggagcagcagccggctgcgggacaggctggcgaggatgttccggccgggcgcgctgctccggtcgacgtgcaacaaccacgccaccgcgtcgacgtcctcgtcatcgtcgtcggcggcggcggcggcgggtggggtggtgacggcgtccgcgtgctcgtccagcagggcgctgctcgccgcggacg

SEQ ID NO: 80885 - DNA, 11126 bp, Oryza sativa
  unsure (1)..(11126): unsure at all n locations
cgatcgatcattctgcgggcactgatccccatcaacgtcggcaaaacaccatgatgtgattaagtgatgatgagctcattgtgccggctagtttagctacagagataatttgaaaaaggaggtccaattaattacccccttaaatatataaaagcctattaagttgggtattggtttagccccttaggctttgttgtttgaagtaaataaccctaagcgtttttgtgagctgtccttttgcttgcagggcatgctgactcaacgttttttttttcaccatgtcaacacactagtcaaaccagtacatggagtaataaaataaaccagtactccatgtacgtacatagagtaataaaattgttcatatatatttttcttgttctgttagtggtgaaaacatcatggtagaatcatcatgtgcacatgccaacatggtagtaggaccattaatgagttcgtgagccacataggaaaaaaccatccaataatttatactccctccatccacaaaagttacatttattacttttatcacaagaccaagaagaaattaaatcatcttgaatgttacaaaaccaaagagtgaaagcaatcaatgagaatacatgagacttcttggattctaatcaaatatttaatttatctcttcatttaagtcttaaatgtataaagactacaaatagaaacaatttatttggaaaaactcaaatgtgaaataggtgtaacttttgtggatggaaggagtatgattcaggggttatgtggaccaattagcatgttcaaaggctcaatacctaatagttcaaaattttaggcggactctcgagtatttttttcttcaaaatgttgttaatgagattatgcttgatatatttcactattacacttatgcctatatctgaacacaatacctaaaaatatcttattttttatggtattagaagtaatggttaaccactatttcttctcagtaaaagtacaaggttttaaggttgtgaaccactaggtagtatactaatatacttttttccctaaaaacaaatcggctttcctaagatgccaattggtctaagctttatatctatcctatcactctcttgcttaaattaacttccttccttaactcagatctaaatggcttcctttggatcgacatgaacttaggcgtaagtcaaagcacgggcatggaaaagggattatatggcgtgctgggctggataaaagaagcgactacgcctacaatgagaatagcgggactcccactagccgacagagaattcccagccaaaatgaaattggacttctagcaatagcagaaatatcagtagaacctttcctactggagaataactagaagtttctgggtcgagcaattgagggaacgagtaagatatgtttgtcagtctacttgaaactcgatctttcgggaattagttcacttgccattcaatctcttttccaagttcatgtcttagaaggagtacacaatctccttttctatccttgtgagaagcggaacactgcctccctctcaacgatgtcactagatagggacacacatttctgccaggcgtttgttctcattcctggccaaccgtgccatgaagagtcgagcaagagcaatcgcagctttatctctgcctttaatgctcccattttagttatccataattttgttacggcgacgtgacaatgtattccttgaatatgttacttactaaccttacttttatgaatcatgcttactgcaaaactaatgatccaaaataaccctaggagctgcagggaaactattttgattcctcgagaagatgtccttttgttgtttgcatgtcactcaaatggttatgaaatttttttgagaagatgtattaacatgtgatatatcaccccacaaacatgcaagttcaaattcaacttctacgtctcgcaacgaaaaaaacaaatttgactgtgaatatacattgattagcttagtttattttgaccaagaaaattacattagcataataatacgtgtgtaacacatattatatttccccccttttaacccgatacctacatgcatcaaattcgatacgtgagtatcagactcgatacctgagtatcaaagctgatacctatagatgtcagatctagtatctgcgtatgagaactgatacctatagatatcagatccggtacctgagtatcaaacctgatatctatagatatctgacatggtactcatatgtattactacctagtatttgggtatcatgtgtgatacaatctgatacctgagtactatcacgtatgatacagacatgtacttatatggtacctggtacttgcgaggcatatataaatcagacatcgtaggagcccaacgtgcactagtcaatcttagtaccagacataatagtgtatcatcaaagattatcaagactaaaatagtctttttatttttcacagcctcgctccatggctcgggaggcatatatatttccttgctaagacattcggccatgcctgcccaagctcaattaatttaccacaactcaaagtgtccaactaagtagctctctcgagacctgtcattgagacccaattaatatgcacatgcttagatcggtcaagttggtacatttgtactagtgggaacacggaacatcgcacgtttggcgtggagcggcatatgcgacttgggttcggaaatggtagctgggagcgacggagcgctagacgcgggggagacgatgtcagcacttatctctttgaaacggaaccccgttgtccagacattctctaaataaacacgctgtaaatctcgtcaattatttcataagaagaaccgagtgattaaccgaacaaggtcttaaacctcccggcttcacgctgtcgcgataatactttacctagcacagtcacgcacgcgcgcgcacccccggcgcggcgagttccgtttcgcctcttcgctcctctcccggccactgttcatgcgtgtcagcgtttgtcccgcaacgctcggggaccgccacttccccccgtcgcgcgccaacttgccgcgcccgcgcgcggaacggaaccacgtacgctcgatcgaatgctcgatacccccgcaagctaagctttccgatctctcccaaaaccaatcgtttctggccaaagagattccgccactccagatgtacgcagcgcatgtgactgcatgccgcgcgactgcgacgaccgagctagtaccggcggcggcgaaggcgatgttcaggtggtagtgaccaggtcagcttatcgctttggcacgcaaatggcaatcgctggcctatccacgaattactgacagtagtgaccatgagtatgacatgcagcagcagtagtagttcgctcgattcggttgatatatatgcagctcgctgtcacttcagaatcgacggacttgtcgaccaatcgatctctcacgcaaatgtgcgtgcgtccgttcgtagtcgcgagctacaagccatttgggcgtcagtagtgccgatctcaatcgggtagataaagttagcggagccatcgattcgcttattcacagaataagtgaaagcgaatatgcgaaacacatatttataaatgagaaataatttataaataaaacttttatatacgtgttcttaacaatataaaagtaaaggctaaaaaaataaacttttatgagaaaaaaactcaaaatcagttttaaatttaagattaaaaatttaaaatttaactgaaaaatataaacataaacgaaaagatgaagaccgatctgagagccgggggttctttgctgaaaaggcatagcaggtggcgaatggatagatacataggtagtaaatcatgcagcatacgtgctcgattggtgtacagtggcaacggcgtgtgtgtagttcgcccacgacggttcaaaggctggcttgatattttttccgggtgtagttggattggtaggacaaattagttgcactctggttttctgatcttccgtggaacagaacagagcaattgtttttggtgctacttactcatggtttacaatatcgaggatagccgcttggttatcgccataacagttgatatcagaggacaccatatttaaaaacattttgatattttgaacaggttaaaaaagtttcatactagaatttatttttttggtaaacattattcaaaattcatcgattttagttgataggtagttatcatggttgttgacaaaatcatggagtaacaatttcctgtgcttacgttgttagaaactgttagtgatgtaccctagaggattgtatcacatactatgtttacatatttatccgacattgttccttgaaatagataactccttattggttaatgaatatgtgattctttcatgagactctttatgttgtttgttactatttctaaaggatccctgatcaaatatcatatgtggaacaaatatgtttatatgatcagcacatgtattaattgatgatcatgtctcatggatcatggtatagtgataccaaattaataatgtggatacatgttggtaaacatgttgttggatagacccaacatgagacactgcaagagccatatgtgttgtgtcatcagtgatctcattgagtgttggtgttgaatccttagacctgagattattatggttctcaacatgtgtagtagcttacttagggactgctaaatactactccgtaattgggtagttataaaagtagttttcaggtatgttatgaaacatgtagtgagatatgaataatcaagatgagatttgccccttctatggagagatatctctgggtccctcgatgttgtagattatagaagtgcatggccatgccaagggtgattgaggagtcaatcacaagttatataatctatcaacaggttcgagtgaagattgagctattagaggatggcacatatctagccttgagcttaatcgatatcatgaggcaaaggggttcatacaagtatacactagaggttcagccgatatgatatttatgtatgcccggtgggtcaatacgttctgctaggagccgctgttgacgcgtggactgaaaaagagttttcgggttacagccgagtatacatgaacctatagggtcgcacgcttaatgggccgaaataaggggattggatggagatctaatatgagcttacttcggatagggatctgaataggagtcctacgggacttggaggcccgagtgatggatcatatatattcgtgaggggtgtgaccggcggaggcattacatcacgtgagaaaccctagccgtcacttccctccccgagcaaaaccctagccgcgcgcgggcactagcaaatctgcgcgtggcgttccgtccctgtacgtgtggataccggtagaggcgccgctggtttgcggtgctgatcagcgtgggagtacggcgaggagaacgcacgaggaggagaaggtcgagccggtgcgatcgactacttctacatcgacgcgcgctacttcgcgagagttccttcgacttctcagcgtcttcttccactgcgcagtgcgtcgagtggtaacgatttatgatctaatacttgcatggttcctggtttacgcgatagaaaattttgatttatgtctatcatagcctacgcgtatcccaacaggcataagtaattgaacttttgtgggattttttctttgtaaacatacttgtcttatatgtataggttattttttcccatgttgcttaattaattgcctggttttccaataacattacggttgtgttcgacactttattttcctatttgtccaacctctacccccttatttttcttgcgcacatttactgaactgctaaatgacactctttttttgcaaaagagtttctatagcaacttattttaaaaagtcatattatatctattttttaattttattttaactaacactcaattaatcatgcactaacagatcaccctgttttgtgtgcagggaagtggagctcctaacctccacctccaaacacagtttaggagtatctagctacattgttctcgaaagagttcctctttgtttatctatttggtgttgcgtcctccaactatgtcacttctttaccgattacctatatttcctcatccaccaaccaccctattttgggtgtctctcccctccgtcgccgttgctcctgcttcatatcccctgatggcattcccctatccactgtaaccactagatagttatgaaaattcttttaataattaatacatatagaaacctaataataaatgcaactgcaaataagactctacttttcataatcaaatgtgatgttttttccttttatttgtagataaaatttgatagttcaggtttgtgtagaacatttaacacacttatcgatttatctacagtaattattttttatgtttttttattaattatttatactgaatacaagaaacatccttgatggcttaaaatagtttcccaactttttatactacttgcactattattgctcgctagagaaaagtgctccggcataaaatgcgctctgtgttggagaatgtataagatcttgatgatgctccagatgtgaaccaagtgcaactaggggctgtttggtttccagggacttattctaagtccctgtcacatcggatgtttggacactaatttgtagtattaaacatacactaattacaaaatacattctataagcttggactaattcgcgagacgaatcttttgagtctaattacgccatgattttgacaatgtgatgctacagtaaacttttgataattatggattaattaggcttaaaaaattcgtctcacggattagctctcatttatgaaattagttttttttattagtccatgtttaatattttaaattagcatccaaacatccgatatgacatgggctaaaatgttttagccccatgtaaacactcctaggtcgctgttgacgatcagacgggactaaaaagcagaaaagcaaccttcactaaaaacaacttccaagaaaagcccatgttagccctcatctatccttttgggttctgctttgcacttatggtacttgacctcaggtcacatcatatattatgcatctaaatttggttgcaatttatgggcatgcatatatattgcaagcatgtcgtgtctactgaacctcgtgattgattgaataagacgtttagatttataagactataatacgttatatctatctaaaatcctttatattttaaaatggagggagtggtatagaataataaccagatttggcacatcacctaaaccacgtgatataaggttatataatgatagctggagtttaaaatttatctaagactacaagggtatcttatcaacattttcatctcaacaaacttatttttcatttattctttttaccggagtacttatctatgtaacaaccatctctgacctcaatcttaagctctttgaaaaaaaaaaatcaaatattgttatatttttggatgaaggagtacgggtattcacctcctctctctccatttacaaatattgtgcactatttgacttctactttttttttactttgaccatcaatatatttttgactggttagactaccattagttttaactattaatacatactatagagtgtatgtatgtcttctttattttcacttttttaaatagttatatatatgtatgaaagacagcgtagatgattatatcttcatacatccatttactgacaagtatctaaacatgctgaaacaaatataacaaacatagcaaaaataagcaatcacgttcatacttgggattaccattttgtttgttaaaaaaaatcaaatttgatcttgcatatatattttatcgagtgatatgtgacacaacaacaatctacgttatgtaatgtttttagaatttattagaacctttttggccatactcaattaaccacgtcacatacaactctattcaatcttttcaattacttcatcgtattatataatcttcgcaggcaggagggagatccgcctgcatcacaacgactgcgacaatcgcaacggcccgcctgcgaaaatgcaaaaaaacgaacaaaaaaaatcgccgcacgcggctcaccgccgccgtcctcccccggccggatctgagaggggaggggagctgccgccatcgtcatcgtcgccgccgccatgctccatgccgtcatcgccccgcgcgtcgtcttcaccgccgccccgcgctttcgtcgccgccgccgctcccgccggcctcccccctccctcctccggccaaatctacgagggagggagggaggggagacgccgccggccgccccgcgccggcggtggaggaggagttggagaggtcaagctggcggagggtggcgtcctggaggtagaagcgagggtgggtggggcagaggacgaggtagacgatgagcgcgatgatgccgacgaggatggcgaggacgacgaggatgccccgcgccgtcgcccccgccggcctcccccctccctcttccggccagatctgggagggagatgggaggggagccgccgcngtcgccccccaccggcctccccctccctcctccggccagatctgagagggaagggggaggggagccgccgccgccgccgctccacgccattgccgccaccgccggcctcccccttccctcctccggccagatctaggaggaaggggggaggggaaccgctgccgccgcccggacttcggccgcacctccttgccgctgctgccctccgccgtcaccgcccgccgccgccgccggaagccgccgccggggagagtagaagtaaggggaggggaggggaggggaggggagaggccggtgaggaagggaggagaggtgtggagcgactcggaggtgtgaggacttagaaaaaaattagggcccgcaaatctatttatattaaagtctatttttgcatgtggatcacttaagcggcgcctgcgaaaatgattttcacaggcgccgcttaagtggtccgcctgcgaaaaaaatctattttggcaagcgggcatcaaatttcaccccgatttatatttttgtaggcggtcattttgctctaagggtcatgtctgcctgcgaaaataaataaggtcctcacgttgggaaaatgctttttctagtagtgatattgccctgaattatttaatgtatatctccaaatatatgttttatagaaaaaaaatattctcatgcattgcatagaccacttgttgtaagctattttaagtttgtatattaaaatatttaaccaatccctataattaaatagattatctactataataatttagtcgtcaaatatctgtttcaaacttgcctgatcaatttatgaattacggattatcatgggcacattttctaaacttataaatagtatatatatgatttaaaaaatcttcatcggcatttattagaattttcaaatcaatttgtaatatttaattcagtcgtttgtgccctcaaataattaattatcataaactcagtatcataaatcatcaatcatctataaagaacaggcccttgcgtccatcgcataattgcaagtatatatacttcaaagttgccattttgaaagcatatgcaaattctagtaaacatccaacacaaattcaatctacattcacatgtcgttggcaaccctcggaggctcgtgtatatgaagcatatattcccagctgaaaaatcaagccaataagcaccgtgcatgtacatatatatgcagacagcaatacatggaatggaattaataatatgcatggtgtcctcctctgagcacaagagcgcaatgatgcagggacggaaccctacgtagctacgtgtgccgagtacacgccaagtgcgcgcgcggctgggtgcagtggcagctagcactacgcagggcgctcggcgatcctgcggcgccgcccgtgccccataagcacaccaccttgttgccatcgacggacagaatctctcttgcatcttgcttgttagaaagtgggaaatgatggagatgagatggaatcgtggcttcagaaaagctaaggagcaagggcttccaggctgatcgatcgatcgatctctattactccctccatttctcgttacaagatgttttaactttggtcaaagttaaactgctttaaattaacgaagtgtatataaaaaaatagtaatatattttcgatccaagataagtttattataaaaatatatttaattattaatttaataaaactgatttgtaatgtaaatattattatatttttctatatatttagttaaatttgaagcagtttgactttgaccaaagtcaaacacatcttataacttaaaacggagggagtagctgataccattggcgcgacagctcaaggctgggccggtgcaagaatatgccttgtctggaatatatgttttcatgagtctcagatgagagacagcgcagacatgcaactggggttagggcataaggtctcggagcccccttttggtgttggacaagatgagaaatgcatctccttcctctgactagctatgctatgagagtgagagggtactttgattgcatgtaggatcgatcgacatcataaaaccaggggttgaacggtatcactgcatatatgctctagtggcctgatttgtggtggtggagtggtcccttgggatcaatacatattggtacagaatgatgacgatataattgaaagcaccatgcatatatgtatgaaaatatcggcattaagaacctgtttggtatagtttcaactctatatatatcctgtagagagacttcatcgtccaaacagtttcagctcctagctgatactgaaatggtgtatgtgggattcatctagaaaggtgatatatatactgaaacatgcattagataatgtttggtattgttgacttaccatatggatttccattggtacccactgaaagtacacattagttaacgcaaaattgagagtaagaaggctataatgtgaaaacaatagaacagaaaatctaccagagcatagattattgcaaatgttgtttgttacaattgacacttacaaaataacatgacaacaattgccaaaatgaaaaaaaaaggaaatgaaatc

SEQ ID NO: 80886 - DNA, 9385 bp, Oryza sativa
tgaaatgactagatagcctcatagccatttcccttgcttgtcgcgttcggaaactggttgcaatttttgccacctcctgttcttgtaggatagtaatggcaaaacacaaccacacacagtaatcaaacatgtaactactagaagcttctctgctggatacgcacaattcttgcaagttttgtaggggtagctttggtgagattgcttgcactgatcgctcagcccatttgtgtaatcagggtagatagatccaagagaattaatttctggctggatacttagctgagcaaaaagatgatgggcctgcctctcacatactccctccgtttcacagtataagtcattctagcattttccatattcatattgattttaatgaatttagacatatatatctatctagattcgttaatatcaatatgaatgtggaaaatgctagaatgatttacattgtgaaacggaggaagtatcattcacgtgtttttttttcttttttggagagagaaacatattcacatgtttgcttcagtagttctgtgtagtactcttgccagttgccacctcctcatttcaggctgctcacatggtgtggcctctgcattatgcagctgtgcgtagccaataaaggcagcaacgtacgctgacaatgcttacgtttcgtgtctcttgatgttgccaaacattaggccaaagtccttttttatgatttttttttccaaaattttgtgaagcgagaatcttgttgacctgatggttttttgttgttcaaggatgtcctcaattctttttatttttctgttgcagaatgcaatggtcttccaagtcttcgcgatcctgtcgcggtcgatcgatcaaccgagctccatgtcggagccaccgtcgtacaccagcgtggcgctcgccggcgtcggcaccggggcgctgcagacgctgatcctgtcccccgtcgagctcgtcaagatcaggctgcagctggaggcggccgggcagaagcaccgccggcccggcgaccaccacgggcccgtggacatggcgcgcgacatcctgcggaaggagggcgtccgcggcatataccgcggcctcgcggtgaccgcgctccgggacgcgccggcgcacggcgtgtacttctggacgtacgagtacgcgcgggagcggctgcacccggggtgccgcggccacggcggggagcaggagagcctcgccaccatgctcgtattcggcggcctcgccggcgtcgccagctgggtctgctgctacccgctcgacgtggtgaagtcgcggatgcaggcgcagggctacccgccgaggtaccgtggcatcgccgactgctttcggcggagcgtcagggaggaagggctccccgtgctgtggcgcggcctcggcaccgacgtcgcgcgggcgttcgtcgtcaacggcgccatcttctctgcctacgagctggcactccggttcttggctagcagcagcaacgaccagaggctggtcatggaggagaactgaatcaccgagacggcgagactgcaggggttgtacatagactagtattcattggcagcatttccgaggctcgtagcgtcgcaagaagatgagattttcagagaaagcatcgttgctgcagagttcgtgtagattggcattataggtttgccaaatgatgatgatgatcaatccccaattgtctagggaaaactttttctggtgtactgctattacagatataataacattgtttgagacagtaaagactaaaattaatcttcttgtcttgctgggattccatgtttactctgttgtttttcctaaaaaaaaaagtttactctgttgtgtagtttttttttctcagttcagacaaataaacaaatacccttttgctaattcacatttctaaacccttagaaatatgcttcttttttatcctctgtggatctccaaaagctcaaagatgcacattattttcagtttcccgtttgatttttttacttctacaggaaaaggaggagaatcccaatacaaaacaatggtcttgtgactttgtgaggtgttttcaatcaagacaagaaaaaggttgctttcagcagctacctcaatgaacaagaggaaggcaaaaggtagactcttttcttgggagcactcgtggatatgaaattaccatttatgtgtaatctttttctgcttacgattggcgaaattgcaggctatcttactccacccaaccaggtctagatcctgattccaaaaggaatccagttggtttgatttgatttgaggtcccagatccctggagaaagctaagccaagtgagaaagatacagccgtgctaactgattgctttgccaattgtcatggaattttgtccttgtccatatcttcaacatggattcacctatttctgaagattcgcagaatcagacaagatcatattctatatcatattctcaagacttaggactccatcgaggcatatttgcaaaagaaaaaataatttgtaaataaaaattttatatacgtgttcttaatgatctaaaagcaaaagctgaaaaataaactacgatgaaaaaactccaaaatcaactccatatttaaggttgaaaattcaaattttgacttataagcataagcataagccaaaagatgaggttgttagatcatataatctttgtgaaatctcatatccttgtatgatgtcacaaataagtggtgtatcgaacatcagcatagtctgtaaagcacactccatatgagataatcttgggaagacattatgtaattacctccatccctttttatacaacgtcagttactaggatcgaacaacaataactaagccaacccttgcgtgcgcgcgggggagggggggaggttgaatggttgtaatacccaaaaccaaaacttttagtaatcgacggatgtcggtctgaccgaagtaggtctgccgttctaacagcgtgatctgaccggagttgatctcccggtctgaccgtcctgaagcgtcgttgccttctgtcgcggtcgccggtctgaccgaagcgatgccaccggtctgaccgtcggtgtcctgctggttggaccaccgcacccgaacaaacacaaattgaagatacctcaaagtagattgaaactttattatttctctctgtgtttacaaagtgcaacaacactcctcacaaaaatctcgactacccattgtgtgtatgtgggatgtggagtcgaatttggagggagtccaaatttggtacaattgagtttgtaaagttctttttcttgcacgagaaggtttcctaggggagtaggacttcttgtaaaaggttggttcttagctttagactgcttacctcgggtataaatagaaagggagggtgtggcatcccgttatcgatattgagagagttaagtttagagaaaagttagggtttcgagatcgtatgtcatatgaaatctttaccaaccacgtgcatggatctttagcctaagcatcctgcatgatatcttgatcgtccggccatcatcttctcccaagttgactcccgatccggcgtcaagactcacatacacatgcatcaatcaagaaaccatatctgagcacatgttctcaccaatttgactcattgttagcacacaaaagtattacatacgccataatatccacctagaaatcataaacatgatttatccataggtatccaaataagcaatccgaaaacgaaaccgacacatcgtcggctggtcagaacggctatcacaacccggtctgaccagacctaatatgtcagcaataatccctgttcatcacctgaaaaactaatatctctaaaaccaccttgccaataatctacaaaaatcaaaactaataatctcatatgccaattgttcgtcacaaaatagcaatcaaacacactttgattttacaagttagttaaaaataagctaaccacgttaaaaaaacaccaaagggcgaaagggcctgtagcctagtagttacaaaagtctcagtagcaccttgggtcctgggttcgactccctatgggagcgaatttttccaggatttaacggatttgttctctagcgatgttttagaatgtagacaaacactacaagggacagtcttgaaaagaaaatccagtgtgatagtaaaagggttgaaaacgagaaaaaaaaaaccgtagacaacatagtgcatacagcgtggcccaaatagctattctgggtccctatcttgctctaactgggctaccagaggtccacacagcccatgtggagaatacatttccaaagttcaaaataagcaaattattttttctaggggcttggctagtaccgagaattaacacaaagttttccaggttagtagtaggaaaaatctatcagaataaaatatgaatgcacatagctggatagcatgtaacacatggcaaaaatgtgtgcttccaatgctatatgcaacgtcatatatagggacaaaactagaactatttgaagggaataatttcaaggaaaaatatggtgaacttaccgcatcgcaaggtcaaatactcaatcaatatacacgacacatgtacatttgcaagtaacactgtatatatagatggactcttgaatcgtactcgagcattctgaatggattgtttctggatgaaagcccacggattatctacttaactaggtgatttcttgtgtgttgttgcgggaattactaagtagtcttttatatgttttcttttgtcgacaattgagctatgagtaaaaagaatattagttattaacaacaaataaaaccgatttatgaaaccatgtttgaagagaaatacatttcatagactttgtatgagattgcagatgaaatattaaattgctagctgaaatttgcatcaagcagagataaggaaaaaaaatgaagaaagtctgagtttattagtaataatcaataaataaactaaatgatataccattctttgatggataaatatatattaagtattataagaatgataaatagatatgctgaaatattgtaaaaataatgtgaggggtgatgcatattgatttgtaaaattcattaaattttagatgatgttgcatgcttgcatgagttttggtatgtaattattgctagtagatgatgaggtgatatgtttgcatgttaagttttagacttagtgggtacatgatgaggtggcatgtttgcatgttgagttttaacttcagtaggttacaactgttgggggaaggattgtgaccctttcgtcagcgcccccctccccccgggtcctgaggaggctagggtctccactcccagggccgccaccgatgccttgcggagtcccgcaaggcgggctcttgatggagccctgcgaagttggcaagcccgtagagggcagttggctccggaggcctcggaaccaactgaagggctccgagggtctcgaagcccagtcaagggacccagagaccccggagtcggagcctaggatggcctccagaagtgggcatgggcattgctcaccctccaaccaccactgacgtcacggcacggaaggcgatgtgaaggccaatgctagctattacgtggagctcgctattacccgggtaaaagctagcatcatgatggcaccataccgccttcttaatgggcgcagccggcgtgcgttcgggtggatttgacccccaacctgttggctggcccacccgtcagccaactcgggatagctaggatgatagggacaattttgtaacttcctttatatgctatcgggtataaatatgtaaatgctaccctcagaagagctcagaagagggggattgaaccatacacagaaacacttgcttagcattcgtgagttgtgttccaacacaactgtatagaatgtatatattatgtggaggactaagtatattataagttgtgaacataacaatagaacaaccgatataatagacgcaatagatttttttagaaatagtgtttttaagaagagtagagtaagaaatctcgagcaataatcggtggataatctaaaaagaggggccaatatgatgagttagcatgcattacgggcacatgacatgatctagatccatgcagggcaatcttgcacacccaacaagtgttgattataggcctcaatcacaatcacaatcacaatcacattatattgatgtgcctcaatcgactattgggcacatctagacaagctgtaatatggattttaagttcctggttagcttaaagaaccgtactgtgtacacatgaactgagctcatctaatttgatttcttgtgctgaaacttatccatttatgttctaagtcctattcttgacacgaccactcacgtttacagttgattttctttccgtcgtagatatcgaaagcgagacatttgtatacaccgatccagtgttcgaagatgcttatagaaatatgatatgcatatgcttattcataagggtgagtgcgacgcttaagctcacgtgtttaggaaggaaaaaaagctcatcatgggacgctaaatcgtcggagctctgccgaagttcgccacggctagggaaggatgtcgcggtgcacaaatcgtgtagctgacctgacggtcatgattttgtaaggtttgcgctgatttttaagtgaaatacctagtaccatttagcaaattcataattttagtataattcctgatccacggtacgaatcgactttttgggcacatccagacaagctgtaatatatgaattttaagttcctgcctagcttaaagtacagaactgtaaaagctgtacctttatctcgcgttttgtaagccaggatgctggttgagtaatatatttctctcccccccctaaaaaaaaagaacagtactgtacacatgaactgagctcatctaatttgatttcctgtgctggaacttatccatttatgttcaaagtcctattcttaacacgatgactcatgtttacagttgattttctttccgtcgtagatatcgaaagtgagacatttgtatatacagatccagtgtaaaaaatgctcatataaatatgatatgcatatgcttattcataaaggatgagtgtgacgcttaagctcacgtgtttaggaaggaaaaaaaagttactgtacactgtcctcttgttcttggccgggattgccggataaactctaggcgatcgacacagaatgggaccgcggcaacaatatttggagcacacgctgcccaccaacacgccaccacacacacacgcgcacgtacagtcgtccaccactaccccgcgtgatctgacgatgtgagatgcccctttcgtccatccatctctcgttcttcaacgactgaaacgaaacgacgggcggctgatcgcgagcacccctgtcacagcgctcgacgcagccgccgccggtcgcgaaaacgcgacagtgcgcgggaccccgcaccggaaatggaattttttttcacgaacacgtaaagaattacacgttaatatattaaaaaaatataataacaccacgcaatcagccagaccggcttatgctaagggaagagagaaaagcaaaataaaaaactaaagcttagaaaaaactacggtggctaaaataaaactccaaatagcgggaaggagctgagccacgttacactcctaacaagtccctagaaatggcaacgccagctaacaaacacatacgacccttcgagtaaatggactccagaaccactaagacagaagagagctcagagtcgaaaactctagcgttccgctccttccccccacacacattcacacgtacagtcgtccaccacggcaacaacctaaaaacggcagggcacgatcgaggaaaaacgtacgatccgggaagcagaaaaagggtctctcttcgggggctcgcttttcccatcatttcaggtttgcgatggcgcaatccacatcaacatccaaccaaaccaaacctgtgcgttggcgcacgggcagggcacaccgaacgggccgacatgtgtgggcgtgtgggtcacacgggaccaatgcgcgcggcggctacgttaccacggccccggcgctcgcgcgcgcgcggtggctgcaagccggccggccactagagtagagagagcccctgcatggctggatctgtacagatctcaggctcgacaaaggggtggaatctttccgtgccggccggaatctgagtgttaatgggtgtgttaggacaaagcccctgttgctgcagcatcattattggtaccactgtccttgttgtgttacagtatgtacgagtactatttcggtggatatacacatgtagtggactagtatggcttctccatattcattactactcctatacatgctctgattggtcaaacgaactcgctcagcactcttgcacatatcttaagtgtgtccttgtaacgcaagaagggatggacactaaatttgttcaaaatgcacccagttgttgccatgtggccagggtgaaaaacggtcggaaacgatcagaatcggtagcatttcttcggaaacgattctcaatcggccggtaattaaccatatttatcatttaaactattcagtgttaatattaatacgatgcagaaagaaattagaaaaaaaacaaaatttaaaaatagcaaaaaaaaaaacagtacggtcggaaacgatatcccttatacggaaacggtgggcggccgattaggaatttccgtgaccgttttcatccctacttgtgggtaatcgtggatggcaaaacttttgaatctactatccttttactccatactaaatctaaatgtgtttccacatagtttatccgagtaaattccataactctgttcccagcagatcatgagtggatgtacatgcaacaagtcagagaataaaagctgcattattaattctagaagccgcaaaagggcaaagcagggttgaaaattccccagaacaacatacatgtgtaaagctgccaaatactactattccatatactaacctgaagcacccctacacacatgcattgatgcatatgatgcatcgacggatcgatctctgcaggttgcggtccggcccacaccgtgccgtcgcgcgcatatacatgtgtcacgtcagggtgcatcatgtggcacggaatggaagcagctacacaagtatacctcggtcctaatcctaataatggagatcgttttccagggcctaaaaaacaacaaccaaagcgaaaggaaaaggaattataattaaagtcgacggaacccccccaatatgtggcctcatgattatctggatatgccaaatgccgagcaaaagtagtgtaggaatgacgacgaagaagagcatcccgttggcccccgtcggctctccccttcgcacacacgacacgacatgacatggatccatcgatcggccagatgtaggagt

SEQ ID NO: 80887 - DNA, 25432 bp, Oryza sativa
tctcccgcctcctaaccccaagaattctcctggacaccaccgccgtgttcccgccaagcagcagcgtcgtcgccccgtcgctctcccgccaactgcggtgcacgcgcacgggtgggtcgccgccggcgccgccgcataggctcgtggcgcggcgggcgatgagcaacggggcggcggagccggccatctacggcggcggcggcggcgcacaacaggcggcgtcgtctgctgcggcgcggcgcgtgacgctggcgacgctccgcgggaagcaccggcgcggggagccgatcagcatggtgaccgcctacgactacccgtccggggtgcacgtcgacgccgccgggttcgacatctgcctcgtcggcgactccgccgccatggtcgcgcacggccacgacaacaccctccccatctccctcgacctcatgatcgagcactgccgcgccgtggcgcgcggcgcggccaggacgttcctcgtcggcgacctcccgttcggcagctacgaggcctccaccgcacaggtaaatctagattctagacgcggacgccacgccattgattagctcgacgacgagcagcacacatgtactgaaattaactgacacgtacgtatcgtaggctgtcggctcggcggtgagggtgatgaaggaaggcggcgtgaattcaatcaagctggaagggagcgcgccgtcgaggatcagcgcggcgagggccatcgtggacgccgggatcgccgtgatggggcacatcgggctcacgccgcagtccgtcagcgcgctcggcgggttccggccacaggggaagacggtcgagagcgccgtcaaggtgcgtgtgaacgcgtcgcgcgcggcggggcacggcgcggcggcgagcgtgtgctagctactgatcatcgatctggttgattgcgcacacgcaggtcgtggaggcggcgctcgcgttgcaggaggccggctgcttcgccgtcgtgctggagtgcgtgccggctccggtggcggcggcggcgacttcggcactgacaatcccgaccattggcatcggcgccgggccattctgcagcgggcaggttcgtccattattcgagcagagccggttgccattctttactttctcaagttttcgaaaagaggaacgtattatatgtacacaagctttgtatatattctcggtgcacaacaactaacaaaatatcacaattttttttattaaaaaagaatctacatctaccaataatcacttacgtggttatgcataatggacatcttcggaggacattgatacggttgcacagctgtagcaactacagtatcaacagcacaaatcacactgcttttttttataaacaaaatcacactgcttatacggttgctactgctacagcacagctaccgccatagccggctgcagcgtcgtgttgctgaacagggcccaacgaaaactataattcagacacttatatcaacattttttttaaacacccagtacaaagtttcgttttaatataaaagtaaaaagaaaaacattaagtctcatatcaacatatttgaatttctaccgcaggtcttagtctaccacgacttgttagggacgttccaaacaagtcatgccaaggtaaatgccaccttcttttactgatccgacctaaaccattttttacccgttacgattttgctctttgagctcatagtactgaacttcttactctatacctgactacatctgcaggtctcgccaaaattctgtaaacagtatggtaacattggggacgtgattaacagagctctatcaaagtacaagcaagaggtggaaacccagtcttttccgggtcctagtcacacgccctacaaactagctgccacagatgttgatgcctttctgaatgcgctgaagatgaagggcctgaatgtggctgctgatgctgcagccgatgctgttgaatatacagatgagaaagagataaatggaacgccgcagctcaaggtctatgcttgattgttcctagctagctagcaatggatgaatagcaatatggtttgatttatcgcaaaataaataaatgatttggttgctgaatgaagctgaatctgaatctgaagagtgaagacccatcaagtgttatgatcttctttaggtgtatttgaccatggatgcatggggatttcttattttttgtgaagtataacgtgagtgttgtatgcatgaagtatgtatggggagtgcactcaaacctatcagatagtagattccattggtgacaaagttataattatgtattctgtaataagttcatcgtatgctattgttgtggttttggaatgtgttcagcaaaatttgtagcaaagtagtactcctacttttttataagatagtcgcatgtttataaaattatattagatcccgcaaaaaaaaaagatattagaaaaaatgactttaatgaatgttcactttgatggcctagaccatgttaactacataagtaaatttcactaaactacaaatgttcttttatcaaactatcataaaacgttagatttgatacattatatcataaaaatacatatttagtgctaaatgtattaaaaacaacatatttatcaaactgcatattgaggttcgaggacatcttttttttccgccccaaactcagcctcaacctgagggacctcaagtgaacttatttccaaaccatccacatcggttaggtttaggtgggctgaaaatccaaatatcctgaaaccaaataccagcccaatgaaactacatattcactcgtgactcgtcgtcacccgtcccaatccaaacccccacccaaaacctctcggcatcccacttgtccccgtcgctctctctctttttcgccgcctcgcctcgcctcgcaccaatcaccacacgcgcaccgcgcactcactcgccgcgcggcgcggcgcggcgccgcctcacgcggcgatgatgatgatgatgcggcgggcgttccggcacctggcgcggcagcagcggcggccgctgagccacgtgccggagtcggccgtctacggcgggccgcggccgcaggatgtgggggcggcggcgggagcgggggcgggggcgggggcgacgcggcgggtgacggtgacgacgctccgcgggaagcaccgacgcggggagcccatcaccgtcgtcacggcctacgactacccgtccgcggtgcacgtcgactcggccgggatcgacgtctgcctcgtcggggactcggcggccatggtggtgcacggccacgacaccacgctccccatctcgctcgacgtcatgctcgagcactgccgcgccgtcgcccgcggcgccaccaggccgctcctcgtcggcgacctccccttcggttgctatgagtcctcctccacgcgggtacacgcgcctctctcatcattcaccccatcgatgctatgccgccgcgttgccgattgattttgttccacatctgaattttgatctgatagacgttattttaactcttttttttttctatattcgtgtttactactaggaaaatagctatgcgagttcatgcaggatgaataaattttggttgtcttgcaatgttatttctgtttggtacaatggggatgtcaataaaggcacaaatttacccccttgtgattacaaaagcagatagtgtttggttggcgatgctagcatctatgtgttctaaggaatttgattgatattggttattcttatcacaaagtttctgctatcagatgaagtttttttatacacaatatatgtagtacttgtgttattttgttcacctttcgatgacacatgagaagtcgagacttgaactgtcagtagagctctgtttcttacgttcagaacactagcatatgctgaaatttcagctcaaaacagtataaaataacccaaaagatcagcttgccaaatactttttaagtatttcacatgtatgcatatgcatacatatgagacattgagattttcgtggtgtatgctttattcgtaataggctgttgactctgcggtgagggtgctaaaagaaggtggaatggacgcaatcaagctggaaggaggtgcaccctcgagaatcagtgcggctaaggctattgtggaggctggaatcgctgtaatggggcatgttgggctcacgccgcaggctattagcgtgcttggtggatttcgaccacaaggaaagacggttgatagtgctgtgaaggtgtggttctcttgattttgttggttacttggctcttagcctgattcatgttctttcttcatgtatagatttgccccatgctgttctgcttgtttgtgtaggttgtggagacagcacttgccttgcaggaggctggctgcttctcggttgtgttggagtgtgtgccagctcctgtggcagctgctgcaacatcagcattgcaaatcccaaccattggaattggtgctggaccattctgcagtggacaggttcagttattcagtatacttcacagttcacacttctacagatatatgttcattttcctcaacagtttagattaagccagttgtatctattctgattcttgcatcatttctgtcaatgcatgtgtaattttgtcctttagcttccttgaataaataacttcaataaaatctgctacgagaccttgtcgagtatacaaattttatgaagccctcatgccgaaatatttgtaatgcaggtcttagtttaccatgacttgttagggatgatgcaacatccacaccatgccaaggtaaatgacacttgacaccatcctttcaatgtcagtaagcagctttgctttgatgtgagttgtgccgagctgaacaatttgtataatcgcttactgctctactgcaggtcacaccgaaattctgcaaacaatttggaaatgtcggtcatgtcatcaacaaggctctatcggagtacaagcaggaagtggaaacccggagtttcccaggtcccagccatacgccgtacaagatagctgccgcggatgtggatggcttcgcgaatgcactgcagaagatgggcttggacgaggctgcaaatgctgcagctgccgcagctgaaaacgcagagaaagatggagaactacccgagaacaaatgatttttttttctgttggtggcttcgagcatcagagcctgccacaatgtcgccacatctctcaatgcaatcctgccaaggctgcaggggtaactgttgtcggaaacgcctgcacagtgtttgggtaatctttcctatgccctaacgtgagtcttaaaaaaaaaaagacgatgacatcgatcccctgtccgggcaattataaactggatgtttgggagcgaattgcacatctcaacgtattcttgctctgagtgacgatttcgcatctatctcgacaccacccatcatgggatgcacacgctctgaaaggaagcacataatacacacacagatgctatccagctactgaaaggaagcaccttaatgcatttctccagccaagctaagaacagaactaaagaatatgctgttccaatgctatatattcactcgccatctagtacataactaattcagaaaacaaaacatattttcttgctttctggactctgctctacatacattgataaaaaattctatgcacacagccaccatatgacaccaaagtatatccggaaatcctagaagtggcaatatacagatttaccagacctggaaatcctaggaagtggtaatatacatttacagaactataacctgttcttccagattagcattgtaacattgactatcatggctggttttgttagaaattcagtatgtgcgaagtgcataagctgaaatgtggaccaggagcacttcatcagtctcatgtagagctaatcttagttatccttgagtaatcgccaacgttggcaacaaagagtgggtctttctcgtcgctaaagatagtcttctcgcctgcttgttctaactctttagtcaagtcttccattgttttcttcaagttggctttgctcatctgtccaccttcgcccattgagataccaaccatcgtgattttggggagaagtgggttggcttgtaaatcattgttgatgctggcatcacatctgttcatcaaacaaagatgatttgaaaatttgtgcataaatataaccataagaaagattatacaaataaacaaagcgacttattaaatagattatgataaacattaaacaaacaaagtacaaccaaagcacaaaaccaaaattgaggctattgtatagaaacatgattcatagagtgtacacttcatgtgcatgacagcaagagggaagggaaagatgaggaagaacagaccttctgaatgctctgtctcttccttgtgctttgaaacttctatcatgacctggccatatattaggaagcaggttgctaaatgggaagtgagattggccattatttgagttttcatgttttccacggttgctgttatcaacgtctgactccaaagtttctggttgtttactaatttggaagcaatcagcatcctttgaagcagtaaaactactactggcagtagcagccctgtcaattgcagcagcagtcctgagagtgaataaaacaagagaaaggcatggatgaagcaaaaggtagaactaacagatactgatgaactagttaaattagtgtaggctatcaatgagtattcacacaagaaaataacaggttaaataatttgtttcagtatctcaggaagtttgattattttttaggcctccaataatcaagttaaccattttttctctcctcttctcaaggtcagatctcagtttttcaacaaccttctctgtacactaaacaaggtcatcaagctactgagctactagaagcagctttttttaaatatgtgataaccagggtacgtgtagttaaaactaaattcaaacatgttaaaaaaatcatagaagtatttcatgaccaatctaaatcagcttggccgttaatctccctcaagttaatagcaatcagcgaagcacttctatattaaaaaatgtaagaggcgttaaataatttaaacatgcattgaggatgcacctttcttcaaatgaatcaacgacataggggaattgtggctgtatgccagtagcttttctcaaccacttatttcctagaagcattttatcaacaacatcaagaaattgaatctccgctgcttttgttacaacatttagcggtatcccaactggaccaatctcattcatcaactcttgtacctacatcaacatttcctagcaatttgaggggaccaaaaaaattgtagaagagattggagacatctcgtgcatagctaatgatcatattacctctgggggctcaaggaaactgtctgcactttcttccatcatttcagatgtcaaactatcatcaacaatatctctcctacgccgtgtgtggcgattttggaccattgagtgaaaatgttgatccattgaagcttcaagaatattgtccaacaagtttttatcaaaaaaatatggtgtatacctgaaattgtgatcagcagaagaattcatattgtgctttcaaacaaatactgaatacacctaaaggatctcctatgctttctttcctatcaccaaatagaagcatccactccgaacaagaactgctatagatggcaaatggaacttcactgaagaatccacgaatacaagataacattttagttgatcaagtataagtaatccaaacattttggcatttgacagaaatcagcacctaatgttgagtaacgtttaagaataaagaataaatcaatgttgtttggttcacaatgctgtcagttcataggaaaatgaagcttataatgaacatctgtggaaaaatatataattgcttattcttctcaaagaaacagtaaaaaatatcaagaattcaatccataccatctaattccatcattcgttgccacggcaatatttaagttttgagcactaaagacggggacaccatcaagttttttccttcttctcctttgaggaagagactttaagagcttattggcagccttaacctataatggaaaaggtaatagcctctaaatggcacgttcaaatttatgcaaaactgaaatatttcagcacaaacctgcttttcacttggaacaaactggaacatttgaggtttttcctgaaaaataacaattacagggaatatgatgaatacaagatgctaaatgtttgatacgcagatatgaaaatgactagcatagtgtatgtgtgtgtgatgggtgataaataaatatactacaagatccagagtaaaaatacatactacaaaaaataacataaatattcaggcaaaacctcatattaaaaaaatcatcatacctaccttgaaatgctcgtatgccacatcaaggcgacaagcccccaccataccacttggcacatttaggcgtttaacataagatactgaatattttaaaccaagttagctaaaattattccctgcaataactaaatgtttgaaatactaagttatgtgaaagccagtaatcagatgtatctatataatgcaaggaaaatttgctcaggaatgcaaagttatttctagaaatacaagatccaaacctgaaataactatataacacagaaaacataggccagaagaataattaaggattgaagaaaatggcctgcccaataggcaactctggattaccaagtttttggtgtatcagatgtgtaagaggtgggtcgtgggtggggttgtggggctaggcttcaggagaagctagaaaacacaactataattggttttctgttagttttctaagcccgagtgaaagcaaattctaggcaaacagatttgcgagatatttgctacaaattttgaactgaaattctatgcagtgcacaaaatctcctctatcaaatctaccccctaatagagctgttctacaaggtgcctgctgtaccacctctataatccaataagttcatgatgcatcaagcaacaagaaaacagagtatttgataacagaaaatacctgcatcattcaaatccataaagaacctaaatactggaccattttcactcttcttcaatggcgataagatccttttgaaccacataggagtcctgagaaaataaatttgaaaagtgcaattcagtagacaactaatacattatgatgccattatatgttacaatcaacaatttggattgttatcagatagtgtgagtactaagtaggcaaagccaattcaacaaagtagaaacttgcaaatgatactccctccgggttgataatatttgtcgttttggacaagagcacggtctccaaaaaacaactttgaccattgttttccattataatatgtataaaagtgttaacaaatatatgattttattaaagtacttttaagactaatatatgcatgtaatcaccatatttgaaagataatgattttaaaaatgattcataatcaaagattctaaagtttgacctcacccttgtctaaaatgacaagtattatcagcccggagggagtagtatttcagtatctgaagattttaaaaaaaaaaactatctcaagattaaaaaaaactaatatttgcatttcactgtatgcacatctacggtgcttcaggttatggagtatcacatacaaggctcaatcccactttggtctgatggtcagcaggttctagaaaaacaaaaaccaatacagcctgagcctgccatgttggcattctatgtgctggcgtcaaggtggacaatatgcccaaacgtctggtgcgagttgcaatattggcacactgggttagatggattaatcaatgtagtataataaaaccacttctaatgagagaatcaattcatggtagcggtaagcaggtaagaatttctcctagattatgtaatccacttctaagaagtgcatagtctagccgtctagcgcataattctcactcagtcaaaacaggtgaaaaaacatttcgtgtcagcactcagcagtaacgaaggccccaatctaacatagggcaacatcaacagatacactgctgcgagaaaaaaggccaagaacaaactgcgcaggaagcaaaccctccacgggaggaaatggaaatggtacctgctggcgaggaattgggggagctcgaagcgggtggtgacggccatgaggccgttcccggaggggtcgagcatggtgaacacctgccccacgaacgcggggcccccgcccttccccaaaccacctccaccccccgccttgccgcctgacgccgccgcggccatccgcgccccacggttcgactcgggggaagccgcggcggcggaggcggaggaggaggaggtgatggggaggatgagagggacggcgaggtggggagccgggggcgagggcgagggcgaggcggaggttggggacggggacggggaggggaggaaggggagggtggaggcgaaggcgtggaaggggttggacgccgacgagacaggtggtggtggtggtggagcggccgcgcggcatggcggtggatggcgccgggagagagcggcgctgctgttaaaaaagtcacggtggcgatgaggggtgggagagcgtttcgttggatttgggcttggaatctgggggatttgcgggtggtgggtgcgttgcttcggcgagggattagcttagcacgcttttggctctacctcgtgttgccttctctcctctactgattaattactctcctaatctcatctcctgtgaggtgtgagaggctagggaggttgataacttgattgatttcgagtcgtctaggattaattagctgcagtgcagtaattggttaaacgttgtttcaagtcaatgccttaacatccagattatccgtacaaacacactagttttattttgttaggtgaagctccgaatgggtcgaaactcagaacaccttttgtctattctctgtacaatacagaacatgatttcatcctgacaaataagttcgatgtcatactccatccattgtgctttgtcgaaaacactaccacagccgttgccttcaggcttcgataatcgaagcagaggacgcacctttccacggttctcaggagaaattagtatcaccacatcacggttagattgctttcctttcttctcaacaatcagcaaacggctaccatcttgatcacttcggtgcaggcagcaaagctagctaaaccactggctacattttttgactgaaacgcagcagtttctcttccatcagctaggtcaccttcataacaaagcaaccactgaagattgccgcccttctgtagggttagctcgtagtacgtcgtgccagcatcctctatgacgtagtgggttcacatactgttgtccttttatctgttctcatcctggtattgatcctaggaccggtattcctgctgttgctttttacagtctcttttctaggaatggtgcgctgtacaacccggattggtatccctccaatgtcgaaatcttctttgagagattttgtcaagaaccttatatctgtatcagatagctgaaccttcccactcataaaggcaacgaacgtcggtggccgtgctttcacctgagtgaagtacttcacttttggctgggtagctgagtctttccaggaatgtctgctcataacctgtcacggggaattcaaaggaagactaatgtaaatgtcgaagtgacataaaagactggcgatcaataatttaaacatgtggtcaaagtagagaatggcaatgatatctaataagaactagtcctgagaaaaaaaaaagaactatggaaatctgacatccctaagtacagatggcttagatcaaccactacagtacaaattgatatttctgaacaaccccctagttattccattttgcaagcacaaaatcccacctagtgaaggtaactcactttaatatgcagccatacaccatcaaaattcaatctaacagcacatatttaagttactactcccttccaagaatataaggatatctggaggggggttttttagagagattaaggttgaggtgaaggatggttgtgattggttgatatggggaagtagatggggatgtcctcaaattattggacagatttcaaactctagatgtccttgtatttctggacagaaggagtgcttgttgctatcctacatttacatcacttgccatggttgttaaggcgtaaggcgacctgaggcgatccatcctcgccttactgctataatccacactattagtagcgattagaagagggagagagaaaattagccctgcagaccagcccagaaagctcatgtcgcccacaaagcccatgccacccaaagttcaaagagatagccctaacacagtgtcaggcgagtctctcctctcacagcaccaccttgatgtcgcttcttcttccttgcgcaagctcttctcctctttctgcgctccttccctgctgattcagaatgaatccagcactccactctgcatgtgctccttccctgacttggatggatctggctgctcccctgactcaaatcaatctggtacagggagagaaaagaaaggtagtggagaccagagctaagggggagtaagatgggggatgacatggagcagagaacaaggaagaaggggaagttgctgctgccttaacctctccctctctccctctctgtgttatgcccttaaggcggagggacgccttgacccctgggagtgccttagcgctatagcgacgcctcaacaaccatgtcacttgcaattcctacttgtcacacaccctaaaagcaagttctgtaatgccaatgtaagcaccgaacacttgagcaagatgtttaccttacgcaaccaacggttcagccgtgaggtcgacaaccttaaacaccatttctcataagtatctataacctggcgcatgacagcaatccgccccctaccctccaatgcagacataaacacaactggtattcctgtaacctgccagaaataggagaagattagtatattttgtcacgtggtcccctgtcaaaatatgaagcaaactactgatatattctggtaaaatggttcactgtaattctccctttttagtgaatcaaagttatacgaaatgcactggaaaagcaacacttcatatttcataatgatattactacactaaatcattaatagatatgcaacgtgctctggaaaggtcaaaaaaataagccagagattagattgcacatttccagccattagcagacactaaagaaatcatggtttgtcaatcaagaacatggaagatccatcaaaatgaatctcaatatctacattccgtcagtagacagagcaagacatctccatgtgcaataacaaccaaaacaaagaaacttcaatcttccatttctcgtactccatcggcaaacaaagtaaagcatctacatgagtaatactcagaaagcactaaactgataataaaacatcaagcttgttgctgaaaaaactgattataaacttggcaaggtttcaactaaagaacaaataatcagaaagctttcccagaatcaattggaaatgaaagtctccaagataattagataatacttagcagaaattacacaaaagtttccagtgtctgtgcaatcatgttagcagtatataggtcaaggttgtaggttagtacaacaagaaagcaaacctggggaataactgtctggatttctttaggaacagcatctatcactttgtcaaacaatggtcggttttccctaagaagatccattttgttgacaatcacaacaagtccacgaccttcttctattgcttgccgtgctatcagaacttcagggtgattcatgctacttttagactttgcaatctacaaattaataaagatttgttatggcattggccgttaaaaatcaaatgacagcaaatgcatagacatgcaaagtatcagactggtatattcaatttaaacattgactatgatgcttctgatgcttactagtttgaaataggactgacattacaacatcaagcttacaaaaactaaattcagtacattaaacagaactacggttaagaagtaatagtattgaggaggcgattgttacaaaataaatgactgtacaaaatattactggcactggaccaaatttcacatgtattttacataaaaaggtggtggcactcgccataaatgtgaaaagcacatcaactatgatttacaaccaccaacacatccaatactagcactttagtagtgcagccccatgactaatgcaacttagtttctagcagagtacataaacaacgttaacatgcttgatgaggttgttcatcctctgtctgactctttgtacttggcaagttgacatagaacttatgcatatcaaggttaaagagcagataacccaggtgatctagcaaatgcaattggtaaagaagaacaccacaatcaattgagttattgtttattccctcaaatattcagacaaaagtcatacacatgtagtgatgcctccattagcaaatcatggcttgagaggttgaaatgttgaatagcacgccctgctcaagtgcaaatcaggattttttttttccacattccaaaggggcatgaatatatgccacattaataacatggcaccagaaacccgtagtaaaagatattcacttggagttcttcgttatgaaaaaaaaaagacacaaactacagaacaggggagcattgaaaatgttatcccttaaccatatagaaagaagcatagtaagaaatatgcaggtcattggctcagagcacatcaggatgaaattaagtaccttttctccatccagaacaagagctacaatatgagctctcatcagattctttcttgactgcaccacgctcaacgatgctggacctttctcctttcctgacctttccatccaacctgcagtgtccacctgcaccacgaaaaaaaggaaaaatgaaaatgatgactccgttcagataagtagcttgcatggacattatgatatgagctcctagattgcaccatgcaatcgcaactttgagtgaatttgacacactccaactagataatatttttaaacaaataatcattatgttctcgcaaaaaggctgtgtgacacatcatagtgtaagaccactaaagttcacaacacaagcacatatatatatggccaatacaagaaataaaagtgaaaaatataatattgaactcataaaaaggaattaccaaatatacagttcgattgtcaaactgaaactgagtccgaatagagtcccttgttaagcctgcctcggggccaaccagaactctttgttcttgcaacaaggtattcagcagggtagacttcccaacattaggacgcccaacaattgccaattgcaaaggtaacttgctttcatcaccttcatgggcttccgtctcagcctcagaggtagggtcatcttggttgagtccatctatcatatttgagtgtaattcatgaataatttgttcgtaaatggcaatacagtttgcttgagagaaagtatagcattataagcaaacacaaaagactattgccttgaactcaataggttgtggtcactcatttgttgatccctccataacaaacaaaccagttcctccagtaatgtgcatgcaaataaaaaaataaggtagtcccaactgtcaagatatcatttctacttgggcagaataaaagggacagatttaccagatgaagatatgatattgtttagagaagccttgatacctaaacattctgctaagaagaattcatcatagaggtgaatattgtactaaatgtctctcgatcagtatgacagtagaaggtaaagatgcttgaccaaggaggaagcatggagtcagtcatgttaccaaacatcaacacaaatgatcaataacaaaagagtacttactgtttgttagctgaaacatgtagtcctcaaacaatggccttagtgtctcataaagctctgccatccccaggcctgtctctgcagatattgcaactgggtcaccaaaacccaacctatgggcttctccagcagccgcagtcagcactccatgctcatcaagtgactcagacttgttcattgctacaatggtatgtatcccagatgcatgtctccgcagccattgtccaacctcaagatccagtggctgcagaccatccctaaacagagcattgctcttttaataggcaacaagtgccaacacttaaaattgactcaacaatgagaacttgaaaattgaaatcaagccatagcctactcacctgacatcaatcaagaaaatagcaaattgagatctagctaacacattcccagtcatgtcagctgttcgagcaaggatgctaccagatgttgctgctgtctcaagtccagccgagtcaagcacacggaaacggagatcaccaagcttggcaactccttcacgaatgtcacgggtgacatggtccccaggtgtattgtacaccaatgcctccctccttcgtataaatctagtttcgataatcaaaacctctaagtcagaagcaaacatttcaagagaacaagatagtggcaaacaatgcacgctgcaatgccaaagcgcataaactgatcagagtagtacaatgatgagacatttgtcagtatgtacgcagaccaaattgtggtgaatgattcatgaaatgatgaaatacataaagcttccaaggaaacgtaccaacatacttgatgtaataaaaaaaatacataataggttgcatgcgttattgcaaaatgcaaaatattagagaaggtaaatacatgctatcataaaaattaaaatgtgtatgaaaatgcaagttaagtaaattcagaaaatgataaggggtttaaatgtgcagtatcattaagatggcggcaaccataagttacaattgtaagaaagggttatcttgcaccgcgaattttctactagtaggaagcggtaagaaaacaaagtggagtaacctaaaacgtgttcgtggaaatgccgacctcacgatacacaagcaaactacgaaggggggcgtctctcaccggttgaatagggcggacttgccaacgttgggtcggccgacgaggatgacggtgggtaggagcgcggcgtccaccttggtgaagtcgaagcgggactgcttcatggggttcttcctggccttgcccttgggcttcacgggagcggtcgactcatccgctacggtggagtacacgaatccggcggagcctggaaatcgggagaggagaggagaactccggcctgcgttggggagtgggacggtgagacgaggagggaggagagggtttagggggtttggttcgagagcggagaggggggacttaccgagagaaggaagaggcgggaggcttcgagaggacgggaggggacggtggtggaggagggccgcggcagctggacggctccggcggagggcggcgcggaggatggcggcggccattgagggtaagcgggacggcgaagcgaagctgggctgggcgctgcaaaaagcaagtgcgaaaggcccaggcgcccagcgcccctgcgtgactgctttgcgtccctccgagacaatttagccgtaaaactggtgtaatctaacgaagatttaccgtataaacttatgggataacatagtactacctccaacataagatataaatatttctaactataaatatttttcataaacacaatacaaacggtaatactcgcggaattcatcatggatgcctcgcggcacatcctatcccctatgagcatatcttgagattgacaaagtcatcataaccgtcttactcgctgtgtacatgtacatcccgctattactgaaaaataattagacctaaatacgagcatttatgctaagtcgacttgaactcgagtgagctggttccatcacacggaatgtaaccagttaagctatactcactttgtcaaactatgaatcctaggactaaatgggacgcatccaactactactaaacttaagtttgtactaataggatgtgtcccatctaattttcggttcttatattttgaaatgaagaagtaaaagatagctaaaagttattatattttggaatggaagtgcatatacgaatagaggcctaaacaacatacgccttcatctgtattgtttttcttatattatgctgttattatataatacctctgttggtagtttggtttgaaacatagttaaataagcaattgtccctagaatagaaaaagacttatggctacgaatatgaacacaagatatatccaagtttaaacctagaaattaaattttctaaaatgaagatagtattgttattatatagttgggtacttgtctaagaaacatgtttagatggtgaaaacaataatatagttgagtacttgtctaagaaacatgtttagatggtgatttagttttgacagttcgtttttctgattggagataagaatttccgaatggaacaattgattttaatcatgttttaatcttgacagattgtatttctgttcagagacgagatgactacggctggtcaaacgatcacgaacatggtgcacattcatccgcttgtaggcaaatgcatccatcatataaactcgaaaactgtaaagtaagatcgtgctcttgcgtatgcgttacaacagatgctaaatttcacagctaattttgtttctgatagttcctttagtagatcaattgtctgaatgttgcaatgttgacattcaagacataagttatcttgagcatcacatcaaaacaattagacaggtacatagctagagttcattacaaggttagcagcctacaatgatcattacatcagagcctacaacgatcattacatcagacagcacctgttctctactccttgctattccagagcctgtatgtcagaaactacagccctacatcagaggacgacctaggtcacctatccataattacaacacatgtaaatacagatagatacaggagatacatagattagaacggccgttaatctatgtaaagtctcctcaaaacagacacccaaggctcaatcagagtcactgtcatgctcaaggaaacgatactcccttgggccaccaagccttagtactatggtcccggcattttcctcatgccactcaacgccttccttctccacaagctcggcaacctaccacagccatttttacagaattcaaaagcatggtacattaggtaatgagattgaccaattaagagtactagtctacagattgaaagagtaaagatcagcaacacagacactgtcaagagctgcatgctaaaagcattctattatagtggggccatatagccaccacgagatagaaagtaatataacacaggaaggtatcaaggtattcaaccaaacatttcatgagggcagctcagtttaaagaacatgctgataatactataaattaatgaagaaacgaagcatgacaacaagcaggcacacatgtgaggtcccagcttgtctaagcaaatacttaccgcgcgcttatttttcccttccctgtgccttctacaccacaaccagtaattactctaagaaaggtggctgtttataagagcacaagaaaggagacaacagtaggaccatgaagcattagaccaaatcaaagttgaataaaaaatattaacactgataatcagtgtagcacccaatcgggtcatactagaatactcacttggcatgcacacacaaatcatcatgtgaaccttgagaagcctcatggcttgtttaacatgttgcccatgcaggtcaatagtcactgtattcgttatatgcttatttctgcaaacagaagattagcacgcagatgtgatttaaaagtaatagctgggaaagttatgcaaattacctggcttcaaatatttccctgctagctctctcatcttccatgcgagctaattcacggtaatgcttcccctaaaaagacagaattttgatactgaggcataaggaagttactgagatttaacagcctatgcaaagttttaaactttgagaaaattgcagtctattggcataagaaatgttcctaaagaactgtatgctgcactacatcagaaatccctacaacctatctgctatcaccccgccttctttcttttattgaatcatcatagtcatctcagaattaacaaattaaaatgggatatcagacctcctctgcgagataggaggcataagatttttctcctttggaatatgccatggcagcctgcataggaagaaatgacaggaggcaataagaaatacaaaagatagagggtatatgataatagtagttcagattaaaaaatccctcttactttctgataatatgttttcattgtatcataatgccttccagcgacagtacgaaattcttgatacccattcccttaatgagagaagtaggtgttatatcttttcagaagtatcaaatgtaacaataacaaagcacaacaagtgacagttgaaacaagaaggggaaaacaattttactgtattaatagggtgaggcatgtgctcaaaactaaaggtattatcaagtccataaataaactagtcttaaatgaaggtcatacaattattgatcttattatatggtagctcaaacagctacacttcccagaattcattctaaagtgatatttggaagccattgaataagaatgtgaaaacatgctacagatttagaagatggatacagaaaaaattgccagaaataaaggaagtaaaggaaaaaagttcaatgtgatgcaaaaagaaattaatgatcttaacaaataacgacacaaataacagtggctaaaacaacataccattttttggtttttcttgattgttcgatgtgatgggagaattgaatgactgcagcctcttaactaccttcttccagtccatggaacttggttcatatgtgcgttgttcaggtattttgaacagtgaatcgagcacttgttgtggtgtcttagatatcgagcttgttgatcttgtagatgatgttgttgagtggggctcctcacatgcaaccttcaagtagctgttgagcaaggataacatagaaacagtcacataagtgcaaaaatagagttgaacttacagatagcaactaactagttatacaatctgcgcaattgaagtaaataaacaaagtatatgcacctacacttagcataaaatttacaggttaaactggtaaggtcaaaacattgcaagagatacaagccttgactgcaaaaaataagctcacataatttgtttgtccattataaagaccatattttagaattcctaggaaagttgcaactttagtaattaacaccatgcaatctgatgtatctagacaacttaagtttctatccgatcgactgagaatatgtcccatgatcaaagattttctattgtgcttctcgcaaacacatatatccaaataaaatatttatacaggatggggtgcaagaataatgcataggtatatccgtatattatcaatttgacgcatgagctagcaaaaatcagcttatatattggcaaattattacccaccttctctgaagctcgccccaaaagaatccgtgctcattatcggaacgattatatgacatgtttcgcatttcatctgtaaactgaataaaactataatgttagataatagttttacaggggtttaaagaacctagttgaaataatataagtatctagaaggtactaaggaacaagaaggaatcacaagcatgcttatcagactgtatgtatcatgtcaatcaataggaaatagaaagttgaattccaaatgcttgatatcacactctgtgcaaggatcattatcagtgtcaaaagtgaacaagaaaaccaacacaatttatatcattcttgtttgtcttgttagcactaaaaccacaactcagcagctcctaaaaacaagtggtagtaagtggtgtcttgaaagataccttcttatcttagaaggctgtaacacatatatgttagcaagcaagaagatacaataatacctgcactaataactacaaaattataaggtagtctatccaggtcccacactaatataatttgtaaaaaagataactactgtgacctcaataataaccactaatatatgcatgagtgaactaagaatagtctaaattttcagtacggcatatctgcatatgattgtagatagtgctaagtaaacacctggtatgaacttttttcaatgcctgcagttgacacttcctcagacagtccatttcctaggaagatgtttggagagctcatgccatttatttgagcattcgggaaacacctttccatgttttgaagggaagacatacccgagatatcaagtaatgcatccagagcctgaaagcatttcaatttgttaaacttctgaacaaatagctgaaaacttacggcatgcaattctttcagggaaacaagaggaaatgctagttgattagatttcatgcaacctagataacaatccttgctttacaaccttccttttggtttaatatgtgaaaattcggtacaaaccatcaagtttgcccactgatgggtgctcattgacccacaccaatcacttgaaagtgaacatctctcccatttcctagtatgtatcaggtagacaattgaaatcaaataaaatggtgtggatcagtgggtaactgtgggctgacccacgtgcatccctacctagatatgacaaaactttatatcgatgtgaccaacttatcatgagaacaagccaatctggtttagaatatcaagacctacctacactggctactacaaatatgattagatggagagattttcttataagaataaggtgataatattaaaaaaggattatgccaggttagatccagtatacaagaactgtgcaacacagctgtaccatcaccaccttactcatcaatgtcacaagtgaccgcaactgttgatggtatttgatgtccatcgattgtttttttgtcaatagacacaagacactgcaatctgcaaaggctagacatgttccacatgtactacggcatgtgtttcctactgtccacatcttgtgtctagcagaaaggcactctttcgcagccacagtagaccaactggaacgctattcaagaaattggtatcgtctgcgcaatgtcataagtcatgatggatattggtaacaaatgattaccaaaggtatttttcatgtgtgcatgtgttcaacatgacatcatgtaccataaaaatatttcatttacttgcatggctgttttcatgtgcaaaaaaatgacaacttatttttgcaaatgtgcatgattaatgagtggaaattcccggaatagtgcgctaacttgcacaaatgcatagttgcttgttttgagtttgggaaaagaatcaagttgaaaatagttcccgcgaagaaaagtaaaattctactccaaccaaaaggcaaactttttctattcaggacgtaaaaacatagctggaagtcactgagaaatggacccaataagataaatcctttaccttctcaacatcgcatccatattgacctgaacaatagagggaagtaacatcagaaactcattccactaagattcatttccacttccaactgactggccaatcacaaataataaaatgttaaggtaaaagaaatcttttgccctccactagttttagtaagcataaaagtgaaagatttggtattacattcaatgaaaccataaaaatggatcaactttcaacacaacacaacaccaatttcatccatgactagtttcatgacgaaaacataacttcagcagttgtgtgagtaaattatgcagcagttccgcatataaataacatttacaaacatgcagctattcaactaaatgtatagatgattttaacctgcagaacgctacccatgtatgtaagaaaaccagccaatgtccatgacattgaaaggtagaacgttgatctatgatggaaatcagtatgcttccattcttagttcatgcaagaacttagcataaaacaatcaccgtaggcaacaatctccttcacatcccaatgcttggcctaagagaacaacggtgcaccacaatgtatgttggcataacacaagtccaagtgactgatcatacaagaatcttgctctatttattcagggcttctacaatgtttcaaacaaaaaatcaatcctctgaataaccttcctataggacttcatcccaaatccaccatcacagcctcagacacatctgtgctggaagaggcatagtcaaacctaattgccacagatttgagaacgagatagacagcctattgccctttcatttcaagcattttgaaataataataataccccaactaatcaataacattttgtgttgggatagctaagattagtagtagtagtagtagcactaacgtcaaatattattgactggagggagtaataataacaattcatatagaatattagcagatcaggaagttaacacaagattcgcacccagaataagaaaactaaaaactaatcatcatattttctagttcaatcaaacaatatatttgctcctttcactagattggcttatgaactgtgcaatgttatggatggcatttggattctctttttgtaaacaagaaccaaccattccttgggggaaaaaatatatcttttgaatcgtagatgctctcctgttgtgtgtagtaagtgtttctatctttatttcattctttgatgtattataactctgctgggctcttacaacggtaaaaaaaatgcatttttttacaggtacgcttgttaggcaaaagcagcttaccgagcacgtctctgaccacacccatgccaagctccgaattatcccccagcatagagcacaggaactgctcggcctcttcaacactatacttgcggtcgccaccacttccgtccttccaagcgttgcccttccacgcgttcgttttgtttacgggcgaagtggcaggtcgcgtgtacgccttaccgatcacgtccgcaaccatcccggtcgcagccacggctaccttcttcggcctcctgctggccttcctgccaccagatccggcccgcggcgagagatccgggggccggggtggcggggagggctgcgtttcgggcgaggagccaaggatgccggccgcgaggaaggcgtcgccgccggcctcgcggtaggcggagtccacctggtcgatcgtggcggtgccgaaggcgtccagcagccacgccatgtcgcgccgctcgtcgccggcggccgacgacgacgcggtggaggccgacgacgagaaggcggagagggaggaggtcgaggccgcccccgacgacccggggttgaaagccgacgacgacgacgagcacgtggacgcctcgcagctgctgctcgactccgtctccgacgccaccgccggcgccgccgccgcagcagct

SEQ ID NO: 80888 - DNA, 514 bp, Oryza sativa
attaaaaaagtaaaaagattgagaaagatttattatatatccatcgaggtgtgaaattaattctttttaattcccttcatctcataaggagtaacccagaacaatctcgataacgaattggttaattttgcgtctacgatcaataccagttttttccttcacctgggctaggagtgtagattctccgacaaacaaacgaaattcatgttgaggaatgcaaattttgtcccccactctgatggcctttatcgccattggattctgttctttttctgatcttaaaggtccagccaacttgtagttatgctgtactctagtagcctttcatttgatagagacggtttataatagcaaatccaaatcgcaataaatcaaatagttgatgtagatggcaatctaaccaaaatttagatcaccacgagagggttttgaagcgtcaatagaatccaaacagtttatgcatagctggcaagcatttcctggcatgcgtatcatataattggccacaatgttt

SEQ ID NO: 80889 - DNA, 654 bp, Oryza sativa
gtttgcttttgtcaccaccgactgttctttcgttgttgttgggcgcctacatcttcactgctagctgacctgactgttgctgactggtttcttcgcctccatggttatacaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtttattttctatgctcaaagactggaccaattattattctccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgcctgcagcccatattttcaggtgtggcctgtcacgtt

SEQ ID NO: 80890 - DNA, 981 bp, Oryza sativa
gtttccgcctgcacggctggcctattatgccgctgttgttgggcgtctacgttttcaccgaccggccgcttcgaccgccgccgactagtgtttccgcctgcacggctggcctattatgccgccgttgttgggcgtctacgttttcaccgaccggccgcctcgtccgccgttgttggatgtctacatcttcaccgttggctcactttcgttgccgtcgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgttcggtttgccaatggatggttgcctttgggccgattcctagcacccgggggctcgttggatggaccgaataacgcaaggtgctaagtattattcggaataaatcaaaagcatagagataagataatttattttctgctcttaataattgcaaaagtacctgagtagtaaattctaatccgtgaaactttgttccattaatgacgaactcatatcactcatatgcatgtttgggaagtgcctaggccgactcccgatgcttggtggttatgactagtcgggcagagtgtttaaacgtacagagtcatctgctcggggaaatcaaaattgacaagaggagaaatacatatttataaatattttaaaatacttgattttttctcgagtat

SEQ ID NO: 80891 - DNA, 1987 bp, Oryza sativa
tgtaagcctaaaacttttgcacatctaagcttcatgcatcactaaaaaaaacagcccacaatgagtcatggcagaagagaagaacacaacaagctcatgtagtgaatgttgtagccaaagatgaggtaatgcagcatgttttcaatttgtggaacaagaataaacctcaaagtataggaacagtgaactagagtattcttcttctctggtcgtggttcttagaaaaatatcaccatcatagttgtttactatccaaaccaatgcacgcaccgtctagcatatatcagattaacatatgcaccaaacttagtttcacccatctggtccatacagtgaataaagcaaactttataggtctataggtacatccaacccaaatttcaaatttatttgcacagagaacttaaagcaagcatattagtgcaaatctccactccccagctaggtgaaatcatggtaattccattgaatctttatgtagagaccaagttaacttctcagtaagtagcattccagagaaaaacatcatgtaccacataaattatcaggtaaaatccatttttatcccttgaactttcactaaattcctattttcaacctcaactacgaacccatatatttttcaaccccaaaccttaaaaaccgggtcaagtcccaagactaatattttaatggtgttttttaccacatctaaaacaacaaaaatatgttaaactattctagttgctaatattatagtgactcaacatgccaaacatttcccggggaaatccacccccccccccccccccccccaaatcttcaatcctcacacaatgtagtgataagagaaggagatgcaaggaagaaggatataaagcatatgatatgtgaagcaatgccgtgctagcaaccaatatagcatagcaatgtgattctcaacatggataaaaccagcaactaaaaacaatcatgggagaagtttgtctggtttcaaaagtttaggctgttttatagttcaaggtgaaagatgaactttgatggaagtttgaggcctaaaaatggactttaccctaaatgaactcggtagccacataggagcacattttgatgataataataccctacaaagtacaaatgtgcatatcccttcaaaaaattgcattgaagattgaaactttggaagaaaaattctatatttcacctgtcctgataaatttatgctggtactttttaatttcccccatgatgaattgaactctagtctctaggcagccgatgcgaaattcgatttcttctacaagaaacttataactatttcagttcaagttgcaacataagtagcaacacagatagttgagaccttgagcctccgtttggctacgcggtggattcagataatcccaatagctttacaaattttggtgtctggcaaactgatttttcctttagtttggtgttacaaagggtaatattattacagtttgaaaatataaaacaattgagggaattatgagggttagataacatattttaaaacaattcgatcggcaaaacaaacaaagaaagattgtaagttttagtttgcacagcaatttaaaaaaggataagcacagggcagcaaccacaaaccgagcctgggaattagatcgatctaaaggggggagaggcggcggattcaccgaacctgggcaatgtgcatgcggccggagggctcaaatccgtcgtagcagatggggacgggctttttctgcagcagattcatgagctcgtcctcctggatacactcctcgccgatgccccgcagcaactcgaaccggtcttggaggctcatggccgccatgcccggggcgaggtcctctacggcggaagaagaggaggacgccgaggcgtcggcggagctaccggacggcgccgaagggtccatgtcggcggcggcggcgggcctgcgtgggctggctgtgtccttccttcctgtagtatgtgcgagcggcgggcggctaccact

SEQ ID NO: 80892 - DNA, 3742 bp, Oryza sativa
agggagagggagagggagagagagggagagagagagagttaattgaaaatgttaaggatttgaggtattattactagaaactattggaatatatggcgtggctttgagccttcggatctgcgatgcaaagtttgtagattagatgaatgacagctatgagattcgagcttttctgtgacatccatgaagcagatttcaacaggaggagaggaacagtccatgtgttccttgtgtaagtgagtgaagggagtttggggctaaaaacctacatgacatcaatgaaattagcctaatgaaacccctctttctagttcttcctacttccagttctcgaagcattcccatatttcttgtttcgtgtctcagtttgatctcagatcaccataatcttcccatggacaatcttgactagttagttcggtggtggagttctcatgttgttgcgattcttttgcaataggaaatttgtgccagctattctggataaaatgaacacatggtattctgttggtagcagatttccatcagaagtttccccaattaaaattggtgctaccatccaaactgtattttagtgtacaaattacagtgctattcttttggagaaagacgtgtcatggtatggatatgatgtcttaacctctaattcggcaattcgaatacccaagctgaaaatccaatgtccacaactgcataatcatgtcttatactgacattggaatcattacatggcaaccaattagatctacatgagaatatatggaattgcattacattaacaactgattttctgttacaggtctggcattgttagttgatgttccaagagatgataatattacaggtaactaattcttgttgtttaatccatcaagatactgttagcatagtaaaattgtagttattgtttacttatctcagcatgtgttagtcaaacctaactattgaatttattgtattcgatgcagctaaaatgatggaatcattacatattcctaaaggaattcaacgagtgctatttagaacactaaatactgacaggtaatggactccagcatagttatatgctcatttgtggtaagcatgcctagttaactgttatgccaaaaaaaaatccattatatatatgagcacacatatagttcaaaatcttctgctttatctgttcagcatggtaaaggcattctttctctcttccttaatctatgtctaccgaccctctatatttccttctgagatccaccccattgattgttaaatctgttggcagtgggtcctactgtatactccttgcatttacatttagtttactcactcttgttttctcagatattttaacatcatgattaattgagctcattatgctactagagccactagccaaaatcaccaccttttggtttctatatgaaaacccaaagtgcgtggagtttttttagttgctgcaacggcatgcccttttcatgtgtttctctatctatttagaaatgatgcgctgctgtttaccctatttcttcctaattgtgtattttgtgcatccgtagtctacggatagttttattgcgtattcttataatctatctattatggaatttcctgaaataccgcacttagtaaagctgtcatcttgcaggcaactaatgtggaagaaagaatttgacactagttatgtgggttttatggaggatggcgcacaatggttggtatacaacacagatattaaacttgtcggtgagtttgaagtagcaatgcatccttttgaggttccttcactatatttgtaaccgactcttatattatttagcgtatgcaactatccgtacaattgactcttatcttaagcttgctcatgcaaatgattattgttttggcatggtttgctttgcaactttttgtttttacaaatatatctccaatgagacttttgctaaaaatggaccctaagcagagaggtgacatttggcgctgtgtgtacatagcacaacatagcaagatttggcatcgtgtaggtttctgtatggatgttgcgtggaaccttatggtgtgtttggttgggcgtatgagactggatgggagatggccgcccgagtttttgtggtgtttggttggagggcatgatggatggggcggcccggaatagggaatattccctcaatatgctggatgagtgcatatggccgatttggctggatgaagccatccagttttggactgggtgatgtgtcctgttctgatttgctgtggttggtttgatttcgtgttaagcaagctccaaatgattttttctcgtaaaccgtttatctaatttatgatttgattacacaattatatttgttataattaaatctttaaaacaagatctcggatgattatattttgataaaaaaatatatatgacaaatgggtcccactaacttttggtttttcccatccatgctatatccctccaaccaaacaagaaattggatcgccatatccatacaaaccaaacaaaaaattggatcaccatatccaacaaaatatggatggctatatcctatccatgcatgaccgtgaaccaaacacacccttagtggctccactggccattttacatgccagcctacatgttgttcaatcctgcagcatcgtgttatgaacagacggcaccaaatgtcatagcaccatttggaagggttctatttctgtaaaaagttttttctaggggtccatttgtaaaaaaatgttttccgaaaggtctactttgtgaaaatcactagtctattcctgtttttttttttgggtaccatttatcatattagattaaaattacagtgtcttccttccaaaaacatattattgtttcttgtacttacggacttaccctcccttgataatcatctcaatgtctagtttggtccgatgaataagcatttagctggaagcctcttctcatgtttcacaagtgtgcatccccatcttacatgtcttcctgtttgagcaatgtaattgtgcaaatttgcacttctaatgtgatgatcttcagaaatcatgaccttaagggacttcaaagagtttttgtgtgttatttcatactagtatacttgaactcatctttcaggatattgtgtgtctcaggcagaagcagacatcagctgaccttctgttcaaggatgatattaatattgaatagcacgtttgcaggtttaagtttgtgtcacgagataggtcttgaaacatataacacctatggaaatggtatactgatctagtatggttgcctgggggatggggtactgcatgctgtgtatactccatgcgacatagcattagctcctgtgaaaatccagaattattatgtacttgtatataaaaaacatgggccaaaactaataagtttctgagtaccctgggtcagctttttcttttttttaatattgaatgatttttttttcaaataatagtgtctggagcatacatgacatgctaactaatacacatttttctatgaatcaatgctgaaaaaccagagaaaaaaattacttaggaacaaaagatttttcttgacttgtgaccctccacttaaggtcctatttaatcaagtagtgatgcaaatgaataagattgaaagcatggtaattaaagtcaagtaggaaatgtcatggtctgttttgacactttttggtagataatgctccttttttttgttttttagttctttcattcactttctatgtagagaaaattccttgtgtgcacctca

SEQ ID NO: 80893 - DNA, 11656 bp, Oryza sativa
atataagggattgaaagagttttgaggtgcacacaaggaattttctctatgtatgtactatcagggcaaacttctgtattcttgtttatttaaccttggacgatagtgctctagaggtaatatttttatcgtggtggtgtggtgccctacactacagttattgttctgtaatttctcatttctgttgtcattttcaggaatagactatttgtctgttgcagcttttgatgacttgatcccgtcacatttagttcttctcaaaaacagggtatggacatgtttcctggagtaattttgttatgttcacattcactttcagaatatttatggctcttttatctttgttattcatcttacgtttgttctgatgttctgaactttatcttgcctatcctgtatttcctatactcggtcacttacaacatccagcttccaatagaaatctgataggaatgcgatgtagttaagaaatagttgagtgttgatatatattgtcctcacctaaaattttcttattcttcctagcttggctatgttgaattcaatgtgctaatatcctgttaggcttcctgatgacattaatttctaaactgaacaatgtaaagttgaaaaagttgattgacaattcggtatgatatatcaaagtatccaaggataccagtagtcactcctgaaatttgttgtgccattttttttctacgaagactaatttatgtgtggcactctgcccaaaagaaaaagtgaggcactgttggcacagcacgatatattacacaaactgatatgtgccatatggcagagtcaaacttgtccatacacttgcaagatgcggataaatcaccagactccagtgtgcatataacacaagtgagcacctctagatatatggaatgacaagaaaaaaagtttggtagcaggaatacccacaatctggtatcaacttaattaggagtaccatgtttttccaagaagctgatgtgcttatgagtgttgcagctcatattctgccgtatggaatgtgaatgttaccctacgggtatgatcgacgtaatatattctattttgtttttcaggatatcattcttgtcgagggcctcaaactggaaaatatcatgcctgggatatactccttgcactgcctgccacttcggctgcggggtgctgaaggttcaccaatcagatgcatccttataaagtgaaggggactaggatcagtgcgtttgctagtatcaatgcaacttcagttgcactggatcactgcatggtgagaaatccatttcataacaacgtgtttcatactatatcaaccgttcagcctcaatgcttatttctgaatttatccgttgcttatgcccagatgcaggtctgccaaataaaattgtgtcatgtcggtgctaagctcttggacttggaagctgtacagcatagtcgtaaaacacacaactatcgatgaactgcacaatgggcacattctgcgacttctcttttgaacaaactcaattgaagtttagggcccctttgatttgtatgaaaaatgtaggaattttggaggatttcaattctatgaaggcctttgaaataaagaattgaatcatatccaattctttaaaattcctatggaataggtaattctatgtacattttgaaggaaagttagtaagaggtctaacctccaagtctatctctctcatctgattcccgtgtttattctgtggtccaatcaaacggttattcctgtgttttgcaatcctctattttacaattgtattcctgcaagaatattgtgtttttcctattcctttgtttttttattcatacaattcaaagtggcccttagtcatatcattgtggaattattagtgcttctcagcaggcatggtgatgtttttccccctcagttccgtgtcaagtggttgcatcaattggcaattataaacttcatacctaatatataatttcgtatgcatatgcattttcgagttggatgagattcaatagaatgtttgattcaatagaataggatgagatttaataaatgttcccttgaaatttgttaagaatttaggagatttgttaatgactcactctaatatatatacttgactagcaaagatgcccgtgcattgcaacgggacaaaacaaagaataagttaagaatatagatattgttgtcaatacttagcataatgagatattggcatagaagaaaggggtggtcgttctaaaaagacccgatagtttcacatgcaagcggagtttactctcgtaatacaaaataaagccttaaataaaatttcaggccttaattatgagttacatgcaatatatcgagaagcacggagaatttggtgtctcaaataaatattggagaaaaaaatcggcactggtatgagatcatcagtgccgttatttaaataaatcggcactgatgtatttagtatacatttttcacggtttttcaacggttaattggatccacaccattataaatatattataaatatagtgtattgaaaaaataccattgcaaataaatcggatggatgccactacaatcttctaaaaatagaaccataccactccgtcacatcgtcgtcttcatccccgtccccatcccctcaattattgcatccatcattgttggctccaatctcctccctcgctgacggccaactccttcttccttgtccctcgcgcctccctcgtgctactccccgacttctgccgccgtatgacctcctctgtttccatccctcgcgcatccctctcctcgttccccaccatcagtcgccgctgacttgagtggatcgggggccttggggctaaggcggactccgcgagcttcgcacgtcgaggaatgctgctaccagcgttgacttgagtccctacagtggaagccgatgaacacgtgcatgcggatgcttgggacgaggcacttcttctcacccttccaacattggaccagccgaccaagttgcagaagctggatgtgtgtactgcaagtcatcgaaaccagcgtagaacaggtgaacgacaagttgggtgagggactcatattgcttgatcctaccgtggaagatgtcgttgaggctgaagtggttcgtgctttcgtggtgtactagccctcgtcggtgttcgcgttgtccaccgactcgccgaggtcgccgttgctaaggtacacgcacatgttgaatcactggtacaggtaccactcatggcagttaggtagcatgttgtcattgaactgtggtggcaggtcgtggatgtaccccttgcaagctccgcatctccggtgccttgtgccacgactgtcattgtgacatcgcatgcagacgaacgccttctaagctgctaggaaaagctgagtgttctcgccgtcggacgagcgattaacacggtaagctgatcggaggcgcgttgtcgaactatcacggagacagagacggcgatgtgatggagataacagaaatcatgacggagtaccacattgttctaattttagaaaaattgcagtgacatccacccgattttgtgaatagtaataatatttttctaataagttgtatttgtagtggcattgatccaattaattttttcttacctaccattgattaattaattaacgtatttttttttaaaaaaacaacgaattaattggagccgatcctatccatccggctgttttgttccagctccattgtcgatcaagccgaataaaaaaacaacgaacaaaaaagaacagacatcgaagccgatccttcctatccatccgccctctcgctctccgtccgtccttcgccttcgctccccatctctccctgctagcgacgccgctatgagcgcactcccgcccccgcgccaccaccgccatcgcgtgccgtttctctccagtgtgtaggccgccggatccggccgcctagaagccgggggccaccggatccagccaccttgaagccaggcgcggccggatctgcggggaagcagtggcagtggtgatggtctcatcttccaacgagcagcggctgcctcccccatctccttgataagcgggtggcgatgcggttcgagggtgatgatggatgagagggagattgaccatagcgccacaggttttcccctctattcccttctctcctcaacccaatccaatccctcgtacctgttatgaaacaacatggtgatctaatggatcgcaattgaaggcaaccgcgcctcttctctaggcgctccttgacaatagacacgatgccactccttccccatctataaattgtactgcactgatcaataaagaaatccgctcatttattccctacattcttgtgttaaattctctctcgctcaatctctcaatctctcgctcaatcaattctatccacgttcaacacgttattagagagcgaaggcgaaggagatcgcgaagtgaaagaagggagaaacatcgcttttgatctaacagaaaagcaaatagaagaatcattagagaaggtacgatacctatcttttcattggatcatggatgtcgttctcggcctccctcgccatcagcgcgcatgccggctctgccattttcttcgccgacctatgaggagcacacgctggggatcacgcggaggcagggctagggttggtggccgccgccactaccctcgccgccatgtgactgcaactccggttgtggttcccccgcccgtccctgttgtgcctcctcctccgcctccggttgccgaagcacctcaccggatcctcgtgtagggggtgcagtactgcgcccaccacagatggacggcagtggtgacactacccggcgagccatgtgctcttcccccggagatggagtcgcagccgccaccatcaaccgctccttcaccacctccaccgacaccaagccgacgccaacgccgttcccccactcccgcgccagcggggtctggccggaccggtaccctggctgcgcgcacgggggagccgcccttcttcaatccgtcctcgtctcgtcgtcacgccagtgaagccgccgctcgccgtcccggcctccgccacatcttcatcgccgtcccccatggctctcctagccgtacactccctaacggggtgctggggaatggcgtcagggctcggccggcctccgactccgacgaggattgggagccgtcagcctaatccggctggcaaaccgccagcggacggaggggcggtcggggcggtagtggatggtggatggcgacggcggtggatggcggatggcgacgacggtgaggcggcagaggaaatggatggagacggcggtggactctgtggcggtggcgtcggcggcgcccccaacggcggcgtcggcggcgcacctcggctgcgtcggcggcgttccccacggcgacgtcggcggcggatgaacggcgcccccctcctgcctttttattaatttacctctgtaaattgataatgttaaccatgattgtagggacatggcaacaaaagagttcgacgaaatcgccctcgataggactaactatcccatctgggcttccgatatcaaaatcaattttgcctctcgggggattttaaatacaattgaggaacccaatgatggggatccgcaaattgagcccaggaagctcaatacaaccctttttcttttaagactctacattcacaaggatctcaaacatgaatatatgttagagacgagccctctcaacccttggaaagctctaaaagagcgttatgatcagcaaaaggaactcatttggcctgaggctaattatgagagggttcatttacgccttcaggactttaaaactgtggcagaatacaaccatgctgttcataacatttgttccaggttgaagttttgcgaacaagagccaacggaggcagagaagatagagaaaactctatcaactatgcttccggaggacaggatactgctcaacagtatcgtgctaaaaatttccagaaacattctctgcttatacatacattgactcaggcagaaagacactatgagctttctttaaagaatgcccaacagcgcccatcgggctctgctccactgcctaaggtgcacttcaatgtacagaataatgctgagaataagaaagcattcaagggaaattcttcgaataatcctaagaatctgactggaaagcgcaaacgcaacaataacaggcacaaattcaagggtcaaaagaaaggaaaagggaagggtaaggcaccacaacctcgtagcaatggcaacaagcattgcaacaggtgtggatctgacactcatgtcgctaaagactgccgcatcccgaaacatcttgttctcttgtaccaaaaatcccttaaggacaaaaagtcttctgagaacccaagatttggagcccaattcaatcttacagatgaagagcgccctgaggttgcaagttctcaccaggctcctgttgaaccagagagcaacctcaatgttctcccagaagatgtcgctccactctctgcgatggacgatatgttcatcgaatactgctcaatggacctacttggtgatttgcaataatctcggtgcgtcccacttagagatgaagctgctcttatctcagtgtgcttgaaacagtatattgatatcctataagtttgccaaacaatattggttgtaataagtagataagtacgaactcccttatattgtaaggttgtattgcttgctagtcattagagtatgtacttttaacatatgtaaacgtcatactatgtatttatgtatttgatgttttaattattgtatgtatgtatatatattggataaagaattcttaatcaagcaattcttctttcattatagatgtctaaggatatcgctccgattggagatgaattatgtcttgtggatagtggtaccacaaactctatacttagggagatcaaatactttcaaactctcaaaaagagagaaggaaaagttttgactattgctgggcgcgatactgtgatagttggctcaggacaagcaattattacactcccaatgggtacacaaattacaattgagggtgctttattgtatcctgattcaacccgtaccctactaagttatagatatatccgtcaaaatgggtttcacattgaaacccatatggataatcgagaagaatttcttctcttaaccaaacaaaatggatatggcaaacacatttgcgagaaaattccatctctcacatcttgattgtactatacatacattaagcccattgcacatattgcgtataaagtaatttttcaaaatgttgatgcattccacacttggcatgatcgacttgggcaccccagtatcgggatgatgagaaaaattattggcaactctattggtcatcatttgatcaccgacaaatttctcaaatcctctgatttcgtgtgcactgcatgtgctactgggaaactgattttgagaccatcttatctcaaaattagagctgaaccacttaaattccttgaacacattcaaggagatatctgtggcccaattgtgccaagatctggaccgttcaggtactttatggttttgattgacgcatctacaagatggtctcatgtgtgtcttttatcgacacgaagccatgcctttgccaaattaatgtcttaaattataaggctgaaggcaaattaccctgaacatagggttcaatcaatccatatggacaatgctgccaaatttacatcccatgctttcgatgattattgtatggcattgggaattcaggttcagcactctgttccatatgtccacacacaaaatggtttggctgaatcattgatcaaaagaattaagcttattgctcgaccattattgatgaattgcaaattaccttcgtcgttttggggtcatgcagttctgcacgctgctaaccttgtccaactatgaccaactgcatatcatgaaacttccccaatgcagttagtacgtggaaatcctccaagtatttcccatttgcgtaagttcggttgtgctgtgtactgtaggatcgaatcacaagaactaagccaaccagaggggggggggggtgaatggttggtatacccaaaaaccaaaaacttttagcggaaataaaagttaccctcgaaatcgacggaagtcggtcagaccgagattgatctgccggtctgactgagtggatgccgccggtctgtgtcgcgtcccaaaacgactctaaaatacatcctcgaaattatgcctagaataattaaaatccatgtgaaagcctccaacaattaaaatgtgcaaagttaaaagttaaataaggcttggaggatttttgtatatttcctaaaagcctaaaatgcgtaaataaattttagtggaattttcagagcacaaataataattaagaagaaataaacaaagttaaaatggttttataaaaagaaaaaccctaaaaagttccctttccctccccctctccctcttgggccggctcggcccatccctttccctctctcccctcttccccgcggcccattcggcctcctccccgcgcgcgtgccgctgacgggcgggcccgcccgccaccctcgctgacgggtggggcccacccgtcatccccttcctcccgccgctcccgccgccttggccgtgccctagcgccgccgccgccgcgaatcccgccgctccagtccgtccggggtgcaatcaagaggggggaaatattccccgtgattccctccctctttccccccatttttccctccctctctcccttggattcgttcggaaactttccccctaacctcgccggcgcatcaatggcggccggatcttccgcgcccgtttccccctcatccggccgctctctccccctcccaaccctatataaacactccccgtgcctccctccgccgtttccgccactcgccgctctctctctccgccggaatcgagctcgcgccgtcgctctctctctccgccgtcaccgccgagctccggtccgccgccgtcgtcgccccggaccatctcctgcttcggcgtcgccttcttcgggttcgccgcaacctcgccgacctcgtccacctctccgtttcggtcgccgatcgccggaacgccgccgtccccgtcgaccagagccgcgccgccgcctctctccgctccggtcgccgttcccgtcgtcgccgtcgacccggggtgagccgtggaccgccgattcgtttccccctttcctcccctctctcgggcgccgctccgccgcgccagtggtcgccggcggcgaccatcggggcacgagcgcgccgcctcccgtcggctgtgccggcgtggccgccttcgggcgcgtcccgcggctgccatgtggggcccggctgtcagccgcccgcgccctcgggtgcggctgacgcatgggacccacggcgccggccggtgtgagccgggtgcacccggtccaccgtggaccgtgaggctgccgcgtgggccccactcccgtggacccggtccgcgcgcccctcccctcggctgacgcagtaaatccaattttaaattaaaatttaaatgaagaaattcgcaaatattcatttaaagagcatataaccttcaaatggccataacttggccatttgaactcggaattggaccgctcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcagggcaagtcacatcatccttgaacatattgaatcccagtttataaaattatgtcgctttaaattattgcattatcgctttatttaaattcccgcgttatcactgttttatctagccatgcctatttacctttgttatgaccttattattattgttattgttattatttccttgttcaccctagagtaaacaaaaccccaactagtggacactctactcatggtaccactagtatgattttaggtagatgctttgctatttaattaggtaacattaggtggtttttcaactctagactttgggaatattcatatcacctggacactatggaatggtttggttattgtggaattggcttcacaccgctccttctattcaaaatccccaaaatggttttaggctggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacatggatggagatggacgaagtcgggggtcgatggacatctccagggcaaatgaaggctacacgagctgcggcccggtagtcgagatgtcatggcacagggccggtgtcctgttgctaggggctcagtcctgcctacctgtcccgggggttccggccgtaggtgggattgggtcggtactcttgtctatggctaggatgggttggaaactatgtcacgtcttccgtctgtataccgtggtggtatgtggcacatggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgctaaacaactaaaaggaggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgagcaactaaatatctttaaatgctgtttactgcaactctaaccctttatattataactcctttgtactccctcgcatttattctgcacttgtgggtgtgtcttgttgagtacggtggttgtactcagtcttgctcaatttttcccaaacccagaagaggagcccctagaagatgaaggctttggtgtctagctcgtgcctgccgtcaagtgcctgtggtcatcgccctagtcttccgctgtttcccgtttgtctttgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttctggtcgtgacagtctgaccggtgttgaatctccggtctgaccgccgaagtcgcctgccgtgcctgtcgccgccgccggtctgaccgccgcttgccgccggtctgaccgccggtagatcgccggttagaccgccgaaacccggtgaaacacaaatcaaagaactcttaaagtagatgacgactttattgattctctctgtgtttacaaagtgcaccaacagcattccttacaaaaatttcgactaaactcgaaaccctaactcaaaactcaactcaattgctctcaaaagcgataccgggaagcctcacgctccccctttatttatacccgaggtaggcagcctaaagccacga

SEQ ID NO: 80894 - DNA, 3286 bp, Oryza sativa
gggtgtgtcttgttgagtacggcggttgtactcagtcttgctcaatttttcccaaacccagaagaggagcccctagaagatgaagggttttggtgtctagctcgtgcctgccgtcaaagtgcctgtggtcatcgccctagtcttccggtgtttcccgtttgtctttgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttccggtcgtgacaagttggtatcagagcccccttgaccctaggacgagccgtagatcccaagccttagcaatattttcaaaaataaaaaaatcctgtcttatttgtgaaaatcctctagtctctctctgtcctgctgcttcatttatcgccaaaatctgacctttaaaatgttgtttttctttttgtttttgtttgtagatggccggcagcgtcagccgtcgtggcctggacatgactggtttcgtcttggagctgcggggcatgtgcgttgtcctggggtatccacatggagtggactaccagggcatgccgcttccggagcaggagggtgacgatgcagagccccacgctgcttgggaggttactgcagtgatcctcactggctctcccgagcggacttcgttggcagtcaccgcaggtggagattctttccccgccgcttgccagaacgccgctctcctcgccatcggcactcttcaccagcgctacccggacgagttgcagcactcgccctaccgctaccaccctcgccgcggaggagcccgcgacttcgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaatctgcagctgaagaaggacctagacgcagtggaggcgcagctgcatcagctcaagatcgcccagggagaggtctgtcgccccaagcgccgccgcgtctgccgcagccagaagatcaccgcccgcaagagcacctccaggcccgagcttgttcgtcagtccctggcgtggacctgcttcgtggagacccctcgtgccgagcccgcgcccgtggttccccaggagggggaagcctccggcgttggtagcacggaggatgcgctgttgctcaccttccgtcctggcctgtcgcagcggtagacgagcagttagtaggcttgcgcgtgtgttctttctcgtttgtcttcttgttggagtcgtgtggggcatggttatgccggtgtgtggcataactgtgtcggagcctgtctttattttatttgcttaagcaacttgaactttaatgaaccaatttaatagcagtaataaattcaagaattatggtagtcgtgggtggttagctttaattgtcagctctctctgtttgctggttttgtgtggggtttccagatggtgacgactaggagaagtgctgccaccggtgatggcaaccaacctgaaggcagcaaccacaacaaccatggcagcccacctccacctcctcctccgcctccaccaccaccaccagacaccaacgccattctcacccaaatcctcgcccagcaggccaacatgatgactgctttcctccaccacctccaaaatccgccacaacataatgctccaccaccaccctcacaacactctaaactcgccgagttcctccgcatccgcccacctaccttctctagctccaataaccccgtggatgcgttggactggttgcatgccgtggggaaaaagctagacactgtgcagtgcagcgatgaggagaaagtcatcttcgccgcccaccagctgcaggggcccgcatctctatggtgggaccatttccaggctacgcagccagaggggcagcctattacttgggctcgcttcaccgccgctttccggagaacccatgtgcccgccggagtcgtggcccttaagaaaagggaattccgagagttgaagcaaggcaaccgctccgtgatggagtatttgcatgagttcaacaacctggcccgttacgccccggaggatgtgcgggaagatgaggagaagcaagagaagttcttggcaggaatggaccctgagctgtccgtccgtctaatctccggtgactatccggatttccaacgtctggtggacaagagcatccgcttggaagccaagcacaaggaactggagtcgcacaaatgccgcttggcgaatttccgcaatcaacagggtgctaaccaaagggtccgctacaccaatccctatccagggggaacctcctcgcagcagcaacagcagcagcaacctcgctccgcgccccgacctcaattcgtggtgcgcgtcccacagccgcagcaacagcagagtcagcaagggactcgtgcgccccgtcctcctacgccaactgtgcagcctggtcaaggccgcagggacgctcaaggtccgcagcgtctgtgcttcaactgcttcgagcccgggcactttgcggataaatgcccgaagccgaggcgccagcaaggccaagcgcctccccgatccaaccacggtggtaaggacgtcattcggggtcgtgtgaaccacgtgacggccgaggacgtgctgacaactctagacgtcatcgttggtacgttcctcattcattccatccctgctaccattttgttcgactctggagcttcccactcatttatatctgtgccattcgtggggagaaatcagttgggggtagaaaggcttaggaaccctctgctcatcaccacccctggaggggttatgacagcaaagtattatagtcctgccgtccctatagaaattcaggggattccttttccctcggatctgattctgctagacaccaagaacttggatgtgatccttgggatgaattatttggctcaattccaaggagtagtggattgcgcgagacgcactgtcactctgtaccgagggccggaacaaccggttgttttctttgcacccccaacctccgtcagtagttcagaacttcatcagataggactgtcagaaatccccatcgtcagagagttcggagacgtgtttccggaagaactacctggtatgccgcccaagcgagagattgagttccggatagaccttgctccaggaatgtcacgaccggaaatcac

SEQ ID NO: 80895 - DNA, 7894 bp, Oryza sativa
gggtcgcttgtgcaaaggagtggttcctggagcaagatctatccggaactcaatctctcgcttgggcggcataccaggtagttcttccggaaacacgtctccgaactctctgactatggggatttctgacagacctatctgatgcagttctgaactactgacggaggttgggggtgcaaagaaaacaaccggttgttctggccctcggtacagagtgacagtgcgtctcgcgcaatccactactccttggaattgagccaaataattcatcccaaggatcacatccaagttcttggtgtctagcagaatcagatccgagggaaaaggaatcccctgaatttctatagggacggcaggactataatactttgctgtcataacccctccaggggtggtgatgagcagagggtttctaagcctttctacccccaactgacttttccccacgaatggcacagatataaacgagtgggaagctccagagtcgaacaaaatggtagcagggatggaatgaacgaggaacgtaccaacgatgacgtctggagttgtcagcacgtcctcggccgtcacgtgattcacacggccccgaaggacatccttcccgccgttgttggagcggggaggcgcttggccttgctgacgccttggcttcgggcatttatccgcaaagtgcccgggctcgaagcagttgaagcacagacgctgctgaccttgagcgtccctgcggccttgaacgggctgcacagttggcgtaggaggacggggcgcacgagtcccctgctgattctgctgctgttgctgctgtgggacgcgcaccacgaattgaggtcgaggcgcggagcgaggttgctgctgctgctgctgctgtgaggaggatccccctgggtagggattggtgtagcggaccctctggttagcaccctgctgattgcggaaattcgccaagcggcgcttgtgcgattccagctccttgtgcttggcttccaagcggatgctcttgtccaccagtcgttgaaaatcaggatagtcccaagagactagacgaacggacagctcagggtccattcctgccaagaacttctcttgcttctcctcatcttcccgcacatcctccggggcataacgggctagattgtggaactcatgcaaatactccatcacggagcggttgccttgcttcaactcccgaaattcccttttcttaagagccacgactccggcgggcacatgggttctccggaaagcggcggtgaagcgagtccaagtaataggttgcccttctggctgcgtggcctggaaatggtcccaccatagagatgcgggcccctgcagctgatgggcggcgaagatgactttctcttcgtcactgcactgcacagtgtctaacttcttccccacggcatgcaaccaatccaacgcatccacggggttgttggagctagagaaggtgggtgggcggatacggaggaattcggcgagtttggagtgttggggagggggtggtggagcattgtgttgtggcgggttttggaggtggtggaggaaagcattcatcaggttagcttgctgggcgaggatttgggtgagaatggcgttggtgtctggtggtggtggtggaggcggaggtggaggtggattgccttggtggttggggttgctgccctcgggttggttgccttcaccggtgttaacatttctcctggtcgtcaccatctgaaaacccctcacagaaccagcaaacagagaaggagagctgacgattaaaactaaccacccacgactactattattcttaaatttatcactgctattaaattggttcattaaggttcaagttgcttaggcaaacaaataaagacaggctccgacatagttatgccacacaccggcataaccatgccccacacaactcaaaaagacaaacgaggaaaaacacacgcgcaagcctactaactgctcgtctaacgctgcgacgggccaggacggaaggtgagcaacagcgcaccctccgagctaccaacgccggaggcttccccctcctggggaaccacgggcgcaggctcggcacgaggggtctcgacgaagcaggtccacgccagggactgacgaacaagctcgggcctggaggtgctcttgcgggcggtgatcttctggctgcggcagacgcggcgacgcttgggacggctgtcctctccctgggcgatcttgagctgatgcagctgcgcctccaacgcgtcgaggtccttcttgagctgcagattctcttggcgcagctccaggatcttcatgttgttctccaccatgccacggcgcaccatctgatggaagtcgatacgagccgcgtcgtacgcctccaccatgcgtgccagatgcacgacggtagcgtcatcctccgagctggcgtctcggaaggtggcgtagtcgcgggctcctccgcgacgagggtggtaccggtagggcaagtgctgcaactcgtccgggtagcgctggtgaagggtgccaatggcgagaagagcggcgctggcaagcggcgggaaggaatccccacccgcggtgactgccagcgaagtccgctcgggagagccggagagaatcactgcagtgacctcccaaccagcgtgaggctctgcatcctcaccctcttgctccgggagcggcctggcctggtaatccactccatgtggataccccaagaccacgcacatgccccgcagctccaagacgaagccagtcatgtgcaaaccacgacgggtaacgctgccggccatctacaaacaaaaagaaaagcaacattttaaaggccagattttgacgataaatgaagcagcaagacaagagagaatagcgggttttcacaaataataaaggatttttatttttttgaaaatatagctaaggcttgggatctacggctcgtcctagggtcaagggtggctctgataccaacttgtcacgaccggaaatcacccaacaggcgttcctgacgtgcgtgtattattccttgtcccaggaggcaaggtacaccaaaagttgatacaattcagagtttaacaagcggaagcgtaaatataattattacacgggcaacaacggcccagcacacaaagacaacgaaaaacagcggaagactagggcgacgaccacaggcacttgacggcaggcacgagctagacaccaaagcctttatcttcaaggagctcctcttctggacttgggaaaaattgagcaagactgagtacaaccaccgtactcaacaagacacacccacaaatgcggaataaatgcaagggagtacaagggaataataatatagggattaagttttgcagtaaacagcatttaaaagacatttagttgctcagggctattttgtaaacacgatcttagaactacacaatattattaatcaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgttaccacgcgccacataccaccacggtatacagacggaagacgtgacatagtttccaacccatcctagccataaacaagagtaccgacccaatcctgcctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttaagactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaccataaaccaacaattccaaagtgtccaaatgatatgagaattcccaaagtctaaagttgtaaaacctcctaatgttacctaattaaattgcgaagcatctacctagaattaaactagtggtgtcatgagtagagtgtccactagttggggttttgtttgatctagggtgaacaaggtaataataataacaatgacaataatcatatggtcataacaaaggtaaataggcatggctaagtaaaacagtgataacgcgggaatttaaataaagcgataatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttttatgctctttaaatggatatttgcgaatttcttcatttatttttcaattaaaaaaaatcctatttattgcgtcagccgaggggcgggcgcgcggaccgggtccacgggaagggggggcccacgcgtcagccgctcggtccacggtggaccgggcgcacgcggctggcggcggtcggcgccgtgggtcccgcgcgtcagccgcacccacgggcgtgggcggctgacggccgggcccacttggcagccgcgagggcgcgcccgagggcggcctcgccggcacggccgacgggagcggcgcgcacccgcgccccgatggtcaccgccggcgaccaccggcgcggcggagcggcgcccgagagagaggagggaagggggaaggcgaacggcggtcttcggctcaccccgggacaacgacgacgacgagaacggcggccggagtggagggaagcggcggcgcggttcgggatgacgatgacgaaggtgctccggcggtcggcgggcgaagcggagcggcggacggggtcggcaaccactcggcgaagcggacggaggtgtcgccgagtaaggaggaagtccggagcggcggcggcggcggaacggagctcggcggcgacggcggagagagaggagcacggcgcgagcacgattccgacggcgagagcgagcggcgagcggcggaaacggaagagcggagctcggggagcaattatatagcaacgggagggagagagagcggccggagagagaggaaacgggcgcggagatctcggctccattgaatacgccggcgaggtttgcgggattgattccgagcgaatccgagggagagaggggaaagagggggaatcgggagaggggattgcggggaataattcccccctcttgattgcacgcggggcggacgggagcggcgggattcgcggcggcggcggcgctagggcacgggcgcggcggcggcgggaggagggcaatgacaggtgggccccacccgtcagcgagagtggcgggcgggcccgcctgtcagcggcgcgcgcgcgcggggaggccgatgggccgcgggagaggagagagagagggagagggaagtgggccgagccggcccaagagggaagggggggggaaaagaacttcttttaggattttctttttataaaacctttttaactttgtttatttcttttcaattattatttgtgctctgaaaattccactaaaatttatttaagcattttaggcttttaggaaatatacaaaaatcctccaagcctcatttgacttttatctttgcacattttaattgttgaaggctttcacattgaattttacttattcttttgcacaattttgaggatagattttagagtcgatttgggacgcgacaaacctaccccccttaaacggaatctcgaccccgagattcggaagaactggcgaagagatcgggatgggctgccttcagctcgtcttcgcgctcccaagtagcttcttcttcggcgtggttgctccactggaccttgcaaaaacggattactcggttcctggtcctgcgctccatggcgtccaggattttcactggcttctccacataggtcaagtcttcgcgaacttcaatttgctctgagtcggcctgctcggatggcactcgaagacatttcttgagttgcgacacatggaacacatcatgcacgttgcccaaggaggcgggcaactccagctggtaggcgacttctccgcgtcgagcagtgatacggatgggacccacataccgaggtgcgagcttcccttttgtctgaaacctgtgcacacctcgcaatggcgtgacccgaagatacacaaagtcatacactgcgaattccagatcacggcgacggttatctgcataacttttctgccgagactgtgccacctttagattatcccgaatgattctgactttagcttcagcttctctcaggatatcagtcccgaacacttggctttctccgacttggtcccacaatagcggtgtccggcatttgcgcccgtacaacgcttcatagggtgccctttgtatgctggcttggtagctgttattgtaggagaactcggcataggggagactcttatcccaagtcttcccgaagtccaggacacatgcgcggagcatatcttctaggatctgatttagacgctcggtctgtccatctgtctgcgggtgatatgcggtgctgaaattcaatcgagtacccagctcttcttggagcttcttccaaaagtgagaggtgaattggcttcccctatcagatacgattttcttgggaacgccatggagactcacgatcctagcgaagtagagctccgctagtttattccctccataggtggtcttcacaggaataaatcgagctaccttggttaatcgatccactattacccatatagaatcatacccaccttgggtttttggaaggccggtgatgaaatccatcccaatttcatcccatttccattctggcacttggagaggttggagaagtccggccggtcgttggtgttctgccttgacacgctggcacacatcacatagagccacaaactctgcaatttcccgcttcatgctgacccaccagtatttctccttcaaatctaagtacatcttggtactgcccgggtgaatggaataaggactttcgtgagcttcctgaagtatcagctgtttaagttctctgctatctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggctgggcttctagcgcggccaaaaatccacgaccaactatgtttaggttcagggcttccatctgttgattaagctcgggtggaatgcctcggacgttgagagtattgcaatggctcttccgacttagagcgtcggcaaccacgttagccttaccagggtgatagtgaattcccacatcataatccttgatgagttctaaccatctcctttgccgaagattcagatccgactgggtgaagatgtatttcaaactcttatgatcagtatatatttcacagcggttcccaatgagatagtgccgccagatttttaaagcatg

SEQ ID NO: 80896 - DNA, 3335 bp, Oryza sativa
agggggggggggaaaagaacttcttttaggattttctttttataaaacctttttaactttgtttatttcttttcaattattatttgtgctctgaaaattccactaaaatttatttaagcattttaggcttttaggaaatatacaaaaatcctccaagcctcatttgacttttatctttgcacattttaattgttgaaggctttcacattgaattttacttattcttttgcacaattttgaggatagattttagagtcgatttgggacgcgacaaggaaccactcctctgcacaaacgaccctactgtatggcagcaaatgaattgaccgaagtcaagaaacagttggaagagttgaaagaaaaggggtatatacgtccgagtacttccccatggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgtgaagaagatattcctaagaccacattcaccacgcgatacggactgtatgaattcacggtgatgtcgttcggtttaaccaatgcacctgccttcttcatgaacttaatgaacaaagtgttcatggaatacttggataagtttgttatggtgttcattgatgacattctggtgtactcacaatcagaggaagaccatcagcaccatctccgtctggtgttgggaaagttgcatgaacatcaattgtatgccaaacttagcaagtgtgagttctggttgtccgaagtcaaattcttagggcacgtgatatctgctaaaggagtcgctgtggaccccgaaacagtgaccgccgtcaccgattggaagcaacccaagacagtcactcaaattcgcagtttcttaggtttggcaggatactaccggaggttcatcgagaacttctccaaaatcgctcgacccatgacacagttgttgaagaaagaagagaaatttgtgtggagcccgcaatgcgagaaggcgtttcaaactctcaaagaaaagctggtttcctcgccagtgttaatcttgccggatactcgcaaggacttcatggtgtattgtgatgcttcgcgccaaggattggggtgcgtgctcatgcaggatggtcatgtggtggcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcactcagtcggacctgaatcttcagcagaggagatggttagaactcatcaaggattatgatgtgggaattcactatcatcctggtaaggccaacgtggtcgccgacgctctaagtcgaaagagccattgcaacactcttaacgtccgtggcattccacccgaacttaaccaacagatggaagccctgaatctaagcatagtgggtcgtggattcttggctgcgttggaagccaagcccaccttgctcgatcaaatccgcgaggctcagaagaacgacccggacatgcatggactcctcaagaatatgaaacagggtaaagccgctggtttcacagaggatgaacacggaaccctatggaacggaaatcgggtatgcgttccagataacagaggacttaaacagctgatacttcaggaagctcacgaaagtccttattccatccaccctggcagtacgaagatgtacttagacttgaaggagaaatactggtgggttagtatgaagcgagaaattgcagagttcgtggccctttgtgttgtgtgccagcgtgtcaaggcagagcaccaacgaccggccggactcctccaacctctccaagtaccagaatggaaatgggatgaaattgggatggatttcatcaccggacttccaaaaacccaaggtggatatgattctatatgggtagttgtggatcgcttaaccaaggtagctcgatttattcctgtgaagaccacctatggagggaacaaactagccgagctctacttcgctaggatcgtgaatctccatggcgttcccaagaaaatcgtatctgataggggaagccaattcacctctcacttttggaagaagctccaagaagagctgggtacccgattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctataataacagctatcaagccagcatacaaatggcaccttatgaagcgttgtatgggcgcaaatgccggacaccgctcttgtgggaccaagttggggaaagccaagtgttcgggactgatatcctgagagaagctgaagcaaaggtcagaaccattcgggataatctaaaggtggcacagtcccggcagaaaagttatgtagataaccgtcgccgtgacctggaattcgcagtggatgactttgtgtatcttcgggtcacgccattgcgaggtgtacacaggtttcagacaaaagggaagctcgcacctcggtttgtgggtcctttccgtatcattgctcggcgcggagaagtcgcttaccagttggagctgcccgcctccttgggcaacgtgcatgatgtgttccatgtgtcgcaactcaagaaatgtcttcgagtgccatccgagcaggccgactcagagcaaattgaagttcgcgaagacttgacctacgtggaaaggccagtgaaaatcctggacaccatggagcgcaggaccaggaactgggtaatccgtttttgcaaggtccagtggagcaaccacgccgaggaagaagctacttgggagcgtgaagacgagctgaaggcagcccatcctgatctcttcgccagttcctccgaatctcggggtcgagattccgtttaaggggggtaggtttgtcgcgtcccaaaacgactctaaaatacatcctcgaaattatgcctagaataattaaaatccatgtgaaagcctccaacaattaaaatgtgcaaagttaaaagtcaaataaggcttggagtatttttgtatatttcctaaaagcctaaaatgcgtaaataaattttagtggaattttcagagcacaaataataattaagaagaaataaacaaagttaaaatg

SEQ ID NO: 80897 - DNA, 7070 bp, Oryza sativa
atcaactctctgttgggccaattcagtctaacatagattggctggaggcccgcaaaattgatctcatagcgcaacttcaagagtgcaacgccgagctggatttggaaaaacaaaaattagccaatctcccaaatgctgtcgaagaacagaagtctagactgaaatcggctatcaagaatgtggctgatatgaccaagtccatcaaggtcattcctggaaccgatgcccaagacatccaagctattgaagaagtagatcaaattagagaatgggctgtgtcggctatctagcgttacttatctgaatgattatatttgtaataggacttagaaaatttttgtgattggctaagaaacgttggtactccttttgattgtcactgatcctttgtgtcgattaatataacttctcaatttgcttgaaatttctttacgcaaaaaattctcgacttttgtatatatgtgcccccctaattttgcaatgctgaaggcattgataaaattataatttagactaagggcgatatattaaatatcgtccatcatacatcggcagaacacaactgattagataataaaacaactaagggcaatataactatatcggccatcatacatcggcaaaacacaaccgattatgaataagaaaacaactaagggtgatataactatatcggctatctcaaggcgatgcaaacacatcggctatcatgtatcggcaacactcagccgatcatgcattaacccaaacacttggataatatttctttaagtacttgccattgagcgatgtccataaacttctccatcaagtccttgcaacatataagctcctttggacacaaccttatggatttgaaatggtccttcccaattcggtgaccacttgccgaatttgttatctcgagttcctatcggcaagatcagcttccaaacaaactctccttcagaaaaagacttagggactaccatcttgttataatgcttagcaatcctttcaatctggattggaccaaatcttccctttcatcggccatgagattgtaatattcatcggctgtcaattcgttttgtaattctgttcttcttaagccgattctaacttcccatggtaaaactgcctcatgtccataaagaagcttataaggaggaacttgaattgatccatgacaagccatccgataagactacaatgcttcggccaacctagtatgccattgccgaggataatcagaaatcttcctcttaatgagcttgatcaaactcttgttagatgcctcggcttgcccattagcttgtgcataatatggcgaagaattcaataatttgatacccatgctatcggcaaattgaacaaactcatcggtacatgaagatcgagccctgatcggttgtaatggtctgaggaataccaaactggtaaataatatgctcttgaacgaattgtatagcatcccctgaatcaactttcttcaaagaaatcgtttctacccacttggtaaagtaatcggttgccaccaatataaacttatgtcccttgcttgaaggtggattaatcataccgatcatatcaattccccaacctctgaatggccatggcttgataatagaattcatagccgacgccggtgctcgctgaattgctccaaacttctgacaatcttgacatcctttgtaatatctgaagcaatcttccaacattgtcggccaaaaatatcctgcctgccgaagcaaccacttcatcttatgagccgattgatgagttccacaaattccttcatgtacctcgcctatcgcaaccttggcttgatcagcactcaaacatttaagcaacaccccatcaatcatccgataacataactcatcatccaacaaggtgtatttcaaagctttatagagcaacttccgagaagctgattgagatggattctgcaaatattgaaaaatatcatatctccaatcatcggctgatatagtagcgatttccaccttgatatccttcgtcatcggcttgtaccccgatgctccctgagccaaatcattagcttcaatattttgctctcgagacacatgtttcaaagttactagccgaaatccatccatcaattctcggcacttttcattgtaaaccatcaacgtatcatttttgcattcatactgtcttgccaattgactgatcaccaacaaagaatcacccataatttcaacagcatcagcttcaacttccttgagcaactgcaatcctttgagaaccgcttcatattcagcctgattgttagttgcataaggcttaatagtataggcaaactcgaaacttgcaccccgaggagaaattataactaagccgataccacaaccgtgagtgcacacggatccattgaaaaacaaagtccaaggcacaatatcgaccgagccaattgagtcatcacgatgatctacaataaaatggctatagcttgtcccttgatcactttcggagactcataccgcagatcaaactccgttaaagcaaatatccactttccaacaattcctttcaaaattggagccggtaacatgtatttaaccacatcggctttgcatatcacagtgcattcattggacaatggataatgccttaacttcgtgcaagagaaatataaacacaaacacaacttctccacaggagaataccttgtttctgcatccaaaagcctgcggcttaaataaaatacggctctctctttcccctaaagctcctgaatcaaaactgagccgatcgacttctcaccggccgatagatataatctgaaaggtatccccttctgtggagggattaaaactggaggagaactaagatactctttaatgttatccaaagccttctgttgctctgccccccaggtgaattcttgatcggctttcaatctcaacaacagcataaaaggttctaacctgctagacaaattagaattaaacctcctaacaaaatttaccttgccgatcaactcctgcaacttcttcttgtcctctggaggttgaatcttcttgattgcattaatgctcctttgagtcacctcgatccccctctcatgaacaagaaaacccaaaaactggcgagccgatacgccaaaagcacattttgtcggattcatcttcaggccatattttctagttctctcaaaaaccttcctcaaattggctatgtgattctctatttcctttgatttaacaaccacatcatcaacataaacttcaaccaaccagccgatcaaatcatggaatatgtaattcatggccctctgatatgtagctccagcgctcttcagaccaaaagtcattacaacccactcgaacaaaccgattgcaccagggcacctgaaagctgtcttatgaatatcctcttctaccataaagatttgattatatcctgcattgccatccataaaatttaatatcttatgccccgaagcagcatcaaccaactgatcggctactggcattgggtactcgtccttcagggtagctttgtttagatcacgaaagtcaatgcacaccctgactttgccatttttcttgataactggaattatattggaaacccactcagcatatcggcatggacgaataaaatcagcatcatataaacgtgcaacctcagccttgacagcctcaagcatatcggctttgcacctcctcggtggttgctggtatggtctaaccccggttttgataggaagccgatgttcgacaatcgatcggctgagtcctggcatctcataatactcccaagcaaagcaatctctatattcttttaaaagctctatcaacttggttctaaattctagagataaattcttactgataaatgtcggtcttggtctatcacctggacctatatcaatttcttccaaatcatcagccgacatgaaaccttgtccttgcttgtcatcgagatcatctactgtgtccttggtgtagacgtttgaaccctccacgacgccctcaaaataataatttgggctctccatcttcaattggttgtatatcacaatcggacactcttagaaaatctccatcccaaactttcccagacaggcaatcaataccatccatctcccaaagagctaaatcggcactggcaacgttaactgacctatcggccggcacgatctcaatcttgtcgccttgccattgaatcaaggactgatgcatggtcgaaggaatacaacaattggcattaatccaatcccttcctagcaacaggctataggaacccttcctatcgatgacaaaaaaatgttgtaggaacagtcttgctgtcgactgtcagctctacattcaaaactcccttattctccgatggattgtcaccaaaatctttgagaaccatatttgtcttgatgagatcctctgaatttccgcccaactttctaaatatagaatatggcatcaaattcacagcagccccaccatcgaccatcatcttagacatcggcttcccattgacataaccgttaatgtacaatgacttgagatgccgattctctgttccctccggtttctcaaaagatcgccgcgcgaatcacaaagtgtgtttttgccacgaacgcacccaataccctccaatatgtccaaaaatcatgttttggcgttttttgaactttttgattccagtacaaaacatcgcaccctcgtgtgccaatattggcattaattgacaaaagttcgccgcgcgaatcacgaagtgagtttttgccacgaacacacccaatacattctgatatgtccaaaaatcatgctttggtgctttttgaacattttcattctgttcaaaaacatcgcacccgtgtgggccaatatatgccaatattgacattatttgacaaaagttagccacgcgaatcacgaaatgtgtttttgccacgaacacaccccatacgcaccaatatgtacaaaaataatgttttggctcgttttgaactttttgattccagtagaaaacatcgcaccctcgtgtgccaatattcgcattaattgacaaaagttcgccgcgcgaatcacgaagtgactttttgccatgaatgcacccagtacactccaatatttccaaaaatcatgttttggcgtttttgaactttttcattctggtcaaaaacatcgcacccgtgtgggctaatatatgccaatattgacattatttgagaaaagttagccacgcgaatcacgaaatgtgtttttgccacgaacacacccgatacactccaatatgtccaaaaatcatgttttggcgttttttgaactttttgattccagtagaaaacatcgcaccctcgtgtgccaatattggcattaattgacaaaagatcgccgcgcgaatcacgaagtgtgtttttgccacgaacgcacccaataccctccaatatgtccaaaaatcatgttttggcgttttttgaactttttgattccagtagaaaacatcgcaccctcgtgtgccaatattggcattaattgacaaaagttcgccgcgcgaatcatgaattgagtatttgccacgaacgcacccaatacactccaataagtccaaaaatcatgctttggtgctttttgaacattttcattctggtcaaaaacatcgcacctgtgtgggctaatatatgccaatattgacattatttgacaaaagtaagccacgcgaatcacgaaatgtgtttttgccacgaacacacccgatacacaccaataagtccaaaaatcatgttttggctctttttgaactttttgattccagtagaaaacatcgcaccctcgtgtgccaatattggcattaattgacaatagatcgccgcgcgaatcacgaagtgagtttttgccacgaatgcacccaatacactccaatatgtccaaaaatcatgttttggctctttttgaactttttgattccagtagaaaacatcgcacactcgtgtgccaatattggcattaattgacaaaagttcgccgcgcgaatcacgaagtgagtttttgccacgaacgcacccagtacactccaatatgtccaaaaatcatgttttggctctttttgaactttttgattccagtagaaaacatcgcaccctcgtgtgccaatattggcattaattgacaaaagttcgccgcgcgaatcacgaagtgagtttttgccacgaacgcacccaatacactccaatatgtccaaaaatcatgctttggtgctttttgaacattttcattccggtcaaaaacatcgcacccgtgtgggccaatatatgccaatattgacattatttgacaaaagttagccacgcgaatcacgaaatgtgtttttgccacgaacacacccgatacacaccaatatgtacaaaaatcatgttttggctctttttgaactttttgattccagtagaaaacatcgcaccctcgtgtgccaatattggcattaattgacaaaagttcgccgcgcgaatcacgaagtgagtttttgccacgaacgcacccaatacactccaatatgtccaaaaatcatgttttggctctttttgaactttttgattccagtacaaaacatcgcaccctcgtatgccaatattggcattaattgacaaaagttcgccgcgcgaatcacgaagtgagtttttgccacgaacgcacccaatacactccaatatgtccaaaaatcatgctttggtgctttttgaacattttcattccggtcaaaaacatcgcacccgtgtgggccaatatataccaatattgacattatttcacaaaagttcgccacgcgaatcacgaaatgtgtttttgccacgaacccacccgatacactccaatttgtccaaaaatcatgtttgggctctttttgaactttttgattccagtagaaagcatcgcaccctcctatgccaatattggcattaattgacaaaagatcgccgcgcgaatcacgaagtgactttttgccatgaatgcacccagtacactccaatatttccaaaaatcatgttttggcgtttttgaactttttcattctggtcaaaaacatcgcacccgtgtgggctaatattgccaatattg

SEQ ID NO: 80898 - DNA, 3096 bp, Oryza sativa
ctctttttgaactttttgattgcagtacaaaacatcgcaccctcgtgtgccaatattggcattaattgacaaaagttcgccgcgcgaatcacgaagtgagtttttgccacgaacgcacccaatacactccaatatgtccaaaaatcatgttttggctctttttgaactttttgattccagtacaaaacatcgcaccctcgtgtgccaatattggcattaattgacaaaagttcgccgcgcgaatcacgaagtgagtttttgccacgaacgcacccaatacactccaatatgtccaaaaatcatgctttagtgctttttgaacattttcattccggtcaaaaacatcgcacccgtgtgggccaatatatgctaatattgacattatttgacaaaagttagccacgcgaatcacgaaatgtgtttttgccacgaacacacccgatacactccaatatgtccaaaaatcatgttttcgctctttttgaactttttgattccagtacaaaacatcgcaccatcgtgtgccaatattggcattaattgacaaaagttcgccgcgcgaatcacgttgtgagttttatccacgaacgcacccaatacactccaatatgtccaaaaatcatgttttggctctttttcaactttttgattccagtagaaaacatcgcaccctggtgtgcctatattggcattaattgacaaaagttcgccgcgcgaatcacgaagtgagtttttgccacgaacacacccaatacactctgatatgtccaaaaatcatgctttggtgctttttgaacattttcattccgttcaaaaacatcgcacccgtgtgggccaatatatgccaatattgacattatttgacaaaagtttgccacgcgaatcacgaaatgtgtttttgccacgaacacacccgatacactccaatatgtccaaaaatcatgttttggctctttttgaactttttgattgcagtacaaaacatcgcaccctcgtgtgccaatattggcattaattgacaaaagttcgccgcgcgaatcacgaagtgagtttttgccacgaacgcacccaatacactccaatatgtccaaaaatcatgttttggctctttttgaacattttgattccagtacaaaacatcgcaccctcgtgtgccaatattggcattaattgacaaaagttcgccgcgcgaatcacgaagtgaatttttgccacgaacgcacccaatacactccaatatgtccaaaaatcatgttttggctctttttgagctttttgattccagtacaaaacatcgcaccctcgtatgccaatattggcaataattgacaaaagttcaccgcgcgaatcacgaagtgagtttttgccacgaacgcacccagtacactccaatatgtccaaaaatcatgctttggtgctttttgaacattttcattccggtcaaaaacatcgcacccgtgtgggccaatatatgccaatattgacattatttgacaaaagtttgccacgcgaatcacgaaatgtgtttttgccacgaacacacccgatacactccaatatgtccaaaaatcatgttttggctctttttgaactttttgattgcagtacaaaacatcgcaccctcgtgtgccaatattggcattaattgacaaaagttcgccgcgcgaatcacgtagtgagtttttgccacgaacgcacccaatacactccgatatgtccaaaaatcatgttttggctctttttgaactttttgattccagtagaaaacatcgcaccctcgtgtgccaatattggcattaattgacaatagatcgccgcgcgaatcacgaagtgagtttttgccacgaatgcacccaatgcactccaatatgtccaaaaatcatgttttggctctttttgaactttttgattccagtagaaaacatcgcaccctcgtgtgccaatattggcattaattgacaaaagttcgccgcgcgaatcacgaagtgagtttttgccacgaacgcacccaatacactccaatatgtccaaaaatcatgttttggctctttttgaactttttgattccagtacaaaacatcgcaccctcgtgtgccaatattggcattaattgacaaaagttcgccgcgcgaatcacgtagtgagtttttgccacgaacgcacccaatacactccaatatgtccaaaaatcatattttggctctttttgaacattttcattccgttcaaaaacatcgcacccgtgtgggccaatatatgccaatattgacattatttgacaaaagttagccacgcgaatcacgaaatgtgtttttgccacgaaaacacccgatacactccaatatgtccaaaaatcatgttttggtgttttttgaactttttgattccagtagaaaacatcgcaccctggtgtgccaatattggcattaattgacaaaagatcgccgcgcgaatcacgaattgagtatttgccacgaacgcacccaatacactccaataagtccaaaaatcatgctttggtgctttttgaacattttcattctggtcaaaaacatcgcacccgtgtgggctaatatatgccaatattgacattatttgacaaaagttagccacgcgaatcacgaaatgtgtttttgccacgaacacacccgatacacaccaataagtccaaaaatcatgttttggctctttttgaactttttgcttccagtacaaaacatcgcaccctcgtgtgccaatattggcattaattgacaaaagttcgccgcgcgaatcacgaagtgagtttttgccatgaattgatgaggacatcaacaccatcgatacatccacgtccccccatgtatagcatgatggtcctattacccgcgctcgtgcacgtcaactaaattatcaggtgagttctttcttgagttcatattcctcgtctttataccccggagacgcgtgcactcgtgttttactcaggaacgatggagaggatccaaagggaagaggattcgcgcggggtggattaggactgcagggcagcaccaacttctgacggccgccacgacttcatgcgaactccgatttgggcgtgcaagtacttcacgg

SEQ ID NO: 80899 - DNA, 32044 bp, Oryza sativa
tatagaatactcaagctgctcctgcgaatgataacaacatgcagtcctatcacatcatggcagaaccactcaaggatgcagtcactagaacaatgccagctatatctctccagaatcaaaatgagcagccatgtttgtggttttcagttcgctacttatcattgtgtaatcgaaagtttgcagcaatcatgtaatacataaatatattcatgtctataaacagtgagcttgctatgcttatggatgattcatgttgaggatacaatgtaccgatgttaagcaccttccctttttgtttaaggcagtgcctcgtattcatgtaatatgggagaaatgtgtaataaaaacaagttctatgaggactctttcagaagatgctgatatgggattatgtgtataattgtttactgtcaaaggagacctagggtctcatttcagaggaactatgttctaacctcgagttaataaccaacctgatgatggaaaagaaaatcaagcgattaaccaaagagacatttgtttggactaagagtttcagatgtgtcttttttggatcaaaggcaatggcagtcagtatagcttttggcgaaacacttcaaggattcactgaaaggcagtagaccaaaggacctcatcgccaccagaagtgtccgcaacccacattaaagagtaccacctgttagagataggccgaaagatgattgataaaagatattggcaaagaggttctctagcaggaaagatgtaggccgaaaggtgattgataaaggataatcaaaaacatgctctgcatcactcaaggaagacccctgatagtaatcgccctgcaacagtcaccttgtcattgagagaaaaaaaaagtcgtgagtaagcaagatgacctaggtaaaagtgtttctatgaaggcaaggagtgaaatcttcaactcagtatcagatgctacacggagtgaaaactgcaagcaccggttaccaggcaatgccatgtcttgggagatgatccaatgggaaggaactcatcaaggtcaaaggagtaaaggaatacgttgaatgctaaataatgacaacctgaagataatagtgggaagtaaactgaatgtaaagaaccaagtgatatgttcgaagatagtctacagaggtcagattaaaatcacatctaacaacgaagcttcaaatttggcaggataacgatcaaacaataagaagttcagcagtaaagtcatttgggaagacgtcaaagcatgtcaagtgggataatttggttcccttgggaaacataattcaaaggcaaagttatcgaccctcacaatgaatagaggaaatatctagcaccggagaccaggaaagctaatatgagacaatcagtggcaagttgtcaatcatggtattcttagtaagcaggatatcatagtctaaagcatatggtggtaagttagaagtaaatgacaagcatggtattctcatgatgacaagcatggtatcctagtaatgacaagctgatatcggcgcaaaacgtgaagtgggtaacttgtatgaggttgacgccaaagatatgaattatgagaagttctggaactgaagccccatcttccaatgccgcagcctagtcgaagtcagctagaggtgcaaccagggaaaagtcatgtgaagagaagattccatctataacaggagatcgagccaagcagtccagagtggagaggttttgctaggcaagtttgttatagaagacgcgacggaagaagtcagataagaagagaagcccgcccaacctatcttcttgctagcctcctcgaatctcggggacgagattcttgtaaagggggtggatttgtcacgtcctgataaattcatcccgaattaaaaatcattccctaaaaggaataatagaattaattaaaattcgaaaagaaattgacaaacactaaaatacgtgccagaaaaattcgaatgtggcccggagaatttttgttaaattctccttggtctaaaaggagccctcaaattttacttgaattttcagagcactggaaataattattaagcaacaaaaacaattatcaatgtttattaaaaagaaaacctaaaaataaatcctcttcctcctttgggccaagcccagcccaaagtcctctctcccccccccctctctttctccccctcctccctttgggccccaaagcctccctccattcctctcagcccggccgaaagtctgttttacctcccccgtgctacagtgctccttcttccagctcaggcagagcccgagctctccagccgtgccgtgcacagtgccaccgcctcctccttccaaatctcgcctccccgttgctcctttttccaaattagttgcgggaatggaatcctctcaatctcctcttcctttcccccaactttccccctttaatcccgcccccaatcaccgggatttaatccctcttctttgaccaccattgatgccgccggccacctcctccggcgccattttcggcctctcccgtgaccggcactccgtccttgccctataaaacgaagccctcctccttcctttggtccattttgctctctcccgagcccctagccacctccccatcaccttcccctctctcctgtgccgacggccatctccggccgcccctgccgcggcgcctgtgtgccggccggccgtgccgtcgccatccgcgacgtcgcagctgcctcctcttcctcggcttcgcctccgtttcgcggggaaatcaccggagacgcgtcttcgccggcaaaacagtggcgttgccgccactgtaccgccttcagtcgccccggtcgccgcgtcagagcgtcggccgatgtcgccgtctccttcgtcgacgtcgcggcgtcgccctccaccccggcctgccctcggtttcgccggaacgccgtcgcccgcgccgcctctccctcggtcttgtcggcacccactccggcagccccttccgccgtgccagtgcgccggccgacgtcgccgtctccacctctggcatcgcagcggcaaggtcgtcctcggcatcgtttcccctccatccaaacccctccgcggtccatcgtcgtcgcctccgttcgttctcgtcgtcgacgtcccgtcggtcgcccggctcgtcgtctcgcggcgtcgcctccgtcgtcggattcgcagcggcgcgttccacgtcgtccccgtctccgtgcagctgttgccggctgccctcgtcgcttcctcgccggccccggtcgtcgtcgtcgtcgtcctctcgtcgttcccggtcgtcgtggcgttcgtccctccgtcgagccgttctcgtccgtcgtccgcgttcgtcaagcgagccgctgcagccccgtcgtcgtcttcgtcctcggctccgcgtcgtcaagcattgcgccggccgcgtctcaccttcgtccaaggatcgccgctgaagtcgtcccctcgccatttgtctccgtcgttcccggccgcctccgccgcgcccgttcgtcgttgtcgttcccacgcctcgtcgcgtggtggtaaggatctctcctctcgctgccccgtcctcgtcctttcggtgtcgcccgtgcccgttgtgcggttgtcagccccggtatccatgtatcggtatcggtagtcgttcgcttgtccgtgtagtgtccgtgttagtgtgcccgcttggtagccgcgttgtttcctcgtgtgcaacccgtgtggtgtctagtggagtccgtttgtcggccactcgcctcggttgacacacggggtccgcttccgtcgacccgtggaccgtctctgtgtacctggtctaccgcggtcctttaggttgacatgtggggttcgcatgtcaacagcgcagccttcctgtcttttccaggctagcgcttacacatgttttatagtcgcaaagcctaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagttgcaccccggccactataaggattaagctcaggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctagggggctcaatcctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggatggctagggacgagctgggacccagggtcgggttgccagttcggtctgaatcatcgtaggccttgggttaaggcaggttcgtgcgggttcacgaccttgattaataatactgtgtagctttaggatcgtctttttaaaatggctttgggcaactaagtgacttttaaatgctgttttctgcaaaacttaacccctatatcattatcccttgtacccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttattgttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacagaaactacaatttagttgtactctctggagctcaaaagttgtgtgttgaagtgtgttaggtctcctactttcatagctgccaatgatggttggaatggcggttaacccctcagaaccatcattgggactccactggagccatccacgtgtaaggtggagatgaggtgggccaggatggattctctagcagcttataggtgggcccctatggcggtttggtcccaatgtaagtcagtttcgactgacttgtggtccgtccaatccttgtactcgcacatgattggtcagaggttcatttttgtcgcatggcagatatattttctccttaaatgacctgcatacatatatttaccaaaattagttgaagtggttagtagtaaactcctaccactatgttttgagagtatatttgatatcttttatgtaggtgttaacggttaaagtttgcacttaacgaccttcaatgacaccccaacacttatcttcaactcgtccctgagtaaagctcatgaacctactagagtaatgactttttgcttcatgacatgacataccaaatattccaagacatacttgaggctgtaaacattgatgtgtttaccatgccatctttaggcgattgaagaacgtaacagtcctcgaaccaagtcccctctactacttctgatgaattaccataggattttctttgatgtttataaaaacataacttttactgtacttctcaattgactccctcaaatcactcaaagtgtttattcctcaccaaggtattgatgttgcattttctcatcctacctttctaattaggcttatatggatctcagggtagggaataagaaatgacatacttgcatcagatatatagtaaagtcaaacagaggatacaacaagataactaatcatataaccatgaccaagcttgtgcacctatgtttatgggtagaaatgaaaagggtgaaaaatctacaataaaaaatgggatggtgactctttttatctctacctttttttcatcgtgctcgagtttgatcattttcttttgagcagagttttttattttagctcatctctcatttggcatggatcatgggaggagagaccacaaaatttttagagtctttattctgtggatacattgcttaaaacatagaagtttagcatatagatatggatggattagttttctttttggctaatcctccagtgtagagaaaaagcaatatttttggtgtctaagtgcacaagactttgctcatgagaatatgaaaagaatctaagatggtcacaaccatttggcaaaactcaaaatgatagcaagcaattgagtaccaactttccgataatgtacaaggtttcatcattaagatcgatatatggctttggtaggaagggaacatcaatgaagagtacgcaaagatatttattttctttttataaaatcccaaggattcattattaagagcaaggttcatatctgttgacggtcgttagcgatcagtttcgcacgtcaatattaccaaaataaagtagaactaagttttgcttgcaaagcatattatgtcaaaataagatatattccactagcactaggctttctaacctcttgcagagaataaacataaaatggaggcgattcgacagtaaaatggacgatcaatcaatcggacgctgtcgaggatcagacttagaggaagatgggccaagaattcagaaagaacacaaccaatgggacaaaactcgcaagtctgcagaaaccaacagaagaggaggccgccagccgaaattggactaattttggcccagcccatggttcggccgaacccccttgagctccgttggatgcaggggttggtttggacggtgtggattagctccgaatgatagttggagggtatttccgaccattccaacagtcacaaccgtcattggagagctatataaggccttcacctcctcacctcttccacacatctcaagcaagaagcttcatacattctctcaagtttaatatagtttctagagtatagtggaatagaaatagaatataatcttcagtccgcagagtttttggaagagttcgggtaagactctagtagcttttccttcttttgtaagacttgtactatttatagaatattcttctcaatatattctcatttttgggggttatatgctgcggatacgtcgaggagggctactgatggagacagctcagtatgggtattcctctgcgcgtgtatataatcctaagttatttttttagggagggtactcctccgtatttagccccagttggatgggcttgacgggttgttgtaagaaactcggcaaccaagggtggtctctcgaaacaccaggagggcatcataagggggtattggctatacggttatatagtagataatattgactaaagtgtatgtatgtatattagaagtataggaaatgatccttttcttattctttccacttagcatagaattagtaagtatgagaatagtgaatgcttcagctttgtgtcaccctaccctttgaattgaactaaccccttcttagactttgattattacaagtaacatataagtattagcttggttctctctattataattttcccacgggattaaaaaaatacgatacccttggaatactctcgggtgaaatgctacaattatccatgtgcttgcggatgaaatctgtaaccataatataccacgagtggttttgcaccattgctgggaattatatttctagtaatatcgttaagaaataccaacaagcatttctagcgccgttgccggggaagatttataaaagagattactaatattttatatttatctctgtataatcactgtccttttgcaggctaaccttggttattttcgcttttgctgtgaaaatagggcagtgtatgactagtttcaacttgccggaaaatttcaaagaaaatcaaaaagttttcttctggagtgttaagccgcgcatcgttcctccgcagaaatctctctcggcaaagaaatcagcgtcaccgagcttcaagtctatggccgagaagacccttcaagagttcgctgctccctcagctgagaacgtgcccgttaggccacaaattaacttaggagacacaaacttcgatctgaagtcgagcctcatcatgatggcgcaggctagcccgttctgcggcaagcctaaccaatatgccagcgcacacctgcagcaattccaggagatatgtagctcgtacactatgaagggtgtcagtccagacgcgtcaggatccagctgcttcgtttctccctcctggggaaggtgaagcagtggttctatgccaactgtgctacaatcaacacctgggacagatgctctacggcatttttgttgaagttcttcccgatgggtaagaccaacgcccttcgtggaaggatttctggattctagcatacgagggatgagtcaatccccgaagcatgggcacgacttcaggagtatgtggccgcctgtccttatcatgggatggatgagtggctgatactccagagcttctacaacgggctcactcccacgtctcgtgaccacctagacgcggaagctggaggagctttcttctctaagacagtcagaggagccgtcgacttcatagagaagatggtctccaccatggactggagcaaagaacgactccagacccgtaagtgaggaatgcacaccataaaggagaccaagatgctcgctgcaaaactggacctcctcatgaaacatttggacgaccacgagaagaagccccagggcactgttaaggcattggactcacatgtaacgtgcgaggtctgcggcagcatgggtcattgtggaaatgactatccggaaacacgtgaagaagcgatgtacatggataacaacacaacgggttccgtccacagggaggtcaggggtgaaaccaaccccacccatatttccaaggagccaacaataacggtaacctttctaaccaaccttccttgaaggatctcgtctttgcacaagccaaaacaacttacgcacttagcaaaaagctagctgctaatgacaagatactagagaatataaacgtcaagctagatggctttggttctgcatttcagaacaagcttagttttaaaagatgattgaaacccagctggcgtagcttgctgcattaattcccgctaatgaataagggagggttccggagcaaccggaaccttatgttgaaaatgctaaggcgattacaacgaggggaggtaagtccactcgcaatctgccatatcctaaccctgcagggaccggcaacaacagcaacagggaagcaccatctagtgacacaactgaagaagaggttcagtcaaagaagaccgtgctgcaggagtattgtgacacgagaccgctgccactcccccagagatacaagaagccgtcggtggacgagtagttcgctcgttttgttgaggtgatccaaaagattcacattcacgtgccgctgctagacgtcatgcaagtgcccacttatgcacgatacctcaaggatatcctcaacaaaggccactaccgacgactaaagtggtcaaactaatggaggaatgcagcaatgccatactccacaagctcccggaaaagaagaagggtccagggtatctcatgatcacctgctcgatcgagacacagaaattcaaccaggccctctacgaccttggagcaagcgtgagcatcatgcccaaggatgtcttcgacaaactcaactttacagtgttggcaccaacaccaatgcgtctgcagctgggcgattcattggtccattacccaactggcatagtggaatacgtaccggtcaagatacgggatttcttcatcccggttgacttcgtggtgttggatatggaatctgacaaggagacgccaatcatcttggggcgtccgttcgttagtaccgcagatactaacattgatgtgggaacgggaagcatccgtttttgtatcaatgggaaggaagaaaagtttgagttccagccaaggaccgagcaatgctccatggtgaggataaagtatgggccaaacccgcaaaatattcatgtggtcgaagtggagccacccaagacagacagcctagtaaaattcatgcagaatttcctggagaagggaatgccggtaaccaggtcccttgagaagaagacgctggtaaaatctagtacaccggctaagaaacaagagaagacggctcaaaagaagccgccacctgttgacggtcgttagcgaccagtttcacccgtcaatactacccaaataaaggagaactagttatgcttgcaatgcatatttatgtcaaataatataggcaaaatttgctacaggacaccgaaaaattgcggtctttgctgcgagacacccgaagatcgtgtatttgctcgtggacactgtaaaaaagtggtaattagctgctggacactcctcccattattttattatctccggtcaaaatagagagagaaagagttgtgtaattaccaaaatgcccctgtacagtgttctttctctcacttcttttcttttccccttcttcttctttgcagtggagtagagggtgacggcggccggcccgagccgggacggctcggccacggcagggcggcggcggcggcgcatcgcccatggcaccgccggtgatgccctccgcatcggcggcggcgagctcgacttcttcacgtcgcgctcccgcgccgcccgccttgccgacctgatcaccttgccgtggcccgcctgcgtcgtcgtgtccaagcacgctgcccgaacagcacgtcatctgcttcatcgaggaagccgcgcaccgcgtctgtgaggcactagcaacgtcgtcgaggctgtccgccacgtgcgctccatcatgggcgaaatccgcacgctccgcgacatggacgacgacgaggtcttcgcctacgccaagcgcatcgccgcgccctacgacctcgtcatgcagaccaagcagctgggccgcctccccgtcgtgctgttcgcggccggcggcgtcgccacccccgccgacgccgccctcatgatgcagctcggttgcgacggcatcttcgtcggctcgagcatcttcaagagtggtgaccacgcgcgccacgcccgcaccatcgtgcaggcgatcacccactgcaggtcgttgcgtccaagcacgctgccgcctcgtcgtcctcgctggcacaccttcgccgtggagctctgcccggtgtgccgtgacagagaaagagaggaagagatgaacggagagaaagagaggaagaagaagaacggagaaagagagattgacaagtgggcaaatttgtctttaaccaaagtttctctctccattttgaccggaaataataaaataatgggaggagcatccaatagctaattaccacttttttacggtgtccacgagcaaatacacgattttcgggtgtctcacagcaaagacctgtagcaaattttgccaataatatatattccactagcactaggattactaacctcttgtagagaatgaacacaaaatggaggagaatcaacagtaacacaaacgatcgatcaatcgaacgctgtcgaggatcggacttatcaatgaatgggccaagaatgcagaaatgacatgaccaattgggccagaattcataagtctgcagaagagatctagagaagaggccaccagccaaaacttgggctggttgggccggcccatggttcggccaaaaccatcgtgcaaccgtccgatgcatggtttgcgctggattgtccggattgctccgctatggcggttggagggtattaccgaccattccagctgccataaccgtcgttaccaagatataaaaggagctctcatcctccattacaagacacacctcaagcaaaaacttcatttcatcgctcaagtttagtagtcttctagaagtataagtggaaataggaaatagagtaggaattatcagtcccacggagttcttcggacagaattcgggtggtggctcttagtagctttttccttccttatgtaaaaacttgtacctttagaatatttcttcttttatactaattctggtatctgtattttatttccgaagtatattaaatcccacctttccttatattgtccaagtttatatgttataataatgttagctatctggaagatgcaatggtgtaggtataatgatcgtgtatacgatgactctatgtcatgatgataatattagagtagtatttggtaatttaagcatggtgtttgttgacggtcgttatcgatcagtttcgaccttcaatattaccaaaatagaggagaactagagatgcttgcaatgcataaacatgttagaataataatattccactagtattaggtatactaacattttgcagagaatgacactaaagtggaggagaatcgacatcaacacagacgataatcaatcggacgatgtcgagaaccagacttatgtgtgaatggccaagaactcagaattgacacgacaaactgggccaaaattcacaagtctgcggagaagaacaacagaggaggccaccaggcaaaccatgggctggttgggccggccccaagttcagccgaaccagggggttcggccgaacctccctcatcgccgctggatgcagggtttcttctggacggtgtggattagctcccaatgacggttggagggtatttccatgatgaggacataactagctcggatatgaccatgactaatttatatattcatcaaccaaaggtgcatatgttctatgttagatttacttattatatatttgaacaaatgttgctacacagtgagtttcgtgtgttttcgtttgcagaggtacttgcttgggagaaggaaaagaaatcgagcataaggaatacttggatgatcaaagaagttgattggggaccaaaccaagaccttctccaagtctatttctacctcaccatgtcacttttggtccatagaagacaagagatgaagttctacacgtttttgattcggattcgggcctcctgacagcatcagtctactttcagatggttttggtcccacgtcaaaattcctatcgagctgccggggatcttcaaaaaaaggagagggctacacgtcggacgtccgatgctttagggaaaaatcggatgctgacgtcagcatgacgtcagcgcccgatttacgtgcaaaactacttttaaactaatttttctcttaaattacttatccaaatcatgatccgattacaccattaaattcgttgcaattaaatcttcaatacaagaccacacatggatatattccgataaaaagaaattttagcttattattgaattatctttaaatttttagcttattccaccagttatatcgaaattgtttcactaagtagatcgaaaatgtttcacttgtttaaatctggtgttgtttcaccttatataaaaacaatgtttcagcaaatagcgaaagaatggttcggttcactgcaacattagatctatacatagtgaaacattataagtacactaggtgaaacatttttcggtgaaacaaaaaatgaaacgaattcccttaacaggaggtttccaaaatatgtgggttttttgttgcaatgaaatatttcagttcactgcaacattagatctatagatagtggaacattgtgagtgcactaggtgaaacattttttgtggaacaaaaaataaaccaaattcccttaatttagagtttccaaaatatatgggtgatttattgcaacggcgtgttccactgcaacatttgatctgtacacagtgaaacatcatgagtacactagctgaaacattgtaaaactactggttaaaacatcaaaagagaccacatgcaacattaaaaaaatcaataaaaaattaaaatattttgttgtcaaaatataattatgtgtggtcttgttgtaaagatttaattgtaacgaatttagtggtgcaatcagatcgtagattagataaatagtttacgataaaaattcttttcaagaaataagaaaagaaaagattctttgcatgctgcagtggcaggaaaaaacaacgtctaatttttctccaacccgccggtggttcgggtgtgagcattttcacgaagaatgggttaaatcaatagtgggccccacctaacttttcgtccgatattttgtttcgctccggacgctcgatacgaagcgttttcgtcaaaacaagccacatatctcatccagtcccaatctgatttgggttttgggcctcgtaattgtgtcgtgggcttagcccaaggtggtgtgcaccctagggcaacactaggacgtccctaatcacatttattcagtagccgtcatcgtttagagttgggttttgcttagattattatgtgaagaatagtttcgccgctagttcggtttgtggaaccccaaattctagtgcttaatcattcatatgcaattgtgttgcaatctatcttgttcttgcttgtgttcttcgattcgcatgaagggattagccttctcggcaaggtcaactgggtttcggcacggttgataaccagaggagacatggtgctgcgattgcggggctcaagagcgtgcacgttcaacaagccggatcaatttgtgtcgtgactccacccaaatcgttgtttatcagaacctttcagaagatcgggaaccctagtgcacatcaagtggtatcagatttagttgaaggcatctgagaacaaccaaggtaatgaggaggaagagaagaaagacgaagagcaaaaagatctatccatagctccatgcatgcttgaggaatgtttaattgaccaagcgcttacaatttctgaagatgagaaaaaaggtagtgacaatggtgctacaactgctcaaggtatgcatacttatgatgtgccaaatatgtccactacttgtgctacattagagcaaagcatagtggaaacaattgttgaaatacctttgtcacaaaacaatttgcttgatgtttcttgtgataaagaagagttgtgcgatgcttcacttatatccatgccacaactagtgaatgaacatgttagttctatagtacagccactgtgtgttgagtttaaacatattattcacattgctagtgagaacgaagagattaaattgctatcttctttaaatacttggggttaaattcaatttgatgatctttgtccactcaactgctaagagaagaaattatttgctagatttgaattgccatgcccatctgatgtgatttttcatattattggcaattacgataataaagaagaatataatgtgcatcgagtatatatatgttcgaatttgactatacctccttttcataatgaaatgcattgtctagaggacctcatgcgtataagtaattctctatctatttcctctagttgttcaaatgagttacaggttggtttgcaagaaggggagtgttgtggtgtttcgactacaaagattttaggatccaaccatatgtccatcaagaaatggtcctcaccagatgttgtgatagataaatataagtacaatacgctccatgataaggtgaaaccgaggacggtttccaatcaagaaggggaggatggtaaggacataactagcttggatatgaccatgactactttatatattcatcaaccaaaggttcatatgttctatgttagatttacttattatatatttgaacaaacgttgctacacaatgagtttcgtgtgttttcgtttgcagaggtccttgcttgggtgaaggaaaagaaatcgagcgtaaggaatacttggacgatcaaagaagttgattggggaccaaaccaagaccttttccaagtctacttctacctcaccacgtcacttttggtccatagaagataagagatgaagttctacacgttctggattcggattcgggcctcctgacagcatcaatttcgaacggtcctagccgctgatctagaaggaatttcggggcccatgagtacttgttggaaagcttatggagtctactttcagatggttgtggtcccacatcaaaattcctatcgagctaccgggaatcttcaaaacaagccacgtatctcatccagtccgaatttgatttgggttttgggccttgtaattgtgtcttgggcttagcccaagggggtgtgtgccctaggacaaccctaggacgtccctaatcacatttattcagtagccgtcatcgtttagagttgggttttgcttagattattctgtcgagaacagtttcgccgctagatcggtttgtaagaccccaacttgtgagcttaatcattcatctgcaattttggttgttttctatctcgttcttgtttgtgttcttcgattggcaaacagggattagccttctcggcgaggtcatccgcgtttcgacacgggtgataaccaaaggagacatggtgctgcaattgcggggctcaagagcgtgcgcattcaagaagccagatctatttgtgtcgcgactccgcccaaatcgttgtttatcagaacctttcggaaggtcgggaaccctagtgcacatcattccgaccattccaaccatcacaaccatcattgggaggctatataaacccctcgccttctcacttcactcacagacctcaagcaatagctctctcatttctctcaagtttagtttagtagtatctagctggtggaatagaaatagtgttgaaatcaggtgtccggaagccttcggaagagttcgggtatggctctagtagcttttctcttctcttttgtaagctttgtacttttattagaatactcttctaaatatgagtacctactttatactatgttcatgttatactgaatatatggctagcttatctgggagatgctttggtgcgggtataatgtttgcttatgcaattactctatgtcatgacgacgatattagagtagtatctggtactttagacgtggtgtctagactacgggatatcgttatttagggttatatattgcggatgagaggtgggccgctaatggtgacagctcagtacgggtattcctccgtgccggtatataatcctaagttaattaatttcctggggaaggtattcctccgtattgagccccggttgtatggtcatgacgggctgtcgtaaggaactcggcagtcaggggtggcttctcgaagtaccaggagggcatcggatagagggtattagctagtatatcggttaactagaatatatgtatactatgtatattagaagtataggagtagattttctttctcttttctttccatttagcttagatgaattattatgagaatgagtagttaatgcttgtgtgtcactctacccttggattatcttaacccctgcttagaatatgattatcataagtaatatataaattattagttgagttctctctacatgatcttcctatgagataaaataaatacgatacccttggaatactctcgggtgaaatgctataatggtatatccgtacgcttgcggatgaactctgtaaccataatataccagaaatatttctgcgtcattgctgggaattatatttctagcaatgtcgttaagaaataccaacagtgtttagattattggatatcattatttagggttatatgctgtggaagcgaggtgggctactgatgctaacagctcagtacggttattcctccgcacgtgtatatagtcctaagttaatttcctggagagggtactccttagtatttatcctcggttggatggtcatgacggattgtcgtaaggaactcggcaatcagggtggcttctccaaccacaaggagggcatcggaaagaggatattagctataatgatatgactaggatgtatgtataatatgtatgtatactattgtcacgccctgaagtttcccccttcttctttctttaaaaatttgttaaataaatcgtccaaagagatggttcaaattaacctagagctaattccctaattaataaatgcaattaataattggaaatggcattgtgggatttttcttgggttccacatgtcgcaattgattaacaagatttttagtggaattttcagagccttggaaataattttaaccaattaaaaatgagcaagtgcaatatttaatcccaggaaaaatcctttcttctttttcttttttcttttccttctttttctcttatgggccgccggcccatctcctcccgcgccctccccctcctaccgggctggccggttccctcttcccctcccgaagtccacccggcctccccctcactctcaggtgctgacaggtggggtccacctatcagcccttcccctacctccagccggttggagccaagctccaaccgccggcgcccccacctccccacgccgcccgccttcttcggtccacctggtgcccccactccacacacgcgccgggtcaccgccctctgccgccccactctcgtccacgcgcgcgcttgcaaggggcgggattcaatttgaatccccctctctctcttcctccccactctcccacgtcgccagcaaaatagggaggtttcccgtccacgtctgccccctcccgcacctataaatcgctcctccgagccccctcaacctttttccgctctggccgcgctcgcccgtgcactccgccgctgtccccacgccacacccgagcttcgccgccgccgctgccgcccatctccggccgcatgccgccgccgctagagccgccgccgtgctaagccgccgctaccattagcttcaccgccacaaatctttcccggccgctgccttgcgttgccggaatcccaccgaggccctattttcctcgcgtcgccggtgagtcctctctcccctccgactccggccgacattggtggccgccgtggggtttttgctccgccctaattcctctcctcccctcctctaggtgtcgccgccgcccatccacccctccactcgccgggtcctcgttgtcgccttcgccttccgcaccggtcgccgccgcccctccggtgaggaacctgccccctccctccttcccactccccgtacgcgccacttcccgcgccgccggtcaccgccggtgaccagcacgccgccgccgctcgccatggccggctggccgtctttgtgccgagccgagccgtgccaagccgccccccgcgccgtccgatcggcctcccgtccgatcggcctcccggccgatctggaccgtcggtcccgtggaccgccgcggtggaccacccatgtggtcccaatccacggtgtaccggcgccctttcagccgctgacaagcggggcccgcttgtcgacacagcccccccggatgacgtcagccctgggcaatatcgcgcaataaataattaaggactttttctttactagtaaaaacacagattatcttctaaaaatcatatctaattcatccgagctccgtttaagtccattcaagtcttagtaaattcataaaaatccctagaatccattaaaaatggttttgtttcctgtttcagtagtcttatagcatgttttgcttgtgtgctttgtttgtcgagtagatttcggccgttttgtcgatccgcggtttctcgaagacgttgctgagatctcatcagtgcgagagcaaggcaaatcatgcattacaattgatcatattgtacccaatttacaaatatcctgcatttctattaaatgttgcattcttttacaatgtcatgtgggatggttcctattactcatccatttattgtttaccctatgccattgataacttgggtatcaaaatgactagatgttggtttaggaaatgcttagctatgcttagctcaactagtacacaaatggggatcatattactatatagactttgactattagcatagctttggattagtgccaccacaatggtgttagttaattaaaatacactgaatggtgggttgtgggtgcatggttttgctggtcgcacccatggcaattaaggaccggttcacgggaaaccctgggagacttaccgtgcttaccacaagcgggagtgggtaaatgcttgatttgaagtacagctcgaccctttcctaggcaccggtggcgagggtgggcatgatggagttgggtcggcgggggtgtccggttgtccagctgccggattcaccgcggcgcaagacgggaccgcccactgccttttgaggggtgggggtgaaaccttagcgtggtgtggatggttaggggagggttatgcagagggtcttgtcacgattaccccctttgcagtatcatggtgatacttcgggcatggcgacatgtgtggaatcgtgtcttgtgggtacagttgtacacgtctggccagagtaaaactattcgaatagccgtgcccgcggttatgggcgaccaaccagattcaccgtgattagtctcacccctagtttagcttaatgaactggtgtagtttaagtggttggttgggcctgttgcagcgtggtgtagcgttggacaatgattggttaatattaattaattactacaattgttttactgctttcaactactgcttttaaatgcctgctttatgcaaatgaacccttagcctcctttggatatatcctgcatcatacctcctcttctggtatgacttgctgagtacagtggatagtactcagccttgctctcttttcccccacaccagagctgaagatcttcctagttggagctgtcttattgaggttggtttcgtcgctgccgtcaaggattgcctgtggagtggagtcgccccgctgctgaagtcaagcttccaagtctagctcgttttaccttttccgctgcatttgtaatcttttatatttttgtaagatgtggatctgtgtgtcaacaattatcgtttgtgtaccctggctagtcctagacaggggtttaatgcacattcagcttagaaatcctggttcgtgaatttctgggcgtgacaactataattataggaatatgatctttctatattctttccacttagcttagataatcatgaattagagtataaatgcttctgcttagtgtcactctacccttggaattatgttaacccctgcttagactttggttattacaagtaatatataaattattagtacggttctctctattataatcttcccacgggattaatcaaatacgatacccttggaatactctcaggtgaaatgctacaatggtatatccgtgcgcttgcagatgaaatatgtaaccataataaaccacgagcgtttctgcgccattgctgggaattatatttctagtaatgtcgttaacaaataccaacagtcacctgtgagctcgtccatggcggctagaattcttttgaactaggtgattccccgcgctttactgcaggaactaattaacaattttcactatattttttcgacaattgagctaggagttagaagaataatgaaacatcaataattatcagaacttatgataaaaaaaaataatacccgcactttaatgagtgaaacatattgataagtatatagtaaatattgttaaaatgatagacttgttaaaatattacgaaaatcatgtgagggtgtgataattgaatatgcttgtatgctgatttgtagaattaaatagattgtagatgatattgcttgattgcatgagattaaatatgtaattattgctagtgggtgatgatgtggcatggttgcatgttgagtatagattgagggacacgcttgggagggttgcatggatgaatttattttgtctgttcttccatttgatgcagtggtgatttagacgatttcatttgaatttcatatttgatatgtggaaatggaatgatttgattttaatttcgtgtttgatacatgaaaatgggccgttgcatgcatgtggttttttttgtctatggccactctaaatgtgtcctttttagattattgggtggctaataactaacaaacagctaatattctaataactaacaaacagctaatattctagagaaacaaacagctaacaacttattttatgtcgacttattataactagctcaataatcaaaattacaattatattaagcttaaacaaacaggcttatgctggcggttatcttaactagttgcctacaaaaattagacttttgcacacggtcagcttaatgtagccgcgagagaaaaacattttcactgtcggctgggctaggtcgcccggcagtgtaaatgcctttttgtttgcggctggtggctgctagtgaaaatgatgtcttctcattggccattagtcactggtggaagtgctggtcactgtagaaaacccaaattgaccgcaacaaatccattttgtagtagtgttttcacagttttggtttttgcgtgcttcaatcattcaggctttgttctcgctgtgtggtcctacattgttgttatcatgccatgtaccgcttctttgaattttgtctaaattaatgtgcatttgaaaaagttaattacgtcggtaatacttcaatgtgtggcggaggccgggacggcgagcggcggcttcaccggcgtgacgacgagacgaggacggattgaagaagggcggctcccgtgcgcgcagccagggtaccggtccggccagaccccagtggcgcgggagtggaggaacggcgtcggcgtcggcttggtgtcggtggaggtggtggaggagcggttgatggtggcggcagcgactccatctccaagggaagatctcatggctcgccgggcagtgtcaccactgcagtccaaccgtggtaggcgcagtactgcaccccctgcacaaggatccggcgaggttcttcggcaaccggaggcggaggaggaggcgcaacagggacgggcgggggaaccacaaccggagttgcggtcacacggcggcgagggtagtagcagcggccaccaaccctagccctgcctctgcgggatccccgcgcgtactcctcatcggtcggcgaagaagatgacggagccggcgtacatgctgatggcaagggaggccgagaacggcatccatgatccaatgaaaggtaggcatcgtaccttctctgatgattcttctgttcgcttttctgttagatcaaaagcgatgttttttccttctttcacttcgcgatctccttcgcgagagcgaaagtgctgataacgtattgtgaatagaattgattgagcaagagagattgagtgagagagaattacacacaagaatgtagggaatgaagtgagcgattctttattgataacaatggttacaatatataggggggagagaggcggtaatagaagacgcgatggtttgggaaccatcgcgtccgttactagaatcgccgtgaggcgagaagagatgtggggcacgaccaaccgtcgtgtcccagagttggttgctgctctatccatatagttggatgagatcacctaaatatttcataacaaggatgactagactagcttaatttgttggtctggtcattataccacatggtctactacagttatcgtttctttcgtacggcatggtgtccagcggcgcctgtgttcagtgggtatgtcaagagagtaggtcacttggtgctcttgagattgtcatcataaaataacagtagcgcggtggctgctaaagcttgttatttaattgactattccaaattaacttaattcgttaagcacgtgtactgtcagagaaagcgaagtgttgggagatgttttagcaaaacattgatccatattaactactgtagctgagctgaaataaaaacttaagcacgaatcaatgcatagaaagatcaatatagatttgtattgatcgtggaaccagaattaattttaggtatttccttgatggaaaggtctattttaggtccagctgattttgttgatgatcaggaaattaaaaccttttactcgttgtatcttggcagttaattaaagctagcgccaagtagacatatattttgtttagggctatatgcacatattgcgttaacatcttttccttgtaatttcgggcggtggtagtatttactggctgtatcgaaactaaaaaggctaaactagctagctaacgagatatacttcaggatatccatccacgatcgggcgcgacgggcacgggtagttcctacccatacccgtgcccgtaagattatttgtgcccgtgagtatacctattactacatgacgggtaacgatggttgcccatgcccattgcccgtgggcgccttatgcccgcgggcgtgcctgtttacccgccacaacaaaagcagtagtggaacaaaaaatctacaagcttctaagttcgaatcgaacttaaaatatcaaatattctccgcctcggtgtcgtatctcttctctggcggcgatacagtaaggggagagaaataataaggaaaataaaagggaaaccgtaaaaaacaaagaacgtggcttatgtattctagtggattttgctcctagcctacatgtaagttagatttcgcgggtaaacgggcaaagcgggcatgcgtagtgattacccatacccatgcccatttacccatcgggcatagcttttgacccaataagatacccatgggtataaaatggagaacaaacccaaccctaatagggattttacccacgggtaaatgggcaaacgggcacaattgccatccctactaacgagatatacttcagaatatccatccacgttgtcccggcggctaaactagctagctatatatataacgagcttgattaggtgtatctggctgatgtgtcactaccgaacgataaataagctataataaggtgttgtcgcagctttggtttatgtctaatcatgcattatttaaatgcatatccatgatttcaaatctttaagagattgtactgcgttcccaagtcagctagcatgattaatttgagctttgcattttgtccagtatatatatatattgtaggtggtttgaggaatatttggcatgtttctgcgtaaaatcgagggatcgagggaaacggtaacaaaaggagatcgtgctttatgtagaagctgattttgaatttctaaaaataagataatttgaagtaacataattttgaaattcaatcgatgggtactcgaaaataatgttacttcaaatttacactagtagaaaaactatttttccacatgccaccttttttcacaagcggcccttaaagaaaagcatatgcgtagatacttaaggccgcctcaggtcgatgaccacctacgaaaacctatttttaatttacgaatgaatctctaagaaatttgctcgtgaaacatgtctatttatacgggcaggtccctatgaaattagcctataaacactaattgagatatggttttacataagaaatcaatcttgtaactccattacctaaagcggtaaactttatataaaaattataactctctacgagatttattaccactttgttgcttaaagtgtttctatttgagatgctttaagggttaaaatattcatgttttgtgtaaaaaaaaaccactctaatatgaagtccacctataaaaataagaggccagaagatgaagcgagaaggagaagaaagggacaaaaagacaaaaggagaagaaaaagaaaagaaaagaggaaacacaggaaaaaagaaaatttcgaagtaggtcccacttgtcagttggacctaaccctcgttgaaaccaccaatgaactaccgtggtatttcacgatggcgcatgcagcaggttaagacctatttgaaatatttgaactagtgatcgatggtgccctggacgaattcgggatctgtaaaatgcattttcaaaggcttataatgcatcagctgttgatgtgcatatataccaagaaattatttattattaagatcattacatgctttattgttcacggacgtcgatcccagagtcacaaacatcgatgaaatgtactgcggcagcgacatagcatgcagttcaacacgactgtgtacgagtgagtggtcgtctacttggccgcggcgtcgagggtgaggaacgggcgctcgccgttgaagttgcccggggggtcgtagttgcaggtgatgaacacgccgcggttcgccgcgcacacgacgcgggcgcagccgatgcgcaccgacttgcgccacaccacctgggtgtagtggccgcacaccttgcccgggtcgcacgtgttggtgtcgtagtggtagttcttcttctcgcccacccacgacgccaccgcgtcggcggcgctccaggcgcgccccgccgagccccagaagatgttctcgccgtacggcccgccggagtgctgcagccggcagtcgccggcgcgcttggccgcgtagctctgcgcgaagctggcgaccttggggtcccagctcaccgggccgacgccgtccgcgcgccgcgcgctgttgtgcaggttgacgtagtcctgcggcgtgttctgcgccgaggtggtggtggtggccgccatggccagcgagatggccacggcgagcacggcggcgaggctgaccttggaaggtgccattttctgtctcgtgttgtttcgtgggatgaacggagttggaaatatggtgcttatttataatctgtttgtgtggaaaaggagtcggttaggtgtgatggcggcaaagaaaaaatgcgaaaatttgcgagtggcttgctacaattgggtgcgtaattgcctgcattttcttgtccatgcatgactccatgtgtataattttgaatatgcagattgcattatccaagttccacaaatttaattagtatatatatattggtcatgttgagtgaagttgtaagcaattgacttgaatttttacactatggctgtggatcgtcgtggcttgattggatggcatagttgaaatttgaatacccatccacttccacagggaaggaagcaactacctacccagagaataactaatagctccactatacggggatatagttataccctgcttgaaagattaatttacactagtctcttaattatgggcttccgttgataataacttccaagggtaattatgtcagtgttaacgataaggggtacccaatactcttagagttagacccgacggagcccactatataccaattcttaatacagaatcatgcctcatatacgaaaggtatttcagacaaagaagttgaagaagagttctactcggacattacaaggattactcggatcgtatccatacttgtcttcctagttcttggagcaccccgagagtttaaaaacaagactccataagagaagaggggacatgccaagtgagaagaaagatctagacagatatatacaagccaacatacaccaggataagtctagacaaacttaatttagagccacaaacaccaatatgaaggatccagagcttgtggtctaaacccaatcagatgtagtcgatggctagtgtggtcttcttccttgaatattaacttccaatctccctgagttcatatttgcggaagaaggctacactagccgttgatcatatctgagacctccatgctgctataccactcaaggtcaaagcacactgacgtgcgtaatcatttgattcgtgatgtgttaagttctcggaaaatgcggcttgagaaagtctgcaccgatgataatggggctgacttgttgaccaaggtgatgacaatggagaatctcaaggtttgttgccagctcattggtatgactaccggaaggcagccaggtgctccatgatgtcgggaggtggagtttgttaggctaaactccatccacatagagcctttgctctcagcccattctagtccaaaagtcttacaaatatgagctattgatacatgtcttcatcaatgatgaagattgcctcatatttttgtggtgcaaacgaaaacctagcctccattgagagagagagagcagcagccattggagagaggagaagcaactagcaaattaaacacaagagagggggaggagagtggagaagaagagttgcagattgttcagcttagtggttgttacccgatctttatcaaatcagtgattggaggctcaaccgtggttggattggcaccaaacttagtgaggtttttcctcacttagagcacttcaatcttatcagttcgtgtgaggattggttgagtagagcactggatttgagtcgggttgggcagagtaagaccaaaccgaagaaccgaaccgaaaagaccaagaccgaaaaaaccgagactgagaaattcggtctcgaccagtgaaagacttaaatctgttcggtcaattcagtcagagccctcggttaaccgaaatgaccgaattgggcccaataagcccactaatttgctagaaaccctagaggcagagaggtgccctccggctctcgcatccatccaaaccattcccatcctcctcagttcacaccgtcttctcatctccttcgtgcttgcctgactacatcggcgtgcgccgcctcccgcctccgcctccacctccatcgccttgcaccgcctctaactagcccacctccgcctccattgtcatgtgccgcttcaagctagcacgcctccgcctccatcgtcgtgcgctgtcatgcccggaaattcacaagtaatttccgaacttatttgtgcataaaatcctcgtccaggaatcagccgaggtacacaaactgacaattcaatatacaaatccatcacaacaataacgttgcatacttacaaaagaaaagaaaaacagcagcggaaaataaaatctagcgaagctccggctccactcccacaggcagctcaactgggctataagccaaacgtcttctccttctggatcctttctcttcaactgaggtttgattgattattgcaaggtgagtacatggaatactccgcaagccacacaacaaatatgcaagtgcacaaggataccaaaggatggcaataatataggctcatttgcaaaagcagtatttagcaaatatttaagagtagtaaaacagtagagtaattaatcatcaattttaatcaacattgcacagcaccccaatgctgcacaggcccaaccatcctgaacaaccatacccggttgtatagatctaactccaaaccaggagctaagcaatattattaccagttatagcatcaataattattgtgagaggtgtgagacaaatcacgaaaagcattgctcaacccgcccatgactgcaggcacggctattcgaatagttttactctggccagaggtgtaccactgtatccacaagacacagcctcaacatcatgtctaccatgcgtcgcgatactggaaagtacccaaatagaggctgtgacaataccctctgcacaacacaactcatcacagtgcaccgttcctgtatcataatcaccccctcaacaaccagaggcatagactccccagcgacccccacggacttctcgccacttctcagtctggcgccccgcaatgaaccatgctagacagaagataaagccgttgctcacgctggcttgtggttggcacggttaatgtctcacaacagtagctcgcgaaccggtccttaattgtcatgagcacgaccttcaaaaccatgtgctcacaacccaccattgtcaatttttaattatcaattaattatcgtaccacgattaactatcgtgagctaccattaaatataaccataaataataatgtagtatgattcatcccattaatgagctaatgtttctaagcatggctaaacaattatatatatagcatttacctgaaccaaaccaatatataaggttcaagctaatcaatttattacccaaggtatcaaggaatagggtattcaatgcaaattggccataacaaagaaataggttcacaccacccggtgaaattcgaaaataaatgcacagttgaaataaatagagaatttaaatataggatcaacatgttcaaaggattgtgtttaggatatgtgtgacttgccttacaataatcggtcttcaattaatcttctgaatcacttccaacgcactcccgaaccttcgcaacgatggaaacgacaagctaacatgcaaaacgaagaaaaagactaataaaaaccaaataaacagtacataaaaagtaaacaagcatgtagatcatgattttagataaatttagagacttgaacggcctcattccgacttcatatgaattagttatgaattctacaagattaaactgattttagccttgaacagaaaaggatttacgatttaatttagggaaggaaaacgggctttatgacattattgatgacgtcatcgccggcaaggcattgaaccgcaaggccacaggtgctaggaaactcggccggactatctgagagcaacaccgcggagaggacgacgagatgaactcaccaaggggtgggacgaccacggatggtgacgggagacgaccgacgacgagctccgaagggcggcgaggttctggttgacgacgacagtggtgctccggcgatcttcagcggagggaaaccagcggacgggcttcgccttggctctatgatgccgaggaaagcaacgacgacgtctagcatccacggagttgacggcgaggctcggacgaattgaaggaggagtagatcggcttcacgtcgacgaggggcttccagcgggttacggagaaaaggaaccagtggccgggcttcttctcctccttgcgaatccaacgacggcgacggcgactgaaggtgacgttggacggcgacggacggagaggatggagatcaaaacacagtggcaatccactggttcacggcaacgggcaacctccggtggaactcggcacaaaagaacgggcggccggggcggagatcttcactgcagtcccggtggtggcgacggcgaccagaggcggcggctactcggcggtgcggctcggatggaacgacggccgacgcttggagagagaaggcagctgcggggagagacggctagggcacgggagctcgagctaggggttggaaacgagaaaggaggtcttgcgggttctatttatatccggaagagggagagatcggctcagacccgagaggatttggtggcggattgattaaggttcaccggtttggagataaggtttatctgactgatttgatctcgaatcaaagggataaaatcttattccttagagatgaaacagaagagaaagataggaggaatatttcccctcaactaattcaagaaacggccgagagaagcgggcaaatcgggcagaggaattggcagcgtcacacacggctcggcggctgcactgggaggaggggtggggggg

SEQ ID NO: 80900 - DNA, 18869 bp, Oryza sativa
  unsure (1)..(18869): unsure at all n locations
atatgcgtatagaaagtttgtatacgtgtatataaactttatatatgtgtatacaaactttgtatatgcgtatagaaagtttgtatacgcgtatagaaaatttgtatgtgcgtatacaaacattctatatgtacgaatacaaacttggtatacatacgaatacaaacttggtatttatacatcttgaaaaaaaaggaaaaaaagccgaacagaagagaaaccggaaaaataacaaactgaacagaaaaaaaggaggaaaaaaaccaaatagaaacgaaaaaaccggtgaaaaaaaccaacctaacagaaacgaaaaaaagggaaaaaaacaaaaaaaaaacgaaaaactcgcttctccctccggcacgtcgccgccacctctccgcgcgcgacacgtgtccagtcgcgcggagagggagtcactcgactgatcgcccaatagcaatcttggctgcaggggctctgtccaagcttgaagacgacactgtagcaaaggggaggagtattagactttttgctgggctaaaaagaaattagagggttaagaaatagacttctctgggaaagaaggagacgggaagcagagacaggcaaagaggaaggacaggctgaggatgatagatagacttttccagtttaagcccgaaaaggaaaaggggatttttaattacttttccaattaaattaatcactgaaatgatctttgaattgttaaaaatacttccaatgctcaaataatttcaagaaaaatcatgaaactaattggacactcaaagtactcaacaagattataatcagaccatttaaagactaatttaatatttagataatttctgaaatgctctttgtattattaaaattaggagttgagctatgaaaaatccgagaaaattccagagagtataattaatcatggagaatttaatgaaaattaaatccagccatgctttatatttaggaaattttatttcccacaattaacttcacttgtaaattaatgaacatttaatataaattctaaaaataatttattaaataatttataaatcctgaaacgaaaatcaggatgtgacatgcgctgcctccaactggccggccacaccccagaggctatatattcaaaccatgctttaatgaaaattaaatccagccatgctttatattcaaacttttgttacggttagttcggtctatgaccgagaccgaaaaaaactaaccgaagacaattgcttggtcttgagctttgttggagaccgatcggtctgaagattctgaagaccgaattttcaaaaagacggagaaaccgaaccgaatttctcggttagaccgaatgcccacccctagatttgagttgtggattgtcagcttgattgactgcagtttcagcttgtgcaacatttggaaaaaaatgttagtttgagaggtcaatggtgtctgataaagctatttttgacagcttggaagggactcacagaaccatcatttttgccaagtttcatgcaatttgcttcttggtttgggagatttttgttgagaatcaaaggggacagaatatattatttctctacatgttagttgctatagttgatgttgatggcaccaagtatttaacttgatgatatagttgctgttgtgatatgccctaagatgttctagagaagactccatttgtaccaattattgcttatagtggaagcttggagtgaaccgttggtcccatggttttttatttctcacaccgaggaggtttttccacgtaaatcaccgtgtcttgtgtgcatgtgtttatttctgttccactattgatttgctagttgaaaccatcctcaaagctcatggcaagataagtggttgattgtgtgatatatgtttgccagttggtaaattggagtttgcacattgaagtgatttggttcagccccaacaacaagcagaaataatatgcaactaatgacggttatagttatattggagaagaacacatgagtggtggacatagcttaccaactagcaaacatgaccgatttgtttaaacacagaaaaatcattgtgtccgggtgcaacaattatacttttaaaaaaagtataaaaatagaatcatgcttagaacacgtgttaacattatcattagaagctacagatattcgaggtggttatgacttacgattgtcatcgaatactttgcaaagtcaagaaagtcaaaattgttctatccagattagtgaaagaggagtataacataaaaaaaggatgggatgagaatatcctcgaacatattataatgtattattgaattgtatttaaacccaaaatttggtagccttatttttaattcttgagttaatttcagatctggcaaaattgatccaactcaaagaattaagaagataagggataaacgtgcacaccaacgctcatatgtgagtgtgaagatgtgcagctgcgtgtccaatggttgattcatcttgtctcatgaatgtgcaagcgtcgcggtgtagcacagacatgggtgaccttgtatatgactgtgtcgtgtgagctcaagatcacctccacacttgtttttgtacctagggtgcttcgaagatacatggacaaaataaaagtgaaagcaaatgggactcacctggtgaagcccggtgagtcaatttattttattaatctcgttgatatgcgcaattacatgaaggaatgaaataaacaaaaagaaataaagaaaatgattaaagtaagtcctaggggtgggcattcggtcccccgccaacctcttaatgggaggtggagagagatggcacctgattggcagggagatatgagaagcctacaccttcaacttctcgcagggggacagggatggaatgagcaccttcccatgtccaacgggtgtgctcgcttccacgaagcaaagtggtcgcttcggcagagggcaaagtggtcgctttggtggagggctatctagcaagtaggacgatgtgtccatactcggacaggggttgttctcatttccattgggcgctgccacaggggtcacaacaccaccgttagcatgggatggcctgagtgcattgttaacttggaacaacgggacacaaattatcatccatggtatgtcaaaaagagggaagatgacctcatggaacatcttgcaggcatgcttggcatcggcggcatggcatgacattgcttccaccatggcaggacgtactctcgcaatcttgaactttgggaaaggttccatgtagtcaatactccatacatcaaaaagttccacttgaaggttctatgttaggggcatcacatcacgagcggtgatacctccatgcttctggtatcttgcacatctccgaatgaactcatttgtgtcttcatacattgtaggccaaaagaatccactctgtcagatctttgcctgggtgaggaatgcaccatagtggcctccttagggtgccgcatggcatttttcaatgatttgggtgccttcagctgttggtacacacctcctgagtagtccattggaacactcggtaaatgcccgactcatcccataagtgccttcggctctcatatatgagtcatcttttattcttcccccgtggcacatactccacaaccatgaagttgacgatgtttgcataccacatgttcgagtccatcaaactttaagcgcatgtcgtcccgtagaaaatcatttatcggtagttcttgcatgttagtgacatgcatacgcgacaaatgatttgctagagagttttctactccccttttatctttaatttcaagatcaaattcttggagtacaagaatccacctaattaactgaggttttgcatatttctgagtgagcaggtatttaagagcagcatgatcaatatagactattaccctggctccaactaagtaagatatgaaattattaacaattgcaataactacggccaggagttcatttttagttgtggcatatcttaataggtgaaaacagcaagctttttttgaggagaatgaaccctttctgctgcactaacaaggaccattggatagaaatggtagaaaaaatgtataccgttagatcatcaagctcatcaatgaccgtgaaaaccattggaccaatcaagacttcaggaggcttctagaacaaaggtgcccaatctttttagcactatatatatgtttgcttaactaatcttccgatgaaatagaataaatgaagctttagccataaatttgcattgaatttatctgcaggtttatatctataatgtacgagagcttacactgttatactcttttgcttggtatatattggagcacacatcagctaagcagcgtccactctataccaattttattttaaaacatagtcgctcgccctacgaacgcatacaggtacaccctacacctaagaaatatatctacctttaacatttaaaatttattagaaaataaagctacttctgcgtgtaatttattcgcttattttttatgtcaatcaattacaactttcatccatttaattttacaccgctagctacttcctcattcccaaaataagtatttctaggactcaaatttctacacagttatgagcatttctatgacattaatttcaacgcatggaaatccaagcaattttagccaatcaagtatttacaaagatccaactgaagcttttcaaaatttaacagtaagtgcctaaaagtgatcatttctctctaatgtaaatctttactaaataaactataaatgcctatatataaaaacgaatggagtatatttgagaacggagaaaataatgtactttgggaaacgtcccttcaatgtcatgagatcaatggcctacttataaaggtaggttatgcaaagcgcgactaagtggctagttcactagggcttacaataacaattttattcatctaattgttgtattgttgctaaaaattgcataaatacgatcattagagtcctcttttaatactgcaaaattctctgtatcacactgacgaaatttaaaaagaaaaatagcagcgatggaggaaaacatgtatctttccttgtttaccaatctcaagcaaaatttgcaagttcaaaatctccctccaattgtagttatgctttggagagagaaaacttcgggttggaatagaaggagctcaagcaaaagtacagtacataggtcgatcatcacaaacgggcctcttaacagcttgcctacgataatgcagttaagaggcccgcctgcaatataccgtacattatcggagccagccttcttaacggcccacctgcgataatgcatgtttgtaggcaggcattgaccttctctaagctgacattatcgtaggcgaatggtggtacagaccacctgaagactggagggggactcatctataaaaaagtagtagcgactgccacattggcattctgcatgggcatttgctcataaaggtgatatcaagccagtgcaaaacagttttgcacatatgtttacatatttaagcaagcgtatattattggagacaagagctcttaagatttaagatgaatgcttcttctttcgcatctatgtgagcattgtgtattgtatatgtcgtgataattaattttgattggggtgtgagcgacatctagggccatatatgtaaatgtatgttaggaaaccgaccggcccatgaaggcctagcccaggttacacactaatgggccatcactaaatatggaaggtgagagagggagatggctataaatagatgagtagagaggagaattgtacacttgagcaatgaaaggataaatgagaacatggccacaccctcatatcttgtgtctccaattcttatagaattatacaatctctcttggactacctcggtagcaggaggggttgcataatacgttatcagcacaacgttctaccggagaccgaggaagaagaaggataagaaactctagaatccgctttgcatgttgtagattgaattgcaaaatcggattccttgcatcctcctcgttccattttttgtggttttcgatggattccgtcatcgccgacttggagtcgccggcgaacgccgattgacggagttccaccactggcaaccggctgcaccatgcacggcgccggctgcgcaccgcaccaagcgcgcagcgccctgcatagccgctgcacaacgccggccaagccgagcccacgagcttgcccatgcacgacagccgaagcgcatggccgctgctcgatcatgccattcatgggagaaaagaaaggaaaaatgaaggagaaaaatggtaaccgcgccgacatcttgttgttgagggtcgttatcgatcagtttcgaccgtcaatattaccaaaatagaggagaactagtaatgcttgcaatgcataaatatgttagaataataatattccactagtagtaggtatactaatcttttgcagaggatgacactaaagtggaggagaatcgacatcaacatagaagataaatcaatcggacgatgtcgagaatcagacttatgaatgaatgggccaagaacgcagaattgacacgatgaattaggctaaaattcacaagtctacgaagtgaagcagcggaggaggccaccagccaaaatgtgggctggttgggccaggccgaaccgaacctatgccagcgccgatggatgcagggttttgagggaacggtggagattcactccctatggcggttggagggtattatcgacctttccaaccgctataaccgtcattacctgcctatttaaggagttcactctcttcacttcaacacacacctcaagcaatagctctctcatttctctcaagtttagtttagtagtatctagctggtggaataggaatagagtagaaatcaggagtccggaagccttcggaagagttcgggtatggctctagtagcttttctcttctcttttgtaagctttgtacttttattagaatactcttctaaatatatttatggtattgaaatactttccgagtatatgaatacctactttacattatgttcatgttatactgaatatacggctagcttatctgggagatgctttggtgcgggtataatgtttgcttatgcaattactctaagtcatgacgatgatattagagtagtatctggtagtttaggcgtggtgtctagattacaggatatcattatttggggttatatattgcagatgagaggtgggccgctgatggtgtcaactcagtacgggtattcctccacgccggtatataatcctaagttaattccctagggagggtattcctccgtatttagccccggttgtatggtcatgacgggctgtcgtaaggaactcgacagtcaggggtggcttctcgaagtaccaggagggcatcggatagagggtattagctagtataccagttaacttgaatgtatgtatgtatattagaagtgtaggaatagattctctttctattttctttccacttagcttagatattttagtatgagaatgagtagctccttgcttgtgtgtcactctaccctttaatttatcttaacccctgcttagactatgattattacaagtaatatataaattattagtacagttctctctactatgatcttccgacgggattaaataaatatgatacccttggaatactctcgggtgaaatgctacaatggtatatccgtgcgcttgcggataaactctgtaaccataatatgccaggagtatttctgcgccattgctaggaattatatttctagtaatatcgttaaaaaataccaacaataagcattgaagaaagaatcaatgaatgcattttaggagcttagatcggacacttgcataatattacatgaagaagtacttggtcccgaaccaacatagaaagaatagaataaatcaggaaagaattgaagaaacaaactcgttcattttgaatttgagtttgatttgaaatattaggcagaatccaaatcgtgctaacgcttgcagctaaaggcatgtgacagatggaagtttagtacatcagttcaaccgcacttagaaatgttcatagtgcatggctttggaatagtcgattaccgccaaataggacggaactcccaaacacaagtgtgtcataacagcagacgaatacctggctaattgaactaaaccgaactaagcatcgctgaactattcagtgcctcggcatggtttttagagatggttacccgcgacagcaatcgcaatttaaaaactgtcacaacccccccccccaccatttatgaaatttgagcaacatatgtcgcacatatgcaaatgagttacgtgagaagcaaactcactaagcacatgagccccaatctcttctacgtatatgaattgcatagaagcaacgaactaagtcatgtgtaagtcttgcaaatttatccactaaattattatttacatcttctcttgtattggtgtgtccgagaaatcggaataatgagacttagagaaatgcaaaattcagggggagaattttactaactcattaccaaatcttgatatagaaaatcaagtacccaaaaatcaatctagaaaaattgaacgaagaattgggtttttccttggataagttttcccagcagtttcttatcaaggtttttaatgaggcaattcgtgcgacattgcaagcgtatgctatgtactaaatttttcccactgggtttttatggagttttgattaagcataggcatcacgcagtgaaggcccaaggggaagtgttaggaaaccagccagcccatgaatgcccaacctaggttacacactaatggaccatcactaaatatggaaggtgagagagggagatggctataaatctatactaatataaaaaagaggagttagcctcctccaatcctacctgccaaatcacccggatcaatccctagcgtccatctgcatatctacttatccgtaccgtccatccgagtatcacctattcatccgatcccatccatcacaatgccgtcacctgctctagcgctatcctcgccccgatgcccgccgccgcgctatccccgcgtgcgccctcgcgcgatgacaccccgcgagtccctacggcagccgctgcgctttcctacaccccctcgcatgcccccgccgcgacggagtgtggatcctcccccgtgcagtgaaggtgccctactaggtcgctgtcgtccagtctgccgaccatatcccaacccatcgatgtaagtattgcaagctccccttcattttggtgaatttaatttgtagtgtatggtgcaaatccgagggttagggattggatcatagtgcaaatctgacggttaggaattggattcgtatggatgaatccgagtactgtaaccccaaccatttgtttgtagatttgcagaaaaagttaaaatcaaactggtaaatattgtagatttgacgatgttcttgcatttaatctcctcccctggttgtgttatggtacagatctgaagctattgtaggttcccttgtgtcctcaaggaaaatacgtgtactccgtaagagcggaaaattcaggcttgcttagccacccaagacgctgccccctgcctactccatctccaaggaagcgcctgggccactggtctggttggctagcgaggtgtatttcaagcatctacttgtgacgttaacaactttcaaacctgtgctgattgtggcagtcagggaattcctgcatcatacagcgaatgtgcctttatggctgctacactagctagctacacttccatcttatagttttaaaattcgttaaattaaattgtgccaaagtagtgtgatattacttggattgatgccatttatcatggatagaaatcaaatatatcatgttccagttcatgaaacttttgcaggatggagagcacagaggagtgacatgattcccatcctcattctttggagagtttgataggtatgtcacactccatgtgctctatggctttgtatgtcacagatctgatcaatctgctctttgatatcctaggagcatatattaaattaatctagactgcatatatattagattgcataattcctgaaacataatttcagctgctcatatgattgtttggctttcccctaggataaaactttgtactttaattagctggaatctggccatacccttgaagaggacaagggagctacacacaaaaaaaatgtattggcaagagatgctttgcactggacaaagcattgatcttctgttttcttaaggtaaatactgtatgagagtcctacggtgaatatatttatataatatataactcacagaattacatatgtagtatgaagatttagctatttgtgcctgaatgtaattatctaaccattggagtaaatcgattaatcaatcctttttgttgctaacaaattgattttgggtgctggtatgatttgattttagcaacattattgtttgctttacggataacattagcatctatatcaggaaattgcctacaaaatgcttatacaaatgtgttaatcattctgcatctcttgacatgaatgctaatttttatttttacgcaatccaaacattttttttaatcgagggaccttgattaattgcttcagcttgttgtgaaggaaacactatctggatattgaatttgattggagatcaaatgaaggcagtgatcatgatccaacactttgactgtcaaggacaatgtgttgccatgtgtgcaagtaacaattacttcatattatattagaagtagttcctgctactgtttaactaattagtgttaacctaatcatatttcttttgtatgttattttgcatgcttctatagatcaggagttccgtcatgattcatgaggtgcagggaataactcagaggtttttctatacataaatcttagtctttactctttgcccctattgttgcttgtagaattttgcaaggttctgttttagcaccaatgttttttaattaatactgtcaaacaactcccaaatatgtcatgtagaaaatcttctctcaatcaagttttatttgtagaagaacatgcaatagttttgacaaaaatagaagaccatgtgaatcctgaaatttcagagaaatcttcaaagattcaaatttggaaaatttgcaaacaaatataatggtcaatccctggtttcggacagtggagctggagagtacatttatcaccaaagttgtataagtgtttgtttcaatatctggattttttttcctaattgtcagcaccatatatctaaaccttttatcgtagaaggctcaaccacttattctattttatgcaccacaggatatttttctcttgtttacccctgcagctaatttttgtgtctattctaatcatgtgaaagaattagattttttttcttaaactagagaggttagcctctcccatttctattaaataagtgaatattttacaggaaaacaagggcatccaggttgacaacaagaaaaataaaagactggttttatttcttcacaaacaggtccaggaattctatcttactataaagttatcccccactaactccttaagtttaacatgcaaacgtgccacatcatcctccactaacaatcatcacatttaaacatcatgcaaacatgctatatctttatagtttttataatttaagagcttttcaaatacaaacatattaaattatcatccaacataattcacataatgtttcaatgtatatctttattatgttttatgatatcctatatatttatatagttcatcctcacttagttagtgcttaaatgattaatctatggtccaaattatctttctcctttttttctctaattaagtcatatcacatcaattgtttttaagcctttagatgattaatctacggtccaaactatctctctacttttcttcttccataaagtcacataccatcttactttttacgtttgaatcatcattctacatactatttaaatttaaattatcataaaccacattaatttacttaatctgatattatctagctatcttacacgttattttttttatcgttatcatactaaattcccgcagcaatgcgcggggtttcacctagttagatagaaagaaaagacacattaagatagctagaaaagagttttaaatttgcatatcggtccatctaacagtttcttgtattattgaatgtcaactatccctgtcaatctttctcatcgtttcttgttatcaaatgctaatccattaatttaatttcagttctttaactcatttccaatagcccacctgctgataactaggattactgggtgcaaataatactatctggaccacctttaatgatttcatttactttttagttcaaatttggcaatatatttcttccctgatgggaatcatgtgccttttttaaagcttacaccaaggttcttaaactggactgttcatttcacttctgcagtttattggttttattttctgccatcatattttacatttacatgtaggaatgaagtaatggctaccacttttttacttgtttctatatgtatgcagccatggctttctttactaacctagctgtggtatagatccaggtagctttatactcacatattgctgtcttccataaacctttccatttgccagccaatgtaatgcgatcctttttctctatcatgttttctatctgaagttttattgtgctccgtatttttccaatattgttattccttcaacaaaatcaactgatccacacattacttccaacacatacttcagttttttttccagaaacaggatgtggctttttttacagtatttctgttgaagtcagatttcataaatcaatttaaaccagcattacgatgggtcaccctcggatggctgggaagttagctagaagccgagattgagcagtattttttggcagtaactgctaggatgatggacatgtgcagtgtgaaatcccttccagtgcccaactgctaggatgatggacatgctcatgggataccccgtaagtccataccagaaatgcatagttgtcatttcaatttttaagatgtttccagcatgttcacacatgacatctccttttttgcacttcagttaagacaacgacgtcgagcactattccgataacaattgactggagtactattatgagacaatgtctaagagtaactgagatataaacctctatggtttgcataccatataaacttctactggtcacacgatagaagatatgcacttgctgttgattatgtaaatgttatatactgaagtactattttgagcacttgctgttgatcaggtaaatgttatactgaagtactattttgagatattttttatagagtaaagtgcacgggcgatccttaaacttgtaggggtgtgtcatctaggcccctaaactctcaaatgcatatccaagtcccataaattgttatagtatgtcatctaggtcctaaatctccaccacccctttaggatcttatgtggcgttgatgtggcatgccacgcaaacatgacgtggcattattgtgactaacaaatgggacccatttaatttttttttccttttcttctccttctctttttttccttctcctttatctcggacccgagcagaagaaaggacataaagaagatgagaagaaaacggaaaagaaaatgaaaaagaagaagaagaagaagaagaagaagaagaagaagaaaagaaagaaaataaagaanaggacacatcacgtccatgtagcaagacacatcatcgccacataggatcctagagaggctatgtcgatttgggacctaaatgatacactttgacaagttatgggacctggatctacattttgagagtttagggacctagatgacacaaccctacaagttgcactttactctttttatactttcagtactttgtatgtgcggtgtgatatgcatattgttggaaaatcaatgcattaaactttgaggacgttcatgtattgtgggaaacgtgcattgcacgtgcacgattacttgtagatgagtaaatagatgagcagagaggagtgaatgacaacatggctacaccatcatatcttgtgtctccgattcttatagaattatatgcaatccctcttgaactaccttggtagcaggaggtattgcataataatgtataccggccgcctgtgaaaatccttagtctgaaaaattgaatgtacacgggccctgtacatatatgggtttcattactttccgcgttcgtggatctggaaaatccaaaaatttacaaactgtggagagttcatctccatagctaggtagcgtagcgtgctattccccttctgtcatgtttacgttagtctctatcgcattgtccaagttaactatagcaacggtgttttgcacgtacaggtcaatactccatccgtttcacgatataagtcgttctaacattttctatattcatattgatgttaatgaatctagacatacatataaatttatctaaattcattaacatcaacataaatataaaaaatgacttacctcatctgtttcacaatgtaagactttctatcattgttcacatacatatagatgttaatgaatataaacacatatatatgtctagattcattaacatctaaatgaatatggacaatgctacaaagcactggtggagaaaccatctttcgtcggtcggccgaattccacaatagtcccggatgcaataaaaaccgggactaaagatgatctttagtcccggttcaaaagggtaacgggtaacaccaaccgggactaaagattcaaatgttgtcagggcatgtcaggccccccccccccgggatctttagtcagatctcggggatctttagccaaccgggactaaagtcccacccctatatatatatcttcttcctcctccagctgcccgagcaagcttcaaattttcttcaaaaaagaggggaggtcatgccaaaatttctagtgaatttattttggtgattacatacaaatcggaggtgcctaaaaggtttgcaacttcatcctccaatgttttttttgtcatattacatttgcagctatgttttgcacacttttttgtctccaaaatttagttgtaagttgatgagagagaaaaattgtgtggggaagaaagaatatatagaaatttagttgatttgttaaagaaggttttataaaatagttgagaaggaaaactctagtgaaagttaatcttaaataatagaaaacaaactaaaatgaaaattaaaagaagtaaaacacattaaaattagtttaaaactttagaaatagtaaataagaattatttggtgtaatattttatgatttttgtatgaataaagatatggcattattgtatgactgtcattattgtaagaataattatttgtgtacggtttttttcgactcatgtagatggatcggcaatggatgtacgctgaccggcggtccaaagagtttattgacggcatgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtacgttggatttgaaggaaatcaaacgggcgaggaggaaatagctgctgatggtaacgacgttgcggatgatcttggtcagatgttgcaggacgccaaggaggactacgaaagtgaaaaggaggcccataaattggacaagatgttggaggaccacagaacttcgttgtacccaggttgcgagcaggggcacaaaaagttggataccactctggagttcttgcaatggaaggcaaaaaatggggttagtgacaaggcatttggcaatttattgaaactcgtcaagaacattcttccggagggaaacaaattgcccgagacaacgtacgaggctaagaagatagtctgcccgctaggactggaagttcagaagattcacgcatgtccgaatgattgtatcctatatcgcggtgaggagtatgagaacctagaagcatgccctgtttgtaaagcactacgatacaagattagacgagacgatccaggagaagttgacgggcagctaacaaagaagagaattcctgctaaggtgatgtggtatttccctataataccacgggtaaggcgtttgttcaggaacaaggggaatgctagaatgatgcgatggcacgctgaagagcgtcaacaggacgggatgctgagacaccccgccgatagttcgcagtggcgaaacatcgacagaaaatttaaagaatttggaaaggacgcacgaaacatacggtttggtttgagtacggatggcatgaatccttttggagagatgagcagcggccatagcacttggcccgttacgatatgtatctacaacctcccccctggctatgcaagaagaggaagtacataatgatgccgattattatttaaggccccaagcaacctgataacgacatcgatgtgtacctaagaccactggtcgaagatcttaaactgttgtggaagaatgaaggtgtccccgtgtgggacgaggacaaacaggaggagtttaacctacgagcgctaccgttcgtaaccatcaacgattggcctgcacttagcaacctatccggacagtccaacaaggggtacaaggcttgcactcactgtatggatgaaacagaaagtacgtatcttaagcactataggaaggttgtatacatgggtcatcgtcgattccttgcagcaaaccactcggtacggaagaaaggcaagcactttgaacataaggccgaccaccgtacgaagcctaaacatcgcagcgggaaaacagtgtttgctatggttaaagatcttaaagtagtgttcggaaaggggcctgaaagctagcctatagagagcgaagatggtcacgcggcgatgtggaaaaagaactctatattttgggagttaccatattgggaattcttggacgtacgccacgcaatcgacgtgatgcacttcactaagaacctttgcgtaaaccttcttggctttctaggtgtatacggaaagttgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccatgaatatcaagcgaataataagcacgaaggagaagaagttcacaaacctaaagtctcatgactgtcacgtgttgatgacacaactgctactagttgtaataaggggtatccttccagacaatgtccgggcaacaataacaaagctatgtgcattcatgaacgcaatttcgcagaaggtcatcgatccggaaagattagaagcccttcagaatgaagtagtgcaatgtctcgtcagttttgagttgatatttccaccttcatttttcaatataatgacgcatctgctttgtcaccttgtgaaagagatcagtattctcgggcctgtgtacctacacaacatgtttcctttcgagaggtacatgggcgttctgaagaagtatgttcgtaaccgtgctcgtccagaggcaagcatcgccaagtgttatggaacagaggaggtcatcgaattttgcgtagaatttatcgaagaccttcgcccaatcgggatacctgaatcacgccatgaagggagactacggggaaagggaactctcggaaggaaagcaataatgatggtagacaacaatttattccgtaaagcccatttcactgttctgcaacactcttcattggtagctccttacatcgaggagcacttggctctagttcgcgctaggaacatcggtaagtccgatgcatggattacacggcatcacattgatactttccccgcgtggctacgacaacatctcatgggtaacgagtcgatcaaccaacaacttgccttcctggcaaggggaccgtctgggtcgatcgcgacattccagggatatgagatcaatgagtacacattctacacgagagcccaagacatgaagagcacgaaccaaaacagcgttgttcatgtcgatgccatgggacacgatggaacaactgccacgtattacggtgccatcgaggacatatgggaacttgactatggtcctctcaaggttcctctgttccggtgccaataggttaggttgactagtggaggcgtaatgattgatgacagtgggatgacaacagttgaccttaacaaggttggatactcggacgaaccttttgtccttgccaatgatgtaacgcaagtctttttcatgaaggacatgtctagcaaaggaaagaagggcagagggcctgacgagcctaagcgtcacgtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgtagcgatcacaaggagggaacaatagtgaggagaaagtacgtgcggtcaaccgtcaccgccgatgtattgctgtaattattattgtttacacccaaatttgacacctatggacgaaatagaggaaaattgctaaagtttggaaagtgtcgggttttttcgcagggccg

SEQ ID NO: 80901 - DNA, 6323 bp, Oryza sativa
tcattgtaaaaccctagaatataatctacttgaatcgttcttttactatgttttctattttaccctagtttagtccatctttgtcggtttgcgccgtaaaccgtccgccgccgcagcgagagtgcgacacctctttgtaggtttgtcctgaaaaccttccgttttgcccacaagacgggtagttatcctcatattgatctaaatcggcctagaggctgattttgatctctaaattggctccgctagccggtttagctgtttttctacaaaacccatcttgatttggccctttggcgagatcgaggtggttgacgactctaggatcaccgcaaggcgtttaggtgctgcgatcgtgcttgtcgacttgtcacaaaaagttgccaacacgatttttggtgactccactggagaacgatctaatcagccatatcacggccgaatttcgtttaatctagtaattgtttcgtcaaaattaagaatttcggctaaacagccgaaatcaatctacactgtcatcgtttcatcgagttgaggcaactttcggccgtctggccgaaattgattgcaatagtactgatctgcagcagcccgccgccttcgacgccatctgcttgtcggctacagctgcgatctgcatcgacgtgtctcatctgccgcttagtgcttagggtcatcaagtcgtagcaacgtagtatacaggggcatgcgcgtgtacctgaccgaggagaagcagtagcagggccggcagagttttgcggtgcacggccagaaattttgagtatcaaatctgttcggtttgctgtgtaaaaaaagagaaaaaaggatcaggctatcacagccgatctactactgctcacgtaccggaaaaaaaaaatagcagccgatctaatttaagatcggttgatctttggtatattttgctacagtaccgaagttactgttacgtccagaaaaatcaacaaaggctagttttaattaaattggctaaacacagtaacatatcaagaccgtatattaatctattcggtcaaatatttcggctatgagctatatggtcggatttaatcaaggaatttattcatcaactatgacgagcgggaacgggttcaacaatattactgcacaatacattagaaccgatcaaggcgtcgtgagaggaaatgttctgctaccacaagttgtaatttcaccaaaggtaaccttcgattcgcccaacccgtcctttgctattcaaaacgttaataatcattgtgtagatgcatatgccacttctagttttgctcctatacaatatgcttataatgctaggggggttaatgggtgattatacagccgattacacaggaatcggctatatgcaaaaccgagctgacggtatgaccggtcgtgacaccggtctaaccgcatccatggccggtcagaccgtgcccaccatggccggacagaccgtgtactacgccggtcagactgtgcctaccatagccggtcagaccgtgccctatcatggccagatcgcgcctcctgtggccggtctgaccgcaccactgaccaccggtcagaccgggccatgggccggtcagaccggttcctgggagtttctccaggttttcataccacgactagcaatattgattttaattattattcatcacctgttaatactgttagtcatgctacttcacatatccctgatgcctataatgatgttgctagagggtatcctcccgatactagacaaggccaatataatcatattgcgctgcaacaaccaccccttaggccaccgaatacaccaccagatccacataggcctaaaaatatggaggagttgcttagtgacattatcagggctacatttggggttgaagcgaaggatcgtgctagggagaaccaaaagccatatcctgatttttatgacgctgtcccatatcctcctaattataaaattcctgaatttaccaagtttagtggtgaggataataggaccacatatgagcatgtagatcaattcttagcgcaatgtggtagggctagtagtatggatacatgtaaattgcgcttgttttctttatctttgtccggtactgctttgatatggtttacttctttaccggcatattctattggtacttgggctcaattagaacaaaaatttcatgattattttcacactaatgaaactgagcttaagttgtctgatttaacatcggttaggcataaatacaatgaatctgttgctgattatattgaaaggtttagagatattaaaagccgatgttttagttttagaataactgacaaagatttggccaacattgcatatgatggattgcttgattctattaaagagaaattaaatggccaaatatttcttgatgttgatcatgtgttgcatgaaacactggctcaggaaagccgagtggataacaatagtttaaatgctagttagatgaaagtgcaatatcatgtatagccgtaccaagcgatggttcggattgtgttaataatttgtgcaatgatgccagaacaattatagccgaaccaaatgttggttcggattatcttgctagcttagataatgatgcaacaaccattatggccgaaccaagcgacggttcggattgtgttattaatttagataatgatggaatagccgaaccaagtggtggttcggattgtgttgatagcttagagaatagcatcattgaagatatagccgaactagatgatggttcggattgcatcacaagtgaaagtgaaatagcattatcacctaagaccgaatcacaaatcggtcatgtggatgttggaaaagataataacaatgtcttgcgggatagtactgaaataggatccaaagtagctatgcatacatatcaaaggccgtatcctgaacacgtagattcggtcccatacccgcaaggatttgaggtgcccaacttcacaaaattcacaggtgaggatgctagaataacaatggagcatatcggccaatttattgatcaatgtggtaaggccggtagtaatgatttgcttaagttaaaattgtttcccctttctttgtcaaactttgcatctacatggtatagtttacttgctcctaattcaatttctacatggttacaaatggagcatgagtttcatggttatttcaaagatacaagcttgatggaacaaagaccgattgatacttcatcggtcacttgttaaactatttcggttacatctatgcctaagaccggaattgttagcgatcctctccctgttagtcctattgatgtagacaaaaagaaagggaaaagtgttattattggggatcctcagcccaaaaataggataaaaaatgcgaaggccgaagatcataaagttgcaaaggatgagtcatctagtatccaaaggaccaaaaagccgaagctcacttttgagatgcttatggctaaatacaagaaaggattagccggtcaacgatttaataaccaaactagtgattcgaaaagaccaagatcatctcgtaggaagagatttggtcaaacatcaaagcaatcggagccatcaaccataccaactccatgcaaacctccgattgtgatgccatggtatccatatccaatgtcactatatggttatccttttatgtattatatgccatggatgcttcaaccacctatgccgtgtcatcaggaatagaagcaatcacctaggacagtaccaagtcattctaacccaagacaagaccattttccacaaaagaatcggtccggtggatcaaaggtgaaaaaggtgaagaaggtgtgggtgaggaaagaagtcaaagctccggaggtcgttgctatcaatgaggaatctcaagatgttcatgtacctactggagatgcggcgaaaactatacaagcggagaagactaaagccgacgccattgctgtcgacatcggctgtctgaccgagccagcttgccggtctaaccgccagacaacggccggtctgaccgacggcttgcagccggtctgaccgggcctagaggccggtctgaccggggggcattggagaagagtgggaaaattgagagcaaaataggagcttccacttcgactaaaaatatgaagaatcgttacttagctcctagaaaacaaccacagctaaagtggataccttctggcttatctcgctctcaaaagaggaggctacaacgtcttcgggccataggtcaaaaagaaaaggaggccaaagatgtggagaacaaaatatgtaataatttagagcctcgaacgacacctaggcaagtgtggagatccaaagaggtaaaagttaagagaccggtgatttcccatagtagagaaatccaatttgatgagagaagaatcatcggtcattagagataagtctccttcacatgatgctatgagtgttagtgcggtatccatcttgcattcgaaatcgcgcaatctagaaagccaattttgcttggggggcaagacattaatatgctcataagggaaccaagagaagatgaacggcgatggatacaacatcacatctttgagccgccgtttgttggatgctaaggcaaggtatgagtttattgtgtttaacattatattatatgcctatgccatgttagaacattgcttgctatctagtacatgtgtgtttttgcttatcaaattgatattatacatacatgttgcaaatgccagttctaggtagtagaattggtaggttggcataaaatttgtttgaagtatgatttggctcatgactctttgacatttatttaaagccaaatcatatgtgtttttatggattaccatataagatatagatttcatatttattgcaccatgaaagttttgcttactagtaattcggctaatgtcaatggtcaatgtgatgatttgctctagagtggttttctttaggaacattggcattgttaatattttgcatacatgctcaaccgattacttacatttttagtttattgaaatctatgcatgtgacacatatgattttggtgattcattattgatcatacttcaattggctaagtgttgtgatgccatgatgattattgtttcaaaagccaattgaattagtattcatctagacatattagttggatattatgatttttcatatgtctagagagaaggagttttcgttcaataatttgatacaccaagcatctggctattatatgaagaaaaatttatatactaaaagccgatgcttgatttcaaaagtttggacgaaattggcaaagtcatagaccaggggcggtctgaccggtggtagccagcggtctgaccggctctgtatggccggtctgaccgggcagacatggtggtctgaccggcattgcgtggccggtctgaccgatcccagacaggaggctggggggcacgttacaattgattaaaaggccgaattaattgtgaattcggacatttgtacccatgagttagaaatagcttggagaatttctttgattagatatttgaaagatcctacacttaaggttgatcggagattcggcggcaagcgttcaaatattatatcgccgaaaaatagatagagtattacttagataatgatcaatctaaagttgctaggagagtagtacatgaaaggatttatgaaattcatcaatcggcccgtaagataaattggttgcttaggagggtggggtttcattggccgaaaataattgatgattgtttcaaatgctatagagggagtgaagcttgttgacggatcggcaatgttcaattagcgcctaccgctgtgttgaatcctatcattaaactatggccgttccgaggttgggctttggatttcattggtcaaatttatccttcgtcatcaaaagagcattggttcgtgctagttgcaatggattacttcactaagtgggccgaagccgtgccgctcgagaatattacttgtacagaggtaattgactttatttttgaagcatatttttcatagattcggtatttgtcacaccctgaaaattcaaaatatataaattgttgtttaaatggaatttctagaatttattttaaaagtcttgaaaagaaaatctaattctaattaataaattccaatataaaattgggccagaaaaatttcattaaatactttgcttaattctataattcctagatttttctgggatttatttgagctaaggaagtatttttaataaatggaattgcatttaagaaataatttaaattgaaaaaagttttaaaaaagtcttcttttggctttgggcccaaagtcggcccaaaaccggcttttttctcttctcggcccagccggcc

SEQ ID NO: 80902 - DNA, 2538 bp, Oryza sativa
aaatagatgatccaaagtcacattaaaagttaatggtgtgtagctagtactagaaaatgaaaaaccggttggtagctccttaaggatcgtaaaatttctattgtgatgatacatttgcctttttggtttctaggcactgaaggcgaaggatagagtttgcagttcttcacttcctaaagacttggcaacatgaggttacatcaacagaagagcaaatgcatgcagttttattggatgcgaagtattacaaataaattgtttttggtacccttggcagaatcaatgaatgcctgagttttgatagtttgagttagctagcctaggtatgatttttgtaacgcgcaaaaacctatcagatcttgtattacacattctagatataacaaatattagtgtttcctcttgaccattaattttcagaacgaaaattaaatataacggcaacagcattgttcttgtcaatgcagcaggccattgtcaagcatggatagtcacctatagccaatttatttaattcgtgggttgaaaattagttatgaccacatgctgcactgcttctgccgttctgcggggccgtcaattccttttagttttatactgccgcacacatttttgtaagttcaacgtacgctgccaagacaaactattttactgatatatccagctaaattgcggatcacataatatctggattcttactgacatggtgatatgcagcccggggcaacatataaattgtttagtacaatactactgcgcagcggcggttgtatagcacactagcgcagagggcagtaaacggaatagtcatataaaaatttaattgaattgtagtttgaggcaccttttgttgcaaaaatttcagtttggactacctttatgtaacctttccgcttctgatatacaaaaggtatgatctacacatatttggaagttcatcaacgtgaaactgctggtgtaatcaaaatcattgatgtagtagaaaagagagttcagctggtctaaagtacaacaatggtaaagtcacctaatccaaaataaaaacattagataaaggtggtccaaattagatctttggttatagaagtggtccaaactgtaatttactctcaacattttactacgtacattgaagtggtagggtggggtggagcaagctacgcacgcagagtaaaagatggaaacatctggtatacgtaaataagtgtgggtggttttcaatatttatgttttcgcatgtccattatatgtccttctactaccatggaactctaagtaggtggcacgcacttatggatgccaaaacaaaccgtgtctctaaaatgatatcaaagacaagttgaaagccaatttgcgtgtgataacttgcttggttgaggccagacgtctcctaactaatcatcatagatgcttccaaagaaagcacataaatgttgtggggataaaaattcatagatgcttgtaaagaaaacatgtatgtgagtgaggtacatcttcacatacgttattccataaaaagtgtccctgtaatgtatcataaatgtacgacatacatgtgtatctgattacttattcacatatacgagtatgtatcaaaattgtagatattgacgcgatgtacaagtttgtagtggacaaccttttcatttgacattatttacatgtaatatgcgttacaagttctcagatctatttaaagaaataatctttcaaaattttcaagtgacctcagatgtatatcaaagttgtaaagcttgatggttgacgcgatccacaactttatagttgacaatcttttcatttggcattgttagaatatgcggttcaaggtttcacaactattagaatttttttaaaaaaatttgtaatgacattagatggagacatgctctatatcaaagttgtacaaatcaagaagatctataactttgatgatgacctttccatttgaaatcatttaaaattttaataaatacgtattacaagttttggattggtgaacctagctaaaaagaataggatcccttattctatcaacaaatgcatcaaaagtgggaaggtaagcagacttggcatggagggcgaggtcccaggttcaaagacatatttcctagggtaactcattttttaatcaatccccattcttaaattgttttggaccttttctagctcaactagagttacctgttttattatggtctagcaaatgtttagccccaattttcctttctactacacgaggcattcagctttatgttgatcatttaatttcttgttaacaatgcattgccaaacttcagatttaagcctcatattcttaggttttgtttctgtacgttgtgaattagcaggtcattgggcagagtttgtagtagagtttggctagagcccatagcatagtgttaatgaagtctgaggctcccacttgtagcagctggattttacattctatcagaaaagagtgattaaaaaacatagatctaggccttaagcacatactccctccgtcccaaaaaaaagacaaaccctgtgtttccg

SEQ ID NO: 80903 - DNA, 12115 bp, Oryza sativa
taccaccaataaaaatcctaattataaaaaatttcatataagacggacagtcaaacgttggacacggaaacccagggtttgtccttttttttttaaggacggaggtgtgctgtactacttgttcctatgcttagagagatagatcaatagcatgttctagggcatcaatcaaatcaatttattttagtatggatccacattaattgagtaccaaatcatgttctttgacatcaaaataaatgcatgcagtaccaaacctgaatgcaagaagttgaggaaatcagggaaggagtgattgaggattgagcagttgagtactcttgaagaatacctttcttgcctcttgacagagctgagccgtagagatatgagtgaccatgacaaggggtaggtggcaatggtgcactggtacggggcaccagccatgggggatggactggcgataggagaacggcatgctgccacatcgttcatgcagcatggtggaagaggctgcgccgcctcctttgcatctgttgggggtgacagtgtgaagatctgtgggagctgtggatttacggagttagggttggtttatatatggttgcctccagtgacttggactggtaggtttggaatggctacctctagagagatcatacccgtggggtcttgtgggtcactttcagttcagcccttgctactagttgggcctccaaccaccacacccatgggacaaaaagtaaccctgccccctatggggatatcgccatccctactatgtgtgctcattaattagacatattcttctccaactatcaaacttgagcagacgactccaagctggacggttctttctctacatccatgatttagtatcgttgttgggacctgactttgaaaatctgatcatgagtttcattcttccatatgctcacgttgttacctgagctcatgcggattgaccatcttatgttatacaaaatattgtccaaactcaacttcgttcgtcagatataaaaataacatatatttctaactagtaagttgtcctaatgatagttatagattagttatttttatgtgtcggagacaaagtcaggttaagaaaagagtttttacatggttatataacatcatattatctactttttgatcgtttgtttgatgaatttaaacgacttcttgatcagggtttacaccaggttcacctggatattctatttaccaaccatatgatccatagctagttcattgtccagcgaacacttgtgatttagacaccgcctaaatccatgctcatcgattattcataaaaaatggagatatacttacaagtatcaaataataaccattttcgaaataacaaataataatagtgctcaaaggaaacaaattaataaggttccccaggaatagtggacaaccaggcaaaggaccagctatgcaaatcaacatgcatacataagaagggaaaattaacgtattctctccaggaaggaaaaaataatgatcttattacacaggaatggacatagccacaaggaggatgctgaagaagctcgaatataccatccactgggcaccatgaggagcggcactgctgtctgagtttggagctgaaatcattgaagcgagaaaggaaattatttagaaaggaaagttaaaaagtataaaacaacaaaagaaattatcggaaaataaatattaatttaatttttgagaagttaatactacctctgttttttaatagatgacgccgttgactttttttcacatgtttgaccattcgtcttattcaaaaaatttacgtaattataatttattttgttatgagttgttttatcactcatagtactttaagtatggattagtttttattccttttttttaaaattttaaattaaaacaatggatcaaacatgtgagaaaaagtcaacagcgtcatctattaaaaaacagagggagtacgtggaaacatgaaaaagaaaaacacgaagttgcacttacacgctgtgggaggactgctggctggagctgaaaaacaaaaaaagaaaagacagatgtatcagtaatacggtaatcatatttaagtattacgggtttgaaattttcaaattttcgggagtttcggacccccggtacacaaccatttgctccaaaaatttcggattcttttacatttttgaaattttggtcaaaatttatttaaattttaactaatttcgtaccagcactttcccaaatttcagtgacccgaaacttcggtattttacgaaattgtaaaccctgactgattatacaatatcacactaacaagagcctgtttagatcccctgacaaaatttttcacctgtcacattgaatgtttggacacatgcatggagtattaaatataaacgaaaaaaaaactaattacacaatttgcgtgtaaattgcgagacgaatcttttaagcctaattgctccatgatttgacaatatggtgctacagtaaatatttgctaatgatagattaatcaggcttaataaattcgtctcgcagtttacatgcggaatctgtaatttgttttgttattagtctatatttaatacttcaaatatgcgtcattatatccgatgtgacacgccgaaacttttcagccaccgagtctaaacacagcctaagttggcaaatactcttatcaagaaagacgaacattctgtcaacatcatgttattactacgcatatacgtaccaggagcaggcgcatggctgctgcacacgtcggcgggaaccttgacgtcgcagcgcccgaacagatccaaccccttcttcgtgtcgacgccgacggtggcggccatcgccgggttcgtcagcacggagcacaggcatcccagctcgctctcgtacgccttcttcagcggcgcgcagcacgcgcccgtgggcttcgccgtcgcgttccggtagaactcggagcacggcgccagctccgccacgcacggcaggttcgcctctggcgtcggcggcagggaaggaggaacgatggccgggatcggcggcagggcaggaggaacagcaatggcaggcgtcggcggcagagccggtggaacgacgatggccggcagcggcggcggcggcggtagagcaggggggacaatggccggcggcggcgtcagcggcggcagaggaggagaaggggcaacgacggccggcggcggcgtcgttggcagaggaggagcgacgacggtcggcgcgggcggcgtcgtcgtcggcagagaaggaggaacaacggccggcggcatccctggcctctgtgccatggcggcctggacgacgacgacggctgcaaaagcaacgaccaagacaattcgcgccattgctcgaattctctatctctcaaaatctctctacacgtgtgtgctgctcatatcatgtttattctagtctctctctaacatatatatacgcagaactaagcaagggattatgtcgtgatagccactaatttttccgtccatgctgtaaacagcagctacctatactcgcttcactatttattttatactcactctcagtgcatatatattttgttcctatttttctatttataagaatattgccaaattaaataaattttcaatagaaatctactcgtatcttttttatgtgtcgattcttgatgttttttttaacttatattaataactgatgaagatttcaatgtttgacccgtatcgcagggtatccaaaatccatacattttcgggattcgggaacacacatggggtacatatttaatcatatttgaagatttgaacataaaagtagctggttgcatatgcatacgttgcatttaagttggcatgttcttcccccgtttcacaatataaggtacttcctccgtttcacaatataagacttcactggtggagaaattctttttagtcccggttcgtaaccccactttagtcccggtttccaaagatcgatctttaggctgagccatctttagtctcggttggtgagctgactttttttttttttgcatggccctgttgctgcatggtttatatatatgtttcaatacatatatatgcatatataatatatgcatatatatatattatattatatttatatatgtttcaatacatatgtacatgcataatatatatgtatttatacatatatatatatatatatatataaccaaaatatatttacattatagaaaatgtgtacacatgcatatagaaacatatgtagtcatgtataaattacaatccattatatgtcctagctagctacgatttcgacgtagtagtagtcgctagctcagaagctaaggacctatgaattgtgtttccgtcgtagtagaatttacccttgggatcaaggatttgttcgttgatgaatcccatgagttgttcttgaaccgccgcgataaattccttgtgtgtggtcaggttatccctcatgctaataaactatatgaatatatgaaattgattagtaattaaacaagaaatcgatacgtaatgaaattttgaatttatttgtacgtacatcgagctctcttgtggtgatgatttggtctgcaaagcagtggcaatactcgcacacgtagtagccacacaagttagttccttgctttggctttgcgcactacaaataaatgacaaattaacggcgtgagatctaattaatatacacttgtttgtattaatttgaatcggagaaatataaatgtagagcatgtgtactcacaggaaatttgaacctccgcctaagtctctctccgcggaccaaatgacggaaccgataccaagccctacatggagtttaaagatatgattcgtagtagcaattaacataacaagaatttcttaattaacagaggaacttatgacagtacctgtctataagttcgaaaaccttgtcaaacctaggctctttttaatccattgagtcatatacgttgacggtgcaggccgataggtcgaagagtaaaagcacccagtggaatctgcaatgtgcgtgggatgcattacatatgaaacacttagcaagttcgtacgggaatgaaatttgatataggaagacagtaaaattaaactaactctgtgttgtacggcaacagtatgaacgtcttgtaatgctgcgccttcaggagatggacgagattgtcctctgtggcttgcggatattggtcgagcattgcgacgtttactttccgagggtcgatgaatccaatatcgaaaaccccccgccgtcgggccctttgaatctccattctacaacgataaaagggagtattttattttatatagtctacttatatacaaggacctaattaattaaaggagacgtagtaattaagaaatataactgaacgatatacttacaaaatccagcaactcataatagagacgtcgagggcgtccagctggtatacttcgtagattcccttgaaattgatccagagaatgtcatctccttgcaagaagtccgggtccctgatcctcgctccgatcatctctctaccggtggcgctcatctccatgtacagctgatggaacttgtacatttgtgtgggtagggactgcaccagctcaggcttgacaagcggtttaccgagttcgtacatgtatttcacttccgccttttctattggtgcgactcctagcaattgatccgtagttagaccggtgtcagtaataaattcttctatcatcatgtcttcaccggtcaccaacggctcaatctcctggtttggttgctctccaagctgagggactggtttggacttcccagaagatgctttcttctgcgttcgctcatagtccgatagcttgatggcctcttgacaggtgcagacatacccctgaagaagttcttgacactcgggtctataggaatcttcttttccggacttcgaggcttgaattgtctcttgacttctgatgccacgtaagcgtcaagctcctcttgcgtgcaatcgtaccccgggtccttgttcttggcggcgtcaactttcgccttcttcgttgcccttgtgtgggcaggcggtggagctggggtggcccttgactttgaaggtgccggaagaggagcttgcggaggagtcggtgcaggagcctgaggaggagtcggtgctggagcctgaggtggagacggtgctggcggtgcatgaggaggagacggtgcaggatcctgaggaggagatggcggagccggaggagatggtgcacgagacgccgcttgtcgcccaggaaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatgaccatgcccgacgccgccttcatgtggtgagagattatttattagtaatcaacatatataagcagcaactagcggaatggccaaatctaaaatatataaactacgagcttacctttattgataagttcttgaaaggaatatgcagctcacatggtgtccgctgagtgatgtcatcaacgggacaggtcgattcgtcctgggtttgcatggcgtccatgctctgtgatcctacctgccccattgaggcgcagctgctacggtttcctgacgggctcaccattgcaggaggaatggtcggctggggataatgggaccgatgtgcggccatgcgttcatcaaccttccttgccacctcctcttgcatgctgagctcgtagctcgatacccggaactctagatctgcaatcttcgccttggtatctgtcttgctcctcatccaactcctgtacgtgtggatgtcctccttgaaaccaatcttccaaggaatcacccctttccctcgtgttcgtcctggatgctctggagtctgcagggcgagtgtcaacttcggcatcgcgacgctatagcctcctgaccccaagtggtgatggtacgtcttcttggcggctttttctttgtttctttccatcatcgcctgcccttgttcacctgtcttatatgcagcgaactcgtcccagtgatcccttagctttgggtatgtgtcgaagttcggtgtctgccccttcaggatatacttctggtacagatctcccttgaagctctgaaactgctctgccattttcttcagagtctaccttttcactttgtcctctgtacccgcaggaagggtgaatgtctcgagcattgtggtccacagcatctctttctccgaatctgggacaaagctctcatgatctccgcgtgtccttgttcttcgccagtacaccgtactgacaggcacgttatcccgcacaacccaaccgctgtgacgtacatagttcttggcggcttcggccggggcactaggtcgtccatcttcttccacctccgttatgatgtgccgaccctcaagcttctttgctgcacctcgttgcccgcgtgccctcttctgtccaacggagggttgacttccactagcctcctcctcctgattcccctccacttccctttccacgtgcgcctgctggttcccctccgcatccctctccacgttcccttcctcgttcaagtactggtttggatcctcgttcccctcttcttcattccagtactggctgcttccctccacgattgtatcgtacaatatctgttcctcatcgcgatcagccatctgttgatacaagaaacatctgctaagtcatgagacatttatattttaacaatctaagtcatgtatgctaagtgtaagtgtcgtacattagaaccctacacaaccttacgtgctaagtctaattacaaatctaataatctcatactaaaattcaaatcgtgatatatgctaagtctaggtgacgtatattatacgaccctagctagtcaataatctcatactaaaactcaaatcgtgatataagttaagtcatgagacatttatgttttaacaatctaagtcatgtatgctaagtgtaactgtcgtacattagaaccctacacaaccttacgtgctaagtctaattacaaatctaataatctcatactaattaaaactcaaatcgtgatatatatatgctaagtctaggtgacgtatattatacgaccctagctagtcaataatctcatactaaaactcaaatcgtgatataagctaagtctaggtgacgtatattatacgaccctagctagtcaataattatatactaaaactcaaatcgtgatataagctaagtctaggtgacgtatattatacgaccctagctagtcaataattatatactaagtctaattacaaataaaataatcttatattaaaactcaaataatcttacatgctaagactaaaatagtcatgtatgctaagtgtaactgtcgtatatgctaagtctaattaagactaaaatagtcaattgttaggagtcgcaccaattccgtagttagaccggagtcgcaccaatagtaataaatgactaaaatagtcatgtatgctaagtgtaactgtcgtatatgcaattaagactattattagaacactacacaatcttatatgctaagtctaattacaaatctaataatcttaattgcattacaaatataacaatcatatatattattacgtcacttgcctgagcgaattgcttctagggctagctcttccactccggcttgagggacgactccgacaacacgtcttttctgcaagatacaaaaaaatgtattaggataaacgcgaagtaacatacatatatatattgcatttcacgttcacgttcgttcacgttcattcgctcgttcacgttccctcgttcacgttcgttcgctcgttcacgttccctcgttcgctcgttcacgtttgttcgctcgttctcgttcgttcgctcgttctcgttcgtttgctcattgatcacgttccctccttcacgttcgttccctcgttctcgtttgtcttcgttcgaccgttctcattcacgttcgttccctcgttctggttcacgttcacgttcgttccctcgttctcgttcgctcgttcgcgttcacgttcgttcactcgttcacgttctcgttcacgttcgttctcattcacgttcgttcgctcgttctcgttcacgttcattcgctcgttctcgttctcgttcatgttcgttcgatcgttctcgttctcggtcacgttcgttccctcgttcacgttctcggtcacgttcgttcgctcgttcacgttctcggtcacgttgacgtgttcgttctctttcacgtgttcgttcacggcggtgtggcagcatcgggccggcgcgtggcgcggcggcgtggcgtggcggcggcgtggcgacggcgtggcgccgcggcggcgtggcggtgccgcgacggtggcatgccgcggcggtgtcgtggcttctcgtggcgcggcgtcgtcgtggcgcgacgtcgtggcgggcggcgagatacggagagagagagagatcgagattggagagagagagagatcgagggaggcggcggcggctctcaccccagagatgcggcagcggcggaggaggcggaggcggcggcgacgacgacgagctcgagacgacggcgagatacggcggcgtcggcgcggggatgccctaggcagtggcggcgaaggtctggccgagagagatcgatcggccgaaaacgtctaagtgttggtggagaagacgatggcgcaccgggaatatatataccccccggatctttagtcccggttgttctcatcaaccgggactaaagatcttatcccgctattttcaaattctttttaaacccggttagggttaagaaccgggactactgattatagcactgaatattattttcccttacatatgtgtttctaaaatagaagataatgcattacaattatttaaagtacaaagattaatgacaattacttcgaaaaattattgttgtctgtaataaattaagtggataaatcataataagcaaatatatgacttaaaattaataaaaattccaataatcatatatacttagcatatgaatgctattattaaattggtaaaaactctaattaacatatgtatgtacatatggcatgatttaaaattaataaaaattgtaatcatcatatatacttagcataggaattatattaaattaaatgttaaaaactctaattaacatatgtaaatgccacatgcatgatttaaaacttttaaaaattcgaatagtcatatataattagcatatgaatgatagtaatataaattgtgaaaaactctaattaacatatgtaaatgccacatgcatgatttaaaacttttaaaaattctctagtcaattataattagcatatgaatgatagtaaattaaatgttaaaaactctaattaacatatgaaattgccacctgcgtgatttaaaacttttaaaaattgtaagtatcacatataactagcatatacatgatttaaacttgttaaaacctgtaataatcgtgcgtaattaacatatgccatacatcaattgatttacatggataatcaatacatccaaaatagtttacatagtgtacacaattgttggcaactttttgtgacaagtcgacaagcacgatcgcagcacctaaatgccttgcggtgatcctagagtcgccgaccacctcgatctcgccaaagggccaaatcaagatgggttttgtagaaaaacagctaaaccggctagcggagccaatttagagatcaaaatcagcctctaggccgatttagatcaatatgaggataactacccgtctcgtgggcaaaacggaaggttttcagaacaaacctacaaagaggtgtcgcactctcgcagcggcggcggacggtttacggcgcaaaccgacaaagatggactaaactagggtaaaatagaaaacatagtaaaagaacgattcaagtagattgtattcgggggttttacaatgaaccggccttgtcccttaaataggggttggtcttgccccctacaggcccttctccgcgtccaactcgggatagaaaccaaaggaaacacgaaacatgccttcccgagcaaggaaacccgagacccgacgaaaacatactcggacttggaccctgctggtctgaccgcccatatacctgcggtcagaccggccctactagccggtcagaccgcccatatacctgaggtctgaccggccctaagaaagaaacccggcactttccaaactttggcaattttcctctatttcgtccataggtgtcaaatttgggtgtaaacacatgcccccctgcctttttgatgaacactgtgaatctaaaagcatggaacatgttgtcttagggcgataatccaattaccggccataggacttcctaagcaccttgccaaatgctcgggaagtatttcttcaagtattttccattaattgctctccgaaaacaccgtcttgaagtgtcttcatctccttcaaagtcttcaaacgcttgtcgatgacatcttcaaaattgcttcccatcaaggtcttgtaatcttcaaccgacaagtcatcttgcttgaaataccgaagaaagccaagatttacctcaactggcaaaacgccaatttcaacaatgttttattactcgactcggcttatccattagcccgagcgtagtagagagaagaactcaacaacttaatatcataaaattcggcaaaacttctcacctccttagacataaaagaagctcctcgatcaaagtttaaggaatactgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatact

SEQ ID NO: 80904 - DNA, 28080 bp, Oryza sativa
tgcttgctgcttacagtaaactctgcaataatctggctgacccccttattctcgaccaaacatagaattaacagcctgaaatggggggaaataatgacacaccaagctcaaaacatagttatcgggtgagaaaaaaggaagataccagataggaacagacccatgaattttcagatgaagtgtgcatgctagattgtttgatttcctaatgactcgagcataaaatagacttaagaatacaaagcagacgattggacaaatacatgatattagtacagacccatgtagtcgaagtgttgaaacttgaaattttgtcctacaaggtttgggtgtaatatttgaagttttgaactcacagggaattgtcaaaaagaaggatgtgctatagacttatagtaaaagcaaacaaagttggaccaataaaagattcaggtgtaaacttaatagaattgatagattgttcatgaataacctttcaatatttgaacacataatgttatgatcttccttagagcctcctttgtgagacaaagcaggaacaagagcttgaatgacttcagttggaggtcctttgacaaaaaacgaatcatatatttccttccttgcagaggcacggatctgacgtaaccacttcaaggcaacatctggacaaccaaagtgtgagaatgggattataactgaaggaactttgcaactgacctaactgtgatgaacaatcaagaagttttgagtgtatagtaatcaaattgtagagatcgataaacaatacaaatgaagtatgacttgtatgactggcagataacattataagcaaacaggagagttgtacatgtaaagaatatcaatggtacaaagtatatatgcagtgatagattcaagagtaaacttacggccaagcaaaatcttagatatagtaggaaatgctggaccatggtaaaaagcatgcctccaagatccccgttcatcattgctgaggcttacgccattaattatctgaaagtacagaaaataattctccctgttacatcatggcctaaaaggatggaactccaattggctatttggctgaatcatattgaaggaagcatgtgtctttgaatatccatactaatttatctctcaagcatgaaacatgatcttctgtattctgaatgcattatcaaatgacacaggttttacaaaatgtgtgctgctacagctcacctagcaaggtcctgcaattcgattacccattgtgtgaccaaagttataggtttatcaactggaaaattctgtggatgcttatcaatccagtttcagagtaattccttccagagatcaatttcctcaaatatatgcaccacaattatgacattacagcggctgaaacattgtccacataaccaatagttcactatgatatcttaatgctccatttctattttttgtggcagaattactgctccatttcggcatacagtcctttgtgattgcaggtcaaaacaaaaactcaagacttccccattttttttatcacagaccccttccatgattattagaaatcacacatcattgtttatgccagaaccaaaaatagcaaatgataaaactactagtaatttttctcagatggacgaaataaaaggcctaaaattagcacagagcttcacctggctcctgaagggttcgtccacggtacctacaagagaggccatcagacaccccaagtgacggcgaatgagataaatgggaatagggagcatgtcggattaggattcggagcctcaccggctacggcagcggagtcgacggggaagacgagggcggcgacggcgtggatcgcgcggacgacctcgccggcgctcgacgcggcggcgaccgcgtcggccgcctccgccaccttgtccagtgctaggtcttcgaggcgcgcgccaccatggccgccgccctgggagcccgcagccctcgccgcggagctgcttgggttgctcgccatgggagggtgaagggaaacacacgacgaacctaagagagagcgcttgagaaggggaggttttggagcaagagtaattagggggttttgtttggaggagaaataacagttttacccggcttgactgccgttggctaagataaaattttggggtatgtttgagaatatcaaaatttgcaaatgaacttttgttagagaagatgtgtttgagataccaaaaaaataattgaaggaattaagaatgtcgaatgtcaattgtacttttattcatgataccagtagtatattactcctattatttctaagtttttttataaggatagaattggagctgctaagagcaagtttaatagtatagccaactactagctctaaatcatctatagtcaatctactccttccttcccaaattgattttatacaccaaaaccaaggataatttaaatcacatcaatcaatacaacatacacacattctcccaccatgcatcgattaaaacctcatgccacttacaccatagcatgcacacattcttccatgctgtattaactgtattctgctgaaatccgtgtccatgcagttatatgatgatcaatttaagaatttttagattcttttacatgatgatcaatttgggaaggattgagtaatagtaattcatacaatagttaactagaaacatataccacactattaatatctggtcccacatgtcatactcacattgcctcttggagtccgtactacagctgactataaatctgtagcccactgcacttctctatcctcttttatctttttaaaatatgtctatagctggcttagagcaggtacaatagcataccattagttagctataaacatatttttatgagataaaaaatgaaaaagaatagcagcgggctacagatctgtagccagctgcagcacggactccaaaacacagtgtgtgtatgactggggccatatattaatagtatagtaagcaactattgtatgaatgagctattagattggctatggatgaattggagctagtagtggactatactattaaacttactcttatagtatgctattgtacctgctataaaactaacttgcttcttttcctcgatacagcaattaactaacttttctcagtagtcgaattatgcatcaaaagcggaaggagcgagtataaccaactgccaaatacgaagcatgagtgcatgattctctataagattcgaaaacaagctcgaactttcgaacgctttcattacaaccaagaaacatttcgatttcatattattgacatcatgtgacggagcgtggggctcctcaccgggagaccgcgcaggtccccctttgccggttcggccgggggccctgggtgaggttctaagctcctagtctgtggaatgttcgcgaaagtggaaacacacaagacacgggtgatgtatacaggttcgggccgctgagaagcgtaataccctactcctgtgttctggtagatctgtgtacgaagaagctacaaagagctggagaaccagagagctcaaactctagaaacccctttcctcctttttgcctctcgtgggatcttctcctggatcctccgggagtctccaatctctcctcccctggtcctctggtccggatcccctccctaagtgggcaaggtcctccttttatatctcaaggggataccacatgcaccacttctacctatttctctttttggtggggacccatcctcttttcactaaaacttggctcgcctttccttcataaatgggcggagatttgtaatggttgccgtccgaatgaccttctgatgggacggcccatacctacctccactttcgccggaagcaggtgcgacgtgggaacatggctgtctgccgacgacatgaccagtgtcagaccggtcacaaatcggtcattcttgtccaccacgcgtcagtttatcaatctgcatgttcacccttcttcatacaatgtcttgcttgtaacggttgggatgaagcctagcatatatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacagtagcccccggcgttatgccagggcgatcaccctcctcgagggaagcggtcgggcgtgacgccacttacttaggcctggtgacaagtggggctggtctctacagttgggcagaaacccaacggtcgcaaatcacgcacatcggcaatggtaactcgactgtcaataatgagcggcctcttcaagactgccacattactcgagtagcacacgaatcgggacgagccggttcgttttgcctggagatatggtgatggcacttcggtcggcgagtgcaattaacgcgcgcacgatatgttccatctcgactgccacagccgcatattcacctcatgcgccgcaagcgggcgaatgggattagtggaagcgtgggcgcgagaaacgagggagcgagatagtgggcgcgagaagcgaggagccgggcacagcgttggcaagggtataaagacaccgaggaagagatttgcttccttcctctcgccattattccccttgtcttcgccgcttgtgccctaactccttgtttcctgtgccctaccctcgccacacgcgctcgctctcaaacatctcttcttccggcgtcatggcacggggctctgctccactcgatggtagcgtgctgccgctttcccgcatcgtgagcgagaggcaggccgggctgccgcgccgcttcctgccggaatctgccaccggccaggagatagttacgctgggcgagggacgcccggcgccacgctacccggggcggaccgttttcttcctccctttcgcaatggcagggctggttccgctattttcttctttcttcatggatgttctggagttttacgatctccagatggcgcacctcacccccaacgcggtaatgacattggccatcttcgcgcacttgtgcgagatgttcatcggggtgcgcccatcccttcggttgttccggtggttcttcaccgtacagccggtgtcgccgccgtcggtggttggtggctgctacttccagccgcgggggccggtgctgaaccgctagattccctgcgtcctccgcaagaagtgggatgactggaagagcgactggttctacacccccctcgccgacgaagcgcgcctccgacttccgaaccagcccccggcgcaggcctccagctggcgggcgccggtagatctgggagatggctacgacgccgtcctcgaccgcctggcgggcctgcgatcccaggggctcacaggggccatggtgtacggcgactaccttcgtcgccggatcgcaccactccagcggcgcgcccggggtgcctgggagtacaccgggtccgaggactgtatgaggacccaccggggggtcaaatgggactgggtccctgaagacttcaaggtaatgatccaacgggtgctgaatctcagctccgcggaggcatcgctcatcccccaaggagtcctccccctctgcagcgatccagatcgcgccaccatcctgaccatcatgaaggcggtcggggcctcagaggagcaggctcctcgaggccatgatggcgcgggcgggagctgcaggggagaacaatctaccccaggagggggtcgtgcttccgggctccgtgacgggggctcggggggctgccgccctgccgacgcccgagggaagaggaagcaagagggttcctcctccccatctcctccccgagggggcggggcggcgcgtgtcagcagcaggcgcccggagggggccgcgccgacgccgcagcccgagggggagcggaagaagatacggcttcgcaagatgggggggacagaaccatcccggggaaaccttatttcccctccaaggtagtcgtttaaccgaccccctcgcaggttcgtcccacgcccattgtggctgtattcattctcccaacgcgagttttcactcacccatcttgtttgtcttctggtctttcttctgtttcagcgagatctcgtcgcgtccctcccgccattccaagtccggccagtctgaggccgaggatacggcgaccgcggaggcccggaggcgagaatctgaccggcgagaagccacggatcgcctacgggaagccgaggaggccgcccgggaggccgtccgggctcgccaggctgaagaagccgctcgggaggaagccagacttcgccaagccgaggcggcgacaacttccgaggcagctcgcgacgaggccgcgggcacatcgcttgggcccactccctcgggcaacactcaggacaagccaggtccgggggacgtccccgagcccggcacgtccatcggcgggccgggccgcgcggcatcctcaccgaggcggctctcccccacgccttccgttgccccactgagcgcagagccccttttgcaggccttggccgtcgcaaacaccacggtgttggacgggttaagtgcccagatggaggccctgcaagcagagcgggcggagctcgacgccgcatgggcgcgcgtcgaagaggggcgacactcggtggaggccatggtggaggtgagccgcaaggcacaccgccggcatgcctcagagctcgaagcccgtcggaaggtgctggaggagatcgccagggaggtggaggaggagcggggggctgccctcatcgccactaccgtgatgaacgaggcgcaggacgacctccgccttcaatacgggagctgggaggcggagctagggaagaagctcgacgccgcccagggggtccttgacgctgccgctgcccgagaacggcgggcggcggagaccgaggtggcatcccggcggcgcgaagaagcccttgaggcccgtgccatggcgctggaagagcgtgcctgcgtcgtggagagggacctggcggaccgcgaggccgccgttgccattcgggaggtcacactggcggcgcacgaagccgcctgtgccgaagaagagtccgcactccgcctccgcgaggatgcgctcaccgagcgggagcgagccctcgaggaggccgaggccgcagcgcaaaggctggcggagagcgcgtccctccgcgaagctgcgcaagaggaacaagcgcgtcgcaatctggaaggtgcccgcgccgagagggccgcactgaaccaacgggccgctgaactcgaggcgcaggcaagggagctggatgcaagggcgcgtagcggtggggcggccacgggcgacagcgacttagccgcccgcctcgcagctgccgaacacaccatcgcggatctgcagggcgcgctgaattcgtccaccggggaggtcgaggcccttcgtctggcaggcgagatagggcccagcatgcttcgcgacgccgtgtcccgtttagaccgcgccgggcggcaggcgggtctctggggcgggcggactgcgaagtacgccgccaaccaggggggcctcgctcagcgcctctcggagatggccgggactctccaacggctccccgaggagctcgagaggacgattaagtcatcctcgagggacctcgcccgaggagcggtggagctcgtactggcgagttaccaggccagggaccccgacttctccccatggatggcgctggacgagttccctcccgggactgaggacggcgcgcgcgcgcgggtccaggacgccgccaaccatatcgttcacagcttcgagggttcggcccctcggctcgcgttcgccctcagctccgacgaggagggcgatgacggcggtgtgggcgacagtggcgacgaggctggcgactcgggtgcatcggagtgagcctccaggtccccgccaatctttaaatagttttttcttcttttctttcttccgaagccttcgggcctcctttttgtatagattaacttactctgcaatcaaaataaagaaatttctgtgtcaatttcattttactgtgtgtatgagaacgaggatgatctgtgccatggttcttttgtgtcttagctcgaacaagggctcgtgcccaggtcccagtcctcaaatggctcgggtcggggctagtgcctggggagatccacgtgtcgagactggccaggccgggagcgtggtgaccgagggttatgggtgacccggttgtgggtttttgccgattcccccccggagttaaccacgccccggggcacggctcggttctgggccccttttggcgattttagccgactcgagcccccgagggcaggatcgagcacgagtgacctatttcaagtcaagattcttcaaaaggaaacaacagcacagacacagcctttaggaaatcgaaaatgcttttattgaaatacagatagaagagaaataagaatatgcatgtgtggtagcccccggccaaccctgcacgcccgaggggggtacggggttggcccgagcccgaaacctgacacccgaaccctattaggggtagaagcgacgaaggtgttcgatgttccacgggttaggcagctctgtgccgtcgcccgcggctagccgaacggagcccggccgggggacgctgatcactcgatacggaccctcccacattggtgagagcttgctcaatccagcacgcgtttggacgcggcgtaggacgaggtcgttgacgcagagtgatcgggcccggatgcggcgctgatggtagcgccgtaggctctgctggtagcgcgcggctcggagggccgcgcgccgccttcgctcctccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggtgtggttcggttcgcccagagcaccgctggcaactcctcgatccacgaatcgccgtgcttcttgaggatgttgaaggtcttggttttaaggcctctgaggatttccgcattggcgcgctccacttggccattgcttctggggtgggcgggggaggcgaagcagagcttgatgcccatgtcttcgcagtgatcgccgaaaagttcactagtgaattgggtgccattatccgtaataatacggttaggcaccccaaaccgggctgtaatgcccttaatgaacttaagtgcggagtgcttatcgatcttgacgaccggataagcctcgggccacttagtgaacttgtcgatcgcgacatacagatactcaaacccgcccggggcctgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcactcccctcgggtcccgaggcctggactccgacgggcctcgggggccggtcaggcgcgtccgtctcccctaaggggtcgggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgccgtacttggcgtacgtaagcatccatctgcgggtcagagcaccggtactccatacagacctggttaacaccaggaggcggcggatccccagtccagctgccaccctaagtcccgcaaggagtccctcgtactctgccatattattggtcgcccgaaaatcgaggcgaaccaggtatctgaggatttctccgctcggcgaggtcaacgtgacccccgcaccggcgccctgaagagacagggagccgtcgaactgcatcacccagcgggcggtgtgaggcagctgcgaggggcccgagctggcctcggggagtgagacgggttcgggagccggggtccactctgccacaaaatcggcgagagcttggctcttgatagcgtgacgtggttcaaagtgcaaatcgaactcagaaagttcaattgcccatttcaccacccgtcctataccctctcgattatgcaagatttggccgagggggtaagacgtaaccaccgtgacccgatgcgcctggaaataatggcgcagtttcctcgaagccatcagaatagcataaagcatcttctgggcctgagggtatcgggtcttggcgtcccggagggcctcactaacaaagtagacgggccgctgcacctttcggtggggccgatcctcttcgccaggggccgcatccctggggcgctcttcgtccaagcggcctcgcggggcgcactcgtcttctgtgccgacgacctcggggtcggaggacgacaggcgcggccttcccacagtggcctcggggccgtcctgggggtcgggggctcctggcatcgtcggacaagcgggcaaagggccaactctggtcgtcgggggccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggggcctctcctccctgctctctcccgggccaagccagcacagggtggggatgcgcggaatgaggattgtcctcatcgcgctccacaaccaacgccgcactaactacttgcggggtcgccgctaagtagagtagcaagggttcatctggctccggggcgatcaaaactgggggagagctgagatacgccttcaactgagtgagggcacgttcagcttcctccgtccaagtgaacggcccggagcgtttgaggagcttaaataagggtagcgccttctctcccagcctcgatatgaaccgacttagggcggccatgcaaccggtgacgcattgcacatccctaagcttgctgggggcgcatccgctctatagctcgtatcttctcggggttggcctcgatgcctcgggcagagaccaagaacccgagaagcttgcccgcaggtacaccgtacacgcacttatcggggttcagctttatgcgggcggagcggagactctcgaaagtttccgccagatctgaaagtaaagtttcttggtcgcgcgtcttcacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgtagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagtttgccattcgccttgggaacgaccaccgggttcgccagccactccggatggatgacctcgcggatgaatccggcctccagaagtcgcgccacctcctcgcggatgaaggcttgacgttccggggcctgccgccgcactttctgccggatcggccttgcgcccggccgtacggcgagacggtgctcaatcacctccctggggaccccgggcatatccgccggtctccatgcgaagacgtcagcgtttgcccgcaggaaggagacgagcgcgtcttcctatttgccatccagaagaccaccgattcgtgtagtcttggacgggccgtcacccagggcaacctccttgaccgggacctcgtcgcatgtgatcatccgctgcctcggggcggcgggaacggaggtgccaagcctctcgtcgccaccctcgggcttggacgcagcggcgaggtgatccgcgcgctgctccatacaagcaagcgcgactttgaggtcgccatggacagagatggggccaccggggcccggcatcttcatctgaaggtaagcgtaatggaccgccgccatgaacttcaccaacgcgggcctccctaggaccgcgttgtagggcagacttaggtccgccacatcgaagtttacccgctccgtgcggaagttgacggatccaccgaaggtgaccggtaggtcgatatgacctaacggccatgtgtgccccggcgtcacaccgataatcggctgggacggccagagcaccatccccggggccttgatggcgtcaaaggccgcgggggaaaggatgttgagggctgccccccccccccccccccgtctatgaggacacgccccaacttcacgttgcaaacggtgggggaaaccaccatcgcgatctgtcctccccgggcaacacacggtgggtggtcggtctggtcgaaggtgagggcaacctccgaccaccgcgcccgacgcgtcgcctcatgagtgggggccgcggccagaagctctcgcttcatggccttaaggctccggcgagaaacgtgagcacacgctcccccatcgacagtggcaatggtggccccaggctcctgaaagcctaggtcatcatcgccgccatcgatgtcctcgacgggggccttctgcttggcctcacttcgccgattgccggagggtaccgccggggacttaccctctcggcgctcctgcctcctctcctcctcccactttctcgtccgctcagccaaacttttgactgcgcggcagtccgcgaggtcgtggagggaggtgttgtggacgatgcaccacttgccggttgggcgctccctgctgggagcgccggcctccttctttttgtcgctcgcaggcctcccctttcgggtggcccgcgaagcgccctcgacagtgaggacatgaccctcgtcgtcggaatgggctgacctcttcttcctcctcctgtcacgtcgccctgtctgagcagcggacccgggggcggccgaagttgccacaccggaaccggaggggttccaggtccaggcctcctccttacgagccactcggtccgcgagctgaaaaagctccgcggtagtctggggctccttggaggcgatcttttcgagcatgcggttgtgccgcacacccccctgaacgcgtagatcaccgcgtgtgcagggatgcatggtatggtgttgcggacttgacagaaccgctgaatgtatgagcgaagtgactcatcatcccttcgctgtactgcgtgtaagtccgcttcttcacctgggcgcggatatgtgccttgaaagttcatggtaaactgttggcacaaatcctcccaagagtggaccgacgcgggtggcaagttcattagccaaccccgcgcctgtctcttcagggccatgggaaagaaattcgccatgaccctgtcatcacccccggcggcctcgatcccggtcgtgtagacctggagaaactcggcggggttgacgctcccgtcatatttttcggcgatggtgggccggaaccttgggggccaacggacgttccgaaggctcgctacaaaggctctacagccgacaccaccaaccgggggcacggagggctgatccccgcgtccgtgttgaggtgacactccggacgaggaggcaccctccgttgcgtgggtagcacgtcgaccattacgccggcgctcgataccgatgcgggcatctggccctccacgctgatcttcccgggtcagaggtgctgacgagggagtggcagccgaacggcgagcaacagccgccgctcgccgcgccctccgccttgacgacacggagccggtggtagcagcgccagaggtcttggtggctgtcacgaccggaaataacccaacgggcattccttacgtgcgtgcatgaatccttgtcccaggaggcaaggtacaccaaaagttgatacaaatcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacacgatcttagaactatacaatattattaatcaaggccgtgaacccacacgaacctgccttaacccaaggcctatgatgattcagaccgaactggcaacccgaccctgggtcccagctcgtcccaagtcaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttaggggattttgaatagagggggcggtgtgaagccaattccacaataatccaacaattccatagtgtccaggtgatatgaatatttcccaagtctaaagttataaaaccacctaatgttacctaattaaattgcgaagcatctacctaaatttaaactagggataccacgagtagagtgtccactagttgaggttttgtttactctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaagatgatatgacttgccttgctcgctttcccaaccgatggcttcgacttccacgaagagcggatcttccgaagctgcagcgtctacacgaccaacggaaaagaaaaggcttttacactactaaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaatctcatttattgcgtcagccgagggagagggcgcgcggaccgggtccacgggagtggggcccacgcgtcagcctctcggtccacggtggaccgggagcacgcggctggcggcggtcggcgccgtgggtcccacgcgtcagccgcacccgcgggctcgggcggctgacggccgggtcccacctggcagccgcgagggcgcgcccgaaggcggcctcgccggcacggccgaaggtagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaagcggaagaaggcggcggcgcggttcgggacgacgaggacgacggtgctccggcggtcggcgagcgaaacggaggcgcggacgaggtcgacgggaacgcggcgaagccgatggaggtgacgccgagtggggaggaagtccggagcgacggcggcggcgaaccggagcacggcggcgacggcggagagaaagtgcgacggtgcgggctcgattccgacggggagagtgagcggcgagtggcggaaacggaggagcggagctcggggattgattttatagcgacgggagagagagagggcggccggagagaaaggaaaccggccgcggagttctcgggctccattgaagacgccggcgacgattgcgggattcaaatcggacgaatccgagggagagagagagggaaaagagggggaatcgggagagggaatcacggggagtaattcgcccctctttatggcgcgcggggaaggcgggatgcggcggaatcggcggcggcggcggcgctagggcacgggcggcggcgggcgcggcgcggggttggggatgacaggtgggccccacccgtcagcgagggtggcgggcgggcctgcctgtcagcggcgcgcgctcggggaggagccgatgggccggaggggaggagagagagagagggagggagagaagtgggccgagccggcccaagaaggaaaaggggggggaaagaagacttttagggatttttctttttataaaccttttcaactttgtttatttcttttcaattattatttgtgctctgaaaattccactaaaatttatttacgcattttaggcttttaggaaatatacaaaaatcctccaagcctcatttgacttttatctttgcacattttaattgttggaggctttcacatgaattttaattattctttgcacaatttcgaggatgtattttagagtcgatttgggacgtgacagtggcggaggaccgcccaccaacacctaggtgctgccgtgccgtcatgaccaagttggctacgtcgtccagccaacgttgggctggagactccgggtcagggacgacgggcgggtgacgtaggagcgcgcccgcagcttggagcgcgccctggggcgtgctaccgtcgccgtagacgaggaggcgacgctccccatctcggcgcccttctccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagagcttgtgcgcttttgcttgtttagccattgggctgaacaggaaaagcttggcgcacacgaaagagtatgagagcttagaaaaacacacgcagaaccccctacctggcgcgtcagatgacggagcgtggggctcctcaccgggagaccgcgcaggtccccctttgccggttcggccgagggccctgggtgaggttctaagctcctagtctgtggaatgttcgcgaaagtggaaacacacaagacacgggcaatgtatacaggttcgggccgctgagaagcgtaataccctactcctgtgttctggtagatctgtgtacgaagaagctacaaagagctggagaaccagagagctcaaactctagaaacccctttcctcctttttgcctctcgtgggatcttctcctggatcctccgggagtctccaatctctcctcccctggtcctctggtccggatcccctccctaagtgggcaaggtcctccttttatatctcaaggggataccacatgcaccacttctacctatttctctttttggtggggacccatcctcttttcactaaaacttggctcgcctttccttcataaatgggcggagatttgtaatggttgccgtccgaatgaccttctgatgggacggcccatacctacctccactttcgccggaagcaggtgcgacgtgggaacatggctgtctgccgacgacatgaccagtgtcagaccggtcacaaatcggtcattcttgtccaccacgcgtcagtttatcaatctgcatgttcacccttcttcatacaatgtcttgcttgtaacggttgggatgaagcctagcatatatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacatcatgcttcccgaagaaaccatgatgaatttatcatggttacaacagaaacatccacatctacataatggtagtactagtattgttctattctgcacgtattacattctgtgtgcggaactcaacacgtactgctcgagtacaatttctgagcagaggacagggaaatgaaaagaatgcctaccaggtatagttaagttaagggtgtgtttagttcacgtcaaaattggaagtttggttgaaattgaaacgatatgacggaaaagttgtaagtttgtgtgtgtaggaacgttttgatgtgatgaaaaagttgaaagtttgaagaaaaagtttagaactaaacaagggttaagaagaaataaaataaaactatgaatatatctgctagtattgtacagttatgctacgagatgttgaattcaaatctcacatactattatttttttttacttagtatgcatctttactacatgttgtttcaattggtactaattaaacatcaaaaagtttagtctcgattactagtctcgaacaggtattaaagatcgtttctcgtgcatgagcaataaaaactgatataacaagaggaagctccacgagaaaagcaaagaagacggaaagagaatctcatatcacctgtgccatggattgatgtcacaaaatcgccgttgttcgctctgaatcgcccgttgacaacctgatttatcgatcagggctgtcgagagggatttatatgcgagctcaacattgtttcgattttccgattaccgcggacggaaatttgtccaccgcgtgtggatccggtaacgggcttcatcggggcttgcttcgatggacggtcaataggagcgggagtatgtactccctaggagtacccattttcatatatatactgtactcgaaaaattggctttgagttgaacctgactcttattttgttcttctggattttaatattttgtaaactattttctcaaagataatttaccaagttgagctatcattcatagcaagatctctcgctgcaacacccagggtccttttagagaaaattgcaatattgggacaacaaacattagggcttcgctgtcttgacactccgagtggatgacaaatgggtccatatgtgtctatgaaatatgtgtccagtatcattatagcaaaggtcaatgtttgcagtgtcattattgcaaatctcccgtcatttttaccccgtttcatagaaaaatattatatcttatgaaattaaatcttataaaattaatagacgagatatagctacattggtgtacatctttaatgcatgccatccaattttagattaccatattactttcgaacgaatggagtaagaaatgctcatctggttggcatcaatattttaggcgactggtgatatggaagatgttctccggggttgattacagccgtagttcctcgttccatgtcgtagacacacagcgctttcccattgaaccccgagtagtagatacagttccctctcaagcctgttgtccgtgcatcaagtgacgctccaaaacagcctatctgaacgaagaacactctgccacctagcgaatccaccttcacccacgctgatctttgctcctgcgtcgtcgccatgctcagcctgtaaacgccaacaccagcgacaatccgatcacatccaatcgggtgagagaagagaatggagtgcagctccccgttcgattccacaaagatgctggtacgtttcatgtacaccgccggcctcctgtcgtcgtcgtctacggcggtcacggtgaacgccggctccagtgagaactcgaggacggcgacatggtcgatgagatcggtgtagaactcgccgtccatcgccgtgagctggcgtaacgccaggatgacgatgccgcggtgctcgtggtgaggcggcccaggctggaggtactggtgctgatgcctcttcacccagtggttgtcgccggggcggcaataccagagcaccgtgtcggcgtggtcgatgacgagcacgacgcagctggccgggtccatgggaccgcagcacgagaggaggcacctccggcgatggctgctgccttcggcggcgaggacggtgccgtcgtggtcggggggcagcccgacacggcggccggtgaaagggtcccacaggaaagtgcacggcgagccgcggcgcgccatgagcagccagccctgcgccgtggtccaccaccggtggcctctcatcatgtcgtcgacgccgccgtcgcccaccctccttggcagcagtgctctcgccggcacgctgtacagggacgtggcgtcgccgtggccgaacagaagcagaggagcaagcttgggatccagtactgctgcagatgcatcgcctgcctcctccatgattttgatggccgactgtcccacaggtaggatacggccggtcaattgaaaacgaacgaatttggcggtgctttataaacgaggagaggctttgagcagtgcaattactggcatataggaaagagaagcgaagaaatctgcacgcctacgacctacgattactagtaccaattaggacatgaattcctacacgacatcaaaattcaaacaaattatagtactagtactttgggccggtaaatcagtaaaaggaaacagtaatctgggccggggataaagagggatcaccacatatgcatctatggagattggatagcaaccaacaaaaaccaaccgtgccgggtatacaaactacaagcagaagcggaagccgacctatatatgagtccggaggaaacacgtcaagaaagcagagctccgtagcagcacaaaacgcagcgcgccaagcaggccattgcggtgcacgaaccctcgagattcgccaagcagatagatggaggccactgcgacggcggcgcagggactacgggactggtcgtctctcccgttggacatgctcgtgctcgtcctggatcggctcgggtggtcgacccacccgagcttcgcattgacgtgccggcactggcgctccgccgtgtcgcccttctacccggcgtggatcacgcctctcctcctgagcgccgccgacatcggcgtcacgaacgtcaggtactacagcccctactaccacaggtgtttcgagatcgccgacacgctcctcaaggtgcccaaaattgcggctaggatctgctgctccagtggacaacacctcacgctgtgtctacctagattgatcctccaagccgatctcgtagccggcaccatgtatgagctgccagagatgcctttctattcattcgagtttattgtctacgatgagcacgcgcggaggatgtattgcgtcaacacgacgtacgcgctacagctcgcccgtgcgacccaacaagacgacggcgagtgggggccctgggaattaacggactttgacgtggaaggaccgcaacttctggcggcgccgatcagcaacccggtgctccatggtggtttgttgtatgttcttggtgaagacgggaagatggcggtgtatgatccatgcaaccacgacaataattttacagttcccgataaacctaagggctttggaatcaaacaccaagttgatagccacctgtttgagtccgaccaaggcgcgctcatggctgtcctcgtcggctacagtggtgcgcctatccatgtcgtcaagctcaacgaagagacgatggagtgggagaagatgcggtcattggaaggacatgcgttgttcaccgggacatacacgacaatgttgaggaagactaagcttagattgatgcaaaacaaggtgttcctcccgaggctgtatgactggcctgagactatccatgtcgacattgttacacgtgatggcgaaacagcatttgtaccaaagtcatccagttcgtctaacaccaaggagatcacctcggacataaatatttggttctacgagtttgggcagcaagacgcaagagagttttggggatcggagagagtagattatagtatttgggttgattttagtactaattgacacaaattgacgttgttagctcttatattttcatatagtgaatcatctcacaatgaagttactcttctttcaggccaaaatcaaaatcgacgcaaatgaaatttgatataatatttctttgttggttgaaacatggcgctattaatattatgcactcagccaatgcaatttttgcatgaattgatattgatatttgtgcacagtaatttatgaggatttaagggaataataaaattataggcttggatgattttctcggaaaatttgaatttttttgggagggaaggatttagggtttgggtgattcacaaggatttaggcaagttttgaatttcaaaattcgaaccttgggatttgtaatggaactttgggatgaagtttttgggatatcaaggagagacccaccgagatcttttggcacacttaagtccttgaggatacagaaagatctaaaatttttgcaattaggatttcgttttatacaaaataagttagaaaaataattcattcgactgtgagttgctgaagatatggtggtgttatcggaagacttgaccgaatagccatcactgctaaatggtggcatggatctacttaatccacaaatagactttcccattaaaccaaccatatgactgattactcccttcatttcaccaacatccattatccaatgcatgaatcgatttaaaaccaaaacgtatcacatagagctagaagaatgaggaaaacttcaccaaaagcaaagtagttaacgtacaggtgcaagtagttaacgtacagtatcaatgatactggttggtgacgttggctttcatcatatacttggttatcttcttcttcgccttcttgtcttccgactcacacgtcttagcgtgagccagaagtgggtttctcgccctggccgaagaaggttcaagaagaatcttcttgtagccttttccgcagatccaacacttctttgggtcgaattcctcctgctgacgcacggccacctgatggcccgttgcagtggcatcgagggcgacctcgtcggactcgatgactgcgccgagagaaggtttgggagcgccgtcgtcagcgtcggcattggcgctggagttgggatcgaccttgtcgtcggctgcgacagtgccagtgggatcgacctcatccgtgacggtgttgttggcgctgggagtggggacgagctcgccgctctcagccctggcactgccgctggtgtcagccgtggcgctggagtcggccatgacgccctcgtcgcttgtgtcgctggcaccagccggcgcagcactggtgctggcaatgttagagacggcagtgccaaatccagcgggatccaccagctggtactggaaggcgccgggcttgaactgaaccaggatgacggtagtgttctcgcccgatgccaagccgaactcaacaacctcctcacagatgacacgcagctctgcaccctcctgcatagcaatattaattggtcacagcattattggtaacagcagttttaacagcgaaagaatcgaagtcaaagcagatggcagtttgtcagccaggcatgcatattcagtgctaaactaacaaatggttttgtgaggtttagggcttacacagtttttttttaaaagaaaagagaaaatcaggatatttacattgcttgattgaagtcatttcctagaacagatagcatgattaacaccactaagatatcttgtcctgccaagaagacaaactgagggaaagaaaagactcaccaccgataaacggtcatgtatgtaagaaaccacgtccgcactgtccacgcaagacctgcagggggaaaatatacagtagtcaatgcaattagtatggaactatgagtgaaactatatatgaaccaaataggaggaaaaaaaaaaaagagaatgccaatgagtactggtgacataaaaatgatccaatagttattgacaggtattttttgctgaagagttaccacttaccagagaccttgacttgcaataacaagaaactccatgtcatcagttatgtcatcctgacattgaaagggcaattttccatcagatcccaacccggcaaaactgaacttcatattctaccaaacggacctatttacacttagttacacttacagcgaggatgtccggatcacataccagcatttgtttttcacgatctaaatctttgttcttcttgaaagcaaagtcacctgaaatgtaagtaggtaaaacgccaatcacagtgtaatgtgcttctttttgtgctattacatgcaatcaatgaaaaacagatccagacaagactataccaattgatcttgagattgttacacctcccccaaaatcaccgaggacccattgttccttgactacataattccccattacttgttcacacctaagtccaagagatctccctcctgcattttgaactctctctctttcagactcagttcttgtgcatggtttgtgatcgaaggataaatcaatagcctattgacaaaatggaaacaagcacaaatgttaggcaccacaatgaacgagcttgcaaattaggtattaaccagaaattcaatagggaaacaatcactataccaggccaccctgtcttgagagtacgcaacgagaatcaccaacatgtccaacaatcatttggttacctctgatgacaaccacacatgctgtgctcccttcatacgctggcccagtatatgtcgcctgggaaaacaacaaccaaactgaagtatataacacagaatcacaacattgttagaaggaaaaggctaccaaaaaatagctcaagaaagccaacaggtatagaaaaacatttctgaaaaccaaaccaatgtatgaaagaaataaccatcgaagggatatcgcaaacaatacctcaatttggatagcatagtatgataagaaccaaggtgcaatgagaacttaagaacctgttggcctccaactcagtaaaccagccaattgatatgtaactaattgaaccttttttaataggagcaattagtcgagattagggttaaacatatctcctccaactccaaagtacatcacaagaaagaacaacagtctcgatatcaaacacattcttccatttcctttttcatagatacaatatgcacactgtccaacaaatacaattttgagtaacttcttcacgatatgaatatttgaggatgctaggggttaaaagattactacctgtgggaaaggcttagcacagacaccagccttgagaaaatacatacatccattatcatgaggaataactaactctctccaagcatcggactgttgcaggttctcatccatgctgcagcaatcacacgaacaatgatatcccacatttccaagtgcagctataaacaaaattatgtaaagtaggccaaaataaccttaaaaacacattgtccagtgcattaatcagatcgttgtgatagtcttcatgattgcatagctcaatgtgaaattgttttgcgcaatacaatgctacttcagctcctgagatagaaaaaaacaattcagtatggcgtctcgctcaatacgatggatcaagattacttctattgcatagaagcttataaatcaaaacactgttgtgaacattagtagcagaacaacacttgaataggcatcattaaaaaaaaactaacctgttaatctgtaattatcctctaaattatcatcaccatttatattactagtaactcatattcatgcagtgttttatctctcatgaattaaaatttctttttatgtagttcatgttatccttgcaagcatgccacacgaatgtgattactgattagctaacttgttcattatccataactgtagcatcatatttatttgaaaattgacaggtaaatgtttcaacatataccacaaagttttcaaaacatgcgcagagataaacaaagtgatacacacagacaaacatagcatgacataacagttacgccaacaatttggagggtttgaaattaaaaaaaaaatgagaatgaaagcaaacctccatggccatcataaacaccaaagaaagacgtggacgtggcatcatcaagatttagaatagctgcatgctagagaatatagagggcatatgtcaatcacagtattttacacaattacttaaagatcagtaagaaaattttgcagaactgtccctttttttgtcatacaaaaggctgcaagtttactcacagcatcttccattttctcaccccatccttgcatagacgacacaacatacttaattctgtcattctcttcttcaaaagtgaacttcgattctacaggaaggctgttacccatagcggaacttgctttgctgaaaatttaacatgaatacaaatataaaataacattattaacaaaaacggggaaagacacttaaacaataatacagatcaattaaatgccagaaagctaggttacatatgaaataaagtgaagtagaatcatcaaacttgatatggcactacttatctagctcaaagcacagggtgtaattggtgctttcattcagggcccttaaatgcttaaatgcatttttgagatatataacatggaagtatcaatcttcagttgcagtgctgcattattttacacctaaatcttattttattactgcgaacaaaatacacacaaggttttctacaaacgcgatat

SEQ ID NO: 80905 - DNA, 1193 bp, Oryza sativa
aacggagaccaaccatgaagcttcggtgctcgtcgacctcctcatccaactccgagaaaaccacgcctcaaatgcatcaagcaacaacatcacgggtacgggaagcgaagaacacgaaaaaagaggaccagaccgcggtaaacaggaaccaaccaagacgcagggtgctgctcgattcagcgaagacaagaacgagagaaaccgcgacaccaaacactccaagcaaacaaacaccaccaccaatggagcaagatcgaagaagagtagggagaagaatctcacggcgctttcggagaagaagtagggtttagggatggaggcggcggatgaaaccacagaggagaggaggatgaagtgggagagagatctcacctctcacctttgccgctgctcttgagacgcgagagagagagagatgcggaaaagtggttgtgctgcgaagcgcaaaaagttgtgcttaaatacctggaccggacgaatctcctccgtcggatcgtccctcgcggctgatccaacgctcgaggagtggccccatcctgtggctggtggtccccacggatacctcgcccctgcatgactcgtccaattctcttttactcatcatcatcaactattagtcagttcatcaatctgggtacaattttcatcaattctctttaatctggatcaggacaacttccatacaatctccacacgaatcgacaaaaattctagcattttcaaatcccagattaaaaaaccctgtaatatgacaatatcaagcctaatcagaattagctgacctggaatttctaatattacatggcaagataatatatgcttatttacaacttaatctagtacatcgatcacatcatgttggcaaatggtatgatgatgttatcaagcttagaaggtagcgacctgctgctgctgctgctggccttgctgtgatccgccgattccagtgctcgtgatgtctgaagggccatctcagaatgaagccgcaggcaggtcatagccatcttgaagacaaacatgccaatgggaggagttagatgacagtgtgaaaagttactgagtttccagcttatactgaattggtttctcttttaagtaaaaactggtttccagcttataagtaaaaatatgtcctgtttttcgttacaaattgctgaaaagagctgggtcactgaatttgtatacgggctgca

SEQ ID NO: 80906 - DNA, 776 bp, Oryza sativa
aagtgaagtctgtaggttggcagaggccagcactggttctgcagaatgtgtgatccattattgatatttgcatggggcacattaccgtacggcctgtgagagcctataccgtgcacatttcatggataatttatatgagaaattgcctagccaaatccccaagcatgtcgtcaccactggccttgagggaaaacttagtggaaggatgcttagcgcaccttggtgagtaagagcattgcgaacacagtggtgtagaaaagctagtggcaggccattatgactgtgggtgagtcactgaattgaatgggagcagcatccaggggttgctgatataaagaaaagactgatgataggaggtgatctgattctcgaagcttagggggtttagtagataaactgggtacttcagggtagttaaaatgtattttttttcctagtctattatttttgtcttagcaatgctgtaccatcagcagttctctattaaatcctgataacagagagcaatctcatcatatgtccgtttcacaaagactgttgttctagcattcaatttttttatcaaaatgtttgtcattctcatgttccatgcatttttatcaaaatgtttgcattggggatgccaacagtcaggagcataaggggttcaagctctgaaccacacaatttatgatagctttgggacacgtttgggatgaactaaatgagggtaaccatgtcattttccacaacttctttgtctgatatttgctagatcaagaatcttgggctgcagg

SEQ ID NO: 80907 - DNA, 3924 bp, Oryza sativa
tcctgcagcccgttgcaaatagcaagtctgccaagctgtgagtgatcatgaacacttacccttactgtaattgcattgtttctgttttaattttctgtgttaattacgttgcaatcactcagatatggtagcgtcaaccacatagatgagaggtttcggcacagataccaggtttgttgttcaatatctttagtgtagttcatcataatgttactcatggtgttttaattgcttttttaccttttttttaaaaaaagaactgtgatattgactaacttcccaggtaaatcccaatgtggtgcaattatttgagaacaatgggcttcaggttgtaggcacagacaagaccggagaaattgtgcaggtacaagctgaagaacccagcttgcttgaacaaatttcaacttttcacttttccattattcatgcatgctgatgttattgtttgtccaattttctagatcgtcgaaatacccaatcatcgatttttcgttggcgttcaatttcaccccgagtttatgtcgagaccttcgaaaccttccgcactttttgtcggtaagctacttaaacctctgtaaacgacccaagggaagttgatatatatctttcttttgaaaaaaaaaaaagttagcgatgtaatatcaacataccgctttctcgagtaccgtcaaaatttctctttgacaatctgatcaacatgtataccgacctgcaggactaatcgctgcatcgtgtgggcaactggatggtgtgctgcaagatgcggcttgtaaccatgagccacagcagaatcagcgtgcagagaagcgtcctgctgctagtgatctaggagattgaacctgccgcagcaagcggcaagtgacggcgtgctctgattcaaatgaccctgatgaagcaccggatgtcaaaagctgttaattgtagttgccgtttcttgatatcattgttagtaagaattttgtaaaaagaaaaaaaataagtatgtgtagcagtgttcttataatggaaatgggggagaataatcctctcttttttaaaaaaaaaggaaaaaaaaagtaaaggtgtgcaacacatgaatacatgatgcattgcatcgtcaccagtagttcttcatgtcgagatacggactaggggtttttttgtccgaccttttctccgctcttcacaaaaaatctgggttttttgggaggtccgtggatgtttagaaaaaaaaaagtaagctcttctaggttaatcagcatatctactggaattcaagctaatgcaaccatcggattcttcaataaatatgtgtgctaaataggaactgttttacatttgctagcatcggaaggctacatgttactgctataattgacaataacgatcgcaacagactttgcagacaaaatgaagtcgctgtgataaccttatggtcctcactaatcctttgttcagtattttcaccgttatctggtcaggctcaataaagtcatccagaagttcagtttcatcagcaccgccactgttactagatcagaagttaatttttatagttgaaaccagtgcatcccttaataagatactcttactgtgtatttagtcatgaagacaatgaggaacaagcaatttgtttaattgtttgttgaaatcatcagtttgtcagattgagacacatactacaagttattcattggccgtcaagtgctttaattggaagtaaatttcaaactctttgggagatttctttggaactggatcggctgaaggacctgtggaggcgataccgaggcactgaggcagtgctggcccttggcgtagccctcccaatccatggcggcctccccctggcccctgggtaggttttaggcgcctggtggtggtggatcggtgccggtgggggatttgccgggtcggcgaaagaatgccgaccaaatttcattaagattgagagtaaaatacatgtattccgatattaaactgtcgagtcaaggcaaaagccttgaaacaaagtgagaaaaagaaaaggggaaaactatgccggtggggggattcagcgagttgaatgcggacaaggcggtttaataaccggaatcagggtacggttatgtatgggttatcccgatcaatcgtattcgtgtccaattccaaatggacaatgcgtgcctacttaaattaagtaaggcgcgtttaataaccaattaagacaaggggatatactacaggacatacagatcaatcatggcggcagtcttctgcggggacatgatcccggtaaagttgtggtgggagatcctgctcagggcaccaaccaaagacgtcgcccggtcaagctgcgtgtcaacgcagtggcgcggcatcgtcagcgacccctcctttcggaagctccaccatgacaggcatgccgtgcccaacctcaacgacggcatctccgacactttgctcgtcgccacgtctgacgtcgacggtgaaagcgtctccagcgtcttcccggctgcactggtctctccggcggtgacgggccaggcgcccatctgccgggtcaacaacccatacggctacagcctcaccaacgtctgcaatggattcctctgcttcgcctcctggagcagagccaaggtcatcgtgtgcaaccccgtcaccggcgagaagctggcgctccccagggctcctcaccttggactcgagaagcgtcgacgttactcgcggccggtcacgttcgccttggggttcagcccgaccaccggtgcgtacaagctgttccgctttgccgaccgcaggatggacgtgtacacgcttgccgctgctggcggttggcgccaacacccgtttcctcacccgtaccgcgtggtacaaaatacgccaactattgttgtaggtggtaagatatgcatgctgacagccaacccggcgtcgcatcagcacccaaacgatgttggcaaacccggtccggtgatggttgtcgatgtcgcaagcgaggagtaccgcacgtacaacccagcggactatgggtgcctgtgggccgacatggcagtgagcggctttgagctgcacggacggctatgcctggccatcaggtctgatacggaaatccatttctggaaaatgcctgttgaagaaatatccatgcgtgcttggctcgatggtgatacccacacgttgtgctacggagtggacaataagttgtactccaggtatgtcggcacaaccatgacgatgacaacatcgctggcggcacggtgtctttctccgaccgaggttatgtcatgggactgcaaaatccgtctccctacgactccaccgtggttagtgtcgtgcaactggaacatctacacgggataccgccccagcctgctctcgcctctcacctttgcgtcccagcaagataacaacgacgatgatgaagatgaaggcgacgagtcccgtccattcgtccgcagattgttgtgtgcactacgacaccagaaatcgcagaaacgccgcatgtctccaacatcaaccgatcataccaacggcaagagagtttgctatagaaatccatgcatatgctaatgtaaatatgtaattccccgatcctcgttgacaatattcacatagaaattgtattttaagcagtacaaacaatacataaacttatttatgtggtggattcaatcaatcctttccggcccaaaaaatatggcccacgtagaccacatccccttttaggcggcccatcgagctagcggccagaccgtacttgtaccgtctatttgaatttttttcatttttaaatttttttcttttaatatttacagaaataatctatggcgcaaaaaattacaaaaataaacagtagagggcggcaagctgacgtggcagacggcggctgccgccatctgcaaaaattacatttagccccttgccgccctctgtaagggttgcaaggggctaaatgcaattttc

SEQ ID NO: 80908 - DNA, 7475 bp, Oryza sativa
cagccaaaaagtattaggcccgggttggctttttttgcatgggagccccttgccggttttcgtcgaaaaaaaaaaccctccctctcccgtcaccgcccgtccctcccctatttgcaacgtcaccgcccgtccctcccctatttgcaacgtgcgcttgcccctcccctatttgcaacgtcagcttgccgcccgtctgccattaccgcctgtccctcccccgtttgccacgtcagcttacctctcccgtcaccgcccgtctgccgtcaccgcccgtccctcccctatttgcaacgtcagcttgccgcccatctgccgttaccgcccgtccctcacccgtttgccacgtcagcttgccgccctaatggagggcagtagggtctatttttgtaattttttgcgctgatggattatttctgtaaatattaaaagaaaaaaaattaaaaatgaaaaaaattcccgtcgctttcaactcgcagcgctgatacctggccgtctccgggggatcggtgaccactacggcgtcctggcgctgtggaacccgctccacgcgccgttacgcgacgtgcaccgtacagcggtgtggcccttgagatccaaaaggcatcaagacaggtaaccacaaccctctaaaaaagaaaaatatttggaaaatatttgccccttcgtgtgagagttctgtgtcgtcgtacgtacgtgcgtggtgacgtgtagactcggggagacgtgagacgagtcaacacagtacagatggggagacgtgagacgagtcgagacaggtacagatgtcacgttttgaactagctatacacaacctgttctgttgttcttgtgttcatcaagctgctagaaaagaggctacaggtactacagtcggatactctagtgtgcttctttcagaacaaacgctcagggacaacagatcgatacataacacgagtgaaggtacacaagctaatcggagcatcccgtgatatgctagcatactacttaaccgtcgtcaggcagaagcagcaaggccgtcgagtcgtcgctcaatcgctcatcagtgtgtcgtcatcaggtgaaaaccctcccggcgtgcgccgtagtcatcgccggcagatcaacctcccggagatcggtcttcaagcccttgccggcggcattcgccagcgggtggatgccgtgatccgggccgctcatgtacgctcggttctccctctccttgtcgaacgacacgctgaacttctcctccacacctgcaatgcacgcaccaatcaccaacacaagtagttaagctgtgacgactgacgatagattggagaaaaaaacacaattgaacatgaatgattttgcacgtacatttggcgagttcttggcggagctggccgtcgcgggtgagagccatcatgatctggggcaggccgagcgggagcgcgtcgccgcggtcgacctgccagaagtggatggtcttgccgtaggtcttgcacaccctctcgaggtcgcggcgctcgacgacgccggggacgccgggcatgaagaggacgccgcccttgacctcgaactcgtgggtgtgccacagcggcttctcgtcgtcggggagcgtgaggaacagcggctcggcgacgatgtactcgacgccgatgaggcgcgcgccggcgtcgggcccgtcgaagatgaggcactggcgcatgtcctcgttgaggtgggcgcagaagtggtgcgcctccacctgccgcgtcatgtcgtcggcgtagaagtggaacgcgcacaggtgctggtggatctggttcacggggccgaacccctggatgctccccgtcgccgcctccagcagcgccgtccccgtctccgtcggcttccccggcacctccacctcgtggcacgacgccgccattgctcaactactagaagctagcttggtgtgtgtgccgctggatggatgaacgagagagagactcgagtgcgagcgagctgttcttatggtgcgctgactcgcccatgcagttgcacacgtgtagttctggaggaggcacgtgtctcccgcgacagatgcttcgctgccgccggctgccacgagcgcccacgactcgaactatcggcacgaagcatatgggcctaagagcgatgaaattgaggtgtccattttcggcccgcggcccaataggattgtcagaattcagcccattttcctccgactaactccataaggtggtgggctagacgatctgggtttgaaacctcacccattctaattatttgatattagatccttctctaatattggcctttttttaagaggatttttagggtacattgtactgcaagtatatactagcagtatatatgatttaacggtgtagattcatctaatcttccgcccaatgagcctgcagtataaattgaatagggtatattagtttttttcatcttttgcgtggaggaatatttttgtattttcgcatttctttacttcttcgtcagatcccgctcgagcgaattccagttggagagttagagccgttccctttcctttgtcgcatgtttgaccgccgccgccgacaaccaccggaagcacgccgcgccccgcgccgccgcccccgggaatcgattctatttacgtcctcttttcatcctcttctatcattcccactcatccaaaaccttccttaactcctctattgacggctcgggtgtgcggagacggcattcaggcggagctgcatatgggtgccggctgctgggggcccaggccaaggcgcgcagctgcggcagtttgctccggcaaggctacacacaaggactgaacattaatgatgaacaggttcgaaaagggtacatatagagggcttcagatgttcaagatggctacgcaaaaaaatattttgatcctgttttggataagaatctgatactttcagtagtagcatgtaacattgaacgctcgacctcagtctttgtctctccctcaggaggcagaccgcatggaagtaacattttctgcaacaccagcagtccaaggaagcctacagaatcggcgacggccgggcatggagggcagaagatggggaggcagccggctatagcagcgcgccgcctcgccgcgagagggcacggaggctgatgctgggttccagccgccacgagagtagtgtacaaacacttcaccgccacgggttggggagtacaggagcagtgagactggaggtgggaagcggggggaggcagccagctcgtagcggtttgggaaaggctggagctgtgaggacggatgcggaggagaaagccacgcggggaggaatcgcgcagtcgtcaaacgaggagcctacaagcgcgtcgtcgtcagaacatgccccgaccgctcatgcgagatccaggcctccagggtactgtcgatggacggtattataaatctcaacttcaaatgactaataagcactttttaggtttttgacaaattcctattatacccataaatatactgctagtatatacttgcagtataatgtaccgtaaaagtcctcttttttttaagtgtcaccctgaagtctgaattctgtctgcgtagctgttagctctgaattctgatcagaaaagttcagtatatcttgcgcccacatgtattggtatcacagaaaccaaaacaaacaagatgactctggcataagcttaaaacgaaccgctgaccaagatggtaaaatctttgtacacgtacaagaagaatttttaccaagatggcagaggaggagcatatcgatctcatgtaaaaaaggaaaatggtaaaattctaaactatcaagccatattctaaatgatgataccgggttgatcaagatggccactgcagttagtcgatggaacttcagaaagctcaagcttccctgtccactcctctcccggtttcagagtgatttgtctctccgctgcagccgcatcaacgcacagcatctgtttgtactcctcatcgccgaagtccacgatgtttttcgatttcttttcccacggattccacacaactgggaggaataaagcgaatatgatggaaatttttcaagcaaagttaccatggttaggtggcaaagagaatattgtgtcttaccaacgtcaggcagtccttcctttcttatgacaaatgtgcgtttcttctcatggtccagaacagctattacatttggtgagctaacatagactcggtcaacctgcatatgtttgcacatagaccaggtgctaacaccgtaaatcttggactttatgatgtggcaagtaaatttttacaacaaaatgtcaaaacaagatttgcggaatcagtagatcaaagtatatagcgcatatgattattcaaacatttttcacctccgattcaaatgttatggcatctccttgttctgtaaaacgttctctctggctaagattatcgagataatcaagtgtctcaaggccttctatcctcacctcactggaattaacaagatatataatctgtcatcttcaaaatattatatggcaccaacaaaaagtggttgaagtacaaaaagaatgttgggtgaaatgcctgacctgatgtcagaaacagacagatatgtgtgataaccaaatgagaaactgaatggcttgccattaacatttctgatgcgtgatactagtgacaggttcccatcctttgtaagagaaactctcaggcggaactcaaaactgaaatcaaatattgcaggatcatacataaaatcaaattcagtcagcattaacaacgagatgaggtgcaaatgttcaacaacctccctgaaataaaatattctcctgactattatcatcaaaagtgccaggattaggctgttcaactaattacccccatgatgcagtacataacaaaactttgacatatggcccttactaacaaaaaggcgtgctataagagaaaaggaaatacatattggacaaaaacaaatgcatacccatgtggccagcacttcaggtcatcttcagatggctttagtataaggtcaacagaagctttgctgttgttatcattttgatttaatggtggatgctcctcatctagggcccatatcctgtttcttgcaaatccatgttgctccaatgttccagaatttccaaactgcagtgagtcttgtggatatcagaaaagaccaaaaagaagggaagctagcttccttatcaattggcatcctatttgtaacagtatataatacaaatcttcagtgcaatggaagactatgatacctgtggaaaacatatcgggattccaccacgcatcgcctttggtggcttgaagattgcctgcacgtcaagaaactgcgtgttgaagccagtgaaagagccatggaagagaatactgaagatttcttcagtttcccagatggaaacagtgaaacagttcaggtttttgtgtcttcagagcccgtctgaactgtccttccacaagtacagtttaatgttcagagtacacacttctcaaacagaatcaatccaagaacatatcccgcgagcgtacagtttgaattctactgcaatcaattgaacttgcgaaatacacttccctaggctaatcgcagtaatgtgaacccggttgcagagcactgaagaatcgaaaaatgaattgaaaaaaaaaaaacgtcaccttgctgctggtgaagagaagctcctcgccgcggtcgttcctccaggagaggacctgcccgccgtgcaggctcacctgcaaaacacacaccacgacgaagaaaacaaagccatcagaatcgcaccaaaccaaaccaaaggactcaatgccaacccgatcaaaatccattcgcaaagacctgctcacccgcgagtaggcgccccccggcgagcggagcacgacctggtagacgccgttccagtccctgaccacctccagctccgtcctcggatccgtcaggttggtgtagtgccccatgctcatcaacagccagccagccagcccgcgtgaagagagagtagaggagaaggagagacgcacacgagcgcgcgcacgtacgcgtacgagattttatggcgacgcgcgggaagcagtgggcggcgtcgccattgggacggttggggttgccacgacgttttacactgcgcgtctgcactttccttgtgagcgcaaaaaaaaaaaaaaaaaaaaaaaaaatgaacaccgcgcgagcgcgcgcgcggcctgaaacccgtgagccaccggccacaccagcgcagcctcagcggaagccaaagcttctgcaaccaaccaaaccaccggctcgctctcgctcggagcagcaaattcacaaggcacgccacggcaacaacaacaaacggatcggatgcagcgggaaatggaaatgcacgtggtggtcagaagcgcagcgcagggcaaccacctcgtcacgtcgccattggaagatcgagatgagggaggcgaggcgaggagagaagcacgagtgggtgaagctctagcttctctagtgcgcgaggaggatgagaggatccgaggctaggagaggagaggttgatgctgataccgatggcttcgtgcacccggcagagcccggaacccggtaaaaccaacccagcgccgcggccatggaggacacgtgcagtcgccgctttttcgttgagaaaaaactaagacaaaccgtgggggttcgaccactttgttgcactttgcaggtatagaaaagtctcaggaaagaaactgagaaaggaaaaaagggtttcatcgacgacgcaatgctgagtaggagaaagaaattttgaaggaagaacgaggaggagaattaacagattgttttggcttctgccttgtggataataatcggataaactcttgcagcttttctcgtgtcctgccttgagtctgcgtaatgtaatgcctgcattttaattttagccggttctttttaatttcgcggaggagcccacgctgcaacggtcaagttttctcctccaagtttttcaaaggcttttttggcgtttcttaagccttccgcttcgccatctctctttctttactcctttattataatctttattctcttctttaaagcagaacggcagattagtagtagctactataatcaacaagccttgttctaaacatggcgtctgttcaaacatcgaagtaatgtgttcttttgttttcggagaggacaaatttccagaaacaaacgattcttatgcgtgacacgatctctaaataactttgtttgcatgcacacataggccaggtatgctttgttcacagacagtgcagcgaaaggaacacttgcgttgcttcaggacctggaacttatccatggtcgccaaatgtacgagtgccgtgctctctgaaacctgcttagaacaggggcctctcatttacttacatcaacccagtgatttaactttttttaacttaaaaaagaactcaatgattcggacaaaaatggtgatccgaaaactgtttaagcgaatctttcggaaagggagaagtgcagcgagtgtaatccacaagtcag

SEQ ID NO: 80909 - DNA, 6269 bp, Oryza sativa
aacctatctatatagggatgtgaatcagcgattggacctactatgaataaacaagaaaagggctgaccaaagcctttagtgtgccacgagaagcccacacaaccagagagtgaccagcattattcccaaccttacgacctatccttgacccaatccataacattaacccggttattttgaaagagaaaaaaaagaaggaaatttgagatcgtgataacaacattgaccgtaagggtgttgagattgatactgaagtggaggaaaccttctagcaatctaaccaatttgttgcagcacaagctgggctcatgttcatccatcactacgtataaaaaggtcatatcactctggcatgtcaagaatcaagatgctatcgctggccttatatcacattgctggcaaagctctggaatggagtacatcgtgcttttgctgctatgcttggcctacacaaaactgatgctccgctaatgcagcccacatgaagcctccagccccccactgccatgatcaacctatgttacaccccctcaagcccaccaccacacacctagcctttattgttgcaatcatgtcacaccgattatgcgttgcaatcatgctgcactaatcgtagccaaggacccataaggagaaaatatctcacttggaaacgacaaagatgaccaatgatgtaggaaaaaaatgggtaaatattaatttgtttgttgaagaagtataacttgtttttgtccaagattcgtttttgagataacagatggagatgggaaattatttctgttctccatcatgataaatcgactactacaactaagtttttaaagcaagtgcattgttttatatatgattgtaaatagaaactagatactatcaaccaggaaccaggaactacaatgaagctgaatggtgttctgaagaagcaatataaaggttgatgctatgaagaaattttagcacatcattaaaaagaacatgatacaccaaatgttgaaaggttcagagacatacctcaacaagggttataccctttggcccttgagcactgatcatatcatatatacagttttctaaagagagttccataatttggtcagttgcctgccctttcttgccaagtttgtagtttgaggtttgaatttttggcagaaactcatttggatcaaatttcttcaaaagacgtaaacagggaacaatctgaaaaagatgagcatttttatagcttatggtcaacaaggtatgtgaccgagtaaatgattaaagcatgagtgaggcacaccaggctgataactatgtcactacatgcctaacagatcaaattattgcatgttttcattgcagctgtgaaagaaaatatagcataagtgttgcagttgccaaacagatttggatggaactgctacagtcctgtaagcatgctagaaggacgagttcttagttgtctaaccatgtttcaagtaaaaacttgtgcactctgtttcagattattttaaataaaaaatagaactggaggcatagcctttttgttaaaaagaaaagagacatgaaatttggtaaaacaaatttcaacctgcatccaaaccagggtatgaaaccgtgctggcgatttctgaagaccgaaagattttcaaaacatgaaatcgattattttgaatttactgttcttgaccaaaaaaaccaccaataaccagaagtattaagaccaaatattagaaaaaggcatataactgaaaagactacaaagtgggaggaaagataatttcaccttatcatcaactttggcatcaaattcttcaacaaggtgtgcgtctctaagcctatgcagtacctggagaaaaggtgtcgcggtaacacccaaataagtgcaaccataaagtgtataacacaaacaggaagtgattacaaacaaactcaaatttctccatgctctatgcccaaatgtcatcctgtaattgagatcattttttatgtctgacacgacaagaacctataggaaatagttactgaaggttagaaaactggaaaaatgaaaaagaacaccgaacaaatgaacagaacaattgacccttccactagcttcttcgagtttgtcacaaatggctttcattgctggaagataatcatggatagatacatcattatcggagtttacaccaaaagtcccatcttgtagatcatctatgttggtctcttcattgctcaccaatagtccgggctttataatctcaattctctggtgtgaattcatacagtctttggcatatctagtgagatacaatgagttggtattggttactcgtttattctgtgaagcatcttccttctcagctccattgcctttaaactttataatagttgatcgtctaacaattaacttctgggactgaaggctttgcacaatataatggaagttgttcccttccatgccaaaacttttgcacaggtcattttgtgttacaccagaagtcctatgacaaatacatgatataagttattgcacacattatatcaaaggcactatacttagttagtctatgaacgtttgataatttgaccaaatgtcacacctgacacaccagatgataatttgatcaaatgtcacattgggtagatgttgtgaccaaatgccacaacagatgataatttagaccaaaaatgtcacaaaaccaggacgaacctgcttgccccgacacgttgtaaagccttcttctggacggcactcatctccgatttggagtgcctgagatcatacatgccaaggaagttgtccctgagcgcggcgctcgcaaccagccgcatgcccagccgctcggcgtcctccacgccgaccttgggatcgtcgacgaccggcccctccgcctccgcctccgcctcccccagcacgacgctgatgacggggagcacgatgaggcgggcccagacggcgcgcttgacagccggcccaattgggaggccggccgcctcgagcgcgccacggagcgccgcccagagatcggtcaccgggatgccggccgagaggcgggcgctcacctcctccagcgccgccgagacgagcgcgtccatcggctaccttccgctagggttttagctctagccgcatcggctaccttcggctctccacgagacgggaagagaggattgcttcgctatgggctatggcgagtcggcgaggtggaggcagcgcgcgacgatggccgcgcggcggcgccgcgcgcgcgaccgacggcgagatgaaccggtgttccgtgcggttcaggcgtgccacgttcacgcgctgttttgcgaataggcccttgaatttaaacaaaagtagtttccgtgttcttaactttttattgtagtccctatatgtccgctcgattttatttttatgttttgagttttgattttttaattttaaaataatcattctaaaacttattttaaaaatacttcttttaaccacatcaatcagtgggactaacatagcaaaacatcgctgccacactcatctaaggtagggatgaaaacggtcggaacgatcggaaaacagcctcaaccatttccgtaaccatatttttcttggaaacgaaattggaaacgataaagtcggaaacaaaaacgatatcggaaatatcggaaaaccggaaacggaacaatacggacggaaacatgtcggtacagatcggaaaccggtaacaaatacggaaacattaaactataaaaacatatatttaactttacataagtatgttatatatatatatacataaattcaagcttatactatataaattataaattaacttcattttagccatgtacaaaagttagagattttattgaagagtcattcaatctataagctgtgggttaagtatagacatgtcctataatatcgacatatttagaatacggtaattaccatattataagaaacggtaatttccgcgagaatacggtaaatacggaaacgatcggtataacagcaaaaccatttccgttttcatttccatattttttaccatttccatttttgtttcggtcgattaccatttccatatggctcggccggtagaaagtcgaaaacgaacgccggtcggccggtaattaccgttaccgttttcacccctaatctaaggccccgtttgatagatttacaactcctaaatttaactaccggagataagatctgaagtgaattgtagagtagcataacccaattccacctatctatttttttttataacgctccagctagctctattccgactttaggtggagttagagtcagagtagtgtcaaacaagacttaaatgaagtggcagcgttatttgatcacgccatgttaactaacgtgacaaaataaaactatcatgtccactacgggtgatgtaattttgtcatgctactgttttagaatgaatctctatctccactaatataaaaattaaagatatttttatcggtactttagtacgtcatccgtgtataagtcagttttaaggtcattcgcttatttaagtgagtttttaagttcgttcgcttttgaaaatattggagcgtataagaaatctcttttaaaatactcgcatgctaacttgagacgttcggactcctaattacagctcatgattttgtaaaaaaaaatattcaaggtaaattttaccttagctaaaccgtacaacaataataataaagattaaaatagtcttcgcccgttacaacacaccggcgttcttttctagttatttgaaaattaaaaagtaaaaaaaaaagttgaaataaattttatccgctccccaccaagccagccagccccactgcccgacggcacccggccgccgccgccgccgcctcctcgactcctccgccccgccgcgtcgcacccgacgaccggaccgccgtctccgcctgccgcccgcacggccgcacccggtgagtggctggatggatcctgtttagttctttgcttcctcggtatttgagtgaaaattttgttctttgatgggtttgggcgcgcgatttggtgggaggtgaactcttctagattctccactgctgccgaaattaagctgtgatcgatgttcatggtactctagaatgatacgcgagatgttagggtctaggttccccattgctgccaaattttagttgtgattgatgtccatggaactctagaatgatacacgtgagatgttagggttgtgcgattgcgcaaaactagttgtgtttgggcatattgtggatctgatgcagcaggtcataagactgagtgtgtgtgatctggaagcactcctcattctttttagtcttgcatatgctactgccgcttggttctgtgcttcactactgagtactatgcccattcatgtctattttcctgttgttgaaattaattaagctacatttgtggccagtcaaaactgctcaactggttgacttctaaatgatacagtttcttttttatcatagcactgtgttgatttcgtttattggatccctcggattgcaaaatgcttgccaaagggaggaaagttgctggaaggggtggagacatgtctgcacactatgcatttgggctgcaggaagatgatgcgatcattaaacgtaggcttctgaccaggacaacaactaccaggggtgaaccaccactaaagaagcttcagaagaagttcatgtcctttgccactgaggttgagaaggatgctgacaacataagtgactgtgagaggttgtacaaggcctttttacaggaaattaatgcttttgtgttgcctcttcttaagagcaaggccgtggttgatgcaaaccttagggagaaggagagcttcaacgagctgcaagacgagattcagcgacaaatcttgcaagctcagactgatattgaggaactcaaaaagaaactggaacagagcagaattgagaggctgtacaaagaggagtgcgaagcgatcagaaaaatgatttctttgcagcctccacgatcggaaacagagaagctcatcgcgggtcttgagaaggagattgctaatttggaggccgagaatacagcatgtataaggactctggaactaaggaagaagcagctttctcttcttcttcatgtggtgagtttattcgtcaggttccttttgcttttctgaatcatgccttttccctttctatatagagtggtaagaggatactcattggaatttattaatctgcatggtaagcttaaatgatatactacttttacaaacattgtttcccgcaagaccgcaacacaaaactacgtttaggaaaaatat

SEQ ID NO: 80910 - DNA, 805 bp, Oryza sativa
tacatccaaacatatgtacatagccgaatgttatgtatgttagattatgatatactcccactatttaattaaacaaaaatcaatattgtaatatgtaagtacttagaataacataatgaaagctatgagctttcgcgtacaaatgaatgaataaataaataagtctcattttttaagcaatatgctagctcttgatttgtttacttaaagccatgttcttgtggtggttgacgacagtatgtttacgaaaaagagagaaggggagactacttgggtcagactgttcaggtgccaaccacttctcctcaattcttcttaatttgtttttcaatttttggtaaatttaatatctacatttcttgaaaatccaaccaatcatcatttttttaaggttatcccacatattacaaatgagatacaagattggattgagcgtatcgcgatggttcccgttgatggtgaggtggatcctgccgatgtctatataatagagctcggtggcactataggtaacaagagacaattaaccagctgcattttattcttaacaaattcttagagttacataaatttttggacttacaagtcaatttaaaagctatatatcatgtctttattttcagtttattaacagtatttgttcgacactatgctgcaggcgatattgaatccacgcaatttattgaagcctttagtcaattctcctatcgtgttggtaaataaattgaattattgcataacagatattttaattttctccatggtgatatgataaccttatttgcatgttatttttggacaggtg

SEQ ID NO: 80911 - DNA, 1044 bp, Oryza sativa
aaggtatacgttagaattacagttattaatttagggatggaggttagtacagtagtaaactaaaacatacacaaacatatataggaaaaagagaaaaggaggaattagcagcacgttggttgctaggagtactccagtacgtaccgatcttaatggacgtaacgcggaggccgcacgccttgaggacgacgccaatgctgctcgccgtcacccccttgccgaggccgctgatcacgcctcccatcaccaccacgtacttcatcgtctctatgtacctagcttcttgctccttgggttaaaaacctaacgcagccaacaaccaaaggtaaattaaaattacctgatcgatcgctcaccggccgtaacttcagcccttttattagccgcaacaagggcagagctggactcggactagaatttggtttccacgtcgacagtgcgtcgattagcattcagttaggggcttgtttagcaaataataacaaccatacatgttggaataatctggaggagtatatgtcacaccatgatgttctgttccttcagacaaagggcacacgattacaacttaggactgaaattacaactgaaactacacgagagactctggccttctctctaaaaaaaaaactacacgagagtcatcatgtgtcagggtgtaattaagcaacctacaagtctaaccaaggcaattaagtgctatatagccacaagaaaacgtatctgcctttgtggaactaggcaggcatcgcgcttttctgctaggatcagtctaaagccatggcatctgaagcatcgccgctaccttcatctgtgctcatgttctgctgctcttcagcgccagctctcagctcatccgctatgctcctctgctcatcttcgattgagatctgcaattcctcgacctgtaatagatacaacatcagaaatcaataggcatcagccaaaacaatgaactgcatggcatgattaaaatagctacatatagtcttccaagttccttcttagacaaatggatgctaatagttataatttgataaaaat

SEQ ID NO: 80912 - DNA, 1232 bp, Oryza sativa
gaggtgtacatctttacccacaagacacatctttctcacgtgcaaccacgtgccacataccaccacggtatacagacgaaagacgtgacatagtttccaacccatcctagccatagacaagagtaccgacccaatcccgcctacggccggaacccccgggacaggcaggcagaactgagcccctcgcagcagggcaccaaccctgtgccatgacatctcgactaccgggccgcagctcgtgtagccttcatttgccctggagaatgtccatcgacccccgacttcatccatctccaatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgggggcttttgaatagagggagcggtgtgaatccaattccacaataaaccaacaattccaaagtgcccaggtgatatgaatattcccaaagtctaaagttgtaaaaccacctaatgttacctaattaaattgcgaagcatctacctaaaatcatactagtgataccacgagtagagtgtccactagttggggttttgtttaatctagggtgaacaaggtaataataacaatagcaataataataaggtcataacaaaggtaaataggcatggctaaataaaacagtgataacgcgggaatttaaataaagcgataatgcaataatttaaatcaacataagtttataaactgggattcaatatgatcaagatgatgtgtcttgccttgctcgctttcccaaacaccgtcttcaacttccacgaagagcggatcttccgaagctacagcgtctacacgaccaacggaaaagaaaaggctcaaactgtcacgtcctgataaattcatcccaaaataaaaatcattttcaaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattgaaaagaaataaacaaagttgaaaaggtttataaaaagaaaaatccctaaaagtcttttttcccccccccttccttctt

SEQ ID NO: 80913 - DNA, 4014 bp, Oryza sativa
atgtcatatggcagagggttggtcccctgctgttaggggctcagtcctgcatgcctgtcccgggtgttccggccgtaggcgggattgggtcggtactcttgtctatggctaggatgggttggaaactatgtcacgtcttccgtctgtacaccgtggtggtatgtggcacgtggttacacgtgaggaagatgtgtcttgtgggtaaagatgtacccctctgatcagagtataatctattcgaatagccgcgccctcggttatgggcaagccgagcaatgtacccaagtcagtgtttcaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggattgtcttataaaatggctttggggcaactaagtgacttttaaatgctgtttactgcaaaacttaacccctatattattatccccttgtactcccttgcattaattatgcatctccggtgtggcttgctgagtactgtggttgtacttattcttgctcaatctttcccctcttcagtaagagaagctttggagaagatgtcttaggtggagtcctggcttataccccagttgagcgcctgtgaagattgagccgtaggcccgctagtccgctgctgtttatttttgattgtcaggccttaagtgcctttgtaataatgtaaatattatcgatataataaagatgtgtcttttataccatgtttgtgtggtgtaccccggcttttcctgggacggggattaatacactagcgttcgggaaaaggcaattttcccggtcgcgacacaaacactaataaattccacataacagcagaaacaaagcacaaaaatgggttcttcacttcttaaggaaaaattagagacttgaacggtccaattccgagttcaaatggccaagttatggccatttgaagtttatatgctctttaaatggatatttgcgaatttcttcatttaaattttaatttaaaaatcgaattattgcgtcagccgagagagagggcgcgcggaccgggtccacgggagtggggcccacgcgtcagcctctcggtccacggtggaccgggagcacgcggctggcggcggtcggcgccgtgggtcccacaagtcagccgcacccgcgggcgcgggcggctgacggccgggccccacctggcagccgcgggaggcggccgaaggcggcctcgccggcacggccgacgggaggcggcgcacccgctccccgatggtcaccgccggcgaccaccggcgcggcggagcggcgcccgagagagcggagagaagagggaaagcgaacggcggtcctcggctcaccccgggacgacgagggcggcggaaacgacgaccgaagcggcgagaggcggcggcgcggttcgggatgacgagggcgacggtgctccggcagtcggcgggcgaaacggaggagcggacggggtcgacgacgacgcggcgaagccgatggaggtggcgccgagtcgggaggaagtccggagtgacgacggcggcgaaccgaaggttggcggcgacggcggagagagaggaggacggcgctagcacgaatccgacggcgagagcgagcggcgagcggcggaaacggaggagagaggcacggggagcaaatatatagcgccgagagggggagagcgcggccggagagggaggaaacggccgcggagatctcggctccattgaagacaccggcgacgattgcgggattcaaatcggacgaatccgagggagagagagagggaaaagagggggaaacgggagagggaatcacggggagtgatttccccctctttaatgcgcgcggggacggcgggatgcggcggaatccgcggcggcggcggcgctagggcacgggcgggcggcggcgcggcgcgaggaggaagatgacaggcgggacccacccgtcagcgagggtggcgggcgggcccacccgtcagcggcgcgcgcgcggggaggagccgatgggccgcggggagaggagagaggggggggagttgggccgagccggcccaagaagggaaaaggggaggaaaaggacttcttttagggttttctttttttataaaccttttcaactttgtttatttcttctcaattattatttgtgctctgaaaattccactaaaatttgtttaagcattttaggcttttaggaaatatacaaaaatcctccaagcctcatttgacttttacatttgcacattttaattgttggaggctttcacatgaattttaattattctttgcacaatttcgaggatagattttagagtcgatttgggacgcgacacaagctaacacaacgatctaagacaacgacttaacaagtcattctagttcttccgagcataggaggtcgattgaaggctcgttcggctcatcttcctcatctttgatagctacccactcaaacttggaattgttgcgcttgggttcttcttcttcatcactacttatgatgatgaccggaggatttgctggggcaacttctttctccaccacgcggacctttggcgccaattgatagcgagggacaaacaaagctctcttccttgcggtaagacgaatcctagccttctgcggcggtgcttctcccttcaatgcggctaattccttctccaaacgatccaccttgtcttctagcttgcaaatcttaccacgattccgatcttcacgatcttgagctgctaacacagtctccgcacgactttcatccatagcccacaacatctcaaccaaatgtcttgtggtaacatcattctcaattccttcagtctcaaggtaactgccacggtcacttccctggggttggcgaggatgatagcgatactcagtgtcggccaactgatcactgtagcgatcacgaagctctcctatggcaatccttgccacctcctgacatgcatggatgtagtttcttcctccagcttcaaacatcactgaggggatatcttcactattgctgttcaaggtgactttgactcggcacttttcttcatgacgatcatgacgaatctgggcataaaaaggagcattcccaaatccaatgacaaaggacatcgtacgcaactcctggacaaaaccttcaactccaaacaggtactcaggcttgtaacacggcatctaaagacaagtgaaaggagagagttaagacatctatccaattaatagcacaagtttttggattaatttgaataaagtttgaaaatcaaagtaaaaaggtaagtaattaaagtaaaccaagctttgcgaaataaattaaaacagttggaaacgagatcataaattttgtaattttgaataactggtttcaaaagaaatgaaagaaaattataaaatcaacatggtaaatttattttattgcagcaagattaaataaaacaatattgtaaaacttttgctgataaatgagccattagtacagtaatagatgtacagtactaataacactggaataaatttttaatgagaaccaaaaaaaaattatgaagtgcatgtgccattagtttggttaattaaaagagaaagggaggagaacagttctacttttccaatatttttagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggggtagacggcttcactccacaggcagcttgaccaaggctacacctaatc

SEQ ID NO: 80914 - DNA, 2520 bp, Oryza sativa
ccattttgaatctctatacatgctgggtatgaactacttctctgttcccgattcgggatcaacaaacaaaactgtcctgatagtcctagatagcagcaatagcttcaaaggttcagagcgaacgaaaataattttcaatagtgctggcacatgttttttcagaaacatcgagtggtctcaagtctcaactcttcaaatcgaacaactgctttcttggatccacatcaacaaaataggatgtctacggtctacctaccaagatcagcgctagtatctacttcctccgtttcacaatgtaagttattttaacatttctcacatttatactgatatgaatgaatctagatatatatatctatctagattcattaacatcaatataaatgcggaaaatgctagaatgacttatattgtgaaacggagggagtacttccttgtcaaatcttcgtgccggtgtggaggccgacaccagcagagggaggtgacaagtggtggcgcgggcgtagagcacgggagtataggggatgtgccaccgtcgatccgtcgtgccggaaggtggatggaaaaaggaaggaggcgcggccgtcgcgccggctcgaagtacgcgaaaaaggaggaggaggagggagcgtcgtgccatgcgggctgtaggcattttgtgcctgaaatcggcccatggtctgaagtaggccgtagcgggctgcttcttgggtcacggttactctttcagctcggcaacagcaatagactcactcactcacactcacggtcacaccgatttctccctaggcgaccataccggaaaacccgcgactccccaactccgacgagaacgacatggacgccggcggcgaggaggcgaagcaggagcgccacctggtgctggctcacgagctcttcctcctctcccgccccgacctcgacgacctcgccaatgtcgccctccgctccgatgccctcgacgccgtcaagtccgatggcatggcgccgctgttcgagtcgctggccaccgcgggcgtgctgctcaagccggacgacgcagctgctcgccgagatgcgcgcgcggatcgacgaggaggtccgcaagctcgacgagaagtgagtggattcttcctctcttcgattttatttctagccccacaaaaaagaggtcgcccgttgctgtgttgcgtatgcctgcagtagtactatgtggggataggttttgtgataaataactctggtgttgatatgatccgtttgcctaaactaacctagcttgctctcggtgcggaacatggatgctaaagctggtagacagtggcgaagctagagcaaaatggaggggggttcgagattttgccacaagtatatcaatatatataacttcaagctacattttcgatagaaccgttgattaataattttttacatcaacagtagagacacacatgcatcaataaaataaaaaaagtgacaaacattgtttttcaaaattaagaaatccactaataacattgataattgagaattggttactaacccatgagcaaaagatgatctgcatatgcaaacataagcaaacaccattctatttcattatctcaacatcctcgacgatgatttgataacctaaaacaagttaacatcaaaatcagttctcatttttcaaataaaaagtagaatccagcgcacttagatacaatcattaccttcaatcatcatcaaatatgcgtccttgcattttcatgaagcgacgaacaacggcctcattggtgactttcttcatttcttctttctccacataacaaataaggctatcacttaagtactcatcaccaattttattgcacaaatatgttttcacattcttcatagctgaaaagcacctctcaactgtggcagtagcgacgggcaatacaagtacaagttttaaaagttgataaaccaatggataacaaagatgttttcttgtctccaccattatttgagaaagctcggcaatagtttgtatgttggagaatctaccatcatccctcacatcagcgatgtagagaccaagttggtggctaaggtccctcaaatttccagaattaaaatcactaggatacaattttgctaaactcatcaaattctctagattgaaatcatgaaatgagtctcttggactaaaagccgatgagcaaataagcaattgagagcttgtctcactgaagcgattgtcaagctcttgaagtatccaatcaataacatcattaaacaatccacttgatagtaatgcttgtttgtaattctagatttgtgcctacgcttcttgggatcaatatatgtatcttccatttccaatttgacaatatatacttgtcacaaaagtcagagacttcatctagaactttctcccacttttctcttctaagctcatccaaattgagcctagttgactttacacatttcatagcattcactatgtcttgatccttccgttgcaatgctagtgacaagctgtttgtgattgttaatatagtcaacatgagggctgca

SEQ ID NO: 80915 - DNA, 3551 bp, Oryza sativa
agagttttatagtgggaactccatcgagtatccccaggtctctgaagacattgctcttgattcaacccggttctagtttgaagttgcccacaacccaatgccttactcatttctgtaacattaatatctctaatcaaatcccttctcttagatgatccacccaccacattcagtaagatggaaatcttagtaaaaaaatcactaacgcctttatgttttctcacaatagccacaagaacctattggagttggtgagcaaaacagtgaacataataagctgaactattttccctcatgatcaatgattgcaaaccattgaactcacctcacatattgctagcaccgtcatatccttgccctctaacttgctttagacttagcttcagttctgcaaatagagcatcaatagaagacttgagataggcagaagttgtttcagtcacatggacaagaccaacaaatctctctctcacaattccatatttatcaacatatctcaagaccactgccatttgttctttgcaagaaacatctcttgattcatcaactagcaagcaaaaaacatcatgcccaatttcttctagaatagcatgtagcacttcctttgcaaaacatttcacaatatccctctgtatttcaggagcaaccaaaagactgttatctgatttttttgtacctattgcctttcttaaggatgggttttgctccgctgtgtaatcacgaaattccctgaagttgcctctgttgtagggctcctttgactcatcgtgacctcggaaaggcaatcctagctttactagcatcctagcaacatcaatggacccattcaatcgagtaagatagtccctcttaccagtttctctcacactatgaaaagcaacatcaatgtgctgtctttttttgtaataaatcatcacacttcttcattgcttgatagtgtgaaccaccgacatcacctacatgcaatttcaacctttcttttctatgaaaaccattccaaccatttttaacaaatgcttcatatccaccatccttcttttctctaaacaagaaatagaaaaaacaatatgctcgatttttggactcactgtattcaagccaacttccaaactcatcaaaccattccgggacaaaccttcttgaacctgtcataggaaaagcaaatgtgcgaggttgacaagggccattctccaagtatttccttctcaccctctctctgagattaggatggtactcatcaatttgttttcttaatcctggatcatatttaatctcatcttcccagtttatatcatccaaacatgaattacatgcattgttagcactattcggctctggcactttccttttgtaaaatcgttccatcaattaacctatcattagatgatttaggaggatgtaaatatatactgattttatcattcattcaagtacagaagtagaatgaaaattgatatgacttacatccaaatagcaccttcaactcaaattctcaaatttccccccaatctgcaattttattccaattctgaaggattccaaattgaaccctactggcctcctaattctacaatgtaaaaaaaaacaaccaataaaaattttaggcctttgtatctaataaatcaaattgattaaaaaagaaatagatgaagcatgctttcttaccttgtctctactaacgcacaatgtggctgtgtgctgatcagttgatggagatggatgatgtcattgttggcttcatggcttgtgaaagtgtggtctgacgcttgctcctggttagcttgttgcctggcgaccgccttcctgccttcctggctcctgcggctggagcgagcaacgtaggcactaagcaagcaggggcgacggcgacagcgacagtgagctgccgagggcgacggccgacggcggcgcgtcacgatgccgagatgggcaagtgttgtctgggagactgggattggctgattgcagagcagtggcgtggaagccaaacagatgcgaggcggagtcgtcaagattggcagcgacgggacgcggcatacgagaagtcgagaagagaaaagattgatctggattcgactctcctcatgggcttacaacgttaactggactgttgtttggactgtgggtgcactatattgggccaaggggggtgcatatagggccgagatatgggggtaataactaaaaattttgtttgaggggggttcatctgcacccacgggcctctattgggcttcgcccccgctggtagatccgtagatagcttgcatttgatttggtagttgtaaatttacgaattatgcttagggtcaattcacctctatataaatctgtactacataatactaataaactttctccacagttttgttttagattcatgtacatattgatgattttgtacattatctctgcaatgtgtaatttagcatgtagaaaagtaattgagattgctaaggatcacaatgcacaacatcccaactgatacgaataatttgtgtgtcccttttatccagaaaaaataccagtgtaaactaatgtgaaggaagaatggcatgttgaacttcgttagtaatatggtatcgatttccttggtcgctactttgttgtcctaggtaaattgttatacatgctcggtgtctgtatgaagtgcatggcaatgcatccggaagcatcagctgtcgccccatgtcttcttgatatgatcagatctaggtatgccaagcctaaaaaacatttccctgttaaggaattttattggtaagttaccattttgacatcaaattttgttctatacagctgtttcacaacatcctgaagcatcagaaggtctgtgttgtttgcagctttttgcatattgatagtgctgcacccattgtatgtctcatcagctcttatagaaggaaatcgggacatttcaactggtttggaattgatacacatatgggctcttcatgttgcagaagctgatcctgatacagaatgaatatcagtatgtactttggtcactatggggggatatatctgttatgaatcaccgatttgcattttgttcgtcaaagtagagcaattatagtacaataggctcagcacataatactaatagggtcatttttgaaccaacaaagaagtacagttgttcagggtaaacgttatatcaaattcatttgcatcgtctttgattttaacctgaaagaagagtattttcactgtgagataattcactatctgaaaataaagagctaataactcccaccttatgctttagtttcctgtaacgtacttctttctatcattccatttggtcttctattatactcaaccagtgatccagctcttttcagtaatgtgtagagtaaaaccagactagttttttgttcaactcataattagaaaaccatttcagtacactggaaactcagtaacttctcacattgtcatctaactcttccattgtcatgtttgtctccttgcaggcatcatgacctgtttgcaactctgttccgagatcttcagacatcatgagcactgaatcagtggatcgcagcatg

SEQ ID NO: 80916 - DNA, 692 bp, Oryza sativa
aagagcactagtggcgaaagataaagggcaaatgttatatccaattccgtctgcatcgcctttgattttagcctgaaagaactaataatttcactgtgatatgattcacaatctgaaaatgaaagagctaatatcactcatcatatgctttaattttcagtaacctactccctcctctcattcctttaatctaatgttatactcattcagtgatccagctctttcagcaatctgtaaagaaaagagatcttcaaacgagtagattaacaaaagcgtaaagtgtctagagtttttggaggcgtcaccctaaggtggccgtttttcttttcttttggggggcgttagctgcggctagcaccctgctcgactgtctaaggtcgattctgtaaccttcgtgacaccctctttcttcttaatacaatttgggcgacctctttcggctgtcccggcaaatctgtaaagaaaaacaggacctctttttaccttataaagagaaaccaatccactaagctggaaacgcaataacttttaacactgccatctaactccattggcatgtttgtcttgtagatggctatgagctgcatgcggctccattctgagatggcccttcagacatcacgagcactggaatcggcggatcacagcaagaccagcagcagcagcagcagcagcaggtctctctaccttct

SEQ ID NO: 80917 - DNA, 891 bp, Oryza sativa
catcgcccgtgtcttgtgtgtttccactttcgcgaacattccacagactaggagcttagaacctcacccagggcccccggccgaaccggcaaagggggacctgcgcggtctcccggtgaggagccccacgctccgtcatctgacgcgccatgtagggggttctgcgtgtgtttttctaagctctcatactctttcgtgtgcgccaagcttttcctgttcagcccaatggctaaacaagcaaaagcgcacaagctctctccgagtgttagcggtgacgacggggagccgaacccacgccgtcgagctcgtactccaccgccccctccacgccaaagtcctaggcgggaggaggcgctcgagagggtcgaaggatccgcgacttcgacatccacgggtgatggagaagggcgccgagatggggagcgtcgcctcctcgtctacggcgacggtagcacgccccagggcgcgctccaagctgcgggcgcgctcctacgtcacccgcccgtcgtccctgacccggagtctccagcccaacgttggctggacgacgtagccaacttggtcatgacggcacggcagcacctaggtgttggtgggcggtcctccgccactgtcacgtcccaaatcgactctaaaatacatcctcgaaattgtgcaaagaataattaaaattcatgtgaaagcctccaacaattaaaatgtgcaaagataaaagtcaaatgaggcttggaggatttttgtatatttcctaaaagcctaaaatgcgtaaataaattttagtggaattttcagagcacaaataataattgaaaagaaataaacaaagttgaaaaggtttataaaaagaaaaatccctaaaagtcttctttccccccccttttccttcttggg

SEQ ID NO: 80918 - DNA, 1287 bp, Oryza sativa
gaggagcccaagactactccaccatccgggatgctagctcggaggatgacgctaccatcgtgcacgtggcacgcatggtggaggagtacgacgcggctagtatcgacttccatcagatggtacgccgcgggatggtcgagaacaacatgaagatcctggagctgcgccaggagaacctgcagctcaagaaggacctcgacgcagtggaggcgcagctgcatcagctcaagatcgcccagggagagatctgccgccccaagcgtcgccgtgtctgccgcagccagaagatcaccgcccgcaagagcacctccaggcctgagcttgtccgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgttctttctcgtttgtcttttttggagtcgtgtggggcatggttatgccggtgtgtggtgtaactatgtcggagcctgtcttattttatttgcctaagcaacttgaacattaatgaaccaatttaatagcagtgataaatttaagaataatggtagtcgtgggtggatagttttaattgttagctccttctctgtttgctggttctgtgtggggttttcagatggtgacgaccaggagaaatgctgctaccggtgatggcaaccaacctgaaggcagcaaccacaaccaccagggcaacccacctccacctcctcctccgcctccgccaccaccaccagacaccaacgccattctcacccaaatcctcgcccagcaagccaacatgatgaccgctttcctccaccacctccaaaacccgccacaacagaatgctccaccaccacctccccaacactctaaactcgccgagttcctccgcatccgcccacctaccttctccagctccaacaaccccgtggatgctttggattggttgcatgccgtggggaaaaagttagacacggtgcagtgcagcgatgaggagaaagtcgtcttcgccgcccatcagctgcagggacccgcatctctctggtgggaccacttccaggctacgcagccagagggacagccgattacttgggctcgcttcaccgccgctttccggagaacccatgtgcccgctggagtcgtggctcttaagaaaagggaattccgagagttgaagcaaggcaaccgctccgtgatgga

SEQ ID NO: 80919 - DNA, 1228 bp, Oryza sativa
actctgtattgtatcaacttttggtgtaccttgcctcatgggacaaggaataatacacgcacgtcgggaacgcctgttgggtgatttccggtcgtgacagcttgcttgttttaagtttgtttgtgtgtgtgggtctcgcatgtgatttacatcagtggtgggatgtaagtgcatgcgtttgtttgcttttgagtgttaggaagtgggtgagtttagtggtgtgagagtcttcagtttgtaataatgaaactcagttaagatcaataaaagttaaagtaattctctgtcctaagtagtttcccccgttttctcttcttatcctgtccataccagatggtgaacactcgtagcaatgggaatggtcccaacaaccccaataataacaacaatggagagaatcccactctggcccaagttcttgctcaacagacacagcttatgaacatgatgatgcagcaatttcagaatcagcaaaaccaagggaataatcatgcacctccacagaacaagttagcagaatttcttcgtgtgaggccgcctgttttctctagtaccactaatcctgttgaagctagtgattggatacatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccgaaagacgcatataccatcgggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccacttatggttggagattaccctgatttccagaaattagtggataaggctattcgtcaggaggacaagtacaatcgcatggagcagaagaaacgtcggattgctcaattcaagacacaacagggaaataatcaaaaccgcgtcttaccttaggaccccagtccatgccacagggaggttatttgtctgttgttcgtccgcaacgtcagttcttcaacaccaatgctggcaacaacatccgtaatcaagctccacgtcctggtgcagctccagctcagcaaca

SEQ ID NO: 80920 - DNA, 727 bp, Oryza sativa
aaagttttacatgaaagagaacttaagactggagatgaaaagttttacatgaagcctgatttgctaatattatttgcaggaaattgttgatgatatacactagataccgtgcagcacgtggagcaagatcttcccgtgtagattggaactctctctctgatcttccagcttcaccagcagcatgttgtagaaggatgtcagacttacgagcaaaaatgtacataagattagcagtgagccaaatctgcaaccttcttgggatacgttatgctaagcaccttgaaagggaaaggatatcaaaagcgaaaggattactttcccaagtctcagattctaacaaagagaactgtgtagattcagattctgagcaattaaattgggataattttgaagatcaggaaataagaggtgcgctcgatgaagtccttgagttcattcaactagaaaaaatggaccgaaccaagcaaatcagttctaagaatgaagtgagcaatgattctaatgctgacgaagctccaactgggcaggaacagacagtaagtaattatctctttatcctcaaccaacatatattttattcaatactgatttttccttggaatgatcagattatgcaatatgtaaccagctcaagcactgaagttccagaaagcggactccatgaacatgtaaaaccgtatagacatccaactgcaatccatgcacgtaaaaacatggaaaatttctt

SEQ ID NO: 80921 - DNA, 1728 bp, Oryza sativa
atatatcaacacaaaggtaactaaggacaaaaggttgcaaaacgaacagataaaaaaagattcgcactgcaaacaaacttcacctggtatccttgccaaggaaggcgaccccgtaaaagaaaaacaagtgtataggcaagggattcaagatcatctcttctgcttccagttcttcctaagtgagcatgcacactagcatagcgaacagttccccttttcaggtaatcagtatgacaagtcagtttattagtaacacaagaaaatcgagggctttaggacttagttttcaataaagtatctccctcacaaacctaaagatatcaggcctctgatcatactcaacatgctcccccgaaccagtgtctttccacctagtagctgtgatgagaataaatattgagtacaaaaacagtataatgaggttcttgtgaaatgaaacagaagtacctaatccaaggtcaacaagaaaaagttttttctcttccagggttcctggggttccaagcaaaaaattctcaggttttacatcaccatgaacatacctaacataaataagagttagctatatttcaaaatgcaacatgcaaaaaactattaggcttcactgccaagagaggatcagagaaaaaaacaaataccctttcgaatgcatcttctccaatatggagattgcttctatagcaatacaagcaaccatttcaacagacattctgtaatagaaagaaaaatatcatattaactgagctaattaaacatgaacattcaagaatatattgacgaacaactagaaaacttacgagtgggaattattattccaaacatcccacaggcttggacccaacatgtccataatctgcatataagttggtttgcatcagagaacttcatgttttctaggtaatgaagaaccaatccatttaattttgctctgttcatgattaattatgaatcaatgtgataaaggaaaacagaatatcttggcttgcgattactaaaagttgaagatccacagagtcaggctttcatgcctactttggcaaagtatagttaagagtgcctttctaaatgaatggtctgacacacactataaacaaagttctatcttaaaagtgtaatgatctgagaatacatattttacaagattataggaaaacatttttactccacatctcatatcaaaactttgaggggaagtaaaaaagaagttttccctagtttctataaaatacatgaacaattttatttcttttgttggcagatttagtgcagccttagcaggatctttcttcaaaggctattggatgtgaggcacgaagacaaactacacaacattggaaaggtatcgttgcagcatcgagcatatggtcaaaagaatagagaaacagactggacactggaaatagcgaattgagaaggtagtggtttcttgcttcgcgaaataatacataggactccatatacagagtgctaatatatcttgccatcgaagacaaggacggcttgttaaccgaaaacttaactagacttgcctaaaatggatttccctagccgactagaactaaagttcctaatgccttgcaccttcttctgtcatgcaaaaagaagttgctgatgctgtcctgagctccaacataccttctgtagttcatccacaataggaattcagaacataattttaagattgtgcgcaatctactgctcaatctaaatttatctattgtctctgtg

SEQ ID NO: 80922 - DNA, 20942 bp, Oryza sativa
tccatcatacatcagggtgtaaaaggagcaggtatttcttgcctctgcctgcccaggaattgtggagcagatagaatggagaaatggtaatttggcattatccatatccatttggaatcagagaaaatttaggatatgatatgttgatatatgattagggctatccactgacatacatccgaatgcaagtgttgtgataaacctatctgatttcacttaagattaccaacattaattgctatcgttttgacatcttacaatcttagttatcagtctacccatgctcacgctgaatgtacccatattgtccatggtctcatgtaaggattaaaggatgcaaacatagtctgtccgaccaactgactgacagaatgcagagtggatacgggatagagaaatggttatccggtactatctgattgcgactaataaagaaacatgggggaaggatgcgggagttgtcatctcagtttgcaccctctccaattccatcctacatacgaattgtccattgcaagctacaactccattttgtgtcggtcaccagcaacaagattgtggaaaaatttgacaatttgttgatgatgttttgaattgattcaaagtaaagattcaatgttgcagcagtaatcactcgaacaaccaaataaaaaaatatttctcttaatccataaaacttttctgttgtataataacttctactaaccagcagaactttgtttatcgtatgcttacatcatatgcagagcacctttcatcaatggtctcaaacttttaactgataataactgccattaatgttttttcatattattggacattacctgctaatgttactaatgccagattgcccttgccagttttaatgattgagtgagctagtgctatccctccctccaaatgacttctacacagtatacactgctatttactactccctcctacccaaattgatcatcatatagtggaatctgaaatttctcaaactgatcatcatataaccgcatggacaccggtttcatcggaatacaattaatgcagcatgggatagtgtgtgcatgctagggtgtaattggcatggtcttttaatcgatgcatgcattgtgggagaatgtgtgcatggtgtcttgattgatgtgatttaaattatccttggtcttggtgcataaacatatatgatgatcaatttgggatggagggagtatataacacataaagtggggccaagagtatatgctccgttaccatgatatagtaatccccctgcctccctttataatgtactcttggtacaccatgaatgccgcttagagtgctgccaaatggatgtttacagaaagaaaatgttagtatgcattctagaatgccagctgccatcaaaatgtgtacagaatagcaaggcggacaaaggttgtgctgaataaaaaaacagttgatcatgccagaaaaaatggacaaaatgtcacttacttgtaaacttgccactcatagggagctccataattgcagcctttgctggttcgatgttcaaattttattgccacctggtataaagaaaagcgtgaatataaatgcaactatgatattttaaatatggaaatgaaaaagacatccggattagaagagctgacctccaaagcatttgctccaggtgtcctgtcggtaacaccaggagaggaaatacgccgaccaacatatacttgcccaaatcctccctttcccagctttctatcaagtttgtaagtaggtgaattggcaacttggacctgttcaaataaatcaaaaaagaatttgggtcaccctcagaaaatcacccaacacaccatttaaggtacccaggctatcctattccgctgttttgaagtcagatagtcctataactgcagtaactgaaacgagatgcatgtacctacaagagaattgagtataggcatctataagtgtacatggctatatgcaaaatgagaatggtttggaattttgtatgaaagaaaaaggtcagcttgtgtttttttgtaatgataaaaattaggcctccaatgtatattatgccacagaacttaatcactatataaaatgcaaacaagaaaagggagacaaacagctaagtgctagcaattaataggggcatcaaatgcaaaagatttgaaatatatagttatcttgagcagcaggtaaacatactcatctatgaaaactaacatcaaacttcagtgactgggctattacctaatagaattgctgtatacattagcagctttctgtagattaaaatgggaggcctaatgtggacatcctattatattacttaatcattgctatgcagtatacagtaatattgtgtggatggaacaagcccaaggtgcaactcacccaattctctcaattccattatatataacaggtcaactaaatgttctcccctttcatcacacatccacatggaatttaaccattctatgtactactatactttagacaagatcatgaaacacacaacatagggaacttgggggtgtcctaagtatcaacaaaaagatcacacaagttagaaaacaacattgctgcgtcactgatatgcaggtccagaccccatatgtcatcctcatatgtatattttaatctatacatgtttatagtatagctgaacaacttttcgctatacttggtagctcaaacagtcatgttattcaaatttcaatctgaaatgttaaacagcatggtactataaaatatgaaaaccatacacttctttgactgttgttcagtatgccactttcaatcgaggccactagatcaaacccattaaaacatcaatcatcagatcatacatactcgagagatgctttgattagacacctagttgaaagggtggaagtacaaatactaaagaagtaaataatataaatgcatgctattttgcacaaaaagtggcacgcacattgcaaatggcaaaccagaaccagaacaagaactatataaggtttcatgttgctcgtctataagaaaagcgcttgccgccctaaaataataaatacttgcacaacatatctcaaccaacctaatctattcactagtcactacatataaacacctcctttcagaatattgcaaaacacagtaatgtagccctttttgcataagtaactactacattaaaacattcgaactcgtgcgcctatttgtcagataaggaaacacaattttttttctaatccccaacaccacaagacaagagcatgaaatctgcgcacaacatttcatactcataactcatccataacaccaaataacctctcgaatcctactgttccacaggtgattatccacactatcccatacctaacaccaattttcatccatcctcgcgcttctagcatgcaaattcaccccccaaggccccaacccctatgcactacggccaagcggcctcacaccctcatcgcttccccccaagcacgaattgcgagtccaatcgcgggtgcccaaaccctaaacgcagtgcccaatttcgaacccacactactcgtggcaaaggcaacaaagggaggagaggagatcgatcctcaccgtctcggggagcggcgtggagctcccgtcgtcgcccggcgcctcgccggccttgtccccgctcccgacgacgctgtcgacgtcgtccattaccacttcccccccccccccccgctctccagtcccacgaacgcggctcggaatctccgtcaccgggaaccgccgcgtcgagagccggggctcgccggcgtggtgtgtgcgtggatgccgccgcttctacgagggcctccacccggcgtgggggtggattggtctagggtttggagcggaggcggcggcggcggcgaggcggaggcgaggtggtcggcgacggagaagggaagaagaagaagaaataaaaggcgagagaaaagcagaaaggagaggagaggagaagcgatggaaaattctggactctgctcgtgtgatcgattcctccggctcgtcggttacgggaaatttcattttacgcctttcagtggggaagacgtatcaacgtaagtatttgcgctttcgtgaaccgtcgggcatctcgtccgcgtgggacggcgtttttggttttcgtggaagttctgagaaattgatctcgtgatgatagagttcttagaaattggatacatccagcctttacttagaaaaaaaaagctatagttatcaattataatgtttttggataaaccaaaagcaaaagttcaacctaataaagttaaagaaaggatatacttgagaagaacaagcacataagaagacaacttaggttgtgttcggtagccatggttcctaacttatatttctcgttttttacgcatacgctttccaaattgttcaatggtactccctccatcctaaaatataagcacttttgaattttgatatgatattcgagatgttactttgactaacaatatctacaaaagtaagattttttaaataaaaatagtagtatattatgatagtttgttcaatgatagatcaagtaacatcaaatttacatgattgatttttgttgctattaatggtcaaaattaagaaagtttgacttggcactgttgtaaaaatacttatattttgaagcggaaggagtatgtaatcaatacttaattaaccaggtactaatgagtcgctcagccttatggtgttttcttttaccacctctttcgtctaatacttcattgtttttatgcgcacgcttcctaaactataaaacaatgtgttttaaattctatagaaaagctgctttaacaaatctgttaatctattttttaagttcattttagctaatttctaattaataatgtgttaatagacaacttcattttacatacaaattttacatacaaggaggtgaagttttcaacctctacctccgaatgcagccttatcaggtaaacaatttgattgctaaatctttattcagtgtgggggaatttctcatgctagattgatgtaactttctactcctaatgatgtgtatttatttttgtgtttatttatgatccttttaacagatacaatcaacgagatgacttataattatcgctatttaataaaaagagcaccacatgaagctacatcgtttcattaatctccgtacatttttacaaggtgctttggtgataccggatatgactaatcacagtactattttggattaaaattaaaacgtgttctactaatattttggtaacttaaatagtagacactggtgggttcagtttgaagccaatgttcagcttggcactttttgataacattacactatccaaatgaatcaattttcttgggcttctgaaagacaaagagcctaagccctagatgtggcccaagtatcacacgaggtttagtggtcaggcccaacccaaggcacacgacctccccgcatcgcttccttgcacgactgcgctagtataaccttctgtgaagtagtagcacatatttttctttcatttccttcccttttttttttcaaatgaaaagcagcaccgattttgctactagtagtactaattaaagtcatcatcattattttttaaaaataataaacacagaacaacgcatacactcatccctatgaatgcacgcacgtaaaccttacccctacgagcatctttgaagactagaccgacaaatcctttatattgatgaagtcactataggtgtctcactgtcgatagatacgtcacctaccactgaaatcacaatgccattaaaccctaccctatgagcaccttcgaagactgggtcggcaaatccttgagtttgacgaaatcaccacaggtgcctcgctgtcgctgttaacaagtacgtcgcctgccactgaaagcacgatgccattaaatcctgtaaaattcgctctcatgggaagtcaaacccagaaattaaggtgctactgagactcttataagttataaccactaggctacaggccctttcgcatcatcatcattattttacattcaaggagataccaaagtttatgttataggaaaagtgtacatctctacatattattttatgacaaatgagttaaccaggcgtaataacagagaataatgatgtcaagcattcgaaaatgaaaaaaaaaagagaacaattcagtgcaacacaagtctgctttcatcactaaccatacacgagaaaaaaaataagagaatattttaaagctcctcgtgctctaatcaaggttcactgctacagaaaacatctttctaaactgttaaaagtgattttgaaggcggtcaagccacccatagcgctttagttgtctgtaaagattacgattgggtaggtgtcataactgcacctgaaaaccaattttcgcaaactgtcaagttaggatacccaattgcaacgacctttccaaaaacaaattaatccagaaaccctagtgttcgtcctcgaagccgtcaccgccgccgttagaacccactgtcatcgcagctaacaactggcaaattacagtagtcatcgtagccctcgtcgtggttgaggtcgtcattgtctatgcatggtcgtcagatctgcctcctcttcaccacatcgcctgagcccgctgcggatccactgctcttgagctcaccgccgacggattcgacgctcccatggccgtaagcaacgaatcccctcttccatggtcaccactgtcgcatgaagcccaccgctagcatggtcgttgcgactacttgaagccattgcttccgccgtcctcggcctcccaacagcggatccaccagtcccgtagacgcgggtggtggatccgcctagcccgaggccaccgccactccccaagcccattacgccactgcctggagaggtgagtaggttggctgagagtgggatatagaagagagtaggggcggagccagagagaaatcagggggtgcctaaccttcctttgcgcacaacacaaaccaggagtagtattatgcagataattgtgtatcctaaacatctattctcccattgatggcattatactaaaaggaagtgttcagaaaaagggcagaaattgtgtacctgaattatgaaatcagctaaaaatatttgtgaaattgataatttgtcaatcgtataaaaaagtcacaaatcacaaaatatatcataaaaaatgtgatatcactgtcttcattcatccattaggactgaataaagaaagagaggaacatagttaaattttaagtaaagaataagtcatgaaatcatttacaaatacaaacagttatctattcgaactatgcacaacagtacggtcaaatactcaaaatttgtgaaagttcaacttgaaaccagacattaaaatatagagaaaaaactattcaagattaattaaaaaatttcaagctttatgttggtacatattacattaactgaaaacaaaagaaattaaggatgacatgggacaaaaggaccttgcatctgctcacttgctctagtgcccggttggcatcattggcttgccatgtcgggctgttggagaaggcgacgccgtccagtcattccacgaggagatggtgatgacaaacttagactctcctcacagtgctcaccctagccaaatgccaacaagccaataactataaggcaaaatcacccaatcaaagattcaagagcagcagcgaaagacgaaatcggcatggcggcggcacagtgtgacggcgttctattttagccaatgggcgacggcgtggcgtggcgattttggccaacaggcggcgggccggcggcggcgcaacgctgagtcgaggagagagaggaagaggtggaagatggaaagacgatgcgtgccgtgcccaacgattgacgttggattaacatgtgaagcgctagctgttgccttgttgggccttggtgtcttgcagattttgggctgaaggccagcgagggggttcctgagttttttactaaggggtgcctgtatggtggatttataggggtaatagctaattttttgtttcggcccgggtgcctaggaaccccccgggcctattgggctccgcccctggaagagaggggtggtgggagtgagggagaggagtaggaaaaggagagggaataggagagaaaaggtaaggggccagatgagggaactgaggggagaaaaaaatagagtggaggagtacggctattgtaggggttggagaagatggagaagataaaacatcgttgcgacgggacttggccgaacatcccgaatgaattttcacaaacagatctctttttagcccgattgtgaaaataatgaggtattcgtaaaaatctaactattctataatagtgctttttccggggacactttagaacttaagaaacgacgtacaaatgttcaatacaagcggttcaaatcctgtagtagtataatttagcggtcagttatacttatccttgtttcatcctgctatctcacgtagttcatgcatgtaatattcggtgaatagtctactgttctcgcgtagcaaagctatattgtgcttgcgggtgcacatgaacccccaaatttctaatttctcacttaaaaaaactagaatgtacagtattatactgaaattttctagattttcaatagtagtgcacatctgttttgatgctagcttcgcctctgctcgcatataagcctcctataacatactatcatctaacatttaagttaaaaaaaaactcatctaacattgtataactaacatgtaggtaggctcttcgcgtcagataattggtcaggaaaattagttcatcgatacttgagttccgtcgaaaagtgagatgcgcaaactgcaaacacaacaagcatgcaccgtaccgatatgatgcacatgcacggcgactgttgctccgatccaagtgttataatcgtgttccaaatctccgaaagtaaaaaggttaatctccaaagttcgattagaatgagagtcacgtcatctcacaattattgaccccgattgaaaagcaaatcaagtgaggtaggataaatctcaaccataaatgaaggatggagtgggagtcataatacgtagtattacaattcgtggataaatttaaatttaccatcaaaatacgtattataattggtggataaatgaaatatctcaagcagcagcgaagaggagggttatggttggatacatagagaggacggaataacgtcgaagaagatgaatagaaaatttaagacttaatcacagtcattgcactcattgttttgttcagttgaaagatgagtatggtatttcatatttcaatcttatttataatattattataaatagcacatccattaaatcaattaaagaaaagaaggtgacaagcgcagtaatgaaaaagaaattattagccgttataataaatatttttattttagaaacaagataaatttgcgaatgtcatagaaaatatttgatgcatacatttattaaaaatttaagttaattatctatacctaattaaaaaataagtaagacttccttaaattattcttgtccgtcattttttttcttccgcaacgtggttttttttccatggtttaacgtggttttttgcctggtttttttccgtacggttggttttttctccgcacgtggtttttctttgggcccggttttttgtccgatttttttgttagtgggtcgcgatttttttgttccggttttgtggtgggccccgtataaaaccaaatcggaccggaaaaaaatcaactggcaacacgacaaaaaaccagatcgaacaaaaaaaccgttcacccgtgacccggacaaaaactaccagatgaaaaacctcggcgacctggatcggagcagaaaaaccatgtgtattactaaaaaaacagatcaaccatgtgtattattaggagaaaaaccacattagacggaaaaatataagcaacccggatcagacctgaaaaaaccatgtgtattatgcaacatgtatattattaaaaaaccagatcaggcaaaaaaaatcggcaaaaatcatgtgtattattagaagaaaagcgagattggaccggaaaaaaatgagcgacccaaatcagacccggaggtcgccgttgttgtttctctctctctctaccatgttgtcaatcgcgtttctgcttttatggttttcttcgttaccaatgtccaccatcaatagatgagtctaattgtgggacacgtcctaccacagtcgtcaccgccgtttgatcatcagaccatccacgcccatcgttagtattatgagaacatgaatatatcaatattaaatagtgatctttatccatcctaattatcattaaaatttctaagcctagctaagaaaaaaaattatctatagcgaagcccgggtattttgctagttataaacaacatgtatagagggagactctagtcggacgaacgtgggacataatgcgctggttagacttggtgtctgtaaaatcttttgtgttaaaagtcgtcaggctaggctggctggagtgctggactgtctgcaagagtaaaaactgtctgcaagagctagggaatctttgaaattgttactactacttaccgacacctaccccctcaatggaagatttggcataaagatgctctttaacttcttttaggacccatgcataaaggcaataaagcaagcacttttagattcagacatgccagatactccctccgttttttaatagatgacgccgttgactttttatcacatgtttgaccatttgtcttatttaaaaaatttacataattataatttattttgttatgagttgttttatcactcacaatactttaagtgtgatttatatattatacatttgtaaaaaaaatttgaataagacgaatgatcaaacatgtaagaaaaagtcaacggcgtcatatattaaaaaacggaggagtggttgctgaacatggaacactatcgatccacatttgttttgaatatgcatatagaatttgaagaagaaatttgttaaatcatcaatcaatttttttttagtttttcatttcaaatgaaatgatcatgcgtgcatattttatgtttgaaattaactagtagttacagaattccaatggacttgacagatcggatgctgggaatggtggggctcgagcccgaaactccaaaacggcttcgaaaagtcccagtgcaagacactagcagtgtttagtactcctactagctaaacccaactccctatattgacactgcttcaatacgttgcttccatttcatataatcattttaatattttttctaatcaattttttgtttgatcaagtttataaaaatattagtaacattaacaacacaaaattagttttattaaatctaacattaaatatatattaatgacatgtttgttttaggttagagatgatatagctttttctaaaaagttgtacacattggggaaaaaatcaaagtgttttatatataaaacgggggagtaattaatactctttccattttattttataagtcgctttgacttttttaaggcctgatcaaatttatagaaaaatttagcaatacttataacaccaaattagtttattacatctaacattaaacatatttctatagtttcataaaaactattgctatattttttataaatttgattaaatctaaaaaagtttaattactaaaaagtcaaaacgacgtaatatgagacggatgtagtataacttatttcacacccaagtcctagatgtcatatacaaattaaactacgtctcaagcaaaactcaatcttcttttgttttagagtaccgttaattaaattcccccctcatcataactcctttgtatttgccacatcattataagtagtcgtatgtaccacatcggcagacaacatatttaattctatggatactatcgtgtacgaagtattgggacatcatgcacagaaaaatatttagctaaactcttgggtggctattctagttacaaaattttttagaagaaattcaacgagatagattaatatgtgataaattattctacaaacatacaagattaaatttaacttttacaagttaaagaaaacaattttaactgcgaatatacgtcaactatagtttaatttgttttaacttatagatatgataggttgaattttaacttacatctttatatagagtgatgtgttatatattaatctattttgctgaagttttccattatcagttagtagatgacacgtaaataacaggatagaatgtccactaccccggccgcatgcacttggctcgcacgcggtcgccgccggttgggtgaggtggtgactcggccggaagccgacgcgtaccaagaaaagccgcgcgcaaaggcgcaggaaaagcgaccccctcgctttggtagcgcgtgcaggcgatcgatcgagagatggatggatcattggtggcgagcgagcgaatcgtaaagcagccagagccagcgtggtcaccacgacgacgacgacccaaactaaagatggccaactcacatctcatctcatctcatcacgatcacggccttttcttttaatttctcccttttttgtctgctccaatccattcacttcacattttggttcatctataggtacatgcatggcctgccatgcgtgcatactatttttttccgttataatggatgacacatatacgaagtgagcgtaactcaactgattagatttttttatgatatttgtatttacggctaattattttttcaataatccataagcgacgtatccgtgtgatacattatcactaaagtctatatatacgatattggaataatatattattggtagcgtccaaaaaggatgcaactgaacatatgcaagaaagcacgcagcatatatacaggctgccctgccgtgcagtgcaggtgaggtgaggacatatatatgtagacgcacatgaactaggaatactagctatttgagcaggcaggcagggcatctgtaggctgttgttgagaggaaagggtcaggtttgcttagcattattaagggcctttaacctcaccatcttctttcttttccgatcctttcctacaagggtgtgaactcagatccctgccttgttcagacatcaacctaagaatctcaaagctagggctcatactgccggcactgcatgtacgtacttgtcggtgcatggtaagtatattcatacatatacgtaccgacctactaccaaattaattttcttaatttgtaatcgtacgataaaatttaacagttttgttaaaaatatggcatgacattttttttttgttttgcgattgcactctttcctatatatgtaagtatgtgctcatactgtatcttctctttcaattagataaaaaatactttaaaaattattttttatatactttgtgtattaaaaaattacaatgtaaatattgaaactaacatggtcagttttgaaatttataatataattataatgtaattaagtacgtaatctataatgtaaaaacgacttgatagttttctatataaaatatatatggggccaaaaagtagatactctcttaaactaattgctccacgaactaattaaaactcgtttggcgacgaaaacgatctcaaatttgatacaaatgcatgaaaaatactccccatgtagccagacaccaatatcatggtataataacaatttaattcgtgtacgcacgtatgtacgtacgaacgctcgtatacgctgccaagtatgtagaatcctccgctgcatccgcatcgccatcgccccatgcatgcatgcaacaacacaatcgaacgtacaagctcacgccacgtcgccgccgcgcgcatgctagagcttggcggcgccggcgacggcgccgccgcagcaacgccagcggtggtatatcgagctagctagggagcacggccgccgccggccggctacctgccgcggcggcgcagctggcagtccggcgtggcggcggacggctgcatccgcagctgctcgtagaacttgttgatgaagtcctcgaactcggcgtcgtccacgcgctgctcgccgccgccgccgccgccgttctccggcacggcggggaacggcgagtcggtgacgcggagcggccggacaccggcggggcttcgccccaggatccacgccaccatcggcgacggagtcgcggtggcccagccgccgccgccgccgccctgcaccgccgccgccgacgacgacggcgtgccttccacctcggcgctcatcatctcgaacgcccgcgccaccgccgccgcgtcgaggccgccatactcgccgccgcctccgccgccgcggcggccaccgccgccgccgcggctcttgaaggggaacagcccgtagtgcgggtacgacgacggcgtggtggtgcagctgaactccacctcccgcgggcggcggccgtagaacgacgccagcgcggcggacgacgacgacgacgccgcgaggtggtggccgtgccccgcggcggcgtggtgggcgaggaggccgcggagcgccttgccggcgagcttgccgcggccgaggaggacgtggaggtccaccatgaggcgcttccggcagaggcctcgccggagcatgtggcacacggcgaggacgacgtgccacagccgccgcgccatcccggcctccatgggccgccgcgccggcgtcgtcgcgagatccatcaattttacccaataataataatactcaggggtgtatttgcaaaaacgcaacacacacacactaaagagaaaaacgaaggctaacggatcggagaagggactggttgttaattttgtgaggtttcgaggagctgattagcttaattggctaaactagcgaaggggttgatggaatggaatgagtaggattggggggggaggcagaggaggtatttaagggaaggaaaggcttcaagggacccacaaaaacacaacttaatttggaaggaagggttaagtctagtttaattatttactgatagtatgatgctactgttttttctgctgcttggacctgaggctgctgttagcttagctctgttcatattgtcatctttgaatactctgtctttgtttggttgacagctaaaggctgttctacacatgttacgttttaagtcaaacaataaaaacttttttaaaagtctgttgaaatatttacactgggctagctattgtccgtgcgttgcaacgggattttaattttaaaaaattattattgttaacctattgccatcatcatcatcattattttctacatatatttgttcataacatacttatgtatatatttgttattaacatattgatcttatactttctccttaaaaaaagtagggtgtcgatggtacgagtggtggcagagttatcattcaccatcatcatcactctttttaaaggaatatagatatatgaaaattgtatgcatataagtatatgtttgttttaaaaactactccgatccataatattataatttagaagtgctacaacgtgtagtttcattagttttccacaatattttgccatagtaattagtggttgcatctcgacgacgactggttctgttcaaaacgatatgattttgtaactaaagggtgtaatagtgatcaaactttactaatggaatgctaatgggaaagactataagagattagctttggtgctacttggcttgtggttaggtagcagtgacagtgattgtctgattgacacttaaagatgagatagtctcaagtctggttaataatgtctatgtttttgttggtgtgaaattgacacaaataacttaacaattaacgtccatctgtggggagtggttaattctcccaaagttttccttcattggtcaaggcttaaaaacgttgcttttggagaatatgcccttgattccttaaaccatccatatatcttcttgtaggaaactgagaggaatgtggtggcagatgcaaaacacaagaggaagaaggatatgttaatgatgatcagtgaaggattaattaataaaggacactgctatggaactagtagtgcttctaaataccccgctccaaaaagcacaagctagctaggtcccaaagatttggaatatcttaggtgatatagatcgagcatcactttgcaagttaattacacaaacctgtcttttcatgcttttagaaacacatgtattaggaaaaagaacaaatatggacgtttatatgaacattctgtgcgcttgtgttaaagattaatttacagcatatgtgttggattagtaaatattgcccaaatgacgaaacaagaaatccagatattttttttcctgaacacgcaaaagctttgcatctgtaactgccaaagagaattgaagtgcaccctccatccataagtataaaacatttctagattggtctatgtgattaaattagggctagttagggataagatagtaaactattaaatgagtgataattaatgggataagtagtaggagtactctataaatccacaactttcaaacgcttagaatattttatatctatgcttatatagaggaagtaaaagttagcagcaaccagtataatacactgatataaactgcccctgcgtcgccctcgcgcatgcgacacggggggtgaaacgcccagagccgccgcccccttctcctccctcccctcacctcgctgccaccggagctcaccgccggaaagccagctggcgagcgaggagggcggcggcggcgccttctccgacgacggcgcatcctcttaggtgcgggggaggcggtgaacgctgacgacggggagtggatctggcgtgccccaggttggattcggtcgaagcgggtggtggctcgacggcgtggcgcgtggccggcggcgggccgttgtagtgcgtgtcggcaagaggctagcgcgcatgggtggcggaggccggcgcatgcgaggcggcacgcgtcgccctcttcggcggtccggtggggcggtcgtcgtcggggcgcgtggccggcggtggggcgctgtagcgcatgtcggcgggagactggcgcgcgcgggtggcggaggccggcgcatgcgaggcgacacacgtcgtcctcttcggtagtccggtggggcggtcatcgtcggggcacatcggcgactccggcgcctctccgggcatccaccccctcccccacccccacctctgctaccacctcccttcctctcctcctcccaccccctccttttcctcccttcctctcacccccacctagttgtctagttgctctgctgttctgctcaccccagctcttctatgtgttggtggtaaagttggaggtggttgttgcagttgccagaggtggtttcccgcaaagcccggtgattcttggtggagatgtggcctccgccgcaaagctcttcttacatctcatcagaaacatagaagactccgatgtctctgttgccctgtcttcaactttcagctcctcttccggcaggccagacctcctcgccttccttgatgctccacccttctgttggccggtctacttctagaccttggtcgtgaagtcttttggtggatgaggagatatgttcgtcgacgaagttggtccagcttgtttgtggtcagggctctttggcctcgcctgtgcttcaagtgccttgtgtgttagtgaacctgtcgtagggccgagtttggagcggtgtgttttgctctctgtagtgccagagttttagtgcttaggaggagccagagctgctgcattgggattagttgatgagctgggcaacgataactctcagcactttcgctctggtttcttggaggtcttgcacctttcgagggagccttgggcaaaagccatacctggtttcctagctaggattggcgacatcgacacctgcgggtgccgtatcctccttggaggtgtcgccttgtttgactctcttcaccttcgggtgaaaacccagtccagttttggacgggtgttggcagcggcatctgtcgttgcttccctccttggaggcttcgctttgaaggtctcgctcttcccttggtcacttttgtggttcgtagttttttcgctttgtcttctgtgtggggttttgccggtttcactgtagcaaactgtacagttgtatgtttttggacccggttttccttataaacagggttaattctcttctgcttataaattccggtagaactcgtaccgtcgtttcttcgaaaaaaaaagagggagtataagttacatgaatgctttgctattaccaatcagcttaaatatatctaagctcaagaattagttttttctctgctactatcatactccctccgttttaggttataagatgttttgagtttggtcaaagtcaaactgctttaagtctaactaagtttatagacaaatatagtaatatttacattaccaaatcagttttattaaattaataattaaatatatttttattataaatttatcttgggtcaaaaatattactatttttttctataaactaggtcaaacttaaagctgtttgactttaactaaagttaaaacatcttataatctttagtaaagtacgtacatttgactctaaatgaaaaaaaaatccaaggtttaataattggacttaaatattattgcacaaaactaaacctataattcgccaagattgaagtaaaattcggtatagctcgctagctagtggcggattcataatttttcttgagcctaatgcaaatctaataaaagatataatctatatatatatacataaaaccataaaactaataacttcatagaccatttaccattttattgagccttgctttgcttgtttgttagctgatcatcgagctaaactccattagaacaaataagcaaggtaattaggtaaatatttgtgagtaattatgccgttgaatcaatgcgttgttgtgcatgtggaggaatgggccctgctccgccactgtcgctagctattacgattatcctgcatatttgcatatatattgtctcaatttggtcaaaaaagaggaaatacacaacgccggtttcgtgctcgaatgcttagcaaaagctaaccctaagccttattccttagtaagcaagtgaagaattttcttggcctttattatttggattccttttcttttcctgcatggcattggctgccttgtattctctattagctttgtctaaagctggtcatcgatcagctcggagctcaggactcaagacgtagtacctactactactagtaccttgcagcagatggcttttcacagagaataatgcttgatgcttttgttgttaagattgattaatatactgtcaaatatctgcttttgttgttaaattaattagtgtactactgtacgtatgcatagggaattatagttgtgtactgctggtttccttgccaagaacatataaaagttgaattaaggtgcccttttcttttggacacacatatagaagcagaacatcatgaatggttattgagaaaaaaaaaggttttctagaattatttactggtatgttggttatggggttgatgataagacatatataagatatgagagtagtatttttcaagttatttctagacgtcctagatgttttgtatatatatttgacaaagatgaatgcaattaaaatccaactaacatgaacgtttgccctccaaataagctatgatcatgatctactgaaaatagacaaaaaaaatatatatctagacctattatttttggaaatatatatatgcaggaacatctctaattgtatatgatttttctttataatgggcctaatatgcataagaacatgcattctaatatataattaagcattgtttagttagtatcacactattaacaataaaagaaaactatttgagctacatttacgcacgtgggtccttgcaaagtttatctccatgaacgactgtacttgaaagctaactcaactttaatcggtggtaacagtaacaagtagctttagaggtagcttgtatgtcacgtccatgtacatttggattctttgcaggacaattggaaaagatcaaatgtgctctaggaaggctcttgctttgtttcagctttgacttacagcaactgtaatgtttatatttactaagttaatagtaacatgggtcccattaatgctagtcattagttgttactgtggaaaatctaatttgttgtattacgatgttttctgatctattagatcgagtctctcatggggtatatataggagtacatagaagatagagacttggagtacaatacaagtaagagtagatttatctcttggattctatctttaggatatatcttatctatatatttgtatttgactcttatctctaactagcatgtctatacttctaacattccccctcagtcgtagcaggagccaagcgaacgattgcgattggatttgaaatcttctatccttcatcttgttcgactcaccattatcgattgcatctctgatggatagttctccacctggtgcctgcatccccttctgtgtcgtcccttgactcttctctattccctcttgcagtcataggggagtgtcatggacgatagcgatgacatgaacgctttgactagagtttccatcaatgatttttgttgtagatgttcattgatttagccgatcatatagtagccgtggttgtaggtgtagccgcatacagccgaaggcgaaatttttttttacgccattacgttgtgaagatggaactgcaattgttagcatcttgcaccttgtagatatcagaggatgccattggggacgtcttgcataagatgacgtcgttggagatgaagccaccactttggttggtccgtctgcaccgtgaagcagtcatcacaatagtgatgctgagttgatacaatcgttgtcgtcgtacatgacatgatcaatgctgttgccgctgacgcggtcgttgtcgtcgta

SEQ ID NO: 80923 - DNA, 2276 bp, Oryza sativa
taattccccaaacattcaggagtcagggattcatccaagacacgcgttaagctcaaaatcaacatccactactaaattcctaatcttctaacgctactacctcagtacactggtacacaagcatcgtacatttcgtactggctgtggctgataagcgcacgtttttttttcaccagtacaagcagggaggcgacgccctgggtcgcttgctgccggcgccccactccgcgttcatctgcggcacccaccgctcgcggctggcccgctcgtcggcggcgacagcgacgccactgtgcagctgctcccggccggcccacgccgcgtaaccgtccggcaccccaccgatctgagccagcagcccaccctgcacgaaggaaagcagcgaaatgccaattgccacatgagtccaagcacaagcttctagcgaccttactgttttgaacatgcagacagagtacgggaaattttcaaatagggaaagcagggaacaatctgctcgtgaggggaggatgaatatgatatgcaggtttacgggaaattattctaaactcttaagaaaatatctttttgttgcttgaggcatatcacttcataaacatgtgaattcaaattcaatttatatattctcataccgaaaaaatatattaaactacagctagctagttaacgtataaatacaattaaatttatttttttcgttacaatatatataaattgaattttaacttgtatgtttatgaagtgatatatcccatattagtacatcttctcaaatttttttataactatttgagcgacatacaaacaatgagtgaacgtccccttcaaagtttaaaatccaccctcatggatttatcgcttagtattttatttttgtggtctccacaggatattatcctgacaccctggtccagcaattacatatattttttgttattgctagctgtgtgagcatgactacaaactacctgcatggtaaaatttgtccgctcacgatattgtgaacagattggcttatgtgcccacgacggccggcagggcctgaacagagtttggcgcgccgtgctttgcctgtgcttcgttcatggtgctcacaagaacgtgtgtggattggtttttcagggtttcatgcatgaaccggactgaatacgtattcaggttttcgttgccatggaaagtttggatcgttaacagtggatgaactgacctgaaatagcccgtctgaggaggaggaggcggcggtggcctcgtcgacgaggaagtcctcgacgtgccaaccgggcagcgtcttggtgaggtactcggagatgctgctcccgtcgctcgcgctccccgcggcggtgccggcgacgctgctggggctgcagctgtagtcctcccctgcttcctcctcctcttcctccgacggcgcgggggagtccatcggcgccgacgagaggcgcacgccggtgaggaggaaccggccgtgccgcctcgtcagctcgctcgtggtgtgcaccgtgacgtcgcactcccggcacaggatcgccctgtcctccttgcagaacaagaaccccctcttctcctgaagtgacgagagtccacacgcttcagagttgcagcaagcaacagaagcaacccgaggaaaaagagcagcagcctctcgccgcgtgcatacctgacagatgtcgcagagcggtggcttctgggcggacgacgacgacgccaacggttggaggagggagaatcggcggtgcttcccggcgagcttgttcgcgctgtggacgcggcggtcgcacgcgtcgcacagcgcggcctcgtcggcgcagcagaagaccgaggcggcctcggccgcgcacacgtcgcactgcaccttcatgtctccccgtccagtccgatcgatcggcagagacagctaacgaagcgggaaagaaagatggtcgcgtctcggccgggaggggatgcagataaggcagaagcgcacaacaagctcaggtcaatgccttgggttagaggactaacgacgatgttgcaaggagaagtagagtggtaggttattaggagtggacgagtggtagttgtagtgcacgagagagtagatgtgtttatatattgggcggcggcagtggcacggccggttttaggccgaggtgaaaggaaaataaagctgaaaaggcggtgtcccctgcaaatcaacctaaccctgatttgtgaaagtcttatgaatcgtgttcgtgctgattgggagatgactatactacatggtagtgatcagggcttgtgagagaagtaacctt

SEQ ID NO: 80924 - DNA, 900 bp, Oryza sativa
gcaggagccaagcaggatttaaaaataattacataagtaagagtcgttatgacctctgcatcatcccaaagtctaagaggagtgttttctgcacttaccacatcccttacaacttcattatatattgctatagctgaaaattgcaagacaaatgctttctcctcatgctgcaaaaagaacaccatgcctatcagcctgacagtacaaatgtgtctcgtttcaacaccagctatggattaataggcactaagagagggggctgattaccttgccaatgtaatcataaatatctgctaccgtatattcagttatgccagtcatggtgtatgtctttccactacttgtttgaccatatgcaaaaatactcgctgttacagaacaaattaaaaggaaataaaatgtgttcagttagtttatgcaatcttcaatcaaaaccaaattggataagataggcaataggtttggacttaacagttaatgccactaactacagagagggcaacctccttggccccttgcttgtatacttcgttcgtatcgcagtcagagcggaataccctatctgcaattggaatagagttgtgtcaaaaaacacagctggaaagtgagaatattaaagagcatacttgtagtacgagcaaactaaactcccacttatctgtattctagtggtgtgtagttgtccactaccaaaaaaaaatgtccaatacatttgtaaatgtaaacattcaatttcaggagggttagcttaatttctaaaggtgttctgtcagattttttttactgggacaggaatgtgtcgatgtgttctgttacttgtaacaaacgacgatgtataagtaaccaattaccagtgattgcactccggcaggtatgttaaattctgagattttacatttt

SEQ ID NO: 80925 - DNA, 1494 bp, Oryza sativa
gaatcgcacactaactaggcctaaatctagcaaccgccccgcaagcagagcagctactctactcattccaatgttgactatcgcggctacttcccgagaacgcctaatcatatcccgcagggggcagcatcgcgagctactgccagatcacaatatcacatcagtgagctaggcactagcagccaagtagcagaaaccccgtaatgctcaagccacagcaagggagggagcaagaaaaacaaggtgaaggcgacgagtctacctaccctacaggccgaggcggaggcgcgcttctggaagcgggagccgccctgcagtgcccgccacggcgcgacggccgagcttggagacggccgccatggcggtcgatatatgtgtcggttaactatcgagggggaggacgagtagggggttcccgtcttcctaagatgcgccgtggaggttccgttccgtgagcagcagcggcggccggcagcccgccctccccacgacggcacgatctggcaggtttttgggcgatatcgtagaggacggtggcttttccttttggccccctcccttcctttcctcgttttcccttttcccacacggttgaggggagagagagccggagaggagaccgttgattcccttgtccccactccccacgtcgctctcgctggttgctccttgccgtgcgtttttgcgcgatgcccctctgcttttcggtgtattgcgagcactaaacatacggaggcacggagtagtggatcatcattgggttgggtattcttgtttgcacaggagttgaggtctcagactggagtgactgacagactcacggcggccagactggtgccttcagaattcaggaagcagggattaccactagcggcacgagggatttgatgatgagattaagatgggaatttaatttttaatcccaatatcttgtttggtagaggtgatgaaaattgataaggaatttagttagagattatgtcattaataaaaacggatggctgagatttgcttaaacaaagtgaaggaggaattccctcccaattaactgcccctacccaggtattgaaaagaaaggagttccttcctcaattctccatcctcatcccaccaaaattttcatgtctcccaaacaaacaaaactcttaatagtctcatccctctaaatttccaatccctcctaaaaactttctccaaccaaacggaccgtagggggttaggcgtggatgatgatgcgtggttgtgtttaggaattttgtttgggagaaagagggaagattcatcttgatgtgactggcagttacagtcccttagtggtaaagcaattgctaattggatttttctgagaggttacgtgaacttactcgatcggtatatgtttactaggcgtgctgccttaagcggtgccatttgcttaattagctagctcttgtggctggctgtatgcctgtatatgttttcttgtactgtcgatctgtaaatggtcggggctgc

SEQ ID NO: 80926 - DNA, 2289 bp, Oryza sativa
tctattagatcgaccctctcatggggtatatataggagtacataggagatagagacttggagtacaatacaagtaagagtagatttatctctaggattctatctttaggatatatcttatctctatatttgtatttgactcttatctctaactaacatatctatacttctaaccgttactagcgagcttcattatgtttgatacataaatcgaaaaatatggtaggatccatattaaatgctatatatgagagaagattgtgagatgtacaccaagtaattttcttgtggaggtgaggatgaaccttcgcaaatttttctaagctatccacaaagattggatatactcgcgggtaacacctagctggctagaaggagaacctccaagagtaacaagccggatgtccaaagcaggttgtcgatccacaaatgctcaactaaactttagctcacacactactatgaaaacgatttttgcagatgtggtccttttttctttctttgtgggtatgttttttgtaaccatagatctgcctgcaaaatggggacaggggcgagatggccgtccacttgcgtagatatatcttcccaagtggacgacataaggtgccgccttggaagataaatctttgcaagtggagctcctaaggcatccgcctaggataatagcctaggaagataaatctctgcaggcggagctcttaaggcgtccgtctgggataatagcaccttatgtcgtccgcctgggaagatatccctatatagctttgaactcaaaatcttcggttgcctaagagaaaaaatagaggattttcgtaccctgcaggcggacccgctatccacccgtaaaaaccatttctggcctcctataaatccactatccccctctctctctctccaagaagtttggctcaagaacctaagagaagaagaggtggaaaccctagaaccctaaaacacagttataccattgaaactttttcagaaaagtggaattatggagaaaaaaaaagactgatattactagctagcatatttataaattactctagaaaataaattaatcaaatcataaattgtgcacataataagcaatataatacaagactagatgtaccagaaatcaacacatccaaatcgaactatcacatcagattacgctagccattttgattaatatatctatccatcttatccataggaaggtttacattttgtatgtaatcttggaggctaattggccagattagatgtggggtattaggcttggtgcgcaagtgggttggtgctccccagcatggtgtcccctctgatggtggtagaaattagattaaaaaaaagcatcaccaatcaaaggcacaacacaacaaaaggaaacccacaaaaccctagcttatgcacttttgccaaacctggccctaacctttgttgcttttactccagctgtggcgcccttttagctagctagtatgcttgttacttgatagtactactctcttttttttttatcaaaaatactatactcaattttcagtttccattctgtaaagaaaagatatatgtatttggtgtcactagtggtgaaatataattatgacatagaactattaattggagattcatgtgagcattgtgtcacttgagctgtttgtactctttaattcctctaattagttacactaattggtttcatataccatagagtgttctcactactagtccaagtagtaattaagaagttgatcaaattggcaacacaatgatgaactttctcgggattggcctttccaaaaggagggctgaagaagggagcaaaggaagagactgaaaggaactatacaccattttttctgttgttgcctaatggcaattatttggtgttgctatctagcttctgatggagaagtccaaaccatggaactaggtttttgccgtctctcctcaagttagcaacataaattctgagagaatgctaacttagctgctaagacatactacttccatcgattgcgaaatccaattgacctataattggtgggtctaacctctatctgctagtctatatccatattatttggctcacactagctattttaattttgaacttactgaaaacacctttcacttaattatgtacacagacagtagaatcttttttctgccattacatctgctaatttgttgcgtccatttattagtactttgttaatttgagttgtcaaatttacacaaacgcacaatctttgtttcttttttgagcttataaggttgattggtagtgctaatatat

SEQ ID NO: 80927 - DNA, 655 bp, Oryza sativa
tcaaccctcatcctcctaactaaggggctgtttggttttcagggacttattcacctcagatatttaaacactaatttaaaatattaaacatccactaattacaaaacccatttcataagtttagactaattcgcgagacaaatcttttaagtctaattacaacatgactttgacaatatgatgctatagtaaacttttaataattatggattaattaggcttaaaaaattcgcctcacagataagctctcatttatgaaattaatttttaaattagtctatgtttaatactctaaattaacgtcaaacatccgatgtgacatagactaacaagttttagccccatctaatcaccccctaagcatatcatgctgttacagttgacaccatcacgcgatgtaaccaagggtgcacgcaacacacaccaacctgtcatcgctcacactgctgctgtgctgtgctgcactcttctcctggccttggggaataaaacaaggcgatcggtttgctttcgtcttcctccccttctcgccatgcaaagggcgctttggttcttggtatcttcttccttttgcctcaaaaataatcacaccggcattgatgaaccaagcatatgcaggtactacctgagagaaaaaaaaaactccttcgggtaa

SEQ ID NO: 80928 - DNA, 3319 bp, Oryza sativa
ctgcggcccctcaaatactactgcaaaacattgtagcatattgcattagtagttcaattatagaggatccatatcgggagtagggcatatatgtttgtcggtgacatgggaccggggatatcttgactagaggtttgggcagccgcggtcacccacgtggcctgaccccctcggggggtcgggcccgaggttgatgaggccgcccctccctctatctccccgaggggtcgggccgctcccgtttcgaccccccgggggctggggcgccccgaccccctgagggtttggcgccacgtgtgtgggttaggtgagcacagcggcgctcacctaaccgcgtttattgcgggttggacgagcgcctcacgccgcatttaatgcagcatagcgcatgcttatccggtccgtgatcggtcgcagtgtgtgaccgatcacagaccggtcagatcgcgggttagggggcaacaggcggcttgacacacgcctcgccccgtcccgtcggaatgatgagagcctccaggcactcgtccctagccagagccggcgtgggaactcctagagttggcacgtcagccccggccagatacattccaggcttcatcgcaaccattgcaaggaagtcattgtatgaagaagtgcagacgtgtagcatgctaaactgacacgtggtggacaagaatgaccggtctgtgactggtctgacgccggtcgcgtcatcagcaaacaaccgtgcttccacgttgcacctgcttccggcggagtggaggttggtatgacccatcccgtcggagggtcattcggacagcagccattgcaaatctccgcccattaatgagggaggacagggttatcccggtgtcaggcgaaagtacgagccaagttttggtcaaagtaggatgggtccccacccaaaagaagggtaggtagaaatggtgtatgtggtatccccttgagatataaaaggaggaccatgcctacgaagaggggggaccaaaaaaaaggagggacggaaaaaaagactagaggagacctgagcaagtagactggagaaaagaggagtgagaggggctctagagtgggaactctcttgctctccaactctttgtaactccttcatacacagatccaccagaacacaggagtagggtattacgcttctcagcggcccgaacctgtctacatcgcccgtgtcttgcgcatttactctctcgcgaaacattccccagaccgatcgagggcgaagaacctcacttagcgcccccggccgaaccggcaaaggggggcctgcgcggtctcccggtgaggagccccacgctccgtcatctggcgcgccaggtagggggcgcgcgtgggtttttctaagccctcgtcctctttcgtgtgcgccaagcttctcccgctcagcccaatggccgaacgggcagtggcgcacaacctctctccgagcgctagcggtgacgacagcgagcagaacccgcgtcgtcgagctcgtactccaccgcccccctctcgccgaagtcttaggcgggaggaggcgctcgagggggtcgaaagatccgcgacttcgccgcacgcgggcgatggagaaggacggcgagacggggagcgtcgtctcctcgtctacggtgatggcagcacgccccagggcgcgctccaggctgcgggcgcgctcttgcgtcacccgcccgtcgtccctgatccagagactccaacccgccgttggctagatgacgtggccaacttggtcatgacggcgcagcagcgcctaggcgccggcgggcggtcctccgccaccaaggccactggcgttgctactgccggctccgtgtcgtcgaggcgaagggcgcggcgagcggcagccgttacccgccgttcatctgccattccctcgtcaacgcctcccacccaagaagatgtgcgtgaggggccggatgcccgcctcaatatcgagcgccggcgcaatgatcgccgtgctgcccacgcatcggagggcgcttcctcgtccggagcgccacttcggtccgggcacgggggccagccccccgtgtccccggttggcggtgccggctgtcgagcctttgtggcgagccttcggaacgtccgttggcccccaaggttccggcccaccatcaccgaaaaatacgacgaaagcgtcaaccccgccgagtttctccagatctacacgactgggatcgaggccgccgggggtgacgacagggtcatggcgaatttcttccccatggccctgaaaggacaggcgcgggattggctaatgaacttgccacccgcgtcggtccactcttgggaggatttgtgccagcagttcaccatgaacttccagggcacatatccgcgcccaggtgaagaagcggacttacacgcggtacagcgaggggacgatgagtctctttgctcgtacattcagcggttttgtcaagtccgcaacaccataccgtgcatccttgcacacgcggtgatctacgcgttcagggggggcgtgcggcacaaccgcatgcttgagaagatcgcctccaaggagccccagaccactgcggagcttttcagctcgcggaccgtgtggctcgcaaggaggaggcatggacctggaactccaccggttccggtgtggcagcttcggccgcccccggatccgccgctcggtcagggcggcgggacaggaggaggaagaagaggtcggcccattccgacgacgagggtcacgtcctcgccgtcgagggcgcttcgcgggccacccgaaaggggaggcctggagcgacaaaaagaaggaggccggcgctcccagcagggagcgcccgaccagcaagtggtgcaccgtgcacaacacctccctccacgacctcgcggactgccgcgcggtcaaaagtttggctgagcggacgaggaagtgggaggaggagaggaggcaggagcgccgtgagggcaaggccccggcggctccctccagcaaccggcgaagtgaggccaagcagaaggcccccgccgagaacattgacgatggcgacgatgacctagggttccaggagcccggggccaccatcgccaccgtcgatgggggagcacgcgctcacgcttctcgtcggagcctcaaggccatgaagcggagcttctggccgcggcccctacccatgaggcgacgcggcgggcgcggtggtcggaggttgccctcacattcgaccagaccgaccacccgccatgcattgcccggggaggacagatcgcatggtgggttcccccaccgtttgcaacgtgaagttggggcgtgtcgtcatagatggagggagcagccctcaacatcctttcc

SEQ ID NO: 80929 - DNA, 17971 bp, Oryza sativa
  unsure (1)..(17971): unsure at all n locations
taaaatttgtgaataatattactaacatttcgtcggatgaagaaataacaaaagtaaaagttttagatcttgatgagttattcaactttgttgttgatgactttttcaattgaaatcatttagtatttgaaaatattgtttgaatttgttatattttcaaattcaaattcaaaatgttcaaaaaaaaatgttatatagaaaaatgaccaaactaaaagttgtaaatcttgataagttatacaactttattgttgacattttttccatttgaaatcatttactacccgtaaaattattttaactcataaaataaattattatactgcacttaattattttgctatagttcaacttacaaatataaacatttcatatgaaaaataaaaaaatagtcatcggtgacgggctttagttaatgctcgatagagattaagtatatagcccgtcactgatgagtcatctgtgacaggcctagttgctatctcaaacgagcctcaagttggtgcacgtcacggataatggtcatctgtgacgggtcacaacttgaggcccatttaagatatggaatgttatctcaatcgggcctaaagttggcgtccgtcacagatgatggtcatctgtgacggccacatctttaggcccgtttgagatatggaatgttatcttaatcgggcctaaactacggcccgtcactgatagttgtcatccgtgacgggcttaagttttatgcccatctaatatgtctgtgcgaccatatctcaatcgggcattttttggcccgattgagatgacttccttgtgacggcccgctatttctaggcatattagagcccgtcacagatagaaggatctgtactagtgacgttatgtggaatttatttttcctttatatcaatgataaatagttgattctgctctctgtattcgcagtcgagatattttacatggtattgtattcatatctgtttgatatctgtgtccaactttcaatccgaaaaaaagggtagtttaattaggagatgaaaaggattgatatctagttgaatccaagccaaatattgcaccaatactttcataagttattcttactaagctcacattttatcatatagtatgtaacttcttgtcatgggaaaaatggttaatttcacatatataagaaattattcagttagctgcctggttgagcttatccataaccttgcactttgctaatgatttggcaataaaataacttggtaacctttgctctttatgcaagtatattctggtgcattttgctttctgtcttgcttttccctatttgagactaaattacttccacaccatgatccggccagagaggtggctttggttttgggcctgctttttcatcctactccaagtttggtgacatttgagaaatattactctagattattaagtagattcatcatcatgcatacgttgatgaatggagaattttatatcatgatgcattattgaggaaacaaaagctacttagattcagcaaggcgacacacattttgcacacgaattcctcaggttgtnggcaccaaatttttttttnggnnntnttaaaaaaaatttttgtattgcttccaactttaaaaagatcatatcccgttgtgctctctccactagtgaaaagaggaagaggaaaaggctgccatctttaattcatgtacttacatatacaattagatgccccttttctttgagaagggacaaagatttctgaatttgtgatacatttgtgtggaaattgcatgcaagcccttaatttatccatgatcaatcttaactaacacatgtgtttggtgtcgtatactagagagtgaacattgcagctcaagttgaagctaccgaattgtactattgttcatattttcggaacggttttggcacatggaattcattatctagatacaaaatatttgaaaccaagaactgggccgttgcagatgtcatgcgtgtgtaccaccaacacaaaacaaaacaaaacaaaacaagaagtaatcaacgaggttaaacacaccaatcttaattcatcttttagtgattgatatgtactctagtgccacaaccaatatccgttataaattttatggagtctggacgaaaccaattataaccgactatatagcattataactatttctatccacgtgccaacgaaccccgtgcaaaaccatgtgccaacgaggccctggctctaccagtgatcagactgttaacgtagaatcacgctgccacaccttgaacacattatgtgcaacctgggacaatatccaaagacgtaccgccatagggagtgggtagatctcaccgaatgaacactcgggagggaccctattagggtgaacgcaccggtttattctagactcggcaggccagctaagacgtcctttaacgtagtagaaacgatggacgacgagaaatttgagggaggataatagactttgggataggtataaaaaatgaggaagatgtagaatatagagggtttaggtaataaattgattttgagtattgatttgttgttgtttcaatcggccttagcccccttatatttataggaggggtggacttacttctcaggatcttttaatttccacgtccaattagatgaagaaaccaattggaaccctaaaatctgaggtcttagcaaggaaacctgagaaccgacaggctcgaactccgtcggtttgaccggtcccttgccactggtcagactagcccgatggctgcagtcagacatgcctcgcgtggtaagtctgggcctttaacacatacaacctacattcacacatacattgcttataataattctcgaacaaactgtgaaaaatgatacactattttgtcacgttattttttgcctgcaaaatagtctgcagcccaggaagaagagatctaaacattagtagagagaaaaaaaaaaaacttttagatggtgagtgattgatggatagcccaggagtgatcggtcgactaaccttctctactagtcttttagttaccttttctcagctgagtcagctgggatagtatggctaagcccaaatatgtccttatgtcgagttgatcgattgatcaatataagtttatcagtattaaaagtgtaaatatgtttgggataattaagataccacacgtacaaaagagcacatccgtaccatgcaatgtcactgatcgggcagagtacgaagaaaatggtccatttgatcagtgcttgtcagcttacgatggatggtgcatgcatttgaatatgggtgacacttggctgttgatcttgtgattggaccattgttatcctgcacttttagtactatttagtttttttttcttctcacttaccttattgtattttctgtggaattcagatataaatatgttctcaaatattttatagaagtacttgacatggcatattttaattttgaaaggtaaattctgtcaatttcaaaaagttgagcggtggctttcttctttgcatgggggtgagatggagtcgcagaagccgctggtatgtctctgcgtgtcaacgatctacagtatggcgaggcggtccgtctggtaaattggagacagggggagatggggaggcagcaactcctacgccatcggttcgggtgcctcgccactagccacctcccacctaattgggtccagccaccaccatcgctgttgtgctaggaaaaccacttatgtcatctgatgccggggaggtcgagttcatattatcgcagatctgaggctgtggctatcaatgctaggatcaccaacatcggtgggcgccacacgccttcctagaggagatattgttgacgcccccggcctctcaccccttcattccttcggggtttactctctgcgtgaaaattttgttccggatatccggaatagtgatgaaataaaatagttctggatatccagagtagcaatggtaacactacagctatcttgaccttctttaaagagtcgtattggaggttccctgcttgttgggcgtccttggcatcggatcggctttgatggctatgacagtggcaagatctgggatatgacttatttacaactcaattactctccaatcttatcttccgctttagtttgacattcatcgtccatggtgacatgtgaataattcgatcgacataatgattgaccattgatttcagagatactattttattttggtatggagaagacatggattacatataatttgtaagttgttaaaaaatattggttatgtagattttcactaatcatataaagaaataatatgtctttaaggtggtgttataagtagttttattatttttaatcaatatatgattttataattcacaatagtttgccatacaacttctataataattggttgtgacttccttgaagtaaagtctaaagtgaatttcatcattaaaaaattccgtagattttagctaataatgacgagtccaattacaaaggcctttttaattaaaatgcaccgctgtaatatcaacataacggaagtagcatagtatatcactgcataacaaacatggcttacattatatatgcataaatgcaactttcatccgtcgtctataacaaaaaattgaccaaatatcatcaaacgtcaaaattcaaaaacttggttgaattgttggcaaatgtaagggccccttagaatcgaagggttgaaaaaagaatagaaaaaacacatgattctgatatgaattgaagtgtaaaacagaggattgcaagacacaggaaaaacacaggaatagtcgtttgattggagcgtaggaaaaacgtaggaatcggatgagagagatagactcagagggaattttccaagaggttagagctcttactatatttcctccaaaatccacatacaatgtgccattccataggaatttcatatataggatttggaaaacttcaatcctttaaatcaaatggccaagtagaaaaatttcctatagaatttgaatcctatgaaatttttagataaatcctttgattcaaaggggcccttaaatgtgtagtagaatcgcttgtatagttgggacctggatggttggatcggggaggattggatcacccgtggcagaggaagaagctagctactcctatagctatgcacaaggataaggacaagatgagagaggctggtagttagaaaggggctggatgaagaggagaggaggggcactacggttttgattggtagggcgcgccaagaaagcaacaaaggtgaccaatatgaggagctttatgtaaaaaagaggaaaaataaagggtaacaatcaatggatggatggatggatggatagagtttggacagcaaattttttttattaatcccccttaatgtgttgcaggttttagtttcaactggatggacacagtgtgtgtggtgtttgttactcctgtacggagactcagctagcttaccagctacggccaaaattttaaatttaaaacttaatcctagagttgattttaatttttttttattttttacactagttttttaagtttatatatatataacttttgcttataaattattttttcgctaatatgtattgcgggttataatcagctatacttaaagcgatgaggcatggcctttttcttgtagttgacttcgggctttggctattgatcaagagctagtacacacatcgttttaaacagtactaataagtattttgattaacaaatctgtcatatgcactagattttcatccaatatcgtccatgccctgtatgcaggaggcaaagtacctaatagctgggacaaggaaatttcttgttaagaaaattcacagaagccaaaacggtattagtcacctattagccaatagggcgagaactaattccctttctggttttttggttagaaggaagttgtaatttcatctcacagctagcttgtgaggatattttgagtgagtagcatattcctttcttcctcgaaaaaaaaaacatatcctccatgccccgaagtttttgttgtggttgtttaattagttgacaattgaccattagttctcgacctctcgtgaaataatggtacactgaccttggctcattcttactaagtaagaagactccccagcgcaatcaaaacaattcaggaaaatatttttactggaggggtaaccctaatacgcagctgaccgcgtccggtcatgggcatgcggtcggcctccccttacgtatacatagtatatacacaaaagcattatatataaagtttatacgtataccgataaacgttatatttatatatataggtaataatttataactaatataaatatttggatttttccggtcgtcacaccggtttttcgtcccgcttcgtcgcccccccctcccccaaaatcccaatccgaatccaatcaaaccccggaaaaaaaaaatcaaaatcacaacggagttcaatcgcacaaatcatgatgcatgtacacacatatatccaaataaaaacaaaaaattagatcgaagggggtcgccgccgccgccgccgtcgccgccgccgccgccgtcaccgtcgccgccgccgtcgccgtcgccgtcgttgccgaaccgccgccgtcgccgtcgctgtggatccggtggaggggagagcgccgccgccgctgcctcccctcccgatagatccgccggcagcggcggcggagggcactctccggtggtgggggagagtgccgccgccaccgtcggtggtgggggaggactccaccgccgccgccgctcggggaggaggggcgccgtcgccgccgctcgcggggcgcctccccacccgctagatccgccgccggtggtaggggagggtgctgccgccgccgctcgcggggtgcctcccctcccgctagatccgccgccggtggtgggggaggatgccgccgacgccgccgtgggtggtgcgggtgccgccgccgccgccatcggtggtgggggaggggcggcgtcgtcgccgccgccgctcgggggcgcggaggagagggcggcgaagtgagatgggagggagggaaatgggctagggttccgcggctgagagggagtgggttttgtttccccactatcgacgctcggccgtccgatcaaaaccctagagatcggacggccggtgtcgtccgggccgaaatcggcccaagagggatcgagagtgaggcctcttttccggcccaagcccaggttgcggcctgggggaggaaaagtgcgcccacgcatgcgcaaaaggccgtgggccgaccggcatgggtcggaaataagtctatttttggtccctcgagccgaaaaaaagagaataagtacatttttagtgctcattttttcagaagcattacaattatagttatattgaatatgtttatttcgaagcaaacctataagaaagtattttctttctttttccaattaaataattgttaaatgatgtttgtattaataaaattagaaattaagctctgaaaattccaataaaattccaaagagcgtaactaattatggagaatttaataaaattaaatttaaccatgtcattttatttaaccatggagaatggagaattttacttgtaaattcatttaattatacacatacctacttaaaaataccaaatatttcagcgaatttgtattttaattaattgcatatttttctgatctgtaaacttcccggtgcaacgcacgggcacttttgctaaaccaaacaacacttttggtcaatatacacactctgtaatcacccggtgcaacgcacgggcacttttgctagtaattatatatttatacatataaactctatctatatgtatatataaacttagcgtttatatatttttacaaattttatatttatatgcatacttacacaatttgtgcgtaaaaaaagtttatacatacatataattgttgctttgtacgtataaactttgtacatactccctccatctatttttggtagtcatatttccaaatctgaaaattttatttttgataggcatatttcaatccaacaacctatcctcttaatgattttctcgaatttaatgcgtgactttccgttcttccacacatgattggctacatgggcattgagaaatgtaaatattaattaattgcttgtttacgaggaatgactagtagcatgtttaaatggatgataagtagaattacttatccttggtctatgtgtcaagataaaatatgactatcaaaagtagatggagggagtattacataaaaaacagttgtacggacgcgatcaaccgcatgcatggctaattgcccattagcattcttgtgttggatttgagactcaagaatccattgatttttttatttttacattttttattaaaatatttacataaatatttttttgtttcgaaaatttgcaaatctaatcgcctctcgccctttgggagggcgtttttttaaaaatcgtccttccagaaggcgttaagggacctaaatgcaaattttttatttgtgttcaaaccctttccactagttttaattgcttaaaaactaataatgcttattcgacactccaaatgattttaaatggaaaaataataaactacaaagttgtagatctcatcgagatctacaacttttatataaagtttatctccattcgatgtcgtttgaaatgtagatttgagatttttttaaataggttttatattttgtaacgaatatttggatactaaaagatcttaaatgaaaaagttgtttactacaaagttgtagatctactctagctctacaatttcgatataaagttttgtttcatctgactttatatggtataattttaaattataatatcatagagccaataagctatactgggaaatttgcatctaggtcccttaacgccctctggaagggcgatttttaaaaaacgcactcccataaggcgagaggcgactggatttgtaaattttcgaaacaagtttttttttaaaatattataataaaaaatgtaaaaataaaaaaatttgaatccattgatccataccggatgaaaaataggtggaaaaagtcgacgggtatagaatccctcaactattaaaactaactttgtttacctccccaagtagttttaactatggttctgtctaacatggcggcctacgcgtcaacaaaagttaagaaatttaaaaaaaatgttgccgccctcacaagttagtgagacaatttttccttcctttccctacctgtccctttctcctctcttctctatctgccctactcgggagcctactatgtgctatccccgccggcagggtcgacctcggctccccctcattgatagagggcttgagcttgagcttgacaaggtggtggccgccgcagctgcctgcctctacggtgtcgacgagaatcaaagagctggagaggaggaccgctcaagcgcaggaccactgcagtccatcctcttcgtgctctcacccctttacctccgcggagaggaggccaaggctaaggcatgcggagatgtatctgccgccaccgccaacctctttctcgcttcctccttgttattgttgcaagaggcaaggacgggcggatcgaaggctgcccgcgcaagccgatcccacctcctcccaacatcctctcgccatcactcctagcatcctagtcttcgtcgttgtctcaccgtcctccggtcgtgcattgtttttggtccctccaccgcctcaccacaatgtgaccacaggacttcgaaagctcctcgacagccgcccatcaccgctgccatcttaccatagatgggatggcgagctcaaactcggtggcttcctcgccttccaaccctctccctcgcctccatcctatcctcttccactaacgttggtcgatgccttccatcatcacagctaacacctcatcgggaaaaatagcctcccgctcgagcaccatcttcacagtctcacggtctccgattgattctggtcttgggtggactcaactgagccccgccccatcgccgccatcgtccaccgctaatcgccgccctacactgctttgtcggcctctatcaacttaacacgcatggagaagaagcagagaccggggagagagaaaagggtagatagagagggtaaaggggagaaaggggtgactgaaatgtgggccattatatttttattttttttactaacacgtgggtcccattaattttttatttttatttcagtgccacgtcaacgccacatgagataaagaccaagtcattccatcaagtgagcaccacgtaggatgaaaccatcaaaacccactgacagactctatttggttcagttttcgaagatgatcaaaagtttagggaggtacagtagacttattccaaaataggtaagattcatattgggccgttccatgtgcgtaacattccaacgcattaagttcatcggaggtcccttaaattatcaacgaatttgattttcgtccttcaactagaaaactagatataattggtccttcaactatcaaaaccggtgcaatataggttccatggcggtttggacggcggtttcggctgatgtgacgcctacgtggctaatttgactcggtcttcatctgatgtggcattcacgtggcacacgaagaaaaaattaataatttaaaaaatgttccattgagaattaatctgatcatctaaacaaaagtctagatagcaaccaatcctcgtttcaggctatggtaacccacacgctcgtctgatcaatgatgttgatgaagcatgcaatcatcctggtgatgtcagtggcgacgttgcaaaggcgtttgacagcgctgttgcacgcgacgagcatctccggcagccgcgcatcgcatgcatggtcgcaccccttcttgcacagttgcacagctccgcctccgtcgtgcccggtgctgaccagcagcgtcgtcgcctcgtcgaactcgcgggtgtccagcagcgccaccaccgcgttgcagatggggcaggtacgccgttgcgtactttctgcttcgctagcagcaccaccgcgcgtgtccgctgctgccctcgcgcggtaaatggcagcgacgacagcgactccggtcctcgacggccctgcaagtcgatctccgcgatgctagccggcgcgcatgacgacgttggcggcgaggcagccgcctcggccgcgaagcaggaggcgaagggcaatggagacggagacggagaggctgctcctctgctccgccgaccgcagctccgctctgactactccacccaccgcccaccgcccggcggaagaagcagagggagaagtcgccatcccagaaaggcggaatccaccagcccaagcatcagcggcggcgaccggggatcgaggagcgggccgtggaggcagctgaagcggtggaggaaggtggcgtcgcgggcggtgcagaggaagagcctgcctgcaggcgagagaggcgcggacgaggtctgcagcggtggggagcataggaggaagacctcccggaggaggtcgttggtcagcgcggcgacggcgacggctgacatgcctttcccgtcctcgctgcctacgcctttgcgccggtcgcatccggggaagaggatgggaggaccggaagagggggaaggagaaggggaggagacaaagaagaggggatgagatggaggaagtggggcattgacatcgtgggtttcactattttttaatcttattatttgactgatatgttgatccatatattttgttttattattttttaaattgttaaattttgcttcgagtgccacgtcagatgaagaccgagttaaattagctatgtaggcaacatgtcaattgaaaccaccgtccaaaccgtcttgggacctatgttatatcggtttttgatagttgagagacacgttgtatctagttttctagttgaaagacgaaaatcggatttgttgacaagttaagtcacctcaagtaaacttaggccctgtttgattcagcttaaaattattataatctaaattattagaaataagctgaaacaaacagataacttattatgatagattattataatctataagtcagattactataatctagtaatccactctaaatgtgcttattttagattattgggtggctaacaactaacaaacaacttataatctagagaaacaaacagctcacagcttattctacatcggcttattataattcagtttacagtaatctggctcaattatctatattacaataaagctaaaataaacagggccttattcctattccaaccccccggcgtgatcatcccaacaatcctgcaaggcctttgcaatcctagctagcagcatgcatcctcaattgaaacgagaacgaaactcatgactggaaaaaaaaaagggctaacagtcacaaattctatatacttataaagttatcctcaccaatagttttatcttctatcgtgaagccatatcattccaattacttttaggcattatttatctattatgcaaattacctatatcttctcgtaaagctatgcacatgtatatcataattatctacagctgttttctatcataatcatctcgaattatttttagcatttggatatgatctattttattttttctcttataaaactacatcatctattttctagtagtagaggataactttaaattatttttagcatttagattattgatctattatctattttttgcttatgaagctacattatttacattttgtaattggaggttcttttattgtgtaaagcatgtgaagacaaattttctagtatcaaattggaggttcatacaatttttccgcaatattgtatagggtttcatgtagttaatattacaaaagtgcgtgtgtggcctgagtgcagcaaattaacattactattacagtggattattggcatgaggatttactgtttagagtggattatttgcacgaggattacagtttttaatttgctacaattttttatcacgatgtcttcttgatgtaatattgtaatatggtacatatacatctatatatattcacttagaaattgcatcaaacaggcctgggtcagccaggcccattttgcatgcatggccatagcatccatgcaaatagggccagaaaagtgcatttttactccctcaactataacctaaatatgatttatatctctcaaccacatatctggattataaaacctccccttcattaaaactggcacattttgacttctttagcagtttcatcatgcatggcgctcatgtaccacattgacccgattttcatcctacgtggagtctatgtgatgctcaagtgacattatagttaactagtgttgtatctaggatttttatatgggtgatccattacatatatatatttttaaattcctaaatgtaacaaagttaaaagtataaatgaatcaaaagtgtatcataatatattaaaaagtggagattcaaacacacccaacatgcatgtctggtgtagactttgatcatgtcgatggagcatggtttatccgcacatgtatcaaatcgagccgagagtatcgtccttatctactccagcccggtgctcgcgtccttatccctcccatctctcgtgtctctctccctcctctctctctatctcttgcgcgtctctcgtccgacgctcgctctctctctctctctctctctcttgcgtctctctgccttccatctctcgcgtctctttccctcccctctctctctcgtggcctggcggcggcagtggctgtgacctcccctacagcagatccggcgggaggggaggaggcaggctctcgtggctggcggctgcctggcagaggcggcagcgtcggaggcgggtgcaccctcgcctccgccagatccggtgggtgcggaggcggcgggctcccctcggcgcgcgcggccatggcggcagttctcctctccaacactcgccttgtctccctctcctctgtgccccaccgatggctctcctcctctctgccacggtggggcgcggcctcctcttgtcgttggccaccgtgacggtaggccctttttttatttggaaccttaaaggtgccagttcctaaaccggcacatttaaggataccacaaatgtgccgactaataggtgctggttgggggtttcctatgggggttctcaaatagcacctgtagctatttctatagtagtgttttaatccgatgtccagtgttatcattgcctaatacgcttataatttttttttgaataatatgtggaggtacgtctctctctcttcaaaacttcttttttactagaaaaggactagatgctgattacttggtttggacattagtctccggaaggcatatggaattgaattgaagccacgcgcgggcggatctggtcggcctgttgcgaaacaaagtcgagctctaagctccaacgtcgccgtcctcctcgtcattatcgtccaggatcatcattacgctgctaaagttttctgcactcttagagcaagtttatatatcttagtagaattggttgatgactctaattttatccgcgttatttacttattaatttggagaaaacatataccatatattaataataatacgttggcaatttcaaaaataatttaattttatttatttacgaggggaataattggcgccgatttgactggtcaagcaaacttattgatgttaatttcctctccaacatatagagtggcttgaatccaaacgagattggattgatcaacgggtcgtcattgccggaggagaggaggggaagaaaacatgtggttaattaccgacatcgacgggtaaggcgaaggaagggatgactgagatagggaaggaaaaccggtggtcgctagcgttgattggtgagagagaggaaagggattcgaattcagtgacattgttatggcatggcacggtgtgacattggagcgatctggagcgttgaaatctaatcgaacggtctgctgcgccggcccacctgcagcctccgttttcatcccacgctttctgtttcctgccgcccaatgcccaaatctcgcggctctccccaatcccgcgcgtgcgctctagtcccgccgccctgcgcgcgcccgatcccgcaccaaagcagggctgctggcggagttccaatcccgcggaggttccaatcacggtgttcactttgacaccgctgacattagcctgattgtaagcagctacaaactggcaactcctgtcctggatttccctacagttcaagctaaacctgaaaatgattttgtctcagaaagttcagttcagtcacttcaagcaattgcatagcccaattttcacatggtttagaaatgccatattgccatggatacaagataagtaaggtatatttctcatttcacacaatcaagacacaatgtacaaaaaagagatgaattatttggaatacaaattcagatatttgtttggtactgtgttgatcagtattttcaacatttcagcaggtatgccataccactttcctaagcaaaccatcaacagtttggatcaaattatagtgtgagaagtaaaaacaaaatgacaaaactaagaactctgacactggcatcgacaaaaactgcttcatacgtgcctaccaggcggtgatggtgcccaagttcggctacatccgcaaggccgtcgcggcggcgcgcggtggcatcaccaccaccgtcgagtttgacctcttcacgctgcccggtggcgtcgatgccttcgacaaggccgcgcgctactgctaccgtgccaacttccagctatcagtgcgcaacgcggccgcgcttctctgcgcctctgccttcctcgacatgcagccgccgttggcccggtggccggacgcctccacgcgcccccggtcgtggcggcagggcagggtgccctggttgcggcggcacagcagggcctcggccccggcctcgcgcggcgagggaggcgaagcagcgaggcagccgcccggtcccctccccactcgtggctgcctggcacctctccggcctggcgtggcggcggcggctcccagctagctccggcctggcgcggcggcggcggcctagcgcgggcgaggaaggcgaagcggcgaggcggcgatgcgaccacgggggatttgggcgtcgggcggcaggaaacggagagcgtgggctgaaaacggaggctgcaggtgggccggcgcagcggaccgttcgattagatttcaacgctccagatcgctccaatgtcacaccgtgccatgccataacaatgtcactgaatccgaatccagaggaaagaggggagggaaaccagaggtcgctgggcgtcgatgttgcgcgagagagaagagagagtgaggaaaagcagtactcgggatttgggagaaaacaatttagtgcttgcaaccatttgcaagaaagtagaagaatacccttgcatcttagtactcaatataatcatggcatcagttgaatcaactatgatggatggctctgatttctttcttatctctcaaggatgataaaaatcataaattactaacaatcagaatgcacatacatatacggcaacctatgcacacaagctttcatatgtacacatgtgcacaccaactaacaattatcaccaaaaaaaaatctagaaaaattcatacatgtactttcaatagtattatacctagtggtaaaatcttcacgtcaaattcattatattttagccataacaaaaaaaaaatctgacagttttaaggttgtaagttctgtcagaattttgtcttttttattactctgtataatgaatttgaagatgcgactttacacgtaaatgtaatactattggaagtatatgtatgaatttttctacaatttttttgtcataatttttagttggtgtacacaatgtgtacacgcgaaggcctgtgtgcataggatacgctctctacatatacaggagtatgtctatactagctgaatgcacgtgctttgctacgggtaaaaaaactaaaaactatatgtgggtggaatgagaactagggtatctcattcccccgatgaatcaataactaacacacaattaagataaatggcgtgcttaaaccatccataaaaatatatgggagacttaggttaaggtagttagggatccaccccatatgtgggtcccgggcttcaccctaggtaatttagcatccacgtatcttaattaaataaggaaagggctgggtagaccaggacccggactgttccgggcccggacatgcccttatttccactgaaaacaccgctcggagagtagtgacatacaaaacctatgtattaagatgttaagtgaaggggattcggatgtctagtctggggtccccaagtctgtgtaagttggaacagatccccctgagataagtgaagcttacacgaaatatatcttagtaataataggaagagatagatttagggtcggcttgtttaaggaccccaggcccacttctgtcgatatgtgaaccactgctaaagagcagtattgaaacatatagaatctttaatgactcaaaactctgagcacgaggaatcgcaacttccttatgtctacattagcagaggatggcctcggacccagccctgtccttggtcccgggcttacctctgtccttgtaaatcctacgatccttagtgagagaagcgtagagacctataagatctacatcttaagaatgtaaatagaggtcggcttcggacccacccctgtcctgggtcccaggctcactctatccttgtacgtcctacgatcttcagcgagaggagtgtagaaacacatacaagatacacagcttggggaataagcaaagaccgaccttgggcccagccctatcccgggtcccatgctcatctctgcctacatcggaattctggagtcctttgtgagaggagcgtggagacatgttatatgtatattcatcaaagacatcttcgag

SEQ ID NO: 80930 - DNA, 13131 bp, Oryza sativa
aaccgggactaaagaggagataacagcagtccagatgccccctttcttctttttttcttttttattttcttccgaatcaagtgggatgcatatccccaaattaaaccccaaatcccaaatcaaggtaacatcccaaatccacatcacaaatctttaaagttacttatacacacaaatcaaatacatcacaaatcctaaaaaaaattgcacacaaatcaaattacatcacaagttctacaaaattaatcgcaaatacatcacacacaaatcaatacatcacaggatcatgcaataaatcacaaattctaaaataaaaatcacagaggcgccagccggccgctgccgcctcctctccgcgcccgccggccaccgccgcgctagcccactgctgcgccgctgcccgccgcctccgcactgccctccgccccgccgcgctggccctccgcgccggcccgctctcgctctcagcgctctcgcttgatctatccaaaaagaaaagagataaggcaggaaagagggagggagttagagaggaaaaaaagagatagagagagtttgttgtgtggacgagagaagaggataagtaatagggattatatagtacgtgttagatttttattcccggaattagtaacaccaaccgggactaaagttatatctttagtcccggttggtgttacaaaccgggaataaagatcctaggcgcctgacacggtctgatagggaaccatctttagtcccggttagtaacaccaaccgggaataaagattatctagccctgttattcttataaaccgggactaaaaatcgtttttagtcccggtttttaatagaacccagactattgtggatttgggtcgacagaccaaagatggtttctccaccagtgtataccatatgtttttgggctagtcaatctatgatacgatattatcggtctaatgatcttattaacgggttgcactagttcttacctctccattcatagggtggaagtcccggaggaattagtgtcattatttattaatgtaagcatggtgcttggattaattaaatgtcgtttggatgcgggtgttcctcacggaaagtgagataggcagcaggtggtgacaacccctatttgttctctatattcctccacgttcgggtatgatgtaagagttcataaaatgctatagccacactggcagaccaacagggagtggcctcctggtagattctggttgcctataattaactatgtcctagccatgtgtatgtatatggttgttgtatcgactaagcatgattagtatatagaagtacatttgaaaccatagctatttctttagttctttctccactagctagctaatacattgggatgattattttgtgtgtcacattacccaaatactatcattatcatttacccatgtttggactatggtatattgattatagtatatggttatgaatatatcaacctactctttacaccaccgtgtttcctgtggaaaaacaaataacgatacccatggaatactcctaaatgaaatgctacagcggtattcgtgcgcttgtggatttatctctgaccgtatcaaataccaacacatgggtgggcaaggaactggtcgaaccaatgctcaagatattcaaatccatgtcagttaggaagggcctcaacctcaatcctaagtggatccattatagggttaaggctagggattactgtcgaagaaacgggaagcaaagtccaatctccgactgctcgaggcatatctatcgcttgccctcgtgcacggccccccattgggctgagcttggggcacatttgccctagaattgaggacacatccacctttgggcatgccacccgtgggctatggtcgaggcatgctcgcctctgggtgcggccctccatgggctgtgctctgggctctatccctgagctcgttccccgtggctcggggtagcagtaacgcattgatccaatcaaacttcacattcaattcaaggcgacatatatcaacccgacatacgtaattaataaaacaatgcacgcggttcatagtttagatctgactagtgaaataacagcccgtacaaaacgtattccatacgtggagactacagatatccatttgcgtaaatatatttttttggggtggttcttggtacctgcaaacgtccacgattttcataggcccttgttttgcatgcggagtggaaaatgccagtgaaaacagcttattcatcgcctggatagtagtgaatgtttccacgggcggatgcctttagtaatagcccattcaaaacatatttcaatagacggagaaaggatatccgtctgcgtaaaatatattttctagggtggttaatttatgatgcacctgtaaaaatccatgattttctgcagacgtttggttacaggtggagcagagaaaatgcccatataaacaggtaatgcgtcacccagacaaaatggtagtgtaaaaagggttggaccttagcttgcttggaagtagtggttaaattggtataacactactcctagtaaaacaaatacgactcgttgaaaaggttaactcatcacacgtattatggttgaaatacatgcactacatattgaagcaagtgagtctatctaggtactcaaatcactaagttctactctctccgtttctaaatatttgacgccgttgacttttctaaacatgtttgaccgtttgttttattaaaaaaatttaagtaattattaattcttttccggaaatgaatcaaatgataggatccaataaaataaacgtcaaacatgtttaaaaaagtcaacggcgtcgaatatttaggggcggagggagtataaaaaaagtactaaaatttctacagcttctctatattaaacaattgaccactcggatctctaataatgtgtccggtatattatagttgggccttggagatggccctcattcagtttagacttttctctcctatccaactcagatttttgaacaaatacggtgtacctgtcgtcgtcgctgaaggcaactcaacaacggtatatcagcttatagcttaattagcaaattaagtactaaacactctatatagtcagttcccagtttgaccatctgctagtgtggcttaactgcatgcatgcgttcgccatacatttatcgtccttaatctgatcagctatcaacttaattaagaccctgtttgtttcagcttaggattattataatctagattattataatctataaaccagattactataatctagtaatccactttaaaggtgatttttttagattattagatagctaacaccaaacaaccagctaataatccagagaaacaaacagctaacaacttattattttactgtaatctaaattacaatagtcttaagctaaaataaatagggcctaaatagcccataaccttaaagaatcccatgcgtaccgctctaattccctattgtgtttttcttctgtaaaatgatttttactgatactcctttatatttttacgaatggactgaaaagagattcgcctgcaaaaatatactggtgatgttcagtctataaatatcgatttttacgaacggtggtttctctctcctctacctcaggtctccgcaccggccgccctcctccgctcctttccttttttttaatcttttcagctcccccacccctaccatttatttcctctttcccactcctctcccctagtcccactttccctctcctctctctcccactctctaccagaatcctcgcctctcatgggtagcggcgtgggtttgagtgtagtggcctccgattgggtgaatacaccgcctgcatgcatgggagcggtggatctgtagccagggaggtcattgatggtgagagtagtggcctcaggcttcatgcggtggcagtggcgggtttcgtgtagcggcggtgacaacggcaaagcagtggatccgccacctgcgacaacgacctcgatcacgatgagggctacaatgatgaccgtgacctgccagttgctagctgtgatgacggtggcgcccgatagcaatggaatgccacggcaacaacgacggtggcttcacaaggaaggtggctagggtttctggatttgcttttattttttaatgttttggggaaaaatcatcgtaattaggtgccttggccgtttgtaaaaatgggttttcatgtacagttatgatgctcacatgtaaaaataccaatttttatagatatttggagccatgtggatgctctacccatctaaaaaatgtgtttaggctgtaaaaaattagaagtgtcataagtacaagtatttgtatataagcttgtattacttaataatcggtagcactcctgattactatagtgctgccatagttagtaatacaagtgcctgtacagaaggaagaaggaagctagggaaaaaaaaaacacaccagagaatcagaacatgaccaaacgtgcataatttcttcttaattggtacggacatcatgatcacatcaaccagcaaattaagtacaggtgttgccatcaggtgaatcatgaatgcgaaatcagcgtgatttttgtaccaaagtgctagtcatctaaattccacggagaaatcagtgtttttctgttacccaaagtctgaaaaccaagccgatattttggatgggaatatttgtgctagttagctactcaaagaacaagcttgcaagtaattacgccgtgtttagtggattttccaaaagggaattgattaaaatggaccttcagtcgttcaggcaatcgtttctattcgtctagcgggtcaagatgttgacattacagcatttattcagaattaacttcagatcggaagatgttaagttcagggtaacatggagaaaaagtttgtaaactacttgagcaagtaatagtgttaattttggtacatgatgcatccgacctttatcttcgagaattccatggagtactgtccttgccttgtttttccattggtttatatagtagggtttgttaattgtgatgacctaaaacagtggtctctactcgtagtaaatcaatcactacttctcaagcttgcaaatttcttgtcagctgattgttccatatgggcctacaaggttgaacaaagaaaaactgctgcagctaactatgcacctatgcttactgttcctcgttgcatttccttctcactgcttactattcctcattgcacttccaaggtctgtaatattaactgagaagatctggatcctcccggtgacttgaacaatactactactagaataggtatggcacatctgaaaatttgaaaaactaaaaaatagaaaaactagaaaaatataataaaatataaaaaattcggattgtggtcaaaaggaaaaaaaggaccaagactttttttaaggcttcagagcatgtataaataaaaataaataaatacataacataactaaaactattttaaaaacactagaacggataccctcatctcaatcgggtggtaagccccatctcaatcgggcacagcgttcgtcacaggctagaagtcactaatgtgaagagttatctcaatcgggcaaacggccgtcacggatgaatctatctcaatcaggccctaagtaaagcccgtcaccaatagttttgacccagacgaccagtcaaactatagcccgtcacagatgacctatctcaatcgggccacaactagagcccgtcacagatgactgttaacctcaatcgggcctaaactagagcccgtcacagatgactgctgacctcaatcgggcctaaacaagagcccgtcacagatgactgctgacctcaatcgagcctaaactagagcccgtcacagatgaccgtcatctcaatcgggcatttagttatggcccgtcacagatgactagaatccacaaaaaaaatattttttgttttttggctagcctcaggcctttgctagccatgcccgctgcaaaaatgatagaaacaaacacagatatccaatatccccagctccccagcatcacccattcatatacatatgcattcacatacacagacatcaacatatttcacacaactacacattcacagccatctcatatttcacatccattcacatccattcaaatatttatcatatttcacctggaaaaccaagttaattggatcaaatatttatttagaaagtcttaacataaacatatgaaatatatacataaatataagcatcacagttacatcatcacagtttcataataagtgttcatcattgcctagacataaaagttcaacattgttcatcattttagtttaagtctaaacattcctttgggattaattatttcgcggaggataaagctggctatctcctcgcgaacctcctcaaagctggtaggcagagacttggttattgtgccctacattgtcataattctagattagttgatcgatcatatataagtactaaaatgtagttagtctatcacaattgagaccaccgacctcaaactcagccaaagtcttcaccttttctctgtacagaaggcgcatgttgtggcacacatggaatccgcactggtcacctatttgttgcttcaccgggaagtcttttttgtggatgagggtgtcatgtcctgtcttcctgaggcctcctctttgcacgtattgggcccaagcttcatctatcgctagttgaattggggtccaatcatatgcgttcttatcaattctggagttcaggtagtgacatgtactccacttaggtgttatgaccagaaggatccaatgggcactgcggtattaatatagtgaaagttaattaagtactgaaggaatgtgtcatgctgttgtgtatatttagataacacacttactattgattataggcgcacataatgtactccttgtctcggcgggaccacaaggtgtcgtagatgtagttgaccattccttgacggacattctggagatttgtgacagtgaccacttgtggatcaaggaaggcaacttccggtgcattcttctgacaccattgacaacttaacctacacacaggataaacaatcttgtaaacgagttaaaccgattgttattaccagattgagttgggcgataatacttacaaggagtagcacttaaggaggcttgtgtccaccgctcggagcctgtagaggtcgaaaagatccttgaagtcgaccacgatataatttgttggaccaagaaatggctttccatcgtgctctccaaggatatcggtagctttattcggcttcctggcgttagatttctccatgtagtataagtgaaggtccttgcaagcggtgcccattgcggcaagcacgtcatctccaaccaatggcatgcctagttggaactcctgtggagcgacatatttcttcttgacctctttgcccttagtctcttcctggcccttgcccagatctagcttccttggagctagaagcgaggcctgcacctctcctccccttcctctcccctttgcttcgggtttatcgagagtaattctctgaggggaagagtgtgccttcctgctcttcttcatcagtgggggttcatgaatcgccttgctgtcggcctcagttcggtcctccccaaaatccgtgtcgtactgcaactgcacatcgtaagattgtgcatgacgatcttgagcaggaggggctgaaggagcagaggcgggtctcttcggtggacgaccgcctggtgcagtggttggcctcgctgtaaccctgatctcaatgaggtccttgggccattggatgaaggtaccacgggcatttcctagtgagaggacctcgtcgttcggtggatacttcagtgggaatagctcgtattcgggcttcaccgagtcgacttgaacttttgtatagtcgcccctgagttgcactccatgcactcttgtacgcaagtccctcggctgctggaaccgtgaaggtcggcatcaccctaactgtgagggtgcagctcgttggatcctgcgatagattaatcaatttttttagaatatcatatatcatatggattcgttaagtctttcatgtattgtggacgaaacttttaccgttatgtggtcgacggcgctgtcagccgatgttggattttttgccaactcagttgatgcgcaactgctgcgtttttgggtgggacttcctaactcttcgtgcgcagcagcagcggcgagctgggggttctgttgctcttctcggatctcttgcctaatcttggccctcatcgacttgagcttttcgttgaattcagatgttagctcagctcttatagacgcccggatcttcgcttcaaggcgtgcatctttctccgccttgttggaagtccgcttcttgtactgccacgcgtagtttggaaatccatacttccagggaatagaagacccaacgccccgtgtctgtccacggtgttccttgttgcccaacgatttcgtgaggaggtcgtcctcgcatctttgagagcaggcctcttgcgaggcttgttgctcggcaaccaactccttttgcattacaatttagtggggttaaataaactgcatgatgggaaacaatgcgaacatctagtttgattagacacttactatagcttcatatactcgttgatcttctgcatttggcatgaagattgtgccatcatcattcttctggtacctggccctagcccagttcctagcccgagggtgtgggatatcgctaaacacgagcggcgtgttcgattcctccgcttcttcatcctcacgctgccattcctcttccttactggcatatccggcggtgccaagccggtgcggatgctggttcctggtctggagcaagcgatatgcctcgcttctagctctggactcgggggtcgacttcttcgcatggaattcctcccagacctgttccgtgatccaaggaaatttctttcttggatctggattcgccgggttgtagacgaactcgccgactagcttagtcttgaagttcttccaagcattgcccataaccttgaaagcagcccgcctgagatggtcctcatgctccgcaggataatcgaagctctccttgaacgttagccaagcaatgtccttctctgcggccggcacgagcttgatgtcatcttgcagaatactgaatttctgcctccctatgaccccacagatagatctaaatcggctcaatattttccttggagatgtcggcaaccctacggcatccaccgctgttatgcggaaccgttccttagggattttgttccctgtcctaggagtacatgcccttaaggacccactagttgtcgtcgacattggttcgccttgctgagacatcgtctactttttttcaaaataacaaaaatacacaattcagtgctacaatctattacaatgaattgaatgtcacttataaataaatgaaacataaataaactaaattgcacatctcacagtaatagaatgaattgaatgtcacatataaataaattaaacatatcatcaaatcctaaaatcatgcatctatcactaaattcattaatgcaccacattccatctattcatcaacatgtcatcaatcaaaaaaatcattcgttcaccacatatcatcaatccctaaaatcatctatcactaaattcattaatgctccacatttcatctattcatcatcatgtcatcaatcactaaaaacatctatcactaaattcatcccaacatccacatttcatcccaacatccacatttcatcattaaccacatgcaggtagcagagggcggcgcgatggaggactcacctgaggtcggctgggggggctcggtggtggcggtgccaggctcggtggagggcgtcgccggtcggtagaggcggcgccgggctcggtggcggcagcggcgggctcggcgaaggaggagttcgcggcggcggcgccgggctcagtggagggcggcgtcggtcggtgtagacgctggtcgggcaagtcggcgtcaggcgggcggcgtcgggcgtcggtgaggagtaggcgacgacgatgaggaaggacgtcgccggcctcggtgggggcagctattcgcgtcggtgaagaggcaggcggcgacgacgaggaaggccgacgccggtcagtgtagaggcttggtggcggcggcggcgggctcggtggaggcggcgggctcggcggcggcggcggcgggctcggtggcggcggtggcggtctcggtggcttggggttcatcgtcaaggtcaatgtgaggtcttacatgaagattatggttgtattcttcttcatcgacaacgttgtcaactcctacaattcggcgctttccatccctcacgatgtgcatcttcttgtttgaagggtcttttatgtagaatatctgctcgacctgtttcgcaagtacaaatggttcatcggcgtatccctcctttgatagatctactaaagtgaaacctttcttgtcgactttgacaccagtgcgtagattcacccaacggcagcagaacaaagaaaccttgaacttgacgtagtttaactcccatatctcctcaatgcggccgtagtatgtgtttgacccaacttgatcctggaatgcatttgtacggacgctgctgttttgcactgtgcttttgccatcttgtttgacggtgtaaaatgtgtatccatttatatcgtatccttgccatgtgtctacggtccaagacggtcccatccccaacaactgtactgtctcatttgggacatctgtggacattgtcacacgattcttgaaccattcgttgaaccgagaattatgttctctgttaatccatgcatcagatcacctcaagttctcatctcggattttcgctaagtgctcctcaaagtatgggccaacttctgccatatgttggagcacagcgtaatgagcctgcgcgtacgacgcttgatcgggcctaattcttttccttccgattgagccaacacctgacaaccttccgatgacccatgtataccatctattgtgatttcttcagccatcggcttcgtgtatgttccttgcaatcggagcatgccttctttccttttatagtttgtccggaaagattaccgagtgcagagtagtcattaatggtgcagaacaatagaactcttagcttgaagttctcctgaccatatgcatcctaagtttccacaccttatttccaaagaatctccagatcgtcgataacaggctccaggaatacatcgatatcattgccgggttgcctcggaccttggattaacaagcacaacataatatatttccgtttaaagcataaccatggcgggaggttatagttcgcaataagaactggccaagtgctgtgagtactactcatgtcaccgaaaggattcatgccatccgtacgcagacatatcctcatgtttctagggtcggcagcaaagtctttgtgttttcgatcaatattcctccattcaatcgaatccgctgggtgtctaagcataccgtcattccttctctccgtggcgtgccaacgtactaacttcgcttcgttcgggttggcaaagattctcttgaaacgatcaatgataggtagataccacacaacctttgccggaccacccttctttgacttatttccttcgtcaggtcttttcttttgcttgtattgagaagccttgcagacaggacaagcatccaagtccgcatattgcttgtggtacaatatgcagtcgtttggacaagcgtgaattctacggacctctaaccccagtggacacagaacctgctttgcttcgtatgtcatctcgggcaatgtattctcaccaggaagcatagccttcaaaattcctaaaagatctgtgaaactcttatctgtccatccactacttaccttcagcttcattaggtccaaggtaactgacaacttagtgtgttttgctttgcatccagcgtacagaggcgtctcggaatcactgaccaacctgctgaacttcattccatctctctcattctgggctgggtcctcaacgtcacgtaacatgtcttgcagcagatcgtgatccacataaaccatttcaccgcccaatggagaaggtataaacatgtcatgctcatcttcatcttcctgattatgcgcaccacttctgtctgctgctgctccacttcctgattcttgctctccatgcttcacccaacatgtatagccctccatgaatcctcgttgtatcagatgaccgtgtacgtcctctccgctatcaaacatattctcattcttgcaatctgcacatggacaacacatgtaatcactgtttcttcttatccgatcctcctccgcgacgttcataaaatttgttacgccctttctgtagtccgtagaatgacgtttcaaatttttagcatacatccaactttaatcaattgctacaaaataaaaaaaaacaaattagaggcacatattataagatcagtattgcaaaagtaagacgtgatgaaattgctcaattaatgattaatattactcacttgattgatccattttgattactttgggaatttaatttctgttttccttggaaaaaggacaaaaaatcgccccaacagcctcccaccaaaatagtgaacagtgggatgcagttacactaggtggtggggggtatttatactgtgtaacaaatatctgtaacggccctaaaataatcaaccgtgacgggcatacaagtaatctctatcgggccttaataaaagcccgtcaaaaaagagtgtgaccctcatctgtgacgggcttcttttagggcccgattgagatatggaaccctcatctcaatcgagcctcaactatagcccgtcatagataagtgtcatccgtgacgggctttagttttatgccgatataccatggctgtgcgactatatctcaatcgggcgaaacttcggcccaattgagattacttgtgacggcccgtaaattccagtcttgttatgggccgtcacagatggaaggatctgtactagtgaaaaatagtgtggtgatgcactaacacgagcggcactgaattgcttttacgatcgtcggtgccacgcaaaatttggccaatcaattgtggtaaaatttgaaaactcaaaagctctcagacaaaagttcctaatctat

SEQ ID NO: 80931 - DNA, 3675 bp, Oryza sativa
ttgagcttgagctctgatgaatggatggatggatggaggcttgggtttggaaggggaggtggcgcgggcttttatatagggtttggtgatgcactggagcttaggtgatgagctaggccagttgagttggggcccaagtaaagccgcgcaccgggggaagaagcatccattcgtccatctctgctagctgcatgttatgttgttgttggtagtaatattgtgcgtgcatgcatgcatgtcttgtctagctgcctgctggctataggctacatatgctcccttttgggctgagctagctagctctcccataactggggaatctccaggattgatgggacttgtgaattctctgccaattaacaagtgtgaataaatgaattattgaaaatgaataggagcctacaaggtcaggcctttgcctttccagctttgattatctttggttatgtgcatgcatgcatggctgtgtttatatattcatgtgagggatagaatttgtggttgttgacatggagtaaatttagtaaaacggcgcaaactttcacaaaactataaataaattaatcaagttatacttcctctgtttcaaaatgtaagatgcggttgttttggagtcaaacttaaaaaaactgacttacagcaaaaactaaaacatcttaaattttagaaaaggggatagcaatgttgaaaactatatatttagccataaatttagcaaaactcttgagatccatggaaataatggtggataaaatctctaattaagaccttagtatttgatcataaatgttcgctttaggtatatagtttggagtacacatttcactttgaactaaaaatatattgacaaatgttacacacaactaatggatcgatcaagtcgtgcccatgtttttacttaacaccaggttttctactttattgattggaccagagttcatgaataaaccccaccacgatggcttcagcgcaagtacgggcaaggtgtaggtgacttgtagcattgctccacccctgctaggtcatgagatcaatcaatcaatgttctaacctattccatcctctcttttgctctagctaccaccatgaaaaaaacgagtaggaattatgcgccattaatgatggctagagcaggaagttgggatgggggaggggttgggaaaaatagacatgcatggacacatgaatgaatagtctaggcatcttgcccatcagctatggtgatggtgctttgtctgaatttaggaactgaataatggttccaattcctttcaaaagtggagggttgcttgatcaaatactatctaagtacttcctccgcgtcctaaaatatagctacttgtagtgtttaaattttattttaaaatacagctacttctagagtaagaagagatatttgtagtgatgaaatgtcaaaaatacccttcttcttcaccataccgaccaatcaggacaattaatgaaggaaaatttagtctttttacctctttttttagttatctctatgaaaaactctagaaagtaaggtagatagtatgagatgattcttctaagctatatgtttaatgttatgatttatttatagaataaactaaattaatatgtgcttatatatccaacagtaataaatatttgtattggccaatactcatcccattcaaatcaacattgagatttaacttgcctttccacatctattatattggcgagtgatgcacaccatatataaaagaagtcacctcagcaatacgtgtcctatttttccttggtacattcaattttcctgacaacagtcctttaactctcgtaaccggggacatttgaccatgaaaagcggaaacgctgaattgcaaggtaaaaaagtacatgaaaaaaattttttttgcgagaaaaaagaaaaaaatgttttatggttatccgacacaggaaattacaagtctctaaaacctaagcagtgaattaactttcttgcgggcgattgtcaggaaatctggtaggaatcacagtacacttcgttgttggttaacagttgacaaagtaaaattcccccttgcaattgcagattatcctaatgattcatgcatgaggatttaccatatatatctagcaaaatgtttcatgatagagtgaactatatattaccatattttgcttcctcggtagatagaattgagagaagactctctgctacctcagtttttctatcttatggaaataaacttactatggttaattcagttttctattcctaccaacctactatatgtgtactttgaagttgcctaaaacaataattgacaatattgatcgaggaaggagacaccgtctttagagaggttatgatgtcaattccaataagaagtcattggctgtttgggacaaggtttgcaaacctaagacaaagggggttcttggggttatcaatcttacaatccagaacctccttctaaagtatctagacaagttctatgatagcaagaatttgccccgggtcaatcttatttgatcctcttattatagaaacggagtgcctcacttatccaccctcaaggggtcttttcggtggaaggatgtttgcaatttgatagatttcattggaggcattgccagatgtttaataggagatggagtttcatgctctttttggaatgatggacctcctctttctatccatatgccaagactgtcttcttttgttttgaatgcaaagatcccagtcacaattttctttcaatttagttggaagataattttcacttgcccctatctcaagaagcttatcttaacttgtagtctttgaaagttttgcttaaagaggtaagcttgtcacaggaaaatgatacatgggcatatatttggggtaatttgaagtacaggtcacagaagttttacattcttaattttagagttttgcaaccacctcagcatttcctttggttacggaagagtaagacaggtcaaagtgtttggttggttactactcatggaaagattaaatataaagtatatgctggatcataaacattgtgctcctccaaactgtgacctccaatgcgtgttttgttcaactcaatctttggaaatcttaatcatcttttttttttccaatgccctttctcagtgagattttggaatatcttagatattgtttgggacacctctttgacactagatagcatggtggtggaagccagagatagataccatggccattactttatggaaaaattcttatttgagacatgaaatatttggaagcaaaggaatgggtttatttttgaaaatactcatccttgtttgtcttcttggagataactccctaaggctgatctcctccttttgttgtttaggttgaatgagagagataagaatgtagttttgagttgaattagattgttgtaatttttttcttttttcctgtacttgttttctttctttaataaaaatctatttaacaacggggcctcctatgctgtaatttctttaaaaaaaactatatattgccatgaaggtctcactactagaaaaatcatttttcccaacgtgggagtcttattttcgcaggcagacatgacccttagagccaaatgaccgcctacaaaaatataaatcgagatgaaatttgatgtccgcctgcgaaaatattttcacaggcggaccacttaagcggcgcct

SEQ ID NO: 80932 - DNA, 22375 bp, Oryza sativa
ccgcatcattttcgtaggcgccaccttaagtggtccgcctacgaaaaaaaacttgagtataaatagactcggcataggaggagattttttctaagtctccacacctcaccactcacggccggcaagcttatccattcaacccctcagtccctcagctctctcatcccctccccctcacctctcctcttctccccacctcaacggccggcctctcccctcccctcacctctcctcctctcccggcggcggcggcgggcggtggcggcggagggcagcggcggcgcgctcccggcccctccctcccagatctggccggaagggggcaggggcagcacggcggcgggcggtggcggcgaggagggtcgaggcggcggcacggccacggcggcgagggcagttgaggcggcggcggcggctcccggccgcccctccctcccagaactggagtaacgacggcgggccgtggccgtgcggcggcggcgcgaacgatggcgggtcgtggccgtgcggtggcggcggcggctcctggccgcccctccctcctagatctggagtgacaacggcgggccgtggccgtgcggcagcggctcctggctgccccttcctcccagatctggagtgacgacggcgggccgtggctgtgtggggcggcggcggctcccggccgcccctccctcccagatccgcgttgacgacggcgggccgtggccttgcggcggtggcgcggacgacggcgggccgcggcggacgacggcgcggcgcggacgtgcagcggcggcggatgatggctaggcggcggccatgatttcttgaatgtttttatttgctttcttctagaattgattcggtgattttggatgaaccgtggatgaattgattcggtgatttttggatgaactggatgaattgattggattggatggggaatgggtgggaactggattgggaacgggaagctaccgtcggaaacggcggtggctgcccattttttttagctctcgaagctattttcgcaggcagacctgttgcgcgcctgtgaaaatcaactattttcgcaggcgttgaggtgcaggcggatggcttgtccgcctgcgaaaatatgattcggccgactgggaaaagaatttttctagcagtgtctctccctctacaaataatgatctgtaagtctgtagtgcctcagtcaacttagaaactctagcttttccattctttaatatttaactagttttgattgtacaaacaacagttttaggtacactttcatatattctctgacttgccttgttaatttaattatacacggaactagaataagaataaccgaccatgcatgcatatatatatatatgcacaaaaaagttttccatgcgtccaaaaatgaacatatatccaaactgaattattacctatatatatatgtatgggctttcagctttctcgtgcatatatgtgctagctaggcatatgtatgcatgtgtttttcatggcacatgcgtgcgtcgcaaacaagcaaactaataacccgcagtttacacatgtaatgtaattaaaaaaaatatacacagcgcatatgcgtgcgtcgcaaacaagcaaactattaagctgcagtttatccacgtgtaactaaaagaaaaaaaaatcaaagcatgggatcgaatcacaccgtactagaaatatcagacatgaaaatatgcacgcagttcatgctagttctcaaccgatatatttataggggtaaacgaaatttgatgaaatatatttattttgaatgacttaagtattgtggatactgataagcattttcatatctttgatttagaaattttagattatatagatttgtgaatttcgttatagtatcttgcaagatactaataatagggcatcatatttttgtacaccacactagtcacatcgtattttatatcaactcctgaattgggcaggatatttaaaattgttaactatattagggtatatcacctttataggatatgattagatgctttttggctatagctagaaaattgccttattctattcgtcgtatttagagcaccatatatcacgtaatttaaacggcaacatatcctatgcacacaggccctcacgtgtacacacgtgcacaccaactaaaaaatatcacaaaaaaatctagaaaaaatcatacacatactttcaattgtattacacctagggttaaaatcttaacatcaaattcattatattttagccgtaacaaaaaaaacaaaaaatctaacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacatggtgtgtacacgcgagggcctgtgtgtataggatacgctcccaacttaaacagctataaacttgggctccttgcctttagaacatatggattttaaataaattagatttgttcccataaaatttctgcaaattcatctattccaaagaggccttagggtgtattctacactcctattcccaagtcccaactctactccctcattttccatgcgcacgctttctgaaccgttaagggctcgttcggttcacaagatttttaaaacgtagaaataggaaaaacgtaggaatactataggaaatacatgtgtaaacctatggattgaaaaacacaagaatttttcctatgttgttgagcaagccaaccaaagaaatgcaaacattagattggagtggattattttttcctatgcttttccttcaaaaatgaaggaatagaaaactttcctatagttttcctatgttgcattcatatgaaatgaatggtagtttaaaacctatttctattcctatgtttttcctttgcaattcctttgaaacgaataagccctaaacggtatgtatttttttcaaaaaatttctataggaaatttgatttaaaatatcatatttatccattttccaagtttttagctaatatttaattaatcatgccctaatacattgttccattttgtatgccggggaaagagttcccaaccctcagcgcccaacagagcccaatgtttctctgtctccattgttgatttatgaaaggcatgatagtatcactacttagtgtatattgtgttgttaatatttatatacaatatgtttgctcgcatttataagataatggacataggaaaaacactttcaaatataaatacagtgatagtactttggttaaacagaacagatatacctttggaatagagaaatatatacacgtactaactagtcgactgtctgtcaggggtggacacacccactgggtagggtgggtcaactagcccagctacaaagggccggagctagaacgaaatagaggagggtatcacttgtttaatttactctactttaaattgagtttaaactgatgtaggtgtcaatgtttatattaaagagggtgcatacatggtgaaaatagatgagatatagctaaagtagggatacaaatatttatggaaattcatgaccaaataaatgagcattatttctatacaagtggtaccatttttgtcgttctgattttggccaaacataaaatttgatttttttttctctttctttagaactatattacagtctactaaatagttaatttggtaaatatatatataaaagtttattttactccccaaaactattttggcggagcacttaaccccctaaatactttttttggggggtttatttcacactcccaaactattcaaggtggatcaccttactctgtaacaatatttcttaatttctttaatctctctatgcaaatcgtatttgcactgaaattatgtaggattggtatatccattataacctacctcttgaaatcttattaagaaatttttatcactgtttacataggttggaagcactaattgtgaaaatattttgaaactttgataatggtgttatttatgagaaatgttgttaagcagtaaagtgaaccattattaatagtttaagggtaaaatgagaaaaaaaatacttaaggagttaaatgatccaatgaaatagtctgaaatagtcttggggagtaaaatagacttttcaaaatatgaatgttttgtaaatcatttctaaattaataatttttgggttcgaccattttcatccctaattctcaatatgaggcttccattgccatctcatcttcatgactacgctcattgcctcacctatctgacgcagacgtttgttcgactgttaatctttgttaacttgcttgatgttcgtgagatgcgcctccgtgccagtgccataagctggcgattatggcttgtgtgcgatgtgccatcatccaattagggctagcgccttgctagatatcgccccatctatatattttaaagctgtgtctgccactgctgcctgtagaatataaatattcaatgaatcaacagtaatcatctcttcgagagggatctcgttcttctttctatataggcttaatatttcgagagagctgttctaaaatttttattcatagcttgtagtataacttaactattctttgcagatataattaataaatttaaactgtgggggacttccaagcagtattttggtaaaaaaaaatcagcagtaataataactgccagttcacttgtgtgctaagtttacttatacaccggtagtgacgtagggtttatagattcttggttctaaagtaatgcaaacgtaatttgaacaacttatattgactttgaaaagttggaaacatgtctttgacagaaggtagtaacattataatctatttttatctccctccaatcctcaagaggacaaaaatccttgtcaattattagggattggcagcatatattgtccaccaaacccatctaggttgccaagtctcccagcgacagagatgtcgtaaaacacatgtggtatagtataatatttgatgctcctgggacaatgagccccgcaaattataccggtgactttatgtgattcccatgcatgactccctatcctttaatttgcacactttgttagaaagggccttgagagatggatgtgaagctgtaatgcaaaaaaaggcgaagaggatcgatggatgtggaggtgctggtgtactgtcagaatgttgtaatgcaaaagaaaagccatatatgtacaaaaatgagtatgcaaggaaggttttatgtgggggttgtatattctctttactcacaatcatgcagccaaggtccatggccaaggccagcccagccatccatccatccattgtggtttagatgccccttccatcttgcaatgtccacacaatccgctggctagtgtacatgtaagatacacgcatgcacacatttgaacgtgcttcatcggtcgatatctaagtttgtgttactatggattcatatcctttgccactataatcagataaaaatatcataatagtctataacaaaacctccggttaactaaaattgtactatatatatcatccaccctcattgattaatcgtaaggtgcagatataattgtgcggacttgtgaatttttcctacatagacagagcacacggtagctagataaccgtcaacatcatcaaatgccagtggaacaatgcacatgcttgctctactatagcaagccagagagctcggatagatggctgtctagggtcgccgggttctcaatccaccactgatgatattatatatatgctaatataatatgaatgtaaggttctctatataagtccggagaacttgggccgttgagttgtcgatcacatgacggtcatgctaagcttaagatagagggaatgaattgagacacaatctcgtagctagctaactactcccttcatttcatattataagtcgttttgatgtttttcataataaaactttattaaatttgactaagttaaaaaaaacaacaatattttaaacaccaaactagtttcattgaatatatttatatgtctgttttatattaaagagtaaattgcatcggcggtatacaaacttgtcgggtgggtggaatctagtgtatgaacttgtaaaatgctcgttttggtatatgaacttatcttgtgcgtgcgaactaaggtcaaaaggacattacatgactaattttgtttatttaggtgctgattaggatactatataaacatatatatgcatgagaaggtttctacttagacatactccctccgtcgtataaaaaattaacctagtattagatgtgacacatcatagtactacgaatctggacatacctcggtccaggttcattgtactagaatgtgtcacatctaattctagatttatttttttatggagggagtacacttattcaataaaaagatagagtgagatatagtgattgtagagaaagatataaaaaaccgagcaataatataaggagaaacatacgaaattcaagataaagtagagaacaaatttataaatatagcatgttttatgcatactcactatacgcatgcacgccacatcctaatcaacatcagctaggtaaaattaaccttgccaagccattttggacctagttcgcatggattagataagttcgtgttcgtgtatcaaaacgagtattttacaagttcatgtactaaattgcacccacctaacaagtttatataccaccaatgcaatttattctatattaaaaatgctactatgtttttctatgaatttagtcaagcgtaaaagagtttgactagagcaaaacgacttataatattaaacggagggagtggctaggctagcactgctcacacacacacacgcacacaaaaaggcaagctcagccgccagctctcgccattattcgatcgatcggcaaacgccgccatgagggatcgatatcgttttcagtccagcctagttgcccagctacatcgatcgattgatcagctgctgccgatggatggacgcatggacacatctatatatctctgtcagtgtcaccgggcggctacagcaagcattagctatagctgcaggcatttcccgggtttaatccgatcaattcgctgcactgtgtgtgtgtgatgtgcagtgggcgttggcataaatgtcatcaccatacattgcgtcgtgtgtgtgatcgatcatgggaatcaaatctttcattctgctccatccgcttctcattcctgtcggatcgatcatccatatatatacataactatatatcttctttctatcaatctctgtcattaaatttttccatatgcatcatcaatctcaatttgcacatataaatcgtttgcccccacactggctccataatttaaagttcacagtggagtattcgattgatccgggtgtgtttgatttggactgcgagcccccgaccatgacatgagctgttttgtgtgtgcgtattcctagattcttgccggttggaaagatcgtctcatgacgatgaacaaaagggagggttgatgtaggattggacatgcatgtgtgaggccggcggccggctggattctcaagttgatcaatttgcatttgggcactacttggattagggcaatgttggaactgagaaattcattgtaacacctcatgcccgtttgaagcctgtaaaagtggtgtcgtgtttgtggggtttagaccgatatgcccagaagtgatgttctgatagtggtttagtaacgccttggaagtttagtaaggtgatggcggttaacacttaaatttagcacctaatgtgaaaatagaaaaatatggccaaattttaaaaggactcagcttgccacgtgaagccgatctggccaatcgccatagtgctagtctgtccggcagcatgtgaccgatcagaccggcatagtccaactctaagtccaattaattttcttgcttgggtccgagatttttttagtccaaattgatccctaagcctaatgggatgtgaagaaggcccttggaaagaagaccttctcctttataagagctatatatggttgatttgattctaacccccgactttagctcttatcgaatagttcttttacctttattttttagccatgttttctactttatcgtgtacctagcattagtttgtccatctttatcgatttgcactgtaaatcattcgccttcgctgcaacagtgtgataccctttataggtttgtcctataaaactttcgattcgctcacgagacgggtggttatcttcatatcgatctaaattggtctagaggttaatttgatctctaaataggcccagcaagccggtttagctgttttctaaacccatattgatttggagctttctagatcgaggttgttggtgactccgtcaacatcgcaatttattaggtgagtcctatgttggtcggaaaaggcgccaacaatggcttgtttataagcctgtgtgctccaaccataacacctccgggttaacccctttacacaaagcaatgatgaaagtttaagtggggtaggagtacatcgaaccgcttaacgtgtaaagcggactaatgcagattttggaggccaggtatatttgttggatccatcagcaaattaaaaccaaacttacaagggcacgtaccatggtatctctcagtgtttcaatatgaagatagtgctgaagaaatttagcaaattagtgctagaatgttagtgtctcataccatttcaaagaccttattttactacaacacttattttcaataacacacactgcctctgtacattattataaatgcaacttatatatacatgctagaaaatgcagcttaattatatgtatactagaaaaatgttagtatgccgaaatataaattcaaaataattttagaatagattgcacgcgtaaattctccattagtaacagagctagtaaactttttgttttcaaaagtaatgaaagaaataaacatgatattataatccatcaaccatatatatttagaagcctgctgagaagtaagtcaaaattaagttctgtggtactctcttcatcttcaaatactgtcactagatactattcatcttcaaactttcatttgcttggttgtttaaaaaaaatatgtgtatataggcccatatggcatgataataacgaagtgttgcatcttaaatatcacgaaatctgtgcaccatgatctaactatttaaaatttattatttatggtgaatattaaattgtaagcatatatttgaaacagttctggatttttgatattttagttgatgacgctctctctcgtggcccgatcttctggtgagggggataactctcgctttgatcgagtgcgacgtttgcgacgtggctaccaatcagaacaagttcaggacgccgtgcaatcgctacaccacaaacgatgtcgtatcaaccgtgacgcgcggttgatgatccctgcaatgcaaacgagagaacactgcaagaacaagataagatgcaatctaaatattgcgaatagggaattaagcacaaatgaatagttgcgattgaagtggtagatctaatcgacccggcaaatcaacacaccaagtattgggggctctgaatctatagtcgccgactaatcgagcgaggactagagacaaggtgaatggcacttggcaaaattcaactaaacaaaacccaaatgtttttgaggatgtacaaagctatttatagaggaaaataaagctagggttcagtgctaattcgtggaggtggagggtgacacttccgagatgggcctagtctattacaaggcccaaggcccaagttcggtttcagcaacaacactgtcttgttttggtgattcccgttgactcgagatgaatttggacatgagaccagatgcatttgaaaggtagcgagataagctttccacgaagtccaagatcacccaaatcgagttggcatgaaggcgctaggtccgtttgaagtcagtgctgtctctggaggccgaactggacttggacttggaattatcattggagtgtgtgaagttatgagcgtatccaacgaagtgatgtcctcatcatcctcctcttctagaattggagtcgtcctcgactcaatcccatcttcttgattgtgtgcactctctcgtccattggccatccttggaggtatctcatcgtgaaaaacatcctcatattcctgcaaaaggttagtaatagcgggtggcaaagaatataaagtactaggagcagtagccaatatgagtatagaatcttggcaaaatagagcatagcaacaagaatctggctcatctagtgcacaaatattatatttagaagccaacaaagcacccttcaacttaatttcattctttgtggtacttggttctattttactagttggagcaggatgtttagcaataatttgattttcacttttcgctttcttttcacattgaagtcttgcaagatcatctttcaaagcagtggctggagtcatagaatgcaaaacaactcttttaccatcgaacataaatttatatgtattagtcctaccatcaaaaacaacttctctatcatattgccatggtcgccccaaaataacataacaagcttgcatatgcacaacatcacattcaatttgatcatggtaggagcctatagaaaaaggtattttaaccaagcgggttaccttcatcttaccacatgtattaaaccactgaatatgatacggatgtggatgtggatgggtagtcaagccaagcttcttgaccatctcttcacttgctaaattgttgcaactcccgctatcaataatcattttgacggtatggcctttcacaagaactttgctttggaacaaattgtgacgttggttttgctcttcacacttctctttagcactaagtgctagcttgacaattaggctaggatactgatctagcgactctggatgcaattggacttcctcgatgtcatcattatcttgtccacctgcgtggtcagtggcagctaaagcatattcatcatcataatcgctagcagaagtatactcaccatcagcattcacaaatagagctcgccgatttggacagtcgcgggcaatgtgtccaatgccatggcacctatgacatgtaatatcacgtgtacgtctagtggaatctactgaagttgcactcttggctggagtctgaactgaagcgtttttgcttgtttcttgagcatgggatggcgtggaggtaggtggacgaacagcagtagtagattgacgtggtgttgactgtcgtgtggaagtagcacctgcaaaagaactcctatgcttgttgcgtccctgcacttctctttcagctttgcaagcaaaatggaataatctattcatggtattgtattctttatattcaagaatatcccgaatctctctattaagacctccatagaacctagaaattctagcatcctcagtttcttgcaaattacatcgtgacaaagcaatcatcatctcttgatagtatgtttctacagaattggaaccttgtcttaaaagttgcagtttatttaacatgtcacgagcatagtaagaaggaacaaatctagacctcattgtacgtttcatatcatcctaggttctaggtctaagtcctctaccacatatatcattccaccatagagatgcaaaggaggtaaattcactactggcagctttaactttcttattatcaggaaaatcatagcaagagaatttttgctcaacagctagcttccagtctagataaacagaaggttcaaacttaccatcaaaagaaggcatagtaaattttaccttagataaaggatcatctttgtccctaattcgacgtcgtcttctatttccaacactctcatcttcctcctcatcatcagcaacagattgctcttcgtctttatcgtcatatctttggtgtcgatgagcagtggcacctgcaccttcttcacctgcagcctcaagtaaaccaatgcgtcgcacaatattttcatgtccaataattatattctgaatgttttcagttaattgtttatgtgatcgatttatttgctcaatttgatccactactttcaccaggctttcacttaaagtttttaaatgtttatctgtgctttccttgtatgatttactattacgcatcagctcttaataccaattttccatgcccttcagtttatgtgctagattctccagtgttggttcgtcggaacttgtacctgacatcgttagcaagcaaaagaaactcacaagaaagtgtcagttcctaacaatctatatatatatggagcttttgaaggcactcaacactcaagcatataccaaattcttataatgttctcaaagaatgcaaatcaggtcaatcaccgtggctggttcgtggcacaatgacacgcttgatgagtggagcgattgcaaagccggacctgtaaaggttagtagtatgtggatcttggtaggcttaactatatcacaaggaatagcaaaaatcaaacagatatgcgaaattgaataataatccaaagtattagtcaaaattgctggcctagcctagactcaatcctagctcaagcaagcaaatgttcacactcggaccaaaacaactcgctatgtcaaccaactctctccaagaaatccacaatttaaaaaaaaaaattccaccctttctttttttttctgattttttttcttctctttttttttctgattttttttggtgcggctctttttcttcttcttttttttcttttttttttgcaccttctgccttttctctatttttcttttttttcttttttttttacttttctatttcacaaatggcagctatcaatcgaattggataacatgtgtgtgcaccgaggaattaatctgcacaaggaaattctatgcatgtgtacacccaacaaactaggaggccgagatttgcatgcacatggaatcaggaagagacgatggaaattacacaagtactcatgcatgcatgcatgcgcaatcaagtaggacagcagattctgttctatttttttttctttcggcgtcacttggttgcacgagaaaatcaaagaagaaacaaaaggaagcagattttccctaattatctgacacatgcaacccaaaaaaatctcaatgaaacaaaacctcagctctcaaaccaatctgttactaatcaatctactgcgcaactttctctatggcggcggaactgcgcgactttctgaaacaactctagagcaacatgcaacccacacttgcaaactaaatccaagactaatctagggcttaaaccagcacttgactcgacagtggatcaaaactcaataaagcaaaaactgaatgaaattgcgtggctcaaaactaatgtttggtgatgggaaaaaaatattgcggctgtatggtagacgatgggaaaaaaaattacaaaactaaaatcctcaccaggcaactaaagctctgataccaactgatgacgctctctctcgtggcccgatcttctggtgagggggataactctcgctttgatcgagtgcgatgtttgcgacgtggctaccaatcagaacaagtccaggacgccgtgcaatcgctacaccacaaacgatgtcgtaccaaccgtgacgcgcggttgatgatccctgcaatgcaaacgagagaacactgcaagaacaagataagatgcaatctaaatattgcgaatagggaattaagaacaaaggaatagttgcgattgaagtggtagatctaatcgacccagcaaatcaacacaccaagtattgggggctctgaatctatagtcgccgactaatcgagcgaggactagagacaaggtgaatggcacttggcaaaattcaactaaacaaaacccaaatgtttttgaggatgtacaaagctatttatagaggaaaataaagttagggttcagtgctaattcgtggaggtggagggtgacacttccgagatgggcctagtctattacaaggcccaaggcccaagttcggtttcagcaacagcactgtcttgttttggcgattcccgttgactcgagatgaatttggacatgagaccagatgcgtttgaaaggtagcgagataagctttccaggaagtccaagatcacccaaatcggagttggcatgaaggcgctaggtccgtttgaagtcagtgctgtctccggaggccgaactggacttggacttggaattatcattggagtgtgtgaagttatgagcatatccgacgaagtgatttcctcatcattagttcttttaaaaaatattttacaaagagagatatggacctctagctttgtgtgccagggtggttggtacccaggttgaatgtctcggtgctaggggtgaaaacggatcgtgatcggtcggatctcatccttcccatatcttaacccatattttataatcgaaatcgggtcggacacggatagtgccgaatacggatacaaactcatataatgtcgggcaaaaatacggaacaaatacgtaccgatacgtacactatataacgattacggatatttatttagatatcaagtcgaagcaacaatcttatatatcacatagacaataaccatttaacaattccatgtatctataatacgattatattaggcctttaggaccttaggaaataaatagggtacaatacatcatagtagaaccaatacatagtaaaaaagtgcctcacaaaaacataatacgggtaatattcgtataattatccgggtaatacccgaattttttactggataatccgtatccgtcggatactacgttcccgaatccgatcttgtatctgccaaaaaagacccgtattcggacctgatatccacgaaaggtcctgggtacccgaattttcgaccctactttgtctcgaaataatgtggccaggcgggtgggcaggaaatacccgccccgttttcaccccaatcggtttgcggaaactctaatgggcgatcaatcgccttggctattggctagcgatcaccccattcccccctccctccctccacctggttttcttttttaccaccacattactttcctattttagtaaatttatacacttcaagtttatacacctcaagtttacacatctaaagtttagagaccaaaagtttataagtcaaaagtttatatatccgattcaaatttgaatttgaattcaaatatttttttatatatagtatttctatacatctaaagtttatagacctaaagtttatatacccatttcaaatttgaatttgaattatatctgattcaaatttgaatttgaattcaaatattttctatatatagtatttctatacatctaaagtttatacacctaaagtttatagatccaaagtttataagtcaaaagtttacatacccgatttaaatttgaatttgaatttgatttcaaatttgattcaattttgaatttgaattcaaattcaaatttgaattcaaatttgaatttgaatttgaattcaaattttttatatatagtatttctatccatgattttttctaacttttgtttttttaaaaaaaatttatagtgtactgtagtaggaagagaagatggggaggagaaagggggagaagagagaggaatcggcattgggggaggggagtgcgggtgatcgctcccagctatcacccgcgcattagcaggacccatcggtttgacgccaacctctaccacctaagaacaacttcatgattgctattgatttgttgtaaaaatttggaaacactaacatatcaatgtatcctaattcatttttatttataaaaacttaatctgagacaatgtggatcctttcattctccctcacccctaaatcctgttgatttgccgtcaaattttgaggaaaaaacaaatcaatcgatttattttaaaatttaatagcaaattaataggatttagggattggaacgagtgaggaagccacattttcctcccagattattttttcttaatgcagaataaattaacggagagcaaaataaattatgatacatagatttaccattttttttcacaatttaacagagaggaaacgaagttattctagatggcagatcggcgtcaaaccaactagtggcgaggtcaggtgtcggcgcttgcttatttagcaccgaaacattcaatgctggcgtcaacaaccctggcagggtccatatctgcaataagagcaagtttaacagtagtttaacagtacaacccactactaacttaaaaaacaaaaacaagaggtgctttcagctttcatcgttggtcaaagaaaccgaacgaaaaaaccgggcagaaaaaagtccgatccaagaaaaaacagagcgaaaaaaccgggagaaaaaaatgaccgataaaaaaaagggcgaaaaaaacaaatctggacgatccaaaaaatacgaaccgggcaaaaaaaaacccggctaaaaaaacgtccaatccaaaaaacggagcgaaaaaaaagggagaaaaaaacgtgcgatccaaaaaagggagaaaaaaaagggaaaaaaatctgtccgatacaaaaaaaaaatacggggcaagaaaaggaaaaaaaacgaacgaatcagtaaaaaaaggcgaatttttttaaaaatccgataaaaaaatagggcgaaaaaaatcagtccgataaaaaaaggcaaaaaaaagaaaaaaatcgaaacgaatccgactccatcgacgcggtaaaaaaaggcgaaaaaataaaaaaaatgtccgattccaaagaaaaaagaattatatgtgacgcggtagaaaaaatcgaatcctactgtatctataaaggttcgacactatggtggaaaaaaccgttcttaaaaaaaatacacgagaaaaaaaataaaaagggcgaaaaaaagcgcggcagaaaaaaagtctaatttcattttagtagtccgtttatatatcttatttatctctaatctaatctaatctaactatttaaattcagaagtttctaccgtatattaaaaaagaaaaattacgtgagaaaataaaaacggttttaaaaaacgcgtgaggaaaaaaatgtcagaaaaaagcgcaaaagaaaacacgctagaaaaaaaagttccgtagttcgtaaaaaaaaacacgctagaaaaaaatatttccatcgtatgtaaaaagaaaaaaaaagcatacaaggaaaaaactattagaaaaaaacgctaaattgatggacacttggttggataggctccatcgacttttttccatctcctacacaacttttgtttcgtcatctattctcctatattggagaccctgcacatttttgtaggcagttatcataaaaaatatttctgtgaaatataactattattcttgataacatattatatggaaataatcttagaaaataaacatattttaattgctatttagagaagagtgcatagtgactctattttgtgtagacttgaccatacgaggtagtgtaggatttgattggttgcaagaatgagattaaaagaatattttagattatatgcatgttgttatatgaataatccaattattttaggtaaagcaaacatcgtaaggttgtcatcatcgaggttgggctattatatttaagatgttccaattttctaattttttaattgtcatcgacatggttatgcatgaaaaacgtatattattattacgttttttcacccgttgcaacgcacgggcatatttgctagtcatctataaccaatgtaatagctaattcatataatagttgcttactatagtattaatatctgttcccacctgtcatacacacattacgtcttggagtccgtgctgcagctggctacagatctgtagcccgctgcttttctctctcttcctttatctttttaaaatatgtttatagctggcttatagcctactattgtacctgctataaggctgtgttctgattcaacggatgggaactaatccctcccgcacgaaaaacggagcggtccattaacgcataattaattaagtattagctatttttttaaaaaaaatggattaatttgatttttttaagcaactttcgtatagaaacttttaaagaaaacgtgttgtttcgtagtttgaaaagcgtgcgcgcggaaaaccgggttggaaacatgggattgcaaacacaacctaagttttaaggggtctatttgcaaaatatggtctctaaatagattaaaatatcaaaaattcagtgaaactcaatggtatatatggtcagatacaatgtacgcgatagtgtttttttgacggctgaagcttcctctctgagtcgtcgtccattccctagcacagcagcttttagagatgcatatgttgccattttattattctcttcaacgggcataattaacaagaagaatgcaactaggcgaccagactgtgtactaggattgaattatcatcaaatatattccatcgttgaccatacaaatcaaaagcatgcaaagtattgagattcacacaaaagcacacacagtaatgcagacatcacgggtgatgtaagctgcaaagattataccctatttgcttagacttttaagtcagcttatgagtaaaagaaaatctaaacctaaacaatcaatcaacttttccatttggcttttctaaagtcataaactagttttacactgttaagctaaaaactatattgaagtaacttttttggcttatgtggagattctaccattagatttaacgcttccaagctacgcaccaacttataaactatataaagccaaaaggtcagcttataaaagcttaagcgaataatcctaaacttaaacaaagagagcctttggactttcgctgactaataagcataattaatttgcattaaagaacacgtgatttgagaacattctactaattttcactatgacttttgatctctcttctttgtttcaacatcatgaagattgatttgtctcttctagaggctcctttttcaaaactagatattgataatctggtaaagaatcttcccacgaatagagcacctggccaaatggttttgatgatcttttttataaaaaagtgtcggcctataatttgccatgattactacaagctatgtgctgattttcacttgggatctctaaattagattctatcaatcactctgatccctaagaagttgaatcctatgtatatcaatgattataggccaattgctctcatgggaattgcccttaaaattcagactaagctcttggctgacagattacagaaagtcattttgtctttgataagttagaatcaatatggtttcattcaagaattaaagaaccattcaggattgaactttgaattcctacatcagtgccatcagtcaaagaaggaaattgttcttttgaaattagactttgagaaaacctttgacactatagaacatgaggctatgttacaggtgatgaaagcaatgggattcactgatgtttgtttaaattgggtatcaaaactgttctcttcttcttcttcttcttttgaatggcattcctggaaaaaatagttgtaaaagatgtgttagataaggagatcctctttctcctctactttttgtgcttggtgttgaattgttgcaagctgtcagtaataaatcacatcaagtgggtcttctttcaagaccaatccctctggtcgatgatcataattttccaatagttcagtatgatgatgacactcttctctatgtcaaggaaagtggtagagaattatttgttttaaaagctcttttgcaaacttttgctcaaggtactagtctcaatgttaactatcacaaatcttgcctcattccaattaatgtagataaagataaggcacaaatgttggcaggagtgttacatacctaatgtagtcagattggttcattgacttttacatacctaggcttacttttgggtactacaaggccaagagtggttgattttgctcccttgattgacataactgagagaaggttgtctgttaactcatcttttctctcctatggagatagacttatcctggttaattttatatttttctctttgcctacatattatgtgtacttttaagttgcctaaattggtgatagagaatattgacagagcttggaggaattgtctttggagaggatctgatattaattcaaatagaaaatctttgatagcctgggatgtagtttgcaaacctaaagtcaaggggggacttggtgttattaaccttatggttcaaaatcaagctcttttgatcaaatatatggacaagatctataataagatggatcttccctgggttagattaatctggagctccaattatatgaattgtgtgcctcatctggtcagagtttccttttggtggagacacatatgtaaatcgatggtcatttttagaggaatttctacgtgctctttaggcaatggggccacttgttcttgttgggaggtcctcttttttggttcagaatgccaagactattttcatttgccgctgacaagctggtttcagtccagaactttagaggaacaaacttggaagataatttccttttgcctttgtctcagcaggcttatagtgaatttttggaggtgcagagcttgatgaatgagattaatgcttcccaacagtataatcaatggggttattttggggaattttaaatatacctcccaaaaattctaggactttgcaacctccacaacatctcttatggctttggaagagtaaggtcacttcgaaggttaaagtttgtctgctggctacttcttttggatagattgaataccaagggtatgtttgatcataagtgtgctccagttgattgtgatctatcatgtgtagtttgtcatcaacgacctttgaaactctgatgcatctcttcttctaatgccctttcccagtcaattgttggagcattttgggcttagtatgaaacacttcgatccatcttcagaacaagatgctacaaaacaaagctgcctataatggaaaatattttatagagaaatttctcttgggatcttggaacatatggaagcaaagggatggtcttattttttttttatcatagacacccctccttgtctctctggaggcaactccttaagggagacctcatttttctcttgtttagacttaataagagtgacatagatgtagtgaaaaattagtttatttctttgtaattctttgtatttttcatcctttcaataaaatctttccaacaacgggggcttcccctgctgtgttcatgtcaaaaaaaacattctactaatttagtcaacttacttgggaactttcatcgatgtactccctccatcccagtttgatcatcctctacgcaaagggaaccaaggccaaggacaccaaaatattcatcattatcaaattaatacttaacagttaaaggtgattcattgctttgttccccgtgaattgctcatgttttaaatattgcatgacactacaccaatagaaattaatcttaatttgctgcatgcaacacattcaaatgatgcatgtttactctttgcataataaataaagagatacttgttaaatgatgatcattttgagaagacctcaaaaaacttaggggatgatcaaaatgggaaggagggagtattatcactctcacattccaaagcatttctagatgtagcatttaatctctagccatcataagtgcagtcattcatagcggttaatcaaagttaatgctactttgaaaaacgagtagaatatagttaatgaggcgtaacaatgatcatttgccacaatttccttgtttggtagtatgaaatttgctagaaggtaaataatcggaaacgaatggagagtaggacaggaggataagatcccgtggcatttcaagagattaatatgataaagaaccaaagatgagttaaaattagttcaaacttgatcgtctccaatatttaaaggtaaaatttgctacaggacactcaaagtttgtgatctttgttgtgggacacccaaagaatgtatatcttcttgtggacactgcaaaaatatggtaattagctgctggacacctgaggcattatttttattatttccggtgaaaacggagagagaaagagaattgaaagtaccaaaatgcccttggacacttttcttcttcctgcatcagctctcttttctcttttcttttctttcttctcatctcttctcttttcttctcttctcttcttcagcaagcctgggaggtcaccggcgacagaggacggaatggcggcgagcgaacgccacagcgggtggtggagggagggtaaacaaccggtggggtagcggcggtgggcgtagtaaggagggg

SEQ ID NO: 80933 - DNA, 612 bp, Oryza sativa
acatgtagcagctcattctccagttctatacagttgataattcataagtggaaaggtttgagctattggagaacaacatcatgtgtgatgattcctatgctcgtttcagcttccatccatccatcaaaactcaacgatggctgagattattcagcgcaaagtttagattttggatgaaattagagatgatgtgactgaaaagttacatgtgtatgacatattgatgtgatggaaaatgactgaagtttggatccaaactttggatctaaacacagccatgaagtacagtatatggctggctgactgctgtatgacctccagcccttcctttccatttattcctccgttgcaattcattccgtctggccgttgggtgctaaacccaccagtagcatggcaaattctggccaagggacatagcaacagaaactaacacggaattgcttattgcaggacgcatccctctccctctattcccaaatgagtacctcctgaccatgtggacgccatataatgataggtgctacacgaaagctaggcacttgcttaccacggccgcaatgattaacggattagcatgcactcgaacggcgaaacacgcagttcctcact

SEQ ID NO: 80934 - DNA, 632 bp, Oryza sativa
ataaaatataatcactttacgatttaagcagtatgacaccacacatatggaaacactctaagaacgtaaagaaaatactattaggcaacacccctataaatttaatatttttgggtagataatggggagaggaggcaaatgtgtgtatcagtgtatagaaatattgcactggagttacggtgggttatgggaatgaaaaatggcttcggaagttcagccttaacgaggggtttttgatttccagttggagcattggaggatgagcttaggttaagtttcccttagcaactagagaggaggcagaaggggatgacaaggcagaggagccatacgagagatgtcttgggtggctaagcgtcaactagtaaaacgacgaggacagcttgaggtgagcaggatcatcgaggaacgatatgaattcagctagtcaatgtgttggtggtggcgtgacggaatgacgcatgcaaagtgcctgaccaatgatctagagtgttttaaggtggcgatgggtcgatggcgaggccaacatttataggcgacgagggttaaaacacgggtcctatataagcgacgaggatgatggcgacgccgatagcatggaagcaatgctcaaggtgaactcttggccacgg

SEQ ID NO: 80935 - DNA, 815 bp, Oryza sativa
gtcactctgggtctttaggcggcattgactttggttctgtcctagtcagcgtaggacccacgcggaccccacatatcagtgacacctcaccttcttcttccccttaccacctctcccccatcatcacggcgcgagcagcggccggcgcgtgcgactgtcgccgtctcgtccatcccactgtcgcgtcactctttcctcctcttcggctccctcctcttccccctccggtccacctctttctctctctttctcttcccctccatcgtcgggcaccattgccgcccccctgtgtcgtcatcgttggcggtagggatgagctacttcggtagctactccacctacctcgaaaccatcttctccgtcgtgctcccgccgctcgactcgattgcctgactaatttctgccattgttttcatgcagtcagagctcgtcatcccatcggcgctaacaacgttgttctacgtctccaacatcgtctaatttgccaaggtcatcatcttgagacgctgttgtagtcaatgggcatcgacgggaagcggacgtactacatcctcaccgtagtacaaaaaacggaccggcccagcggttgaaccgagaaaaacggaaccatcactctcaccaggtcagtttgttttaaggaccgcacatgcaatggaaccggtgcaaaccggatgaaccggatggtttttgaggaaaaacggcggccctggctattttgaaccgccggttcgtgaagcagatggctagattctaaggcccacttggattgttgcggcccaattatcttttatttgcctaaaatgaggaaaaagtgc

SEQ ID NO: 80936 - DNA, 2610 bp, Oryza sativa
  unsure (1)..(2610): unsure at all n locations
gggtgtccagcagctaattattatatttttgcagtgtccacagaangatacacgttctttgggtgtgacacagcaaaggtcaaaactttgagtgtcttgtagcaaatttttccatatttaaaatgaaataatctcacgggaattttgtaagaatcgaactaattgcgatgaaatggctgtgaaatttctatgttccaaaaacaccacgtgatctggtgggagcacaaaagcaaggccccgatatttgtgctagggtcgagctcgatcagctagctatatatgagggtttttgcagggaaccgacacatattgtcggttcccagttggcacctatgaggatttttcactagtgatctccttatttggtatggtatttgctagaacaaggtaaataatacaaggtaaataatttaaaacgaatggagagtaggacaggaggataagatctcgtgatatttcaggagatcgattaactatgatagagatcaaaccaaacatgagttaaaattagttcaaacttctctctgatatttgaaatgaagggatttcacgggaattttgtaagtgtcgaactaattcccatgaaatggctgtaaaattcatttctacgtacgttccaaaaacgccacgtgatctcgtgggaggagcgcaaaagcagggccccgatatttgtgctataggatcgagctcgatcagctagctgctgcaagcgtacgtacgtggatgagccccagcgcttgatcggtcgatcgatcgataatatcctgagtgttcttctgagattttgacgtgatcaagctagctagctagcctttagctgattcgctagaacactcactcaatagtcaatactactgcagtgtgcaggttacagataagagaatggacgagagctgcgtgctgcaccaacgatcgagaggcaagcagatggcacgcctgccggcggacgaggtgcgcacctgtcgaaatgccactagcactctctcagattccatgatgggaggggtgggacgggttgttccaaatttactatttcatcccagtatgttcaaaagataaaaatctcagttttgtatttagattgaagggtaaaaatttttatcgtgtcacatcggatatacggatatacatttgaaatattaaacgcagtataatattaagagtgtgtttagatcccaaaaaatttttggtcaaaaatatcacatcaaatgtttggatacatgcatggagcattaaatgtggacgaaaaaaaaccaattgcacagtttgcacgtaaattacgagacgaatcttttaagcctagttgagccatgatttaacaatatgatgctacggtaaacatttactaataacggattaattaggcttaataaattcatctcgcagtttataggcggaatctgtaatttgctttgttattagtctacgtttaatacttcaaatgtgtgtcagtgtacttcaaaaaaaattggccaaagaactaaacatgacctaaaacaaattacaggttccgcctgtaaactacgagatgatattattaagcctaattaaactatcattagtaaatgtttactgtattaccacattatcaaatcataaagaaattagccttaaaagatttatctcacaatatatacacaatctgtgtaattagttttttctatatttaatacttcatgcatgtgtccaaacattcgatgtgacagggtgaaaaacttgccagggaatctaaacaggccctcatataagctcgaagaaatacatatttaattataattatatatttacaacattaaaacattaaagattaattttaaccaataacataaagaataaatttttactacttatttttcctctcacatcctcataaagcaaaatttctattttatagaggccaagtgtttgttggtaaccgtagcaacggtgtttgtatcatctatttatttttttctctttttctgccaccaagtattcccaataggcaatgctaataataattgcacataccctaatcacttctgaaatttattgaatacaaagattaagaaagagatgaaattaaatgataaatggttgtgaacttgtgattgtggttgagataagaaagcatgggtgaagaaattaaataagagatggttataattagttgagacaaggaagtactccctccgtccaaaaacagctaatctaggagtggtgttcagattcgttgtagtaacaggagtaggtgtagaagttgctatattaatttcgaaacaaaattcagtttctatattttaggatcgagagttgaagaaagttttttttttatactagttctttgttcttacaattcatgggtgtgcatcagtgagatacccggggtgggtggctttgcagagtatgggatgcggcttatcgatcgtgcatggagaacgcaaaagtgaggataaaaaagaagctaagggagaaaacgcagtttgtttttgtagtgatatctggaaagtgagattagcatgtttctcttttgacatgcgatcccttttttgttgtctggtcgtactagataattaactaagctagatcacagtataagtctatcgataaactctctagttaaaagtgaat

SEQ ID NO: 80937 - DNA, 6773 bp, Oryza sativa
ttgtttgtacatattatgcaactcaatttcctgtagtaatgtgacgggtattcatctagttaaatagacaaatccttctcagttatcacaaaatctggtagtgccaataattccaacctcgctaagcgtggattaaagattgcgagcctatttatctcataggatataagtagaccaatccggaaacctattttaatttacagatcatttttgcaaaccaatttataaattgatatgctcgaataatttataaataggttcgtgggtcaacccatttacaaccataatctatacatgtgcattgaccacctagcaaacccctctcctgacagctggccatgatgcatggtagtaattactaggatttgccaaaatattggttgggaatttatttgttagagattggaattagaccaagtgcctactgggaagagagatttaacaaagtcagaggcgcctaccagtagtccacttgtccagcattgacaagatcacacacttgcttagcttggcccatgacaccaaattatatatagcctaattcatttctctagctcttcttcctgtagggcatctaaactttaagccacacatgcatgatcatgcctggccagtggatgctgctaggagtaggagggtagcaaaatggtacgaccaagagtaggatgtgctctctgcacagataattagccccttgttttgagttctaccatgatggatttctagctatgtgtctaacagttgttaaaaggaagacagcatcagaaacatgaagaaataaaaggccacactatatatagatacttttgggattaattaaattaaattaatggtgtccatagtgaccctaactcaagtaatggtgttgatcacgttcaatgaacatgatggaaagtgaccctaacttaggttgatagtgtatatgtatgtagggctgtaaaaaaagctcgagactcgcgagtgctcaagcttggctcgtctaaaactcgattcgagattggctcgagctcttaacgagcagagcatgaacttaagctcacgagctttgtcaagccgagctcaaagcctaatggtacatgcatggaacttttatgttttatttgatgagtaggttatgtatatagattattatacatttatgtgaaaaaatagtatgtcttgatatcacatattctcctttattctttcttctttctataatatgattaacttaaaattattgtttcaataaaaaaattcaaatcatcaaatgtacattatcatatactcgagtcgagctcttgagcctaaccgagctcaagccaacctgcttgaaagctcgaaagctgattaggctcggttcgagcttctatcgagcctaagttttttttttcctaaaatataacgaatttgaggttatttacatgtaggtataatactattaaaagtatatgcacattttttgtttacacgtaggtggatacctatatagggaggacgcgagcaagggaggcgaccgtgcgcgcattaattacccagtcccagtcccctcactccctcagcttgcaacccctgacctcccggctttacggattgggaatgcgatgcccacttgcggggatcgatctgccacgtttgtcgatcgatcggcctccaacggccgggattgggaagttggtggtgtgacaggccacagccggtggtgcgatttgcccctgcagatcgaagtgatgctgatgctgcttcgcatgcgtgctcatggagaatttcctttttggcgtgggtccagttgacctctccccatcatcaatcctccgtctttctcctccatccggccaagctttgcaattgcaatattgcatgccggccttgatcgatatccctctccatggctccattattgcctcaacataatatgttccttgatccatgagtcaccatcatgtagacataatgagagggacacgcatggaatactctttgattatatgtagcctcaaactaaatgtgatgcaatgttcctaggtactgattggtagggttttcttttttttttcttttttgtccgcggcttataatccgaagacacgtcacataatcaatgaaaaacaacaatgtaaaactttgagtaaattgtattagaggctacgaacttgataggtgggtataaccttgtacacaatacttatagaaccagggccgtgccgtcaaatttgtggccctgtacaaggctctaagtgaggcctaaatcaagtaccaaatatatctaaaataatgtatatactgcagagcaaatgccactacactggccaaggtcacctgtgacgggcccaaaccctcatctttgacggcttcgcgcatggtcagtgatcagtggtcactggtgagtccagtcacctttgacgggtggccggccgtcacaggtgacacccacctctgacgggcaagttactagaaggccgtcagaggtgttggtctccgctagccttgagcgagttaggacccgtcacaggtgactcatctctgacggccctttaaataaaggccgtcagaggttgaggtctccgtagttagaagctgtcacaggtgatctacctgtgacggccccaaaagtaaaggcccgtcacaggtaggtcacctctgacgggcctttatttactagtccgtcacaggttatgttacctttgacggatttttgttccgacccgtcactgataagttaattccagaaaaaaaataaatgctaaatattggctagcctcaggatttgctagccatgccctctgaaaaatagaaacatcacaagatatattccagtcacagatccatcacagatacatcacccccccaatataacatcacagatccccaacaacacatatatgcagttcaaatgccacaattttgcacagcaaattcacaccccttgaaagccacaatttcagtcgttgctcatagaaccgcatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaacataaatattgcacatatgaaagtaaattacattgaactctataaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcgggggggttgatgggtgagatcttgaagccagctctacctttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcattcttgccctccttgtgcctaccacccttttccacgtatgggccccaagccatatttaaggccttggtgatttcactaaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgcctcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttaggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaattacctcgatgtggtccactgcagctagtggtgcgatcgggagaccaggggccggcacctctgtggatggacaactactcctatgctgtgacggactcgcgtcgtgttgtacacgaggagttggttgcacagcaggtgttgtgactcggggtatattcatgtcggcgagcaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatgcttccagggcacatcgctaccaattccccgagttcggccaggatgttctttggttccgagcgcctttgttccgtccaagctcgctctttctcggcttctgtgaccttcccgatatctttatggaggatcccgaagttctcacgtgccgctatcccgcagcagttagaccatcttccaatgacagtcctgggcgccgtgggcctaccactagcgtcaacctctcttataacttgcactgtggtcggccatatattttgtgaccgcggatttctactagacctacttgcacttgtctcgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcataacatcaaaagagcaagtgcagaaaatctgttcttatgcataaaaaaagaacaagtgtagaggtatataaccaatgaatcaagcagaataaatttaaaaaacagcagcagcaagggtacagaatttgcatgattgacataaaacagcagcaggagaagtataataaggaacacattgggcagcagcagcaagggtatataaatcatcaaagaatgacagaaaacaagtgtatatagtctcctcttatcaatccagaagaaaagagcaagtgcagaaaatctgttcttatgcataaaaaaagagcaagtgcagaaaatctgttcttatgcataaaaaaagaacaagtgtagaggtatataaccaatgtatcaagcagaataaatttaaaaaacagcagcagcaagtgtagagaatttgcatgattgacataaaacagcagcaggagaagtataataaggaacacattgggcagcagcagcaagggtatataaatcatcaaagaatgacagaaaacaagtgtatatagtctcctcttatcaatccagaaaaaagagcaagtgcagaaaatctgttcttatgcataaaaaaagagcaagtgcagaaaatctgttcttatgcataaaaaaagaacaagtgtagaggtatataaccaatgtatcaagcagaataaatttaaaaaacagcagcagcaagtgtagagaatttgcatgattgacataaaacagcagcaggagaagtataataaggaacacattgggcagcagcagcaagggtatataaatcatcaaagaagggctgcaggaat

SEQ ID NO: 80938 - DNA, 4999 bp, Oryza sativa
gatcagcgtcccatattatacatttgactgagcacatgcatatctagatcgcatcatgctgatatgtgtacctatgtagcaacctgataaaggttcaactcggtaagattaaacatagcatactcatttggcttggttcggatgcacaagacgtgtaccgaaataagtgttccctaagtttacgtaccaagtttctcctatctattaagttactgtaccatcgatacaatttactctaaaacttttatatttctattcgtagcagtctgaaagacaaagctgctaaattgaaaaatagcaaaaaaatcataattaattctaaaatcagtatttacattcaaattttctagtgatatatacagataaatgtttcttgtttgtttagagcatggccaacagtttcccgatactcttcccaatatcagttttgaggagttttgttggaaaaaatcgctccaacagtagacctaaatcacccctaaaagcttggcgtttccaaacccgcatatttcgttctccacttgtagggaagagactcggcgcccaatccttcaaccgcatgcacttcgcgcgcgctgtgtgaaaattttcctaccaggttcttctttgtgcgttcgtctacctgtgagtcaatccatcacgccagcagcctcatcttccccgcagctgtctgggaaagcagccatggctcccccaagcttccccagcgtcgacatttttttctcagcggcagcgccagacccatctccaacccaattgggcggaccttcgtcggcgctcccccagcaccaccaccgactcgaatcggccgtcgcccctattcatctccaatcgtccctcgaccctaccgcatcctgcagcacagcctgtctctcgcgtcagactggcgctgcgctccccccggtaatgtgcaggcgacaaaggccccatgcgatgcgaccagcagccggcgacaaccggaggtgcccagtcgctggccttcatcgaatcatcgtgcacctcggtcggagtcgatttctgattgttgctgctgctcaaatctggagcttgctattgctgagaactgcttggtggtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgcgcgagcgtgagtggaggagaggaatgacgattctgttggtagttgtcgatgtggcctactttttttgttttgaggattaaattttgggaatctcttggagataaaaggtattctcataccttaaatcctttttagagatctaaaaaaaatgatttaggggattgaattttgggtggctgttggtgatgctcttacaagagaaataaggctttggtttagattattgggcgaattattgcctaaatcatctacttaattataggaataaatttaacttttaaaaaatatatttacgagtaattctaaacaagtggtttaagcaatacagtaaatgtgtacggggcatcatggtttctttaagtacatgtacggtctttaaacttgtggatgtgtgtcatctagggtcctgtttggatccgcggactaaattttagtccctgtcacatcggatgttgggacaccaattagaagtattaaacgtagattaatgataaaaaactatttcataaccatggactaattcacgagacaaatctattgagcctaattaatccatgattagtctatgtgatactacattaaacatgtgctaattatggattagttaggcttaaaaaattgtctcgcgaattgtaagtagtctatgtttaataatccaaattagtgtctaaacatccgatgtgacaagacctaaagtttagtccctggatctaaacaccacctaggcaactgaactatcaatatatattttttccccaaaacttattttgggtgtcatagatccaaatgaattccagcatgtcacagtgcacctatgtatcgatgggacctacatgaaagtcatataaaaataaattaaaagagagaagagaaaatgatgctttttatttttgaaaaattaaaattaaaatagaggagagagagtaaaaaatgtttatatttttttctacatgtaagcaccaccatggatgccatgtcagcacatgtagcaagttggagcccgttttggtctatatgacactcatgataagttcgaagatctagaaattcattttaagagttcagagatctaaataacatacccatgtaagtttaaggaccacccatacacttcactttttttttcttccttaatatctatttcctccgtttcataatgtaagtttttctagcattgctcatatttatatagatgttagtgaatttagacatcattaacatttatatgaatattagcaacgctaaaaagtcttatattataaaacgtagggaatataaaataaactaaaatattttatatcatggtgtggaggtagtacatagctgacacggcatgtagaccatgtggtcactcgcttgggttggctatgcatgtggttggtgccaccaaggaccaattttgccatgcatggtgaacggcaataactgggagagaaaaaattagaacaatggacattgacgtgtggagagaaaaaaaagtcatatctagccagtttgggaaaacatcattgatgtggtggtacaccatgattaaatcctcatgtctacaaatataattgtgtacattcttggtacagaagtcttaaatttatgctttcatcgttcaaagggaatctatacaatattcgacaattttgaaaaacttctaatgtctattatataattatagtatcattttattataatgataatgtaacttctgaattataatgtaaagtatagatgcatattctagactaaatatcatcgttttttttcttatctactaaatatctctagcaagatatggcaatgaaagtatagatgcatattctagacttcggtccttttggccttctatatattcatcaatcgtcatggtctgattggatcactcgacacagataaaaagattctagcttgcgttagctcacggaaaggtttgatgctagcacttagtagtttctgtaagcaaattaggggacaaatttgctagcacattttatagggtgtatttggtttgctccccaacaagttcaattcctcacatatagctacgaggatcccaatctcatagatacccatattaataattgagtaaactttacaaaactccaagtattattatttaagttgcacaaaatcacaatggtttcatagcaaccactagtacagaacactccataagtgttggtagggaataatctcacttaggtatcgatttttcaaccggcaccacgaagatggaactaatgagaagaaatctatcatcgggagatactcatagaccagataaatagggtattagggtacgttggtacgaggacctacacgatacgacatcaaaacaaacaaaagacaaggattatactggttcaagcccctcgtgaggtaatagacctaatacagtttatatgagattgatatgggaaaccacatagtacaaagagaacagatgaatccgatgataccggcgagatccttgtcgatatcgttcgacaagatctcccagcggctttggcttgtgtccttcggcttcgtaaactatggtcggtatgatggcgctatgattcgatgatcctgaacccctccgacggtgtgccttttataccatgagttgccttagtcttcaagtagaacttggagacagtgaactctgcacgatctagaataatccatgtcctctccgagtaggactctgttaatcaccagcccgtgaggatattttccataatatcttgtatacttccttatcgcatacgaaaatatatcgtatagaagatggtatatatgccaatcttgcatattcggtaaatcgtaggataggagatatgccttatccgtaaccttgacagtagccccctacttcaatttaaatgaactcgcaatgtcatccatgacttctctgccaacgttatcacacccttctgatcgttctcgatgggaaccgagaagacgccgaattcttgataatattgaaagaagttcaacggtccacaagtgaatttaatttgaagtctaatcaatctgtcagcaacgagcttcagaaattttcggcggcaatctctctccttcccttgaaatacgaaccgtctggtagtgcgcttatataaagcgatttactggaaacatttcgagtctgctcgcctctgaagctttccaacttccttgcgcttggactctcggtttccccaatcctcagaaaaaaaaccctacctttcttcttcccctccgttggtcccatcgacggcgatagatctttgggcatccagcaccgatgccgtggcgatgaagaagctgcaggtggatggagcactccccggccgcgaacgcccgaagagagaggacggaggtactgttccccaacccattctaggtcagatggtagtggtagtctggtagaggactttgtgtgaagtggtttctgttagaataattgggctaggcccaacttataatattaaatctcaaaggcccataataaatgttgaggataataataccaccttaggatttaagcgagaaatatctcaaccta

SEQ ID NO: 80939 - DNA, 3956 bp, Oryza sativa
ccgcaacagcgcgtccacgttctttttcctgatagataaggaggccgcgagtccgatccgttttcttcgcttctttcccggtgttagtttctccttctccgcgcctgagttgctctcgcttccccgcttctgatctcttgcgcgcacgagagattggaaggagcagtgcctctgaaaccacaccttcgcctgagatctgcaccgggtaggcgggtgatcaggtttttggggagtgcctcccgcacgactgctcatcgccatgtctggagttgccgccgccactgctggcggaggtggtacgccgccgccgccgacaggagctggatctggatctggagttggtgcgccaggaggtgccgtgaacgacaacaacaacggaggcaattctgcctcaccatccagcggagggccattctcggggtataatcttctcctcctgctactgttgttagcgctattcctgttcccattgttagcgctatcgctatattatgtgcgctatgttcttgttcctgttctacatgatgcctctagcatgttatcgcgttactggtatgttcctgttcctgacattcatgatgcgcatagtatgctactggttatgttaagatcaccctacactgcttatgccatgatcattgtttcaatttcttggattaaaatatgccgattaatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggccaagttcgaggcttcggattgcctgttccgtggagcattgatcagtgtactcgctgacaacatagtggacgtgtacatgcacatgccttctaggaaggacatgtgggatgcacttgaggccaagttcggagtctctgacgccggcagtgagctgtatgtcatggagcagttctatgactacaagatggtcgatgaccgttctatagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaagggcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacctacagttctctctgtttttcattcacctgattggtgggtggatactggtgctaatattcatgtatgtgctgacatttctttgttttcttcttatcaggtcgggagaggttcctctttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatataggacttttgttggaaaaggttatgactgcggaggtttgttccgcttttctttgaatgacatgtgtaataatcataatgctgtgaaccatattagcgagaatgatgagtctaatgtgtggcattcgcgactctgtcatgtgaatttcgggtgtatgacgcgcttagctaacatgagtttaattccaaaattcactttggtcaaaggttccaagtgctatacttgtgttcaatcgaaacaacctcgcaagcctcacaaggcatctgaggcgaggaatttggcacctctagaacttgttcattccgatttgtgcgaaatgaacggcgtgttgactaaagggggaaaaaaatatttcatgacactgatagatgattgcactagattttgctatgtgtatctattgaaaacaaaggatgaggcattgcattactttaaaatctatagagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttctgactgcgtgtcatgtcctgaataaaattccaatgaagcataaggaggtaacacaattcgaggaatgggaaaggaagaaattaaatctctcatacctacgaacatggggctgtttggccaaggtaaatgtacctatagccaaaaagcggaaacttggaccaaaaactgttgattgtgtgtttcttggttatgctatccacagtgtgggttatagattcttaatagtaaactctggagtacccgacatgcatgctggtacaattcttgagtccagagatgctacattctttgagaatgaatttcctatgaaatatacacctagcacttctagtaaagaaactgtcatgccccgtgagcactttgcaccgatagaacacaatgatcaaacgcctgaggaaaatcctgaggaggacaacattgtagatactcgcaagagtaagagacaaagggttgcaaaatcctttggagatgactacattgtatacctcgtagatgacaccccaagaaccatagaagaggcatattcatctcctgacgctgactactggaaggaagcagtacgcagtgaaatggactcgattatgtctaatggtacttgggaagtcgttgagcgtccatatgggtgcaagcccgtaggatgcaaatgggttttcaagaaaaagcttaggcctgatggtacaatcgaaaagtataaggcaaggcttgtggccaagggttatacccaaaaagaaggcgaggacttcttcgacacatactcaccagttgctcgcttgaccacgattcgagtactacttgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagaaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagaattttgaaatgaaggatttgggagaggctgatgttattcttaacatcaaactacaaagaggagatgagggtgggattacacttgtgcaatcccactatgtggacaaggttttgagtcgctttggatatagtgactgcaagccagctcctactgtcgcgaccgagaaaattaccttttcccaaacgctagtgtattaatccccgtcccaggaaaaggccg

SEQ ID NO: 80940 - DNA, 2238 bp, Oryza sativa
agcttctcttactgagggggggggaaagattgagcaagaatgagtacaaccacagtactcagcaagccacaccggcggatgcatgattaatgcaagggggtacaaggggtaatgatataggggttaagttttgcagaaaacagcatttaaaagtcacttagttgcccaaagccatttataaagacgatcctagagctacataatattattaaacaaggccgtgaacccacacgaacctgccttaacccaaggcctacgatgattcagaccgaactggcaacccgaccctgggtcctagctcgtcccaagccaacccaggcccaccattccacattttagttgttaagcaaattttaagaattaaaacactaactggggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagcaccgacccaaccccacctacggccggaacccccgggacaggcaggcaggattgagccccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaaccaaacccaaccacgcacctcgagcccagcctaaaaccattttgggggttttgaatagagggggaggtgtgtgtccaattccaacataagccaaccattccatagtgtccaaatgatgtgagaattcccaaagtctaaagttataaaaccacctaatgttgcctaattaatcagcgaagcatctacctaaattcatactagtggaaccatgagtagagtacccactagttggggttttgtttatcctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcagagagaacggccttccgaaccttcggcgacggccgcgaaccacgcttcgggaacctccggaacgacagaagctacgcaaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttatatggagatttgcggattattataattaagctttgcaattataaaacatgtgtaagcgctagcctggaaaagacaggagggctgcgccgttgacatgcggaccccacatgtcaacctaaaggaccgcggtagaccgagtacacagagacggtccacgggtcgacggaagcagatcccgtgtgtcaatcgaggcgagtggccgacaaacggactccactagacaccacacgggctgcacccgtagaaaccacgctgctaccgagcgggcacactaacacggtcaccacacgcacaagcgaacgactaccgacaccggtacacgggtaccggggtcgacaaccgcacaacgggtacggggcgacaccgaaagaacgaggacggggcagcgagggagagggatccttaccaccacgcgacgaggcgtgggaacgacaacgacgaacgggcgcggcggagacggacggcgagggaacgacttcggcggcgatccttggacgaaggcgagacgcggccggcacgaggcttgacgacgcggagccgaggacgaagacgacgacggggctgcagcggcacacttgacgaacgcggacgacggacgagaacggctcgacggagggacgaacgccacgacgatgaggacgacgagaggacgacgacgacgacgacgaccggggccggcgaggagacgacgagggcagccggcgg

SEQ ID NO: 80941 - DNA, 6856 bp, Oryza sativa
taccactaccaagcgaaccagcacaattaaagtctcccgaagtctgcaaaacctcttcctccatacaaagtcttcgatgcagaatgtcctccttgtattgtgggggtgactgcggactagaatttgtgaaggatagactcggttctaccagcttgttcatcaaatttgatgaaactccatttgtatgtaagtttccagtgccatcttccatctcacaaaaagaatcagcatgcgaaatggctacaaaatttagtggaggaagttgctgggaagaattcaagtgcaactttaaaggagcctggtatatattcccttcatgtgaggattctgtggtaacaccattagcactgtaacatgcaccatcagtgaaagataagtcagattccaaaatgtttgagctgctcccaccttctgacgtctgtaccaagtctgagatgtcctttgagttcttttgagctttctgcattttcttttgttcctcataccttccattgctactgttgaactctatgtaaaggttgtcaggttctgtattctccatgttttcatccatccactccttaaattcacgcagccaatcagttgatttctctttcttcaataattcagctgtattgatcaacgaagtaatttttatgtcattatcagcacctgcaacttcatccttcttagaactgtcactttcgtggggggtggtctgctggtccacaccttcatcacaaagacttctctcttcctccacaattaaggcaagtcgagaaatctttttctacagcaaatagaagggcaaacagactatcgtaaagagatatcagcaaattttgcagagtacaaatgcaggatgccctacttttgcagagttgtttcaatttagtagcgtttaatagatggtgttatatcttgcatttctcgaaacaagattaccataatatgtcaatgggaaatctctgttaaaactagtgaataccccgggtgttgtagcgggaaatttaaaaatactttaaagaaaacacaaggaaaataatttgtaaattatatacttgtaatgcctgaaaaacaatattttgagctcatagtaattgatttagaattgcaattgtacatgacacatggatttatcaagcatgagaggatccaatggctattacttttctaagtgacatggttcaatgcacattgagttttatatcaataactacaataagtgggttgtaaatgtacatgacacatgattgagatcaaaacatgcaagagatccataggctactattttctaaatgatgtggcccaatgcatgtcaagcttttggttccaactatataggatatatagatatgcccccccccccaaaaaaaactgaggctataagaaaccagcttctgcatgtgaaataaacaaatcgtaagcatgagaagagatcactatgcaatatttctattggtaatgagataaaccgctctaactaacagttcttgaatattttctgtcgcatacaatagatgaattttgtggcagatgttaacttaccatctttgaatttgatgtgtcttcatcctcatggtcatcttttgcaggaaaataaaatccatagccagcaggttgcttttgcctgcttgaaaacagtacttgtttttcccagtactcctgtgtgttcatacctttatcatctaacttcaactgaggcagaaaaaggtacagaacagagctgtcatatcactctaatactgtggaagagactattatgatggagaacataaagaaaaaaacatgagaaaataatgcaatttgatgactactcacactttctgagttgtggagaaaactgaaaacacgtgctcgataccaacgagcacagcagattgggttgccttccaaccataggttctgtagcaaaaaaaggctaccaagtatttccagctccgagaaatttgagatgatgttgtaagacagatcaaggtccataagcgactttagatttttgatcccatgtagtgtagttaaagcattatttctcagtacaagttgcacaattcgaccgcaagcctgcacggaagtaacatgccatcaaacaaaaacaacagtacgggaaacaagctcgccggtttagcaatattccaaaggtattcaaaagaaaagacattttacctcactcaaggatgatatagagcgcaaatgattaaatccaagatctagatttcgtagctttgtgcatttccgcagattatccacctttgcaaactggttccgactaagatcaagggtttcaactgcaggtaacaactgcaatgactcatccatgagcaccagaccatttgaagcacatgatacatacaacagccgaccccatacgggtgagtccttgatatccatgatcctgctcgtgaagatatgcctaagagcatcctgaagtagtgcaaaactgaactgttacatggccatggacagtattgttgcattgtgtggaaatgaacaaaaaggaagcctaatcagaagaattgtttgaccaatgcaactaactgtgcaacttcttcctctattaacttttttgctgctactgagcttttgtttgtgtaccaataaaagatccaagcaatggcactgcccagtaaattgcagcctctaaagccacaaccaaatattgaggttctcaggctatatgctctaaacagtcaattatatgtctctactagtaattacacggtccatccacacacacaaacactttgtttgtttccaatcaacagtgttttagttgtttataatgggtaccctgtgataattacctagacaagatgacttattacagcattattaccttaaatgaccactgcggactccactgaaacctctaactcagataaatgacaaattgcctaagttttcctcagtaaatttgcaaaggagtatgtcaagaagcataaccctattttcagctgcatgaaagcatacacaagacaaacgtacaaagatattaaatggctacagtgccacacaacttctgcattcagagattaactaagcacgtcaggagggtaattgcagcgagcacaaaagggacagacgctacaattgcaatactgtggagtgcaccatgtgccacaaacccacaacacaagcctgaatgtgatcagaacttagtattgcaaagatgctcacaattctctagtccagagaaacagcatgtggattagattgctatcaaattcatattcaccagaggggtgcttgatgataacctaaagacctagcagcatcccgttaaatcccatgggttacaatggaaacattagtaaccatcaaatgcttgtggcgtcatgtcatatgtcatactagtatcttagaactcggaaaatgggcaaattcacccatagaaaagccagtaacatgctgagtaactatagtacaatacttgtaatatatgtgccagccaccaggatgggtcagatcctaggaacatagtattgattgtggctttgtggtctgtggggcataggtgggataacacttaaaaccagttcgttggatgtagaagaaccagactgcaaacaataagcacaattcacacttaatatagttcatagtttagtatgagatcaaaactagcgcctctgctcaccatgtgaattgccggaaacaacgaattaagtagctgcaggatcagaattactggggaacatgtcgtaatcgcaccgtggaattgtaacagatgagcttctcgagggtgtggcggaggtcgagcaggcccctggcggcggaggaggtggagaggtcgcacccacgcagctcgagcacgcgcaggcgcgcgaacggcacgagtgatagcggcgccgggtcccgccccggcccgggggccacgaccttgagcgacgtgagcaggcgcaggatccggcggagctgctcgagcgcgcggtggtcgccgaggtcggcgacgtaggcgcggaggtagtcgacgggcgcgccggcgccgaccgcctccagctcccgcagcgcctcgaggcgggaggcgacgtagtggagccccacggggtggagtcgcagggtgacggagccgtcgagcagcgccccggcgttgcggcccacgaagcggaccagcaagtcgaggtagcggtcgccggtgaccggcggcgcgccccccgcacggccagccgccatcgccgccgtcgggatcgggctagggtttggggacccgccgcatcggcgaatgggggcggagcggacgccggggagggaagaggtggtggtggtggtggtggcgacggaggaggaaacggacacggccgcgctagtatgattggggacacgcgggctcgtgggggagggaacggaaggcgacggggtgcggccgtgcagccaggccgcgcggttgccagtgggtaactggcaagtttcggctggcacctcgcggatcgctgtgctgtgatctccttcggagaagctcccggtttgtggaggccaaaacggacggaatcgcgagagtttcccgtgtaaactttgggtcggttcgagccggacggactgccggagcgacgggttgtggcactggtctgtgctcccgtgcgctgtgtgcggcagtttccggcgctaaagctttgcgttgtgagatgtgccgccctcgctggcttggcgtgtccactccaggagaaggcctcttttggtgttacctacagaagcgtttgtcctggtcttagctgccgcgtgaggcgggggatcgctttccccggaccgcgccccgtcttctcgtgatcgcgtcaggtgatgcttcatcagttcagcgttgtttcaggctcctacgcgcgcatgttggttcaccagatcagagttgttctcgtccgagaattatattactttttttcttgtactttagatcagatatgatcagaattagatccgatgagctattgtttcttcggcggctggatgaccacctgcctgagtgttattgctgtattccttctcgtagaacatggtatgtttcctcgtaatttcactaggataacatatggcatattttggcagtgtgggcagtgctattatcagcgactctatcttgcaggatcacgattcaatccttactcgctctcgcgttgcccacatgtccccttccagaatttaatgagccacatgtcgaccgcatgcgccgtttagcatgccacgctagacgctacaatgaactaataatgaagtcaaatttgtttattccctgccttgccagattcaaatcaaggtgtggctgcatccacggtatcctaggagaaactagctgtattttttggcatgttcacacgaatgttagttctacaaacgaaaagcatgaataatagtatcgggctgatcctgtgtagcagtactgcagtagcactggggaggaaacgtatcctgaaggccttgtttgccaaggctgaaaattctcaggaccttagggatatgggctttggcgaagatggccgaagagtttgagcgtcatgttgtaacgggagaaagtctacaagacgtccttcacatacaagcctagtctaatttttttctcaaccccaaaacaaggtacagcattacagcacccatattaagaattaaaaccggttcaatttacctctttcagtgttttgtttcctgggtttatcccatgtgatatgttgatcggttaaccaatgttaacgtattgtccacataagcaccaatgcgagtgtaagtaaagaaaaaaagaaaaaagaaaagcaacgggcttacatgtcatgtcattccctcactctccctcctccccacccccaaactcgaggaaggcatgccgagggtgggtgcggagctccgagaggataagctcgtgttcatcatcggtgacatgggaacaacagggcttacggatcgcacgggtggagcttgagctcgccaacaactgtgcccaaatgaagaagctcatgctcatatgtcatcagcgacggtggcaccattgaaggtggcagtgccccacgatggagtttgagctctgcgacaatatcaacttcttgagaaggtcctaaccctacggtagcttacctttctgagggagagagaaaagggggagaagagcagaggagagagaggattttatttcgtgtgcatcccatttttttttatttttgataagagacctccctacggctacacctattttttttgagaaaagtatgaattacccctctgaactatcacggtcgaccgaattacaccccttaacacgaaaaccagatattgttcaccctgaactttcaataccggacgaattacccccctcgatctaattcagagcggttttgtcctatgtggcgtacccgtggcaacccagtcagcattttctatttttaaaaaatgtaggacccacatgtcgttcccttcttcctctctcttcactctctctctcgatcacggggcggtgcaggggaggatgtgggcggcggcgcgagcggcagcggcggacgcagctggcggcaagcggcggcagagggcggcggtgcccaggggcggtgggcggcggtgcacgggggcggacaggacggaggcgcgaggcgaggcggcatcgccggaggtggaggcctgtggctcgcggtctgcccgtggcccgtggctcgtgccggcagtcgactacacgcagagccccgaggaggaggacgcggaggagaccgacgacgacgaggaggcggcggcggagcaggagctcacgctcgccgtgggcaccgccgccagtgtcaagtagaggtacaaccgcaacgagcaccactcccccgggcagagcttcttgtcgtcgtcgtcgacggagtccgatgtgctcgtcaccggcatctgggattagcaggtgcctcacggcgacgcaaccgcggaa

SEQ ID NO: 80942 - DNA, 11096 bp, Oryza sativa
tttatactctcgacctatctatcaccaatactactacttttttttaataatgagaaatactttttttaataatgaggaacactttgggtatttttactcctcgctaattttacattgggatgctaggattcgtctttttttagaacggagagggagtatattctaaccgaaactcctaatgggctatcgatcgcccctagtcacccccctcctccacgtggttttcttttctggcaccgcattactttcctattttagtaaatttatgcacctaaagtttatacacctcaagtttatacatctaaagtttagagacccaaagtttataaatcaaaagtttatatgtccgattcaaatttaaatttgaattcaaatattttttatatatagtatttctatacatctaaagtttatacacctaaagtttatagacccaaagtttatatacccgattcaaatttgaatttgaattatatcggattcaaatttgaatttgaattcaaatatttttatatatagtatttctatacatctaaagtttatacacctaaagtttatagacccaaagtttataagtcaaaagtttacatacccgattcaattttgaatttgaattcaaatattagtttataaacccaaagtttataactcaaaagtttacatacccgattcaattttgaatttgaattcaaatattagtttatagacccaaagtttataagtcaagagtttacatacccatttcaaatttgaatttgaattcaaatattttttttatatatagtatttctatacataaatttttcaactttgcttttttattttttaaaaatttatggtgtagtaggaagagatgaaggagaggaggaaggaagagagtagcgtatagggggatggggggtgatcgcccggagcagtcacccgcccattagccacaccctattctaacaccatatgcgtacgtttacaagatgatgtataattacttcatcttgaggaagtatcaaagttgtggtggagtggattatttcacttaaaagggttaaaattctgatatccacgtgcccataatgttaaaaaattgaagtttagtacacgataagaatttactcgtggtggtctcttgatcatgtattaagtattaaggtggtattttcatgaacgtgtatatatgtataggtctttaattaatgtaacaaaaacgaactacacgaatattcttcttatgtttttgtatataggatttaagggccctgattcaaatgattgaagcttttcaaatcctatgaaattcctatggaatggcacattgcatgtggattttaaaggaaatttagcaagaggtctaacttcttgaaaaatttcctttgagtctacctctttcatccgattcctgcgtttttcatgcgctccaatcaaatgaccatttctatgtttttcctgtgttttgcaatcctctgttttacacttcaattcctgtcagaatccttttgttttactattcctccgttttttctaacctgcgattcaaaggggtcctaaatggttctatgaagtgggtccccatgttcgaaaagttaccgattctttgggaaagctggcgagaccaagccgttacggccccatggggccgttcctggcgaatgttaagctccctggctaaatttaacacgtcccatcccatcaccacacattgcatgaggctgttttcttgagagctcacctgaacagtcgaatctactgtatgcagcttttgtaacacctttctcctcacgaccgactccgtgctattgggtgttggccaccacggatccatcggcgatcgagtctccattcgtacgccagaccgagcccatgatctacacgtactactattactaccaccagaccctgtgtagtttccgcacaaaaaaaatttacaccttatcacacctttctcctcacgatagactctgtgctgttgggtgttgccaccacggatccatcggcgatcgagtctccgttcgtacgccagaccgagcccatgatctacacgtactactattactaccaccaggccctgtgtacttcccgtgcaaaaattttacatcttgtcacatcgaacgtttagacacttacatgaaatattaaatataggctaaaaaaataactaattacagagattacaactaatttgcgagatgaatcttttaagcctaattgcttcatgatttaataatgtagtgctacagtaaacatttgctaatgatggattaattaggcttaataaattcatctcgtagtttacggacggattttgtaattgttttttttgttagtgtccgaacatcctatacgatatcctatataatatctgatgtgacacgttaaaactttgagcattgctccagtccagcatattgtacctcgaggtaccagtaccttcaggtaccaatttaaatccaaccgttcattcacggagggtaagattgaaaatctcacacgctaaacagctcatgatcgtgatgctccttctctctgactgagtgactgtgtcaacgaagactccaagagcaactgagcaagtccaaaccaagagcaaggacgtggtgggagcgcgacaaggggtggtcggcgccggtggtgccgggggcgtcggcggcggggtgttggacggcagcgtgttgggcgccggcggtgtctgcacggcggcgaggtaacgaggagcaggaggggtggtcggcaccggtggtgttggacggcggcgcctgcgtcgaaggctgctacgcggcggcgaaggcgacgaggacctgcgtcgcttgccgatgtgcttgaatccagcagcgagattaggggaagggccgcggtagacgtatgtcaccggcgagcttgggggaagtggtgcacggaggctcgtcggccccctccacctccactccggctagcctgtccatccctggtgagagccatcgatcgatgcaggcatgcagcatcttttggagagagaaaagacaggaggaagatgaagaagatacacgcgaaattacttaactacccttgcttctttagtactccatccattccaaaatataaggcataaccaccctaacccaaagaccaagaaataattattattattatcttgtagtttggatcatcctaataaatacaatgcatgcatccaatagaattagaaagcatgagagtgaaggatctaaaaaagtaatattttattggagaagtggtcatagttaattctctacatgtatgcatgccttataatatggaacatctaaaaaaagtggttgtgacttatattatggaatggagggagtacctttctatgctctataaaatcacgtggacagtactactaggtacaactctttctcacccgttagatcaaacgaaatcgatggttcaaattacatgtacgggcaggtaccaagtacctgctggaccgtaaaaattctctaaaactttagtgtcttaacaccccatgtatcggtggccggggcccgggagccccagagcgcgcgaccaatgatgcgcacgagtacacaacagcgaaagcgaagcatgcatgccacgcgcgcgccggcgagcacccaccaccgcagtgatccctcgtcgaattcactctgatccagccgctgccgcacccgccgacccgcgggcgctgctgcctgcacaccagcacgtaaaagcgcgcacggctcgatcgtcgcgatggcctttccctccagtctcgtgcgtgcgtctggccgaaagaggagagatatatcgaccacggcagcgacgcacgcagcgtgctgcttgcatcggcgcacgatgcaccgtctcgtggttgccgctcagcgggagccacactcggatgcgtgtattacgtatgtgtcgctgtgcgcgtctcgtgtgttgctgtgcggtccgcggtggcgtggaccacacgctccacgcgcgcgcaggccatgggcgctagtataccatctttctgttctgttccgctcttccaggtggctagtggcaaagcctgtttgtcttggacccattttcgaaacgctccagatcatcagtgtgagtttgtgaccgtgacgtcccagagtggccacgtcaatatatagtactccctccggcccattttaaacaccactacgagttttcatatctaactttaattgttcgtcttatttaaaacttttctattaatatttctattgtattatatgataataaaacatgaatagtacttgatgtttttttttaaaaataagacaaacgattaaaattggacattgaaactcatatgcgcttaaaatgagacggaggccgcacacaaaaatcttgttggaagtccatatgcatgtacgtaatattcacgaggatttgaaccctagtgggttgagtctaggagtgggtattcggtctgaccaaaaatttcggtttcggtcttcgatcttttggtcatttcactctttggaaagtgaagaccgaatttcaaggcaaaatgtcagaaccgacaaattcggtctctgtcttttcggtctcggtctcggtcctaaccgaaattcaacaatattttcatatatgcaaacaaataatgaaaaatttcaacacaaaaatcacaaaaaatttcgtaagcacgtattagtaaagactcttattaggttgcatgcctaaaagaagtagggatgtgaaaaatagagtttaatcctattgaacttagtgggttttaggttgcatttagatatttttgctaattcggtctattcggttaaccgaggagactaaccgaattgagagaacaaatttcggtttttcactgcctaggatcgaattgatgaccgaatttttggtctcggtctttttctacctacccctaattgagtcatgcacccacgagtccatgacttcatcaccacaccgctggtgcttcctaatagtactactattagtatatctctcctccatgtgtctgccttctttgtgaccccatcgatcgatcgatcgatagctttagagtgtgtttaagaaggaggggattgaggagattggaaagatacgtaaaatgaggtgatccattagcacatgattaattgagtattaattattttaaactttaaaaatggattaatatgattatttaaagcaactttcctatagaaatattttgcaaaaaacacaccgtttagtagttcgggaagcgtgcgcgcgaaaaacaaaactatttttctctctttctcatgcgctcgaacgcagcctaatagttgtgcttcagaaaagtttgtttgaaaaaactagcactactgctactttagcaggactgtgcgtttattggtacggggtgactggatgattgccgatttgccttaaacttcctagtttcctacttctgttgtcgatgagcgattaaccttggccactgaggcactgtaaattgccctagctagatcaggctttcggtttcaaccaataagtttgtcactgcatgcgttcttggcgactcattggtccgttgctaccttttgtcatttcgatagcctttttcatgtcaccgaagagtcaaaggcagtgatcaaacgctgatgatctgatccacatccaagtaaatactacaggtagtagaactcttgcagtagatcagccaaacctacaggtaattttcactgattagtgattacaactctacgcactgatctagctcgactttagttggcaactgtttcctcaagcttctgtacaattaatgaaactaaaatgtgatcctatagcacgatatgactaaacaaagtcaaacgacaaaacggtatgggctggtttggtttgtgctttgtggcctaaatttagccttaattaccaatattggtaattttaatagtgtttagtatcattttgtttgatgctaaattttgacatgcttagaaaaatataccatttcaatagcaaacttaagctattttggctttaatccaaacacaatattgccttgtcaaaattagtgatgctaaaacttgccaaaattcagacattgtttgttattttttataagactctttttgtctgttgggctttctttcaaagccgggtcaatataattaatctgtttcaaaaaacaaaaacttgccaaaattttacattgataaaaattggtagatcaattttggccataaaccaaaccttccctgtatacgctcaaggaatattgctcgatcttcgcgtagtaaacacatcattcgttcctaccaagagtgttcggttaaccgccctatcatcctcttctcattgtcactcgacacaaggcgcacatatacgcacactcgcacatgcaacgcatgaatgttactagcttagtacctttcaacctgtacgcctgcagtaacaataatcttagccaaaaactaaatcccaaaacgagataagagcctggtcatggccacaccgacgacgtccatcccctgaaacggccaactgatagcgtccaaattaagcacacacatgtaaggattactgcactggctagacatgccacaccaccagagacagagacgcaaggatggcgactgtaccagcagcagcagctagctagctagctgcaggcctgagcttagcattcatggcatgaacaataaaatggaacaagtgaggcacacggactgtgcacagcgtgcaaggcaaatgtacttaacagagatggacaccggcccgggtcacagtgtaactgcccagatttcttcttggtgatgtacgagagatgtgtttgttgtgctgcatgactgcatctctccctgtgcatggctaatgggtgccattttccatgtgcatatgcctcaataatgaatgcaggtgcaattccatggggtccatgagatggtactatatatccgatgttatgtttaatttctctctcccggtcttcctcttttccctgtttacctgcaacacctttccctttcctgcgatttgtttacttgcaattagttgggcaatttgtttattttattactcctacctgtgcacttgcttgtgtaccaggcaaggagtggcctggctggctagccgggtcacttttttaggtgctgatgtgaaattggctggtgtcttggcatgaaggagacaaggacatcagacattccatgacttcataccttcccaaacttccaaacaaataccccaatcagtgtccgtctgtgttctaagcaggcaggcacctttttttgctggtcatgtggcttatctgtttgattagtataaacaaatgcagtcttgatcgagtactggggagtagctttctcacgaactttggctggaggatgaaccgtgggtcctcatgttagtggggctcatctgtcattggaatgtaatggcaatgggctctctcatctctcttcacattagcccagaaaccttagctagaagctcgtgcatcagtggctgcagctccaggtttatgataagtttccagagagaatatacttcaaatcacactgtccgaagtctgataattcacacaacattttgaaaggaaaagttaacggagtctgggggaatagaactagctactgtgtactgctttacatgccctgtttatctcttctcctactgctactctgtattcggtcgatcgatccattcatcatactgttaccttcagaaaaaaatgaaaagtgagtagtcgttgtactgctactgttttgagattccgaatcaaataattccaaaatggacagcataagtccattgagtcctcgatctcacagcagcttaaagaattatagcagtgtactatattggctctactatttttatatgttctccgagggacctgttttgcgcgtctgtgcagtcatatgaatgcattcgaatgccacattttctgccatcaagcaaagctgtaaggcccaacccggccaattatttcacgtccacggtacacacatcgcaatctttcttcttggaagatatctgcaagaaaacttttagtctgaatcaatcaatcagtagccattcttacccagccaaaggccatggcttcagctcaatgctgtccctctgaagcttgcataaagaaaaattacagtaaacaagaggacatcgcttgcaagattagtactaaaaacgaatcaaacgggccccgtatcaaactgaatcgcctctcatggaatacagttccgttgcgtggatgcacgaaagtaagaacaaattaatggcttgctcattccgtcatgtagtacgattgtacgaacgtacaaaccggcagctaattgacaagggaaaaacatcacctacattatatacacatacataatcacgcggggacagctgtcgctaacatgaacagctggtgaacagacatagcatgatgttcaggaaagagtggttcttcagtcttcaccgatgtgtaaagaactatagctagagactaaagacaaagagagacatacatacctatacatatatactctcttcttgtccattgcaatgctagacacacgtacggacacaacatagtttacgtcgaaatcatccatctcggagacgaagctccgggcatttctgcttggtccaagaggtgatcatcgacagtgctctcgttcatccattggctgcttcctgacttgtgatcaggacccgtccaagacgatgcagcagatgcaatgatccaggcaacggtgaaatgccaatgccatgagcgttgccgcaggctatcttgcaatacacactcgatgcccctgtcgtcgcttgcacacatacgcaacaaggtactataatttgaggtttgacaagcagctttcagctccatttccctggagaaacaggaaaaattggtagcaatgtcagctcatgcatgatggtggaatataaatccagcaactttgaattcaacatgcatgcatgcagtacaaaaaagtacagtatgttcttctattcgtggtgataacctgcttacaaaattgttgcgtagacggcataacaactgaataggtgaatgaattgcatgcacatgatgtcagtccacaaaagaaagctactagttcatagttttactaatataattacttgtcctatgcacacataatagtataaagtatagtagtataaccatagggaatacctttagtcagtgatgtaaaagaaaagaaagggtgatcgatttgatctgattcttcaggtcatgggcgagggagcaaaattagctgttggtgcagagaagaggaagacagcaagcaagtaaaaagaagagctcgaaaaggttaggacaagggcaagtggaggtcagtcactttgatagaatggcatgttacatacatacataaaaaaatagaatgctgtaacagatgtgtccttggggaataaacatgcagtagcaaacaaaccctggtttccgtgcccaacgtctgaccgtccgtcttatttgaaaaaattataaaaaaaattaaaaagacaagtcacgcataaaatattaatcatgttttatcatttaacaacaatgaaaatagaaattataaaaaaaattcatatgagacggacagtcaaaattggaaacgaaaattcagggtttgccttttttttgggacagagggagtaggaaggaataatgtctcaaggcgtttctgagcggccaaagttacacacacacaaaaaaaaaaaagagaggaagaactagcagtagtactagcctacaatatgttatagtagcagcatatgaccatgtacctactccatccagtgttccggtgttccctgattccaagctgattgcatcaagactggagagctcatgctcttccaatggccagcttccaatccatgcatagatctagctagctagctaggccatcacaagggtctaaacgagagccacgtcacgcacaggaagccctgtctcctgcttgattattcgtaggcatcctccctgaccagtcgagggtgtactgtttgtcgttgtagcaagtagcagaagatgaggatcaatgatgcatttgatcgtgctgtattcgagtgagctctgaaattttcatctctgatgagacatgggttttggttcgctgctgtttcatggatgaacatgtagaattgagttgagttcaaacaatcaaacgcctgcaaaattgtactgcgacggacttgtttcaaattttgaatggaccatttctgctatatagctgtagtcctgttgattcgcactcgatgtattgttcaaaccatccagggaaaaaagaacttgccattgtctttttataattttgttccaagccgccgtatgatgcccaggacatactgatatgtgatgtggttcatactttaattatgatccatgtcgacagggtcaccttttttccttgttaagtgcagcaatgctttgaccaattgacgtcaccaaaaccatcacttaggccagctttagcagacagggcaatcttaattgtatactagtatattatgcctgtattgtactggaggaaccatgccatatgattctgtcatatgtaaggctatgttgctgcaagctccctgccaattctgaaatatttaaaaatttcccagtttcaggatggagattctgatgtctgaaatctgaatccttgaattctcattgcccaggagttgatgggcctcaaatgcatcctggaagctcagcctcagcatagcccatgggctatataaactctctttgcaggctttcaacaataggcgaacctgatacagagtgtcagagtcacaggaagcacaaactgaagatcacgctcagaaagaatccagtgaggtactgatcgcttaaatgcccatttgttccctcataaataagaggctgaagctaggagcaacatgaactcatcccaatcatatcggtttcatgattcaatattcaaatgaacccctcgagcagcaaatgtaaactaaatcatttttcttagtgttgacaagaaacatcacagatcacaccacaatagaagattgcaggatgttaaccaaacccaggaggcacatcaggatcctcctcatcatcatccccagggcagctaacggcgttgggctcaccttcatttggtttcacttggttatgattctcagtatttgacgactgctgctgctgagttgccatgatgttgctgcgctga

SEQ ID NO: 80943 - DNA, 4358 bp, Oryza sativa
atgggatcagccaggcccgggtggccgtttgaaagctgttggccgggtgccaatcttgatcaattcaaaagactgatacattgcacatactccgaccggacgagacgcactgtctcatccgtgtcgtttgagaagcactcacttagttgtttcgaaaagagttcaaataaaatcaattgcaaaaaaataacagcctttctttgaagcctgcattaaacacttattttccatggctttctgagtactcccgtactcacccttgctttatataaataattcccccccagttgctgaagaagatgaagcggatcccgctgacgagaagttcttccaggagcaagccggctacgatgagttttagggtttcggcctagttcccaagtcgcgcctgtgatgtttggtccaagtcttggcttccgcttcccttttgtaatgcagttgtgagctcgggatctgtccacagcccaacatgactgtactcctactctataataaagagacctctgttgctgtgatattctgtcttcctgtgataccagcactgttttcctgggactggtatcgattaacaggttaatttggagcgtcacgggctagttccgctcgggactagttcggggcgtgacaacggccaaactgtcaggccgagtcggcacaggcccgacaccagtcgtgccgtgccgtgcttgggctaggatggctgtgccgtgggccaggccgtcgggcctcaggccttatggccatctatactatatcctttgatggtttaggaagcggtttctactaacatagcaggttgacttcgttcaagtgtgttgatgtggcagtccagatcatataagaaattaaaaatagaagtaggtccgacgtgtaattgataggggttaaaataaaaaaaaatgttgaggcccacttatcatcgccatggccaccatcctggacaaccgacgaagaatttcagtgggaagttgggttgaggagaaggtggagataggcgacggcgatggggagccactcatggggagggaagctgggtgggaggcactggctctgactcacctcgatctcacattgccagcaacaaaggtggcatcatcggtgagcggtcattgagcaaggcaatggggcggagaagaggaggggttgctgccatcgtggagtgagtcccagaaaaccggggtggggaggagcgagatatcggcggtcgacataccgtccgccatcacccgccactgctgaagccgggccaagaagtggatccaactaggcggagtgtctcggctgtgatggcgctgtatacatggtgacgatggcggagacctcgggggtaggtagcgagcttggccaactatgtgacgttgagggggagctcgtccaaatcgaagcatacggaatcaaagatcggaaaccaccagggctgccgggttggcggaggacatggaagcgttaaggaaggctgcggcagcgtggttagccgtacgaggcggtggcgccaggccaccacggtcgggtcgtgatagatcttgtatgccccgaatgtctctgttgtcccacccgccatgaggaggatctagtgctagccgctgctgtcacttagcacacttggaccaagttaatccgccgcattgatagaaatagcttcctaaactatcgaaggagtcaatttgtactttttttgaagtctgtgaaggagttgtacccggttttatagttgagagatgtggctctactgaggacaagaaatgagggaagcaatatacttatatattccaatgaaaaaaggccactgcacgggcacagagcactgggagtgacagggcgagcaacccagctacagtccatgcaggactgggccgagagcttagcctgtctccgtctccgtggattaaatgatttattcgtgtggacgatgaaggtagccgagccgcatatagttagcggaagaaccgaagaaatcaccaaaaaattccatggggtgtgagcaagccgttctggttgattgatcggaaaaattcccgggttcgttaccgtgcaaacgtgcagtcctgaaagtcgtgcatacaaccgcgcacccaattgactcggacttatcatttctgcacgttaccttttttttctccctagttaagggttgaacttttttttccctatatacgtttcttttgtgcctttgttttttttttccatttctttttattctgtatagatagccaaatcaccgacaacacctatatagaaccttagagaaggataacactgaaccggtcgctgctataccaacaaagaaactacatccgaaccacccaaaaccaaactctaaccatcaagcaccgcactcaacttcatctacgcctgatggattggaaggaaaaaggtgagagaaaagaatgtaaccgctctcctccataaggcctgccaacatggctagcttgtattagataggactacaccgcaaaaggacaaacatatagagagagcgcccacaagttgtatgagagaagttttggcgcgggggaggggggctcctggacgaagtcttcagggagaaaagcagcgatgagcacaaacaccgccatccgttgtggtctcgagaaaaaccaagatgaggttttcacctggcagccccaccaaagaaagagggagacaacaccccaagagggaaatgacgcccaaagcaccgtcattgttggcccgacaaggttgagctacgtttttacacctactgcacacccctaatataatcgataaaaaaataatctacctcactttattctccgaaattttgacaaaatgactcttttagaaaacttatttgaagattgaaccgtaccaaaaaaactaattgtagaaatgagcctttgtgccaaccccgatggcgctgagctataacatctcaacgccactaatattggcgctgagattctatctgaggcggcgaagaagtgccaaattgtcgtagctcagcgccgaatttattcttctaggtttaggagtagattaatctaattcctttactgatttgattgaaaaattggtcggtcgttatcacgaaagtgcatagtttttttttatttcgtttcaaaaaaatagttatctttttattaatttgttcttgactaagggtgcgttcgttccagtgatattgggtgagaaaacacctcgttttccgcgtgcacacttcctaaactactaaacggtgcgttttttgtaaaaaattctataggaaaattactttaaaaaaatcatattaatcaatttttgtaatttaaaatagttaatactcaattaattatgcgctaatggcccacctcgttttgtgtatcttcccaatcttctcaatcccctcctcctcaaatacatcctaaatgcgtgctagcgattttcgacgccaacattaacatgcattgtttgtcgaaagttcggcttgctagttgtaacgtcccgccttcccccaggccgggtccacttacatctgatagctttcataggtcatagactgccctcacagaccaacacatgtcttttctgcacactttgtcttcactcgtgtgcacccccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcctgtgaaaccgcgagagtcggctctgataccattttgtaacgtcccgccttcccccaggccgggtccacttacatctgatagctttcataggtcatagactgccctcacagaccaacacatgtcttttctgcacactttgtcctcactcgtgtgcacccgggaagaatttcccggtcggtcacccatcccaaattgctccaggccaagcacgcttaaccctggagttccgtcgtggcgcctagcgggaaaattatctcttaaaaaccctaattgcgaaatttgtttctttgcttgttgtctagtgtccgtgccatctcagatctcaaatccccgatctatcgtcgagttcaatcccgaatccaaaccctttccaaatcaattcctccgtaaaagtctattttgcctctcccagggtcgatgggccgaatttctctcggcctatcttctcctctcccccggccctctcctctcccccggcgcgctcccgctctccctctctctctctctctctcgccccctcccctcccccgg

SEQ ID NO: 80944 - DNA, 16937 bp, Oryza sativa
gcacgggagagaggggacgacggcggggaggggtggtgcggccacgggggagctcgggaaggggctaaaacgagagaacgcatggagggggttccattttatagcggagggaagcgagccgagcacgggaggagcggggaacggcggcggaaatggcggccggcggccatggaaagcggccggagttggcgcgtccgttcccggcgattgggggcgccattcaagggggaattaagggggaaagagagaggagggaaaggggattaattccccctaatcaatttggaaagagccggcttgaatggagcggatttggaggaggaacggcgctagggttcacgggagagagaggaaggaggccggcggctggaggtcggggacgcgcctgacaggcgggacccacgcgggaggcgcgcggtcaacgcgcggcaacggcgcgcatgcacgcgcacgtgcgcggcacgggtgggaggcgcggctcggcttgggccgggtgaagccgaggcggcccaggaggagaggagggagaggcagcccgggacggagagggaggaggagggagtgggccgagaggaaggagaggaggcccaagagaaggagggagaggaggaaaagagagggaggagagggagactttggccgtgggccggaagagagagagggagtggcccaaaagaaaaggaggattatttttaggtttttctttttaataaactttgataattgtttttgttgcttaataattatttccggtgctctgaaaattcaagtaaaatttgagggctccttttagaccaaagagaatttaacaaaaattctccaggccacatttgaatttttcttgtatgtattttagtgtttgccaatttctttccgaattttaattaattctattattccttttagcgaatgatttttaatttcgggatgaatttatcaggacgtgacacctactccttatgatcccagcgtgctattaaggaaaaaccgaagaatagcaagggatcaactaagatactctcaaattattggttcattgatgtacttgtatagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttccaaggacaacatgaagtcatctagacacatcaagagaagactgaaatctgtccactccggagtgatagcattggactatgtccaaacggctagaaatctggcagatcagtttaccaaggggctaccacgtaatgtgatagacagtgcatcgagggaaatggacttgatacccacctaaggttgcataatagtggaaacctgtccattgtgatcggagatcccgtgaatttggatggtgaaacaaactattgtgtgactgagagaagagacccttgaaaagggcttattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcgatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaggtggaagttcaacataacagtctccaccaaaactctggtatatcaaacaggcacaacattgagaacatttcttatgagccttgaaatttggtggggattgttagaataattgggctaggcccaacttataatattaaatctcaaaggcccataataaatgttgaggataataataccaccttaggatttaagcgagaaatatctcaacctaaatagggagttattggaggctccctgttgaccagttgaggtgggggtcggaatgccacacgcgcgcgcgcgcgcgccgggccgggccgggccgggccgtggccgtggctggcggcgtgcgtgcgtcacgtcacgtcgctatccttttgcagccactaacccacgttcccacgattccctccgcaacagcgcatccacgttctttctcctgatagataaggaggccgcgagtccgatccgttttcttcgcttctttcccggtgttagtttctccttctccgcgcctgagttgctctcgcttccccgcttctgatctcttgcgcgcacgagagattggaaggagcagtgcctccgaaaccacaccttcgcctgagatctgcaccgggtaggcgggtgatctggtttttggggagtgcctcccgcacgactgctcatcgccatgtctggagttgccgccgccactgctggcggaggtggtacgccgccgccgccgacaggagctggatctggatccagagctggtgcgccaggaggtgccgtgaacgacaacaacaacggaggcaattctgcctcaccatccagcggagggccattctcggtgtataatcttctcctcctgctactgttgttagcgctattcctgttcccattgctagcgctatcgctatattatgtgcgctatgttcttgttcctgttctatatgatgcctctagcatgttatcgcgttactggtatgttcctgttcctgacattcatgatgcgcatagtatgttactggttatgttaagatcaccctacactgcttatgccatgatcattgtttcaatttcttggattaaaatatgccgattaatgactatatttccaacagtttcttgcctccgccttctgaattccttcttttgatcttgaacttctaccggctttccctaatgcacatcaactccaactccattgcttttctgagcattttcgttcacctttgcgaggcctacgttggtgtggtgccttgatctcttccgctactactacaagctccggtggatggaatccaacagaatatcaggatgttgtggatttcatcttcctgatggtatgaaggcggtttacatccccttccaatgcccatcatcccggagccaatggtggtcgaaatggttttattttgagataaaaaacctcgaccctgtactgatgttcccggaggacaagcctgagcattctcaggattggaccaccaagccttctctgacctcctcactcaagagtttgtcaatacaattagcagcctgcgagaatggggattgactgggtatgaagtctctcaagacttcattacccggtgtatccaaccgctccaggcccgtgctcaccctgcctttgactacatggggaaggatgacgagacgcggatctcgacgcggggtactcgttctcgtgtcatcgtctatatgtttcttttgctgtcattgtactcatatttatcctgaaatggtcctgtctccctttgcagatcttagcaacaagacggtggctcaacgcgtggggcgggtgctgataagcgttccgtcaggtgccgatgagccgacgagtgtcgtctgcgagttcaccaacgccgagaagtccgccatcatcaacataagtgtctgactccattttgttcacttgtctcctcttgatttgggaaacgaagtgacttcatcttgtacaggcactacccttggcggatgacattgggcccctcgccgaccgccaggccgccgcctctttaaaggaaaagatctccctgtagacgacgacggtgacgggatccatgacaagcggcaacggcaccaaaatccctaagaggaagtgggccctcactgctcctagtgccggttctcattcttgaacgagtggctctgaggtgagtgccttttctttttactctcggtatatcttgtttccggcgagaagtcagctcttatttgccttgttacttagggtattggcgatctccatctagctcccagactgctgaagagggccaaaaccaagtaagtgaaatctcgagctcttgttctcggagttataacttctgattttattctgtgttcaatcagcacccctttgtgtttttattgacagggcctccccagcgtcctcagctcaaagcgaggaccgtgtcgcgaccagcgcgtcgcctgtggccgccgcagtgcgcacttgatccaccgtcctcgtgccgtctccgactccgccaccgccagcctgtagcgaccctcgtattccacttccgaggtagaataccggtctacggctcattccttagtaagaatcaacttaccaagacctgagcacaccagagtagcatagcaaaaaacaattgtagcgaaacccattaaataaaaaccataagaaattagtttttatcaaaataataacactaacagtaccttgctcttctatatcatcatcaccttcatcatttagttgatgtagagatatgcaacacttgatcaatttttgcagaatcttctcgtcacctaattgttagctcaacactacaaggaataatatataggggatgagtacgaatggtactcaacaagtccaactatagcaatccaacaaatatatgcccataatccacctgcataatacatatatgtccaaagccaccataatccaacaaggaattttatgcatgttcataaaacagtgttgtaaaaactcatattaagtaattataaaatctactgcatataaggcaccaaaggtattagaacctccgataggttcctttcctaccgcattcgcggtttctacccaaaacagggagtgacatatcacacttcatacactctgcagaggtgtgtctctgtacccacagacgccttaaaccttttaatgcccacgcccgttggtgcttgaagcacactttatggtgtatgccggcaaggctaaggtcataagcttttcatcaatcccatctatcaattatctctgcgggtgattcccgcaacaacggcgaatcattggatcccgcaacaatggtgatccacatcatctaatcggattccacaacaacaacaaccctcatcactaggccacgctcacaggattcgcggaagtccttaagcccgcaggataaagccattaagaaagaactactaagctagcctatcccattccaggtcatgtggttgatacgatcgctacagcacttgaatgccatataacaattgttatttaaccttacgatgataaatatatacagctgaaccccgacaaccatggcaagttcagaatacacctatatatgaccgactgctccaccagccaatccaatccatcagcatatttattttaattatagaaagtataatttaatgctaggtgatacatatagattgcaattacgaaaatataacaagagttggtcaaaggtgttggacttgcttgcgatacccaaaattgaagatgaataaagagagaatctattctatgccactgagtttatcccaattcaacgattcaccagtgacattgtctctttctacaatataccgatgactttattaactgtctacaatatgccattgagatggggctctttttaaaaaatacccaaaatacccttagagacatacatggttaacagttaatttatctcattagaaagtttcaaaaaaataaaattttttatatggcctcctcacataacagggaagtatgtatacatattttcaattttttttggtatttttttagaaaaaatatttttttgtgtggtatactagagagaaatagcttacacaaaagataatagcaaaaaaaatcttatgttgcatatgaaagataatttacattaaaaaaacaacacaaaaaaatgttttatataggatataacatatatgctatattttataaaaatataaatagaaaaaaattgaaacttatatactgtgtaaggaggccacataaaagtttcacatttttttgaaacttctaatgagataaatcaactgttaatcttatatgtccataagggtattttaggtattattgaaaaataagcctaacccaatatcatattgtagaacaattgataaagtcaccgatatattgtagaaagagacaaagtcagtggtaaattgttgaactataacaaacttagttgtatagaatagattctctcatgaataaatcaatgaagaattccaagaaatccgatataaacgcccaactgaaagaaacaataaaacacaacaaaacacgagaatgtttatatgaatgcgatgcacatgatatgtctaaccgtaatgcacatgctggatatatataggttatggacttacttttattaacttttattttaagaacgagtaattattttacttaaagaaatttgattcactatagagattttattcaacagccctaagatatattgctttcatagaactaaatatatttgttttcttagaaaaatagtttataagatatatttcaagaaatacttttatttagatttataatatgaaagatttggttgcatatatatttaattcaaaaagacacactttaatttaatttaaaaatcatctgaagtgaattaaaataagtagctgtaataatacattagaatatgcaagaattaagtttgaatagtttaaagaatttaaatgtcatatattaatttttctttattttctaactctacctctaaattttattagcccaactactaaatcccaataaacacaagccacttagcccaccatcttcatctgagtcttttatccctatgccattaagaaagttgctgcttacctgtgtgccaccaaaaagtttggagttacttgtatgccatgagcccaactttcgttgacccgtatgctattttagatggatggagacataacagaggtgttaggggctctgtaaagacagttttgtccttgtgtacaataatgggtttaaaaaatcagaaaagtgaaaaataatttagaaaaggcgttaaaaatcaaaaaatggaaaataattttttaaaaaaggtaaaaatcagaaaaaagtgagaataaattttaaaaatgtttaaaaatctgggaaaaattgggaaaatgtgggaaaaatcttcttgatggcttgcttcttccttggtgtctccactgtccgtggagagacttcataggatgcaatgtcgtcatgaacaactggagggtgttcaatttggagagcaaaggggttattggatctagttacagaccttgtgtgaaagcaagaaaaggagatcagtgaggttgtaaatgacaagatcaggaaaagtgaaagatcatacctgctcgtcaccgaattgtcagtacttgctgatgttggtggccccttctttttggcggcgtttttaactctctttggcttctgtgtagcactggccaccacctcattgtgtgggaataccatgcctgatccaggagtggccacaacaatgctagtcactgtgttactggaagatgctttcttcagccttttttttggtggacccctgaaataaagtttgggaaattgttattttgcataggtaaacatcaagtgttgtaattgtgtagctatgtctaggaagtctacctctcagcctcatatgcagctatgtcatctggattgcctttcttacatgtgtaccaatggtgccctaactagtggcatattgggcacttatgttgccttttgccagtacctcccttagtgcctaatttcttcctactactacctccctccaaagctgatttcatcatgttcttccttcttcctcctgcagttgacttaagcaatgaaggatgcatgaagaagccatgggtgggtttggaccacatggacttgtcaggaatagagggcacagaaccttcatatgcaattttgaatttctcaattgaatagcactcatccacatagtcttcaagattggccccagggattgatgtgatgtaggcaatggcatgtttgcatggtattcctgaccattgccaagctctgcaagagcatgtcctctcttttatgttcactacaaacctgaaggtactagcagaatttcccttagcacaaacttctgcaatgccatcaggtgagcttgtgattacttcaatgtcaaggttatagctagctcctctcaacttctgcactatatgaggcaagatctttccttcaaacttttcggcaaccctttttcaattattccatttaatcaagatcatctgtctaatggtatccatcaagtcatccagatgcaggcccttctgatcctttacctgccaacatagcaatctaattgttagtaaacatgaaaatcaatgcaaagaaagtgttaaacaagacaagcttacccatttattgaatgcctcagcgaagttattggtaacataatccacttttgacaaagtggaaaattggctcctggtccacaatttcctgtgattttcctgaagatatttcatagcctctggtttggctacagccatggcttgataatgtttatcaaacatgcaaggactccaagaatatgcagatgcccacaggtgatcatcaaaaatttgtccactatgtctcttcttgaaattctgtactagatggtacatacactctctatgtttagcatatgaaaaaaccacactcaccccatacatcactgcttgcccacaatcagtgctgaatgtaagcccaactgggttgcctatagcttctttcaacctattcataaaccactcccaattctcatttgtttctgagtcaatgacaccaatagctactgggtacatccaattgtgaccatcaactgcacaagctacacacaaccggcccctgaaccttccatttaaaaatgtactatctactgcaagatatggcctacaacctcataggaaaccatcaacacaagctttcaaagcaaaaaacagcctattaaaccttattttgttgttgatggtatggtgatcaattacaacaaaggatccaggattagtatcctctatctgagccttaaatctatacaggttgtcaaaactgcaggaccaaggaccataaagtttatccatagcacgttgcctacctagataaactttcctgtaggttacctcaactttgtggctctccttcaacctcctcctcagctctttggcacccaatgtttcatcttccttcaaccaatcaagcacttgttcacagacccaaaactgtgtcactcctacacaagtgcctgccctcctagtgctttgacaattctcatgatcgtatgggttccttgtgatctgccaatttagacatcaatggttatttactaccaaaaaaaagacaccaatgcatatagagtgttacaaaaaatttaccttcactatgacttgatcactcaaaagagtggtatgaattctccacctacagcccacattcttgccactgcaatacaccctgtaccgagatttatcactcttttcaatgttatattggaactcatatttggtagcatgtgtagctaaagccaacttaaaagcattcatgtctgaatacatagtgcctactgccataggaggatcattcttgtcatagtctgcatcaggtttctgggaaggctctctatatgtaacaatgtcatcttcctctatttcatcttcctctacttcatcatctaacaatgtgtctggttcagattgactagtgggaatgggaggtgcaggaccaatgtcaatatacaagcattcatcatcaacactcacatgctcattggatgggtttgggctagcaagggattcactatctgcagatttagtatggtttagttcaactgattgcccactcccaatttcccactatgaaatgtcaggaggctcactatccaatccggcgtccatcctacagatgaataatcccccactgtgaaatgtcagtgttgaatggacaggaaagaatagaggttttacctcgctgcttccatgggcggtgacctggaggtggcttggaggcgacgtgggcacgggcggcgaccaggagccggcctggaggcggcttggaggcagggggcgccggcctgggggcgagggcgcaagggcgcgcctgcctggacgcgcggcgacaggcgcgcggcgatggggcgcgccacctgggcgcgcggcgacggggcgacggggcacgccggcctggggctacggggtgacgaggcgacaggccgacggggcgacggggcgccggcgaggctaggcgacggtgacggctccggcaaggtgaggtggcggcggtggtgtgcggctagggttagggtgcagcggcgtgcggcaaaaatgaggagagagcaagagaggagaaagtgagagtatagagctgaaaatagagtaggggcaaattagccattttcatacttgggtcccacatgtcggggatatggactcgttaagttctaacataaggtggacggaatggcacacgggtcaatgaaagttaggctcatggcatacaggtgactccaaacttttttgtggcagacaggtaaggagcaactttttttaatggcataggggtaaaagactctcttcctcttctctccctttctcgttatctttctttttctctcgctctcccctacgctgccacatcctcaggtctcgcccgccgctgttccctgcctccggcagccgccccgcagccgctgctggcctaaatcggttctgtggctcctcatgagtctgaccccaagctaaacctaacttccaacctcctcaaccctagatgcagctggcagcaaaactccggcgaggtaaggattcaggggaagttccctggcttccaccactgctacaaccacaactcctctcttctacttcctccttctctaatctctagtgttttgtactatcaaggtggttcttgtcacacccagaaatttagcccaaatttccagactattttgtgtattaaatccctgtccagtaccagccagggtacacaaaatgacaagtaatatacagttccaaacgtaaataaagcgtaaatacttacagaagaggcacttaatcctcacaccgaaaagaaagcagcagcagcagaaaagacgatcctagcagggcttcagctccactccacaggcaaaactcaactggggtctgagccttggtcttctaacttcgcctccagctcagaagcactacacttctgaaaaaaagggagaataatagcaaggctgagtacaaccaccgtactcagcaagccacaccgatgatgcagacgtgcaaggggatacaaggacggcttgtggctatttgcataaaggtggttgtaaaacattttattgagcaaaacagtaaaactattgagtaattaaagtaacattaaatctccactgatcaacgctacaccacgttgaacaggcccaaccaacccacctgaactacagtgcattgagtcgattttttaaggtgggactaatcacggtgaatctggtcgaccgcccataaccacgggcacggctattcgaatagttttactctggccagaggtttacaattgtaaccacaagacacagccccacgacatgtttccgtgcgccgacatgccaccaccacataccggaaagaggcagtgacaggacccttcgcataaccccctctaaccaagcacaccacacctcaggtttcacccccactcctcgcaaggcagcgggcagtcccctctcgtgccatggtgaatccggaagccacataggccgtcgcagggcccatccaaactccatcatgcccacccttacctggatgcgtcagctagaggaaagctacactacaagcccagccgttgcccacgctggcttgtggaaagtacgaggaattcttccagggtttcccgcgaaccggtccttaactgccatgggtgcgactagtaaaaccatgcacccacagcccaccattcagtcgcattttagttggataattacgaccactgaaacatggccgggtgtctcgagcacgcagctcgttctgatgctaaaaaggtctaatactgcaattatcccatcaactgagctagttgtaattaagcatggctaagcatatagttctagctaggtcacataagtaacatgagctagtcgatttattacccaatgttgacaaatgacatatatcaagtaaacatagcacaagcaagcagataggtaatacccggatcccatgtaattagcaagacatgcatgtttatttgcaaacggtaaaatatttataaattgggatcaacatgctcaaggggaatgtgtgacttgccttgcttcttcaaaacaatcttccgaactcttttcctcgcgaccgcgaacttccgaaacgacggatcctacacgctagcacgcaaaacgaggaaaaactctaataaacaccaagaaaacagtacatgaaaagtaaaaaaacatgtagagcttaattttagatgaatttttcaagttgaatggctcaaattggagttcgtatgaattagatatgaattttagaagttttgagccatttaaatgaatttctggaattaataccaatttattgcgcaattattatttatttttacaaaggaaaagcggactgctgacgttagcaagagggaggcgcggaccgcgtccacaaaaggggcgggccccacacgtcagcgacacaagggggtaccggcccaccgtggaccgagtccacggcggcgaccggccacgcgggcacgcccccgatggcccagatcagccaaggccgatcggacggctggggacggccgggtggcgcggcctggccatcacgcacacaaggccagcggcggtggcggcacacgggccgagcggccaccggcggcggctgcgcgacgcgagcaagcatgggaggcggccggcgaaggggagaaagagggaagggaaggggaggggaggcggttctcaccgtgggctaacgacggaagagggcggccggtggcgatcggaaagactcctcagcggcgagcggcacacgggaaatggcggacggacttcgcctcgacctaaggaaggagaagacgggattaggcgaggaaggggaggcatgaggcggcgggaaaagcggccggatgaagaggaagaggtggggcttaccagtgcgcgaggggagtggaactctggcggaattccggcgaagaggggcggcgaccgaggagcggcgatgttggggacagccacggcgcggcccggagtggttgggagcggcagcactcggcgaccggaggtggcaaaacggcggcggcctcgggttcgtggtggagaggtggttgcggcggcaggttggggaattagagcgagggccggtgtgcggcacgaagcggcggagctgatggtgggggcggcgcggcttgaggtggacgggaacagtggcaagcggcggccggaggtggcaaaacagtggcggcctcgatcttgatggtgggaatggtgctgcgggggtggaaggggagaacggagtggatgccggggcgcggcacgacgcggcggagcttttggcggcggcggcgcagcgcggcagcgacgggagcggcgggaaacggcggcgagcggcggagcgcgggctcgcgcggggagtacgggagagggtgtgagggactcggggaggagggggaaacggaagaggattgcccggggaaggtttatatagctccgggaggaggaaatcgtggccgggcggggaggatttgaaggaggaatgggcaccagtgacgtgggcgaggtggagctcgaataggcgcgaaaatttggggaaaaatgggggacggggtggaggagtgggcggcgaccacgtccgcacggtcggacgtgcgcgcgggaggctggaggcggcggttttagcggcgtagtgggcggcaatggcggttgccgctgggtggcttgaggttggggatgacaggtggggtccacaggtcccacctgtcagggagggagagagaggaagcgggatgggtaggaaaaatagactccaagggcgagcgggccgatggagagaggcggcccgagagggagagaaaggaagggggaaggggacgggccgcggggaggagggaggaggattgggccgggagcggcccaaagacgaagaggggagttttaaattgttttccatttaatttaattggttaaatgaactttgtgctattaaaattatttcttgagctccgaaaattcacagaaaaatctggaggatattttagggcacaaagaatattacaaaatattcttggccaatgatttttaaaggaaaattttaattcttccaataatttcacttgattgaattgatttaacttttatttaatttctaggaaatggattattaaatgatttttaatcccgaacaaaaatcagagcgttactgttctcccccttttctactactgatttatggttgtgatgcactgttgatacttgtagactaatcctaatggtcaacttgatgactctatgctatggattgtaattactagttctagggttctaggtcaattgatttgctagatttgatgatgcctatatgcccatgatgaatgaatgctcagatgaataaacctatgaattttattactgaaattaaaaccacactaacttgattatatccttatatatgcttatgaatgaattgaatgaatgagtgcgcatataaacagattaatgacatagttatgcaataatttaatttccactaacatgattatgttcttatacatgctgacatttagaagtaactgaaattatgaaatagtaacacactacatgaacagatctttataactgtttcactaaataacatattaaaccaccaagctgcatagtttgataattataataaaatatatataccatggattattgactgtagtccataaagcttgttcttgaggttagcagataatgatttgtttcattggacgatgtactgctactatctatgccttatagatcaacaactcaatttatgcaacaatttattaacatagttgatgaggggaggattaaactgttgatctgataataaacaattgctccaactagtaatctattttactggaatatgctactacatgttcctttttattttaatctgaactatcgatgtctttagaacaattcagtaaggtttaaactaactcttaactatttatgaaatcaggttcatggtaaattttaaaatatgagctagggttcaggtattaattcctaagtctaagatttgatttgctctatgcatcaagtatgatatatctgtatgaacaagatctgaatttctagatttgataatagcataagtctaatcacatacacacatacacatacacgcacacacacatacatacatacatacacagacacatacatacatacacacatacatacacacacatacacacacacacaacacacacacacagacagacagacacacacagacacacagacacacacacacacagagacagacacacagacagacagacacaggcacacacacagacagacacacaacacacacacacatactctctctcctctctttatatatatatatatgtatatatgtatatatatatatatatatatgttactacatggcgtaattgtaacatcgtggtgaaattgtagtaaactaggaatcgaaacaaaaatatacatgctaaccatatttttgttactacacaaaagtgtaagtgttactgcatggcagatacatgctaccacaagtttatgcagtaacactacaaaacttataatatttaccacactttcacaataacgttatgatggaattgtagtaatgtataatagatagtaataacacttatgatatagtattactacttgtggagagttaaatttcaaaagaccaatctttgaaggttctctctatccttgccccatgagtaaactgagccaattcatctctctctccatattactggaccttttttttcttactatacatattcttgcagtaacgttatcaagtaatcgcagtaacacattatgttactatgaaacttataatcgttactacatcttgtagtaacgatattacgtgattgcagtaacgcatagaagatcagcagtaatacttatgatatagaattactgctcggggagagccaaatttttaaaaaaccaatctttgaagggtaatatctctcacatcatgtactacttttaaaaaccgtttacaccatgatgttagaaaaggagtgcttatcgaaagtagatccgtcatgactatattatgaatacattccaatattgttactgcaagtaagacatggtgttactgcactatgaacatcgcgttactacgtcgttcatatctgatcccttccccctcccgatatagggtaagactattctacgttactacgtcgttcatatctgatcccttccccctcccgatatagggtaagactattctacacccagggtatagaatccccatcccttctcatctgatcccctccccctcccgatctccttactacgtcgttcatatctgatcccttccccctcccgatatagggtaagactattctacacccagggtatagaatccccatcccttctcatctaatcccctcc

SEQ ID NO: 80945 - DNA, 16035 bp, Oryza sativa
caggaatcaaaacaaaaatatatgggttaaagcctcacatgctaaccatatacttgttactgcacaaaagtagaagtgttactacatggtaggtgcatgttaccacttcaaagtagctatgttactgcacgataattgtagttttactatgtcatttttacgagatgaagattaaataggtgggctataggtaatgtctgtaggtcactttgagcgaggtctgattgatgtaggagtgttttgaacaatttcatacatttggtaaaaccatgttactgcatgtatatgcccttgttactgcaagttacccattctgttactgcacgtggagggttaaagttcaaagtgccaatctttgaaaagcaatatctcacaagatatatattattttttaaaatcgttcccaccatgatgctatagtgttactgcatgtagagggttaaacttcaaaatgtatctacgtactcccctcttcaagaaaccgttcttcctccctcttctcaagaaaaccggtctcctcccaccaatatagtgttactacattgttgacagaaaacacgtggcctgggagatctgcttaactccagtgcaggtccaaagctcgccttcggatatattagcatgccagttgatttgatcctgtaatcaacaagaaatagaagcaaagaaaccatagttaaatctataaatgatagccgatcggctagatgccgatgacatatcatttatccttaggccgatgttatccatgtatcgatcggcagtcatgaattagtaaagaagaactaaatctactcgatcggctgtagatattaacaatatatactccttatatcgatgcatacttaaatcaagtgattgggaaagatcggtcatcatgccgagacagtataaatcacttagatcaaaatatatgtcaataaaaagattagatatgtttatagcatagccgattagatggatctagcatgtatcggctaatacttcgatactactctatatcaagatattaaagcaagtataatatattgagcaaaagcctaacatacttaaatacagcaatatctcaatataaagggcagatttaacatgtcaatgaggcatatagaacaaatgaagttaaatcagatacgatcagctgaaactccgatactattcaaatcggcaactagaaggcaggctagagatcgatattctaagcacgacttaatagatcaaactaaactgatgcagcattaagtatgaaaagaagaacgatatctagacaatcaagccgctagaagtttcatagaatggtagatatctcatataatctagatcaacgtcaagatctaacctaatcggctgtcttctgcatacagatattggccgatagtagtctagatggcgatattgctagagattatgtaagatatatgataacttgatgaattacataaacaagattagagtgtcatgaagatggaagcactaatcctaagaacgcaatccatcacgacgaattttacctcttgttgaagatcgaaatcgatgcagctcaacctgaaagcaagaacccgtcgaaacaaaactaaagcaagaagggtggcgatgcgccgaaattgtgttgaacatgtgtgttaaaaattacttgggactcggggtctatttatacccgaggattacaagatatgcccataccggacacgaccattatctctaacaaactctaagataccacaagactttgcggcagacttttgcccacccttatctataaggaatttacataaaatatcctaattaatagatataattaccttcccaggactctatccatgcatggcaatcatcctgaagtacattcacttgaacccgatgtcgcacacaagtcgtattgtcggaatcggctatatcggcttatttagctcgactcagactcagccgatcttgtcgtagccgatctagacttcagccgattcctgccctgttttcaaactcgatctccgcttccgactttgcttcgatctaatcttctctccgacgctgatgttaccaaatttggttgttaacacatgccccccaagtccgagatatttgataatgttccggatttgccataagctgactccgagcaagtttcgcactccaccattattccagcgctttaaatactaaccgttacccccgagaaatctcacgccgtgacttccgttttcaccgctcaagcgaaaccttttctctcttttcttggcgattcctcggccgcaaaggcgattcctaggcgacttccttcccagcgagatctccgcccgcaccaatgtcgtcttccgccaacccacttggtgcaccatcggccgaacacgctgaggtaagttctcatcggctaaatccccttctttagtagcaaatcgatcttctccaatctgatatcactctctccctctggattgctttggatttgtagcacctttccaacctagttgcgattcccagcctggcgcatgaaaatcactactttcttggcccagtcggcaatccagaccccactgagtttattattggtgaaaccaataggatccccttcagattaaccaacccggatctaggtcactggaagaacaccttcaaatcctggccatccctagagaaagttccaccagaaaagagctggaccacatggttcaaacgtgtatcagccagcaagagggttcactgggatgaaattggaatcggccaagcacttgaccttactatagcgaactcagccaaagatgaacacctgatggcagctgcttcttacttctggtcaaacactaccaatgcctttctgttcaatcaaggaccgatgactccaactctcatagatatcagtatgatcacaggtctggatgttacctcatcggccaaccctatgagtttgaacacaaagaaccaatatgacttcaaaaccaaaagtatagggggttggtcaggctatgtggcagcatacatgggccaaggctcggtcacccctcgagaacatgtggctttcctattaatgtggctagaaaaatttcttttttgtggatcaagttgtggccccacaatcaactggcaatttctggctgaagctctagaaacaaagagacaaattctccttgggcaaaattctcctcggctatctataccagatgctgagcaatgcatcagctaagatagcagtcggctcagtagttagagcaggtggaccctagtggctactacaaacctggttaaacctgatagtcatgaaggttgtcaatcggccatccgtattagaagctgaattcccaagactagagccaattgtagatgatgatggagaagagcgtactcatcggagatgcacatcatatggagaatacgcttctacaccaactaatgccggagcaaaactatcggctgaactgctcaaggattagttttgtagcttctatgaagactttcagaaagatgctagaatctggttcctttatgaagactctgcacaacttgagcacccagtggacttcagattcgaagacatcaaccatgaagtataccaatcatgcagggaaatcttctcggctgcaatcagcccatgtatccttcctgttggcattcatcaaggaagaaacatccaagcttcttatgaattctatcatccaatgagctcagctagacaactcggaatgggccaactcccaattggcttgttctttgctgacaagatccaatgccgaggagggatttcatcaaccctgatgatggatcggctgcttagccttcaaggaccccctctgggcagtattgacaacatagaactggcaacattcagaagcaaaagcttcgataggtggtggggtgaatggaaactgcatttattccaccaaccagcttcaatatatatgacagacctctttccagatgttgtccctcaagtaagtctccaacttttcccaattttagctaaataactgtttggccaattaatcttaaccaatcgtccttttggtttgcagacaacggaatcttcccctcctcatcaaagcaacagtggcaaagacatccaatatgccccaggtttaattcctaacggaggtgggctatcccctccagttatcggctatgatgcccccaagacctcagctcttcttcaagggctcgttagagaaccagccgatgccagcaaaaagaggaaaaccagatcgtcggctgtaagcatcgtagccccaattaagaagaagaagacaaagaaatccaagccagctgatgatctgcctaccctggatccatccatcgaacaagctctggatgaagaggccattgaagacgaggttgatcaggccgtagccgaggtaagtgacactgaaagaacaccatcggcttcgcataaacaaacctctccaactccttctgctccggttcatttctcaagggtaagtgtttcttgttaatccctttcatgattattttgtcttatagccgatcactcccaaatcttataattgtagaaaaagaagactgcggtgaagaagaaatcggctgcagcaacatctaaaccagctccaccagtaagatagttttaactttcattagttaatttttagccgattctatttgacacttgtttccttttcagccttcacctcctccttctccttctgttcaacaatcatcaagtgatcagactccctcagctgcgggaagtcaccacgtcgaggaagaagaacaaccagctgctcctgctaccctagtaagtttcttttatcataacaagcattcaaatcggctgtaatcgtttaacctctaatctgcttctaaactgtcactgcaggtattagccgatcttttctcttttgacatcagggactaccttgatgaaggagaagaagataccacaagcaaagccttggctcctttatctgatgatgtgaagaaaactctaggaagcattttagatcggctagaggcatcatcgctaaacagcttggtggttgactgtggctcaatcaaggctcggctacatgagattcaagctttaatcctagatgagttagccgatatccttactccagccgtttctcttgagcaacaccaattcaaactggagaaagccatgttaagattagccgaacggcgagaacgtaaggatattgaggccactatccaagccaaccgacaacttgtgcatgaagagaagtccaaacttgatcaactatctgaaggcctaatcaagtctaacattgatcggcttgaggctcgcaagattgacctcttaacacaacttgaagaatgtaacgctgagctggatatggaacacaagaaactagccgatctccccaagtctattgaagaacagaaagcgagactcaaatcggctataaagcatgttgctgaactgaccaagtccctgaaagttatccctcgaaccgatgctcaagatgcccaagccatagaggaagtagagcagattaggcagaaggctatatcggctatccagcgatacttatcgcggtaatctttgtgtaataggacttagaatttttgtaatcggctaaaacattctgatactgtactgttggaacgatcctttgcgccgattaatatgactttgaaatttgcgcaaacaaaattgaaaattttactgcatgctgatatatatatgcccccctagttttacaatgtcgagagcattaataaaattatgaaataactaagggcgatataacaatatcggccagctcaaggctatgtaaacacatcggctatcatggatcggcaaaagtagccgatcatgcgttaacccaaacacttgggtaatatttcttcaaatatttaccattgagtgctcgcccataaacttcgccgtcaagcccttgcaacatatatgctcccttagacacaaccttatgaatatggaatggtccctcccaattcggcgaccacttgccgaatttactatcacgagtaccaatcggcaaaatcagcttccatacaagttctccttccgaaaaatatttagatataactttcttattataatgccgagcagcacgttccttatccttagtaacctttgcaagggctcgcaatcgtgactgaaccaaatcctccctctcatcagccataagattgtaatactcatcggctgttaaatcgttttgcagctccgttcgtcgagagccgattctaacttcccatagcaaaacagcctcatgtccataaacaagtttataaggaggaacttgaatcgatccatgacaggccatcctataagaccacaatgcttcggccaaccgagtatgtcattgccgaggataatcagaaatttttcgcttaatcaatttgatcaaacttttattagatgcctcggcttgcccattagcttgtgcataataaggtgaagaattcaacaacttgatacccacgctatcggtaaactgaacaaactcatcggacacgaagattgaaccttgatccgtagtaatagttcctgaacgaattgaatagcatccccagaatcaaccttcttcaaaggaatcgcctctacccacttggtgaaataatcagttgccaccaatataaatttatgccctttactcgatggtggatttatcataccgatcatatcaattccccaacctctgaacggccatggtttaataataggattcatagccgacgccggtgctcgctgaattgctccaaacttctgacaatcttgacatcccttataatatttgaaacaatcctccagcattgtcggccaaaagtaccctacacaccgaagcaaccacttcatcttgtgagctgattgatgaataccacaaatcccatcgtgaacttcactgattgcaaccttagcctgatcggcactcaagcacttaagtaataccccatcaatcgtctgataataaagctcatcatccaacagtgtatactttaatgccctataccttaatttcctggaagccgattgagatggattactcaaatactgatgcacatcatacctccaatcatcggctaacattgctgcaatctcaactttaacatctttgatcatcggcttataccccgatgccccttgggccaaatcattagcttcaagattttgttctcgagatacatgcttcaaagtaaccagctgaaactctttcattagttccaagcacttctcattataaaccatcaatgtatcattcttgcattcatattctcctgccaattggctgattactagcaaagaatcccccatgatttcaatagtatcggcttcaacttccttgagtaattgcaaccccttaagcactgcctcatattcagcttgattattagttgcatacggtttaatagtataagcgaactcgaaacatgcccccctaggggaaattatgactaagccgatgccacaaccatgagtacataccgatccatcaaagaataaagtccatggcactatctcaaccgagccgattgaatcatcacgatgttctacaataaaatcggctatagcttgtcccttaatcgcctttggtgattcataccgaagatcaaactcagtcaaggaaaatatccactttccaactcgtccctttaatattggagccgacagcatgtacctgactacatcggctttccatataacggtgcactcgttagataatagataatgcctcaacctcgtacacgaaaaatatagacacaagcataacttctccacaggagaataccgagtctcagcatccaagagccgtcgactgagataaaatacaactcgctccttcccctccaactcttgaatcaacaccgagccgattgacttctcaccagccgataaatataacctaaacggtattcctttctgtggaggaatcaaaacaggaggagagctgagatactccttaatattatccaaagccctttgctgctctgctccccaagtaaattgctgatcggcttttaacctcaataagggtgtaaaagattccaaccttctagacaaattagaaataaatcttctgacaaaatttatcttgccgatcatctcttgtagctccgtcttattttctgggggctgaattttcttgatcgcattaacgctcctttgggtcacctcaatccccctttcatgaacaagaatccccaaaaactggccggccgacacaccaaaagcacattttgttggattcatcttcaagccatactttctggttctctcaaaaactttccttaaatcggctatgtggtcctccacctctttagatttaacaaccacatcgtcaatatagacttcaaccgaccagccgattaaatcatgatatatataattcatggccctttgatatgttgctccagcactcttcaagccaaaagtcatgacgacccattcaaataagccgattgcaccaggacatctaaaagccgtcttatggatatcttcctcagccataaagatctgattatatcctgcattcccatccataaaactcaaaattttgttccctgatgcagcatcaactaattgatcggccactggcattggatattcgtcctttggtgtagctttattcaaatctcgaaaatcaatgcacaccctgaccttccattctttttaataactggaactatgctagaaacccattcggcatatcgacagggacgaataaaaccagcatcatacaatcgtttgatctcagctttaaccggctcgagcatatcagctttgcatctcctcggaggttgctggcgtggtctaacccctggcttgataggtagccgatgttcgacaatcgatcggctgagtccgggaatctcgtagtactcccaagcgaagcaatctctaaactcttttaggagctctatcagcttggttctaaactctggagacaaatttttgctaataaatgtcggccttggccgatcgcctggacctatgtctatttcctccaaatcatcggccgacataaaacctggaccttgcttgtcatcgagatcatctactgtatccttagcgtagacattcgaacccttcacaacgccctcaaagtaatagcttgggttctccatcttcgattggctgtatatcagaatcggacacttttagaaaatctccatcccagacttttccagataaacaatcaaggccatccatctcccaaagggctaaatcggcactggcaacgttaactgacctgtcggccggcacgacctctatcttgtcgccttgccattgaatcaagcattgatgcatagtcgaagggatgcaacaattggcatgaatccaatcccttccaagcaacaagttgtacgaacccttcccatcgatgacaaaaatcgtggtaggaatagtcttgctgccaaccgttagttccacatttagaacacctttggtttcagacggattaccaccaaagactttaagcaccatatttgtcttgatgagatccacggcgttcctacctagcttctcttcaatactctgctaaaagatatatatagagcaacaatgagtacaaaagtactcagcaagccaccacaaaaaatgcaataatgtacaggataatacaaggagtggctatggttactttgcgtaaagctgagttttcaaatatcatttcacaaacctaagacctagtataaactgatcaagttttaattccattgttcattaaacagcgacggttctgtccaccatccattgtgttcccaaggatagcttcccgccactggtcgtcatggttttctggggtttaccccttctcgcctctcgagaagttgatccaccagtacaaaatcatcatgcaacatcccacccaaccagtttaagaatttagagtctagcctagtataatacacgtctcggtgctcaataaccacgagcacggctattcgaatagatttagtttactcacactgcagtgaatgtacactttacccgtactccgcgacttgcccagcacatgagcctaagtcccaacgaatgagacttgccatggcaaagcctttcaacaacctcactttggcagtacccgctccatgaattttagtcctcatgcactctaggcgtccaaggtttctagcagtgagaggagttctggcgctcccgggaagggaagattcacacatgcattaagttatagttaagtttaggtttacacatggcagtcctaccgatggcgacaccactgtaggcacccacccctcgcggtcctaccaatggctgccccaccgtaggccctgcctcacacacatcaagaaaactactatgcagggaaactgcctccgctcggctatttactctgctaggtctatacccatacgagaagtacggttgtacgggggtcgtttcatgcttagcttcatggctcggtccttaactgaccagggacggcactagccttttccggacaccacccaagtcctccagccgccctagtcgaaaatatttgtttagttttcattttctttcacaaatcatctcatcaatgtcatggcaatgtggcactcatgtctccacatgccgtatctcaactacctccccaaggtagtttcccaagcatgaagcatttgataaatatgagaatgcatgaatctaaattagcattactaagcatttgtcataagtgactagggactcatacgtaattatgggtacaagggaataatgagataagtaataatcaaaggcatggcataataacaagtaggatattcattactgcatgcaattttatttgtaaacaaaacaatttcacaattgggatcaacatgctcaaggaatggggtgatgacttgcctgcttaggatagttcttattcttgatatgatcttgatcaaccttcacctcctgaaagctgcatacgttgcctcacgactaaccgatatacaatttctataatatgcgagaaaaccaatattcaagcaacaatcaaatatgcacaaacaaaatataattgttcggaatatacctagggctattcatatcactcgtgcttgctaatggattgtaaggtgctacgaagtctaaactatggctgctcacatacagaactcaatactcaggactacggaattatctatcaactattgctatgtggagttcatggctaaactagctttgatcgtaatttaaatggtgacaccctacaggagatttaccaacgctcagtggataatttaatcataacaagcgttctaacaggatggattatctaagcatggctctacaaatattactgtattagggttccaacgaattacatgctatgtaggttagattagtgtggtccataatattatagttaaagtttatctcaatgcataattttaccataaataatcctaagtcacggtcaaactataattgtgtgaggtcaagatttataattagtgttttatctactatacacgcttatcatagactcctcagtttaatatatgaaaaaggtaggttattgttcttgtgtatgatttaaatggactgtatagtagttgtgagtgcaataacatactaatattagatcatttactaagcatgagctatttactgtaagctatacagtatatgtgatgcaggtggatttggcgagttggtactatttatcaacttaagattgattaccaacttaaaagatactattccaaggaacatgacattaagtaattaatttcgtataggtgatttaatcacactagctctgttattatttctcataaacaagtttaagattcatctatgagtattaatattttagtaactttatgtaactaatttttaagtcatgaatttaattatatggctatcgaatattaaataagcactagtattttcctatacatccattcatttgagacatcacttatacttagtttatgtggttgctacagtgacaaaacatgttaaatatatttatttgacatctactctactgtacaatatcaattttatttattagcacatttttaagttgaccataatctaatcatttgatattaatatattttattaaatagtgagttatataccattggaaagcttatgaatttagatgaatttaggttcaagtttcactcgaatcggagctaaaatgaataagttatactaatttaaagattcaaatttgagttaatccgagaaattgtaaaaatgcactgttcataaatgatttatttttaatcggaaacattatccaaaacccactgtggttgacatgtgggaccggccctggttgacttagggtcaaacctgcttgtttaattaccattgggtcccgcctgtcataggaacaaaatatataattgtgttttcttagattttaactatagggaccccacctgccattgagtgggataatcaccgttagggataggattactgtgcgctaatcacatgtgggtcccacacggtttctctctctcctcatcttcttcttcctctcgcccgttaccgagcgaggcagaggcacggctcggcgcagccggcgtggccggcccgagccgggacggcagcgggcggctcggcgacggccggggtgaggcgcagaggagctccgacgatctcccgccgatggcagccggcgcgcgaggagacggggacgcgcggcgccatcaggcgacgccatgcccgagctcggctacaaggggcttcggtgctagggacatcctccggccgaattgaagggtgcgggagcatctacggcgtatggggattcgatttcacaaactatatggagaggggagctcccgggatagcctacccacggagggctcgccggcgacgaaacggcggccggggcggcacggccatgggcgctaatcgccgattttggagccggcgctagcaattagatgtatggaggacgctacgggcacgagggtgtaccgcgagacggcgagatggcaaaacgcggcaaagtggagctcgacacggtgcaggacaggggcagacagcggcgacgtaaggtgcttgacggcttttcttgatgtccagcggctacccggcttcccctatggcgacggcggcagcacggctcttcctccactccctccaacctccagctccggccggggagcctcacaatggtgatctgtagcggtggtgagagggtgatcgcaaggtgttcgatgaaatgcatacgagaagaaggctgagagggatggggattttgttgagggcttcgcttaggatgcaagcaaactatggggataagatcaccagcacatgcctaggcgagctagagtactaatggtgatcggataagagcaatgaggtggatgacgcggctgagattcatctccttctccattaaggttctgtggcttaatcatcacacctataacctatagactgcaggtctgggcgctagctggaggagagggctccattttatccattgggcgtggataggggcgatgggacgcgcgtgtctgggttatgaaggcaggcgtggtgacggtgatgcgcgcacatgggcgatggcgcagctccgtgtttcctggagagaatccaggagagcggttagaagtgcggcttggcgtggcacgggccctggcacgacgaggtacggaagggacgacgcgggcgcgggcgtgggtccggcgcgatgcgacgcacggcgcgatacaacgcgatgcggttgcggagcggctagtgcggtttggctagggttggggtcggacgcggctgaggggaaggaggcgcggttgcggcgcggcacgggcgtgactggcgcggccggaagcgatgtggtgcacgcggtagacgggatcgaacggttggcggacagtgaatagtggcggctgagaaaagagagaaaaggaagaaaaagggaaagaaaggaaagggaggggctaatctgcaaaagtgaatgggattgaaattgaattgaaatgtaatcaatatattttggttttgagaattcaaatgtttgatttcaatatttatttggttattcattagttcccaaatgaatttgctttccattaaattatccaaaaattatccaatataacctataagctttgatatttcttaaaaactaattaaatattctaatgtgaccttaataatacaatagcacattggtcgagtttatttgtataacaatgtattttacaaggacacgtttaatctattattccataaaagtaaattgatacttggtacaatattgacctaaatgtttaattaaacactcacataaacatattttatatataaagttcaatttatttgcatgacaaattattttacatgagtgaatccatcccatgagagactcaatgaaagttataaatattaatttaattattctagtggaacactcctatatatataaaatcattgtagtggcgactacttcgtggttacttagatgtcatgacacttgtcgacatggttcaagtatttaacatacaatttgtaattattaataattgacttgtgttttatttggcttgctatcatgtacacaaatatttataggattaataataattatcttattctaattacttcttagttgtacagctttagcttaatcttcaatcgtgacaatttatagtttggcaagcaatagcaaccataacatccagcatgatgcaaaagttttaaaaagttcgaaattttagtgatttttattattagggattttcaggatgttacactgaacgtagcatagggcatcaaattcaccgcggccccaccatcgaccatcatcttagacatcggcttcccattaacgtagtcgtttatatataatggtttaagatgccgattctctgtcccctcgggtttctcgaataccgcctgttctggtgacaggaccaacttagccgattcctcttccacttcatcgacatcggcctgatcgatcccgaactcagctggcaatgtaaagaccatattaattggtgccgctataacactcttcccttttgccaacctcttcacctcgtcatcttcagcatcattggctacgggaacctgattccagacacgccactcctgtctgtcttggttttggtttcctcagccgatgattgatttccttttcaacctcctgaaaacgctccctgctcctcaatctctggaccctccttttctgattcttcgtgaaaataccagaaggacaccattgattcttcctgatcgcctcatccccttggccacaatcctgattcatcggacccagtctctgatgaacagggagtctcgcctgtctcagccgattatccctattgtgtggtcagcttgagctctcgatgacatcactgcatccagggcaattttcgatagatggcaacctcatcccttcattccagcagaatctgaaaaactcgtaaccccaatgaggatcaccaataaatgctgctgcactggatcaccaatagatggaggtggcaaaaacatggcagcaacttgatcttgggtcggctgattcgcgatatgcccagtaggctgtggatgctcccttattaacaaccgagggtttatcggctggcctggcgtcatagctgctacagcaggtagaggagatgatgttggcgccgtcggctgagttgtgggtgcaacggagggaaccgcctgagaagatggctaaacatcagtgatcaacgatcgataattcgggaagacacctccttgcaaataaaccgggcctgcagcctaatgctcagctattgagccatcggctattgtcttcatcatgtttgacaatgtattgactagcactcctgattgattgatcaaagcatgatgcacagcgtaatcgacccgatcttgaaaattattgaaaaagtcctgtgctagttcattgttacgattaagatttcctccttgtggtccttgagcaccatcaccttgagcctcatcaccttgtgctccgtggactccttgcagattgtcgccttgatcgctcggggagccgtcggtagcacctttagcactcggttgggccgagccgcctggagcttgtttcacttctccatctttagaggaaccggtcccaggattatcagcaaccacttttatcttatacttctgaacaagcg

SEQ ID NO: 80946 - DNA, 3317 bp, Oryza sativa
caatgatgtcggtcaatcccggcttcggcgccttgcctttaacggaacctgggcttgatggtggcggtggctgtttctcggccatgaggagggactgacgtctgacttttaatcaggtcccaccgggcgtgccaaaagcgtgttgacagaaaacatgtggcctgggagatctgcttaactccagtgtaggtccaaagctcaccttcggatatattagcgtaacagttgatttgatcctgtaatcaacaagaaatagaagcaaagaaaccttagttaaatctataaatgattgccgatcggctagatgccgatgacatatcatttatccttaggccgatgttatccatgtatcgatcggcagtcatgaataagtaaagaagaactaaatctactcgatcggctgtagatattaacaatatatactccttatatcgatgcatacttaaatcaagtgattgggaaagatcggtcatcatgccgagacagtataaatcacttagatcaaaatatatgtcaataaaaagattagatatgtttatagcatagccgattagatggatctagcatgtatcggctaatactccgatactactctatatcaagatattaaagcaagtataatatattgagcaaaagcctaacatacttagatacagcaatatcttaatataaagggcagatttaacatgtcaataaggcatatagaacaaatgaagttaaatcagatacgatcggctgaaactccgatactattctaatcggcaactagaaggcaggctagagatcgatattctaagcacgacttaatagatcaaactcaactgatgcagcattaagtatgaaaagaagaacgatatctagacaatcaagccgctagaagtttcatagaatggtagatatctcatataatctagatcaacgtcaagatctaacctaatcggctgtcttctgcatacagatattggccgatagtagtctagatggcgatattgctagagattatgtaagatatatgataacttgatgaattacataaacaagattagagtgtcatgaagatggaagcactaatcctaagaacgcaatccatcacgacgaattttacctcttgttgaagatcaaaatcgatgcagctcaacccaaaagcaagaaccccgtcgaaacaaaactaaagcaaaaagggtggcgatgcgccgaaagtgtgttgaacatgtgtgttaaaaattacttcgggctcggggtctatttatacccgaagattacaagatatgcccataccggacacgaccattatctctaacaaactctaagataccacaagtctttgcggcagacttttgcccacacttatctataaggaatttacataaaatatcctaattaatagatataattgccttctcaggactctatccatgcgtggcaatcatcctgaagtacattaacttgaacccgatgtcgcgcacaagtcgtattgtcggaatcggctatatcggcttatttagctcgacttgtcgtagccgatcttgtcgtagccgatctggacttcagccgattcctgccctgttttcaaactcgatctccgcttccgactttgcttcgatctaatcttctctccgacgctgatgttaccaaatttggttgttaacatgcatgtgtaagatgtgatagtaatattgtggtgaattacagtaaatcaagaattgaaaacaaaaatatataggttaaaagtctcatatgctaaccatatacttgttactgcacaaaagtaaaaagtgttactgcacggaaggtgcacgttaccacgtgtttatgcagtaacactacccaaaaaatacagtaaaacgcagtgtagtaacatcgtgatgtgattgtagtaacgtacaacatacaagtagtaacaagtaatagtatagtattactacttgtggagagacaaattgcaaaaaagtcaatctttgaagaacaatatctcccaagtgatgtaaggttttttaaaaccgtttgcatcatgatgctagaaaaaaaagagcttatcaaaagtagatccgtcatgactatatttcaactatattttaacgctgttattgcacgtaagacacagcgttactacacagtggtcgtcgtattactacaccgtcctgggacgagagctgagaagaggtgggtggtggggggagttagttggcgggtttgaccggtgggaggggcctttgaccgaggtgggaggtgggttttgggccttggtaaggagggggaagtgggtgtgacccttgggagggagggaggggggtatagaatagctattctatacccagggtgtagaatagttcatatatatatatatatatataataggtgcatgttaccaattccaagtagttatgttactgcacgatcgataatcgtagttttacaatgtcagttttacgagatgaagatcgaataggtgggctataggtaaagtctgtaggtggctttgagtgaggtctgattgatgtacgagtgttttgaacaattttatacatttggtaaaaccatgttactgcatgtatatacccatgttactgcaaattacatattctgttactgcatatggagtgctaaagttcaaaatgccaatatttgaaaagcaatatctcacaagatatgtattatttttaaaaccgttttcacaatgatgctataatgttactgcatgtggaggatatatgggttaatgtctcacatgctaaatatatttgttactacacaagagtggagtgttattgcaaaggcaggtacacgttaccacatgtttatgcagtaacactatctaaaaaattcagtaaaacacagttactgcaaaaacttataatttttactgcactcttatagtaacaatgcgatgggattgtagtaacgtgcaactgacagtagtaaaaagtaatgctatagcattactacttgtggagagtcaaattctaaaaaagccaagatttaaagaacaatatctctcacatgatgtactattttttaaaatcatttgcaccatgatgctagaaaaaaacgcttatcaaaagtagatccatcatgactatattttaacaatatttgagcgctgttactacacataagacgtagtgttactgcacgttgaccgtcgcgttattgcacagttccgcgagacagagccgagaagaggtgggtgataggaggagttagcaagtggtttgaccgcagtttgactggcgtgggatgcttttgaccgacctttgactgaggtgggaggtgggtttggccattgggagagaggtatatatatatatatatatata

SEQ ID NO: 80947 - DNA, 9042 bp, Oryza sativa
attcctgcagcccggtctgttcttgctgctacacatcactagcaagtgtgtgcacaggtgaagtgacctggacatgatctttgtgcagttttgcatttggttaagagtgagctgtgaaacctctaatataggagtagcttgtttggttgtaatgatgaggtggtaaagtatgagatgcctagcttggattccgatttgatatattgctacaggtcaaggagtagggaggaagtgatctggattatgatattttattgttactaccacttgataatgcttgcatattgccttgtttaaaaaactgcttgcaaattgcagatagctagtcgttagttgagttttttttttaaaaggaatgaatgtttagaaacgaaggagcgtgatttcggacgtgtaatacgttgtgatagggaataaaagaatgcataaacatataaataaaaaacacatgagaagagttgacgatagaaatcagaccgttcaatagtacctgcgtgcaattaactatggaataagctgcagaccagaaaaatggatatatgacacaaggttgtttattaaacattgttaagcctagtcattggaagattatttatataactgcatgaccttgctgtaatgatcctctgattgacagagcctcatgttgagttaaaaacggctttctggatttcatttcctccaaccagtttcagtgacttgccatgtactgaatcatagtgttgaaaacctgaatagtttatccttcatttcttcaccaagaaggcaaaatatagtagagatatattagcaatgctaatgctgccgatttataccgttttgtgacaacatctgcacatgggtaacaattaacaaatcccatgtagtcaaattacttctaccccaatcgctgattttctcaatcccgataaacaaaacctatggttacacccaacaagtgtggtccaggatcatgctacatatcagagagttgactatgctgatcagtggctgttagctcaacactggatcttgcaatgttcactgaagcatgcctttcaaacaagcattaaatacaagctccatcccgttgcttcacttgataaaacagtaaagcaaagtgaaatgtattattgcctactgcctaatgacgaaaacgaagcacgtccaaacccataagagtggtcatgcattagtagtttggactaaccatctagcttgctaattggtactgtaaatcaccatctattcttagcttagctcacattataggatgactcagccctgacaccagccacgtttgctcctcctgaaagacaatcatataaatagtcgtcactagcagaatcgacaatcgagttagtttaaccaaaaaccgaacctggaaatgctcctacaaaacaatctctgcagacagaggaatcattgtttcattagtcacagtgaatgtgcgcctagctgtaccttgcaagaaaatttttaattgtcagacaaaatccatctgcatcgaaaccatttgattctgattgcttcctaatacctaccatgtatagtgtcatccgtgtctgaagagggcggctttcttgttgcaattgacatagagctctgggttacagatgtgttcgttcttttcactgatttccattatatataaaaaaaagtagaacttttcagtgaacatggagagggttgtaactttaaacttttgtctcgttgtcgccatggaatcgatcgagaccaggtcgaaggcttgatgacaacgcaaagccgcacggtttcttctcctctctcgcctgcggtctgtctgcgtcgatgggcacgggtagaagaagaccaaaggccctgttacatccttcaaaatggcaaaagttttgttattttgtagcactttttgtcattttggatctaaacactaataggaaaagttgttaatttggcatttgctagtccatagtagtaaattgtgccaaaaagtgctttgagaccactccctctctctttctctctcttactttagtgctagaatggcaaaaatttaacatgcatctaaacaccaactagtacttttacaatgccaaaacttttgtcatttgccatttgccattccaaatggatctaaggccctgtttagatccttcaaaatagcaaaagttttggaggatctaaacagggcctaaacaggcccaaaggcgagcatcgcgttttctttatcgaaagaagagaaagttagaagcaaagcatgagcagtggaaagtgacaagttagctcagacttactaatcatacggtaataagggctttaattcaatcgcacaccacagataaacaatgtggggcgggtagaaagtgaaactgccatgtctgctactgattaatagcagtaccagtcctctggtatctccagtgatttgcaatcagcgagttcgtgtcgactgatatctaaagttatttgcaatcgatcagtgggtttaagttgaactaaatcgatgcaatctacagtatttgtatgcttagacaaatttagtcgaacttttaaaactttaagtgccggttttataaaaaaatttataaaatctaacaagtctgtattactatgataatatttttcaagtcaagtctacgcatgccaattttttcaaggccgtagcttgaaaacgagttttcggaggccaacatactcactcaaaagaagtaaagaactcgctcccttgccttgaagatacaggtttaggtttcacctgatgtctagttccaaagaagacctaagcaagcaaagcaaatgatcattttccagtattcctttcaaatgataatgaccggttcaaggttgttcagcggtctgccgcaattgcatctcccatcaagcgccctagatttcattgaatccgtgactatctaatgagtactagtaatgactaatgacatacgtgtcatgatcttcccaaagagaaaatgaaaagcatttacatacagcagctgtatgaataggcccaggacgtgccaccaacgtagctttaggcccggcccaattattcggacggttctatattcggcctggtaagaagtttagagatcggcaccatcatctgcatgggaaactgtttctttctgctacgggccatggtccacaagcccaaatgtcacattcaattgcctctaactttcaccctagtggggagcccatccgccattcgcagcgtcagtgacgtcacctgccgcggccggtacgcgccgtcgacggcgagctcgagctcctggagcacgcaggcgatgatggacttcatctgtatgtacgccatctccttcccgaggcacaccctcggcccgccgtggaacgacacgtaccggaacgggctctccggccggaacgtcgccgccgccgcgtcctccagccaccgctccgcccggaactccgccgcgtccttgccccacacggactccatgcgccccatggcgtacgagttgtacgccacgaaccacccggcctccaccgccgtgccgtccggcaggacgtcgtcctcctgcgcatgcagcgagtccaccggcaccggcgggtagaggcgcatcgactccgtgattgcggcgtgcacgtactgcatctctctcagctcgtccaggtcgaagccgaccctgtcgacgtcgccgtcgccacggcgtgcgcgcaccgtggcgacttcttcgcggatgcgccgctccacgtccgggcgagaggagagaagccagaagaaccaggtgagcgccgacgacgtggtctcccgccccgcgaggaggaagctgatgacgacgtcgcggagggccacctcggtgtacgactcgtcgtggctcgccatgaaccgggacaggaggtcgtgcttctcgaggccggcgcgtatctcctcccgccgcgaccggatgatgcggtcggcgaagtcgtggacgatggcgatggactcgcgcagccgccgctcggacccaatgtggagcgccttcttcaccctccagaaccacgggacagcataccggaaccgccccgcgctgagattagcggcgtcgcggaacgcgtcggcgaacctgccgctggcagtggagccatcgtcggcctccgcgagagcgccgccgccgctggcgtcagggagctggccggggtcgtggtcgaaggcgacacggcagatgttgtcgaacgcgaagcgctcgagcgcgtcctggaggtcgatggcgcggccctccgccgcggcgcgccgcagcagcgggaggaggcgcccgtgcagctccccgtgcacgcaccgcgccacgaaggcgcggagcgaccgcgtgttgaactcgtagctcgccgccttgcgctgcgaccgccacgcctcgccgtcagcgttgaagatgccgcgcccgaggaagtcgtgcagcagcgacgcgaagcgctcgcccttggggtagttgtcgaacccggatcggaggaagcgctccacgttcgccgggttcgcggtgatcacgccccgcacgccgccggggcggcggagcacgaacgtgcgcgtcggctgccgcgacagcacctccgtcatccagtccaggatgcggtgccggttggcgaggaactgcggcaggtggccgaccagcggatacggccgcagctcggccgtcgcataccgcgccttctcatgagatctcctactagcactccatgttcgaacaaccaaggccacactcaccaagaacacgagcagcagcagcaggatggcagccatgctgatccgatttgcgaggacgacgaatttgagattaataatctgtttcatctgtacttcgagcgaattaagcaggtaggagtaccagataactggataaggaaatggcagagtgtaatgactggtgattagtgaaactgttgcggtggtgtcgccatggccactcgtgaaactcgtgatcttgttgtgttcttgtgcacgggctgctgtagtgccaacgtcaggtttgtccggtacgtagggacagacgaacagtgttgatttgttgctggttgggttcacaatttctctgaacgaaaatgccatgtagcaacacatcgatgtcgatgacgatgacattacgactactaactgcgtactctagtcctcagtgtcacgtcgttctacggtggcattccgcgtccatccaaagatttctgctcttgccatgttctcgagtcaacactagactaacccctagagattaatctttaaaatttcagtccgaattggggacttatctgaaaaattttctgaccactatgagttattaatggttttggtccaaattaatggggttttcagcgaacaaacctcaagtgagttctcctatctaggctcgagttcactagctttcgcgtaaacttgcactttatctcggtcttttagagctcgaatggagcctaggatgatgtacttgggaaccttgagctttttcaagagccaatcactagcaaaattgaactgaaggatctgtttgcaagatattcatccatcacatgcagatgcttccattcttttggtcgttaaaattcaacttctacaagttgtaaagaaaaacaaattaaactatgactagttaacgtatattcacagtcaatttttttttgcaacttgtagaagttaaatttaactttgcatgtttgtggagtgatttatcacatatcaatctatcttctgaattattttttataacaatttagatgacaaggaaacaacaagggaatgtcccctcgagagtttaaaataatttcccccttatcatgtaatgataccaccatataccatagagatagcatgcacataatatctttgtgccatcacaaagaatctctataatataactatgaaatatcatatataccttcagaatatttttgtggcatcaatcataaaatatcaatggtgaaaaaaaagttgcttctggactggcgaacaactcctgggtctctgatatccgcggtgccttcactgtcccggtcatttctcagtttcttcttatttgggatgcggtgcttcacgttcagctctcaccgggtgtcgaggattgtctcgtttggcattggacggctgaccagcgctctcagcgcgttcggtgcaccaggaattcttctatgaccagcatttctttgcctgtgccgatcttctctagcacgcaaagtgtcctgccaaatgcaggttcttcctttggttcgcatttcagtagcgctgctgaacggctgatctccttcagaagcgtggcatcgatagtcactcgacctgcctcttttgcgctaaggatcttgagacggcgaaccacatcctcctcgactgcgtgttcgctcggcaggtctggctccgggtgttgttgcctcttggctgggctgccttctctcccccctgtggcagctggttccaggactggtggccgtcctctagggcctgcttacctaagcatctccgcgagagtttcgactccctggtgctcctggtctcttggaaactgtggaaggagttgaactctagggttttcgactctgctctctcttcagtctcagtgattttggagtctatccattcggagggccatctatggtctttagctggtgtcgctacttttggtgatttgtttggagtgtagcgtggcttggtcccttcctgttgcttggagtctatttttagccgccatagtttctctaagcttcagttttttttttcatttgctttttctcccttcccctggtataagccaatctggctgattgcgttgtgtaactaaaactctttttcttctaatatattgacgtgcaatacttttgtgcgttcgtaaaaaataaaatatcaatggtacttgtatgataccaatatgaaattccaaaaatatcttcatgatactactagtactatatatagcaatggtatctttatgacacctccttggtatcatggaggtatcatgttctcttaaagtatcactatgaaatctctgcaatacaaccaagaaaaatttgtgataccgatacctccttgataccacgaagtacagggctgggcaaaattacttgaatctggaaaactaggatcaagacgaataaatttgatcatccattcagtcttagcatctaactgatcaaattttgtttggtcaattctgttaatatactcgattgaccgtttgtagcgcccgttccgtcgtggcgcctagcgggaaaatttaaactctaaaaaccataattgcgaaatctgtttctttgcttgttgtcagtctccgtgccaatccctgatctcgaatccccgatctatcgtcaaattcaaatcccgaatccaaatccttgccaaatcaaattcctccgcaaaagtctattttgcctccctcaggttcggtgggccaatttcctctcggcccatctctctctctctctatctctctctctccctcagctctcccctcgctctgcctgtgtgccgcatgtgcatgagccgacgccgagccgagctctccctctctctctcgttctcccgctctccctccctgctccatccccggcaaactccccgcgcgccgttaccttgcgtgcgcgcgcggtcgccgccgtcgtcagccgcctgctgcccgtgcctgcgccttccggccccgcgccctgccacgctgcgccgcctgcgccgcgccctgccccgcgagccagcacgcgtgccctgctgcgcctgagcccgcgcctgccgcccctgtagccgcgcccttccaaaccgcccccgccgtcatcgccgtcgtcacgacccggccccgccaccaccgcgcatacttccaagggttggaggcagagctcctcctcccactgcctcgtcgccctctccctccttccttcttttcccaaagtggcaagaggcaagtctcctttccctctttcttttcttcttccccccctctcccccccgccggcgtcatcctccctatcgccgttttggccgctagccggagaaccaactcgctggcttgaccgcccaatgtcggttcctccctcccaaaccgacaatgccgccctataaacccgagcctctccccaaaccaatcttccccgttttcgcccttgccattgccgcgccctgccctgttcgtcgtcgccgttcgtcgtcgcgcgtatcggaggagccggcacgagcgagacgcgtgacgtggactccgggcgcaccctctccttcctcttccccgcccgaggccgaagcgatcacgccccgcgccgtcggccaccgtcactgcgccccttcatcccgcacggtagtgcctcctccccgttctccctcctcgttcctcctcttccccttagctttcggtagaagctcgtatagcctccctgtagctagctggcgctgccccgaccgctgccgccgctcactatgtgccgccaccgtcgccgcccgtgctccgtagcgcccgcacgtcgccgacctctctcgtagtgtctccgtccaatccgacgctagaaccggattcccggagtcgcgtagatgctctagtcgcccgaatcgatctcccgtcgcgccgtcgccgtttcccccttccctcgccgccggttgccgccgccgcaatccgccgccgtcgagccccctccggcgaatccgagccgttggctcgtctcccctcgtcccatgcaacctcccggtgcgctcgcccttgcctgcatcgctgtagatcgccccgccgctcgccgccgccgtccgtcgtccgttccggccgacgtcgtcgtcttcctcccgccgacccgcatggcagccacgtaggcgccacgtcggcgccacctcggccaagaccgggtcaagcctaccccggtccgctgctaccctctgccccgctcgcgcgcgcggtccaccgcgagccgtgaggttgcgcgtgggcccgccgcaaccgcacccaccgcgagccgcgcgcgtgcaccgcgtcccttccccaaaccctagcgcgcgccgcgtgctccctccgcacggtgaaccgtgtcaccgacaagcgggtcccactcgggaccacacgaggtgagcccggtccaccggctccctctctcctcccctcccgcgcgtgccttgggccgtcttctcgggccggccggcccatt

SEQ ID NO: 80948 - DNA, 6680 bp, Oryza sativa
aaaaatcgatggcatattatagaacgtgacaaagtcagtggcaaattgtagacctatgacaaactcagtggcatacaatggattatctcaaaaaaatatatggaaagctacaaaacctaaacgttcatccttaaagaatcgtttggtacggaaatttacaacacggtacaaattgaagttgtagaacatgaatgcaacaagagatctttgtgtcgcttttaagagctctagttcactttgcactcctctcctgaatcctgatccaccgcaagtaatgccagacgaatggcatcgcccgcaggacttactagcaatcagcccaaaataactttaccacattaacagccgtaattccgtaattcatactgattgtttggctaaaataaggaggttgcacagatggataatatttgattgatatgcagtctcttggtacccttgggatctcgcaatgacgtcaaccacaggaagagcatatcagagatcatgtccaattgaaccaggatggctggctttctctctacttggtagagcaaatgcacaatcccatgttttacagtgccgagaatacaaattgaaatggctacttattagataataatttctcttctaactctcggaaacctcgatagtcattctttttttggttctgtggaaggttgaaccgcctcatctcagccaacctgaagttacacatacaacataaagtagaaggaaaataatcagctctaactgtaaagtggtttcatgatatacaagaaaatatgttgagatagcaatagtacaaagaagcaggagtattttctaattgcttacggggatcaggtgcttacaattttttttggcaatgtcacaactaacaaaaaaaatgccatgttaaagataaaattgaaatttcacgataatttattcaaatcttagttatcaaaataaattgtgatgattcggttcagaatttcatgatgcgtagttgctacctggctagcataccacacatcaggtagggccaatgtataaggccagtgacttctttctataaagttaagacccaaagccgaaacctcagcgttccatgtcatcactaattctcagccgttcgatcggtgaaagagatcgcatatgaaccgttggatgagaagatccctgggccttgggccttggatcaaagatgaagggagattagacccattcatccttccagttgatctgatccgaattctgaacgctccttgattcccatctctctgtccatcattgctgatatattgagcccagcccacccagtataccaagcgatccaatgtatccgatcggtttccttccaatgatgcatgcatgtcgtgtgacgtgcgtgtaaaaatctactacgcaggtttcaatcgccttcacttcaatgttgtgcccgcacatgtgcacgttctgtctcccggtccatcaattcgcttaatcacattctaccttgcctgaaaccgtcggttggtcgactgccacaagaaacagcttccaacgagattaattggcgatttgtgcttgcaatcctcccttcaagatcatcccttaattccacaattcctttcgcaaggtcatcgatcaacctcaggctgcgcagcgcaccgtgagcaggctatggaatcatcatctggcaagctttacatgatctctcctcctctccttcctctctaaattcatgtgttgcctcctgtttccagctactgatttgttttttggttcacgcatggaatttagacttgagagttgaaggtatgttgaattttttaggcttactctgcactttctatcatatctgttcgtctgtaccacttcttgattttggttcattatgtacttttgtttgctcatcaatgtgaactgatagtttctacttttctccagaatattagaaactgtctctccctctctaaacatttgcagcaaatggatataaagatggactactacgcaaaaaggaattcatatggatctcaagtaccaggtgccaatcatcgcctcacatttaagttttgttaccgcctcatgctgaaaaatatttggattggattcttcacttttacctttctgatggtacacaaatgcaaatttatataggttggtactttgttcgaaataaaggtgcaggtatgtgcttttacatctgagtttatacttgaagtctaatccattttattttgtctaatccactttattttgtcccgtattatatgtggtatttaatccatgctagattaacctcagatcatcccgtttgcatgttatgcaaattccaactcagaattacacatagctaccgcacggatatttcacattttgtttcagttttctttatataaactatatgctcaattttgaaggtgtctttttcctatcaagcatccttttagacaaatactttctgtcgcttttacaattttttctcctattcaaatcaagaataacagttgaatgcatgggaaatcttggggtggcaattaacggtgtggttatctcccgtggttcctctctaattagtggtgcaattctatgttttttttcttgatttcccttataaattaggtcaacactgtcctttctatagtaaattatattagctcggtgcttaaaaaattgcatgacatattctataagaatataaatatcctgcagcaatgcgtgaggtatctatctagtgcatatttgtacagaagtccaacaacaaaaatattgcactttgtaaaacacgctaagaatgggagaattttgagaattaaaaatgccacttagatgaagtaaacttaccagtttgccaaactaattattttatcccggatgccttgatttaaagaccatgtttgattcggtgaaaatgttccatcaagaaagaatgaagccccagcagttgtggtgcctagtttatgtgcaatgacagtcatgcccattcacgaaggattaaaaggactgatctcagaagccacaccttcaggtttagggagggcacaatagcgccatttgataacagttgatcatacacggcaagcacaggttcaggtagacctttacaggctccaagaagggctcttgcaacatcctcgtcaccaactaatccttctccgagcttaatctatcctgtagcatgatagcatagctatgtaaatgccactacaaaatgggttgctgttacttgttagtatagaaaataccatttatttatagacagaattgacagattaccagtgcagccttctcgagatgaaggcatattatatccaatggtaaacaagagccatctgcaggatcaagttttgaacctactcttctcaccacagaacatgcttctgcaacaccacctcttgtactggccaaggagcctggcccaaatttctcaaataattttactgtcagcatctccagaataatttgcaaagttaacaagaaggttcaagtcatcatgaaaaattacagtgactatctaaaacagatttaccttaccaagtgaataagtgcaagtaaagcactacatacagctgcacaagaaaaatgcagaccataatatataactttagagcagcaacttgtgagaatttactgtgatcccacacccagttatagagctatattactatatcacaaactgtaaactcagcaacatgagaaattcgaaaagagttttttgtggatgcaaattcagaggatttagatatacctatcgtaacatgtaaaaaatattgataaagtgcttgcttattttcacacaactaagtaaactcttttgagatacaatttacactgagaaagttgtattacccatttaatgtagttatgtggaaagcttccgaaaccttattggtaattctgtatatagtaaccagtcaagtatatttattaaatgtataaagacgcaatggaatgctgaggatatgctcagatcaccggttttcattgtatgatcacactaccaccgcaagtccacaacacgtcatagtctatcctactgatttgtggtatcagttcatatgactttaacagtaaaagaagtgcaatctttatgacagtttagaacttatcaagtgaatttcacagttctactaactgtcacgatccccatagatatgttggttattcctggtaaaaacaagtggatctgctgtgctgctatcaatagtaaaaaaaatgcttattgcctagtaaccctcttacaagagagaagaaagcaggatcaaggaaaaaatctccaagaaacaaagatagccatacctcccaaagattaaaaggaacagcataattgttgaaaagttgagtaatactcttgagattcagtgaaagctctttagccttgtccatgggacatctagcagtctccacatcagctagaatgttatcatgaggaaggcatcatttggtgattcagtactgcctggcagattttcaagccgtgaagccatgaactattcttacttgatttgcatttggaactgaagaactgcaagtttgccttcaagtcgatctactgcgctgctatcaatagggttcctcgaggaatctgcagtaatcccttcacttttgccctgaaccgcagcactgctcagatattgatacctggatgcaaaaaaagtaggtctcattccatatgacacatggaccttatgaaagcaaggacaaaaactgagcaaaaatcaaataagtaaacaaaaagaagttgagtcaaaattgggagacctctggtcaagagttgaagcttcttccgcactggagcactgtctttctgccaatatcaacaacattctagcagcagcaatatgctcccccttgagaacataatacctggctagcagctcaagatacttggtttgactagttgaaataggtgcatccaaatcagtcaatttagaggcttttgatgcaacaacaggaagtccttgaacctaaatgaaataaatttagaggcttttgatgcaaccacaggaagtccttgaacctaaatgaaataactggtcaggatagcataacatgcagatatccataacacagtagagacataacatgcagatatccataacacggtagagacataaactgagtttgatgtaaccacttgatgaattggaaagatatagcaaactcaaagttatctgtggattcatatagccagcatataagaaagacttgtccagatacttaatgcagagagcacattatttcgtaggatggtacacgatagtaagagatctagctggcattatttaagtcatgacgagctgcttcatgtgtatctttccaatagtttgtttgtactgaaaggatattaatcaggtaaatcatgccaaatagtttgtttgtcttgttaaagatacatcatacatgggtcagaacacatggatcctatcaggacagtaagcacatacaaggaaaggggcgaagaagggccaaaatgcaagaaagcaaaaaaaaaaaagttgagaggcgaactctaaaccctttgtcccatctgttaaaaggaaataaaagttggttcctagtttcataaaattgcattgcctacctagaatatgcccccgagatcccccaaactacactcaaactatggatgttctcccagaaagaaggaatttaagggagacaggaaaataagctcacagaatgataaatgatgctgcaaaaaagtgtcactattaacgtatatatctcccctagagttttccccagatttcaaatataactggagagttcattccataatttattatacataatccagggttagcaagatcctaaaatttaatataaaaaactaaattggcccaacattgatgatctctgtttttgtcccggcctcggcctcccgggatctcaaattatgacacggaagataaaccataattttcaaatgatacaccaccgtagctgtagaaaaattcaccccacgttctactaaactaatcatttttagaaaatgagataaacccggcctctacatccgatcggatgtacacagccaacaataaaacaagagttcttagactccaccttacaaaggttcacaaacaaacatcacgacacatcaacaccaacacaagagaacttagcctctcagtcctcacaagggtgatcttacaactttgacaaacaacacaaaacaagacaaagatacatctagacatccaaccttcgccttaaattccatccatgcttagagaagaaatccaaaattcttccttccaacaaagtgcgcccctccttgactttgtccctatcatcctccttaagtagcaaagaccattgacgtgcccaatacgtccccttgaagattacctgcacaaaggagttagttttggagccattaaagactacatcatttctacaaagccaaaccgcccaacacaaagctgcaatgccaacaaaaaattgatgtttaagcctaggttgaacaccattcagccaattaccaaaaagattagtaatgctagtaggcggatggatcccaaaggttatagacacagcattccagattaatctaaccaaatgacaatcaataaaaagatgttgtatcgtttcattagaatcacaaaagcaacacttagtgctacctttccaccttcttttttgcaagattatcttttgttagagtaacccctttttttaagtaccacaagaaaattttaatcctcaatggaattctaagccccaaa

SEQ ID NO: 80949 - DNA, 4356 bp, Oryza sativa
ctctgtgcagtaacactgtgtcttacgtgcagtaacagcgttaaaatatagttcaaatatagttatgacggatctactttttgataagctctatttttctagcatcatggtgcaaacggttttaaaaaaccttacatcacttgggagatattgttcttcaaagcttgacaattttgcaatttgtctctccacatgtagtaatactatactattacttgttactacttgtcgttactacaatcgcatcacgatgttactgtaagtgtgcagtaaacactataagttcagtaacaatgcgttttgctgtattttttggatagtgttactgcacaaacacgtggtaacgtgtacctgccgtgcagtaacacttttacttttgtgcagtaacaagtatatggttagtatatgacacttttaacctatatatttttgtttcagttcatgatttactgcaattcaccataatattactgtcaaaagtgcagtaatgtcatatacaagcagtaacactatattggagggaggagaccggttttcttgagaagaggaaggaagaacggtttcttggagaggggagtacgtagatacattttgaattttaaccctccacatgcagtaacactatagcatcatggtgggaacgatttgtttaaaaaaatgcatatcttgtgagattttgcttttcgaagattggcattttgaactttatccctccacatgcagtaacagaatgtgtaacttgcagtaacaaaggcatatacatgcagtaacatggttttaccaaatgtataaaattgttcaaaacactcctacatcaatcagacctcgctcaaagccacctacagactttacctatagcccagatactcgatcttcatctcgaaaaaatcacatagtaaaactacaattatcgtgcaataacatagctacttggaagtagtaacatgtacctattatgtagtaacacttctaattctgtgcagtaacaagtatatggttagcatgttagacttttaacccatatatatatatatatatatatatttgaatttttatttacggaggatgatacacgcgcgctgagctacgggttaggagcggctacaacaatccgaataagggatagtagatatatttactaattactgcacactaagtatatcgttactatatttgattgacaatgttactaccgggatgcagtaacacatggtacaattgacaataatgtgtgaaggtaaatgctagtatagtttaggaatgattaattgctgcacgtcgggattaaatggcaatgcgtctcatatgttgctgcaataatctataattatcatgatcatgttaccgtagttgagtagtaactgatgtgcaatggtgtagtaacatgcatggtttgaagcgtacaataacgaccatcacaatgtaattactaatgtttaagtgcagtaacggcttatgagttctctcgtctggtggaatgatggatgttatacatttgaggtgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtcttggttaaggtttctatcttgtaaccctgccccccaacctatataaggagggcagggagcccctctaggggcatgagacaacctgatcgtcagatctatactacacccggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggtgcgtcgaattacctgtcgaaaagtgcgatggaatcaacttcagaagaaaccccgagatcaatctcatcaatttcgatggctcaaatcttcaatcgggtctaccgttccaatttaatctctattagattaatttttaatcattgtttgatttcctgatattttgacgaatttcatatactggatgagatcgaaacacggccatcatcgtcgcctacttgggtgcccttgccgtgtccgagtgctcctctcttcctttcctggcagatggacgtgttgcaggagtggcacaggccgccaggattcgattcctgtttgcatgtatgatggttgatgggctccgccggctacctccgatgatggcatcatgccgaaagaacatcgagttagctgttagttgctggggcttatacatgttgcatggcacgtcgccggctatcactcatgatccagcctcactgctcgacttgagtttttcgtttcaatttgttatcaatatatattagattgatttctaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccaccggcctgcctccgtcgccgccgactggtgtccccgcctatacggttggttggcctattatgccaccgctgttgggcgtctacgactacaccgccggcctgcctccgtctccgccgactggtgtcctcgcctatacggttggttggtcacaccaccgttcatgggcgtctacgacttcaccgccggcctgcctccgtcgtcgccgactggtgcctccgcctacacggctggcctattatgccgccgctgttgggcgtctacgacttcaccgccggcctgcctccgtcgccgccgagtggtgcctccgcctacacggctggcctattatgccaccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgactggtgtcctcgcctatacggttggttggtcacaccaccgttcacgggcgtctacgacttcaccgccggcctgcctccgtcgccgccgactggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgcctccgtcgccgccgactggtgtcctcgcctatacggttggttggtcacaccaccgttcatgggcgtctacgacttcaccgccggcctgcctttgctggatgtctacgtcctcaccgttggctcaccttcgttgccgtcgactggtgtttccgcttacacggctggcctattatgccgccattagtgggcatcttcgctttcgccgtcgaccgccttcgtcgccgccgactcgtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgattcgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatatttcaaaatacttgattttttctcgagtattatatttatatcagatactactcatcctatatgtttgttctgcaggatccagatccagatatgcataaaagggattcatggcttt

SEQ ID NO: 80950 - DNA, 1343 bp, Oryza sativa
attcctgcagcccattcaaattcaatttcaaactgttgggaaaaatgttatatagaaaaatgaccaaaataaaacttgtagatcttgaaaggctctacaactttgttgttgaccatatttccatttgaaatcatttactatccaaaaatatattatgactaataaaatgaattattacacaacagctatatattttgcactcatagatacaaatacttcaaatggaaaaatagtcatcggtgacgggccttagttatagcccgatagagattaatctatctcaatcgagcattactgatggcccgtcacagatgagtgatccctaacgggcctgattttcatctcaatcgggcattagtatgaaatttcatatcccacctttgatagatcaactaaagtgaaaccttccttgtcggctttgacaccagcgtgtagattcacccaatagcaacggaacaaaggaaccttgaacttgacgaagtttagctcctagatctcctcaatgcggccgtagtatgtgtttgacccaacttgatcctggaatgcatctatacggacgccgctgttttgcactgtgtttttgtcatcttgtttgacggtgtaaaatgtgtatccatttatatcatatccttgccatgtgtctacggtccaagacggtcccatccccaacaactgtactgtctcatttgggacatccatggacattgtcacacgattcttcaaccattcgttgaaccgagaattatgttatcagttaatccattcatcagattgccccaagttctcatctcggattttcgctaagtgctcctcaaagtatgggcctacttccgccatatgttggagcacagcgtaatgagcctacgcataggacgtgtcacgaccggaaatcacccaacaggcgttcccgacgtgcgtgtattattccttgtcccaggaggcaaggtacaccaaaagttgatacaatacagagtttaacaagcggaagcgtaaatagttaatttattacatgggcggcgaaggcccagcacacacaaagacaaacgggaaacaacggaagactagggcgacgaccacaggcacttgacggcaggcacgagctagacaccaaagccttcatcttccaggaactcctcttctgggtttgggaaaaaattgaacaagactgagtacaaccaccgtactcaacaagacacacccacaagtgcagaataaatgcaagggagtacaagggggttataatataaagggttagggtttgcagtaaacagcattaaaagacacttagttgctcaaagctattttgtaaatacggtcctagagctataccatattattaaaca

SEQ ID NO: 80951 - DNA, 1702 bp, Oryza sativa
ttaaattggttcattaaagttcaagttgcttaggcaaataaaataagacaggctccgacatagttacaccacacaccggcgtaaccatgccccacacgactcaacaagaagataaacgagaaagaacacacgcgcaggcctactaactgctcgtctaccgctgcgacgggccagggcggaaggtgagcaacagcgcatcctccgtgctacctacgccggaggcttccccctcctggggaaccacgggcgcaggtgcggcacgaggggtctcgacgaagcaggtccacgccagggactgacgaacaagctcgggcctggaggtgctcttgcgggcggtgatcttctggctgcggcagacgcggcgacgcttgggacggctgtcctctccctgggcgatcttgagctgatgcagctgcgcctccaacgcgtcgaggtccttcttgagctgcaggttctcctgacgcagctccaggatcttcaggttgttctccaccatgccacgacgcaccatctggtggaagtcgatacgagccgcgtcgtacgcctccaccatgcgtgccagatgcacgacggtagcgtcatcctccgagctggcgtctcggaaggtggcgtggtcgcgggctcctccgcgacgagggtggtagcggtagggcgagtgctgcaactcgtccgggtagcgctggtgaagggtgccgatggcgaggagagcggcgttctggcaagcggcggggaaggaatccccacccgcggtgactgccagcgaagtccgctcgggagagccggagaggatcactgcagtgacctcccaaccagcgtgaggctctgcatcctcaccctcctgctccgggagcggcctggcctggtaatccactccatgtggataccccaagaccacgcacatgcctcgcagctccaagacgaagccagtcatgtccaaaccacgacgggtaacgctgccggccatctacaaacaaaaacaaaagaaaagcaacatttaaaagatcagattttgacgataaatgaagcagcaagacaaagagagagtagcgggttttcacaaataataaaggatttttatttttttgaaaatatagctaaggcttgggatctacggctcgtcctagggtcaagggaggctctgataccaacttgtcacgaccggaaatcacccaacaggcgttcccgacgtgcgtgtattattccttgtcccaggaggcaaggtacaccaaaagttgatacaatacagagtttaacaagcggaagcgtatataaaattactacatgggcaacgaaggcccagcacactcaaagacaacgaaaaacagcggaagactagggcaacgatgtcacgtcctgataaattcatcccgaaataaaaatcatcttctaaaaggaataatagaattaattaaaattcgaaaagaaattggcaaaccctaaaatacgtacaagaaaaattcaaatgtggcccggaggattttgttaaattctccttggtctaaaaggagccctcaaattttagtggaattttcagagcacaaataataattgaaaagaaataaacaaagttgaaaaggtttatgaaaagaaaaaccctaaaagaagtcctcttttcccccccccccttccttcttgggccggctcggcccagtccctccctttatattttcccccgcggaccatcggtttcccccgcgcgcgc

SEQ ID NO: 80952 - DNA, 19017 bp, Oryza sativa
ttcgtgagggttcacggccgtgattaataatactgtatagctctaggatcgtctttataaaatggctttgggcaactaagtgacttttaaatgctgtttactgcaaaacttaatccctattattattctcttgtacctcccttgcattaattatgcatccgccggtgtggcttgctgagtactgtggttgtactcattcttgctcaatccttcccctcttcagtaagagaagcttcggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacatggattaatacactagcgttcgggaaaaggcaattttcccggtcgcgacaagctggtatcagagccatctcgactgtaggataagccaagtggataaaacctaaggacatattttataaatgaaactatttgcgaaagctcctctttttctccttcccctaatgctatttgcaaaaggtttactcccttcttccttcttcggatttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacctgcagaataagtgaaacaaacaacacatcagcaagaagagttagttcctttaaggtcctatccttagtttctaatctgtctctcccctttgttttccctctctccctctccaaacctttgcaacagatggctgacaatgagaaaggcaataaggttagaagtcaggacattggtacctcaagctcccgagtgaatgaagcaccagacaccagttgtgcggcagtggtccaacacctgattaaccagaacaaattgcttatagagatactacagcagcatcggatgccaattttgaacccgagtcagatgcaatctcaagtgcagttggaggcagtccaagcactcacaccacaagtcagagcaccgccaacatcccagaaggcccctcatgccatgccacatgttgacccaaaagaagcaagggcactacgcaaggaactgtcctcagcagaaaagaaaagcaccaatgcgaaccgaagatgaagtccgtaagatgatcattaccagcacagaatggcctccaccaggaatgacaaaatgtcagagaagaaattcctcccgaggtgcacaacagttgacagagcatcttttagctaatggaggtagagtgtctggtagtgaagattcagatcaagtctcctcagatgatgaagatgcgaagtctccccaaggttttaaccagaataaaatagaacttaaggcatgctctcgttgtggagaaatcggtcatgttgccagctcgtgtgcctttacatgcgttcgttgtgaggaagaccatccacccgataggtgccctatgagcaggatcacttgtttcttgtgtgaaggaactgatcatgtaccaaaagattgtcaactcagttttctgctgacgaagaagatggccgaccaacacgcccattctaacggagagaagcatcaaggaaacacaaatcctcgccaacattacagtttcagcctaactccagtgccaggacagaggaatcaaaatgagaaaagaaaatgccgagttcgggaagatatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatcccgaagcagtcctatagcccgcgttgcaacagctccaattccaatgagtgcactaccacaaggtgtcaatgctcaatttcagccccagccaccagctggcaagacagaggccagtatctgcgttgtacctttggaagttccaatacaccagctgagaaatcaagtacaagatgaagaacccgagtgtaagaaagttaatgtttgttacaactgcagtgaagaagggcattactccaaaaactgtccccaaccaaggcaaaatcggcctccacattaccgccaatttacacgaagcggacattcccatcgtattgtggtcactggagcaaacgccgtgcccgtaaggcctcgtgttaatcagaacccatagcagaaacaatgcaccaatgctcctcctgctgcacctgactcggcaataaatcttagcaaccattctctgcatcgacagcctcagcaaagaattgtcgtagatggaagaagttgtgtctctccccgacctactccaggccgagccaagagcaatcaacctccggagggcgataccaagcagaagaccgtcatccgcttcaaccagcaatcagaaggaagcttctcctgtgaatgatagcattatgcagtcctagcacatcatcacagaaccaatcaaggatgcagtcactggaacaatgccagctatatctctccagaatcaaaatgagcagccatgtttgtggttttcagttcgctacttatcgtggtgtaatcgaaagtttgcagcaaccatgtaatacataaatatattcatgtctataaacagtgagcttgctatgcttatggatgattcatgttgagaatacaatgtaccgatgttaagcaccgtccctttttgtttaaggcagtgcctcgtattcatgtaataagggagaaatgtgtaatacagacaagttccatgaggattcgtttgaaagatgcggatatgtgatcatgtgtataattgtttactgacaaaggagacctagggtctcgtgtcagaggaactatattctaacctcgagttaataaccaacctgtggatggaaaagaaaaacaattaaactgtgttgggttaaaaagccaacgagacagtagttgaggataggagtttggatacgccttttacagatcaagataaggattgttggaggaaaccccgaagggtacccgccatgcctctacattgataagatcggatacacctgccgacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcaggcaatgtatttccctgaaggtagtcagtgcagcttttgacgaaccacatcaaggtttcactgaaaggcagcaagccaaaggacctcatcgtccccagaagcgtccgcaatccacattaaagaataccacctgttagagataagccgaaagatgattgaaaaaagagattggcaaagatgttctctagcataaaagaagtaggccgaaaggtgattgataaacagaaacatgctctgcatcgctcacggaagacccctgattgtaattgccccgcaacagtcaccttgtcattaagtaagcaagatgacctaggtaaaaatgtttctatgaaggcaaggagtgaaatcttcaactcggtatcagatgctacacggagtgaaaagtgcaagcaccggttaccaggtaatgccatgtcttgggagatgatccaatgggaaagaacacatcaaggttaaaggtgtaaaggaatacgttgagtgctaactgatgacaacatgaagagaatagcggaaagtaaactgaacataaagaaagtgaatctgagttgcttgttcgtgggagctattcccagttatgaaccaagtgatatgttcgaagatagtctacagaggtcagattaaaatcacctctaacaacgaagcttcagatctggcaggatcacgatcagacaataagaagtccagcagtaaaactatttgggaagacgtcaaagcatgccaagtgggataagttggctctgttgagaaacataattcaaaggcaaaattatcgaccctcgcatcgaatagcagaagtagctagcacccggagaccaggaaagctaatatgaggcagtttgtggcaagttagaagtaaatgacaagcctgatatccttatgatgacaagcatggtatcctagtaatgacaagcaggttacgacgcatgacatgaagtggtaacttgtatgaggttgactccaaagatatgaactatgcgaagttctggaacggaagcatcactgaactaccgcaacctagtctgagtcagccaaaaggtgcaccctggtccaagtcaggtgaagagaagattccatccgcaacaggaggtcgagccaagcagtccagagtggagaagttttgctaggcaagtttgttataaaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaaccctaaaatacgtacaagaaaaattcaaatgtggcccggaggattttgttaaattctccttggtctaaaaggagccctcaaattttagtggaattttcagagcacaaataataattgaaaagaaataaacaaagttgaaaaggtttataaaaagaaaaaccctaaaagaagtcctcttttccctccccttccttcttgggccggctcggcccagtccctccctctctctcttcccccgcggcccgtcggtctcccccgcgcgcgcgcgccgctgacaggcgggcccgcccgccgccctcgctgacgggtgggtcccacctgtcatctccctccccgcgccgcgcccgccgccgcccgtgccctagcgccgccgccgccgtcgaatccgccgcatcccgccttccccgcgcgccataaagaggggcgaattactccccgcgtttccctctcccgtttcccccgttttcccctctctctctccctcggattcgtccggattcatcccgcaatcgtcgccggcgtcttcaatggcggccgagatctccgcgcgcggtttcctctctccccggccgcgctctccccctcccgttgctatatattcgatccccgtgcttcgctcttccgtttccgccgctcgccgctcgctctcgccgtcggattcgtgctcgcgccgtgctcctctctctccgccgtcgccgtcgaccttcggttcgccgccgacgtcgctccggacgtccttccgactcggcgacccctccaccggcttcgccgcgttgtcgccgaccccgtccgccgctccgcttcgcccgtcgactgccggagcgccgtcgccctcggcatcccgacccgcgccgccgtcttcctccgctccggccgccgttctcgtcgtcgtcgttgtcccggggtgagccgaggaccgccgttcgccttcccccttccctcctctctctcgggcgccgctccgccgcgccggtggtcgccggcggtgaccatcggggcgcgggcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctccctcggctgacgcaataaacatgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgttcctgcttgttgtatggagtttattagagtaaaaagccttttcttttccgtcggtcgtgtagacgctgcagcttcggaagatccgcccttcttggaagttgaagccggcgtttgggaaagtgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgctattgttattattattaccttgatcaccctagattaaacaaaacctcaactagtggacactctactcatggttccactagtatgaacttaggtagatgcttcgctggttaattaggcaacattaggtggttttataactttagactttgggaattctcatatcatttggacactatggaattgttggattatggtggaattggacatacacctctcttcctctttcaaaacccctaaaacctgttttcggtggagtttgggtgcatgccagttttgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcattgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcatgagggttcacggccgtgattaataatactgtatagctctaggatcgtctttataaaatggctttgggcaactaagtaacttttaaatgctgtttactgcaaaacttaatccctattattattctcttgtacctcccttgcattaattatgcatccgccggtgtggcttgctgagtactgtggttgtactcattcttgctcaatccttcccctcttcagtaagagaagcttcggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaaacgaccacaggcgcttgacggcaagcacgagctagacaccaaagccttcatcttccaggaactcctcatctgggcttgggaaaattaagcaagactgagtacaaccaccgtactcaacaagacacacccacaaatgcagaataaatgcaagggagtacaagggaattataatataaagggttagggttgcagtaaacagcatttaaagacatttagttgctcaaagctactttgtaaacgcgatcctagaacgctacaaagttattaatcaaggccgtgaacccacacgaacctgccttaacccaaggcctatgatgattcagaccgaactggcaacccgaccctgggtcccagctcgtcctaagccaacccaggccaaccattccatattttagttgttaagcaaattttaagaattaaaacactaacttgggtacattgctcggcttgcccataaccgagggcgcggctattcgaatagattatactctgatcagaggtgtacatctttacccacaagacacatctttctcacgtgcaaccacgtgccacataccaccacggtatacaggcgaaagacgtgacatagtttccaacccatcctagccatagacaagagtaccgacccaatcccgcctacggccggaactcccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttaagactagactgagccacaaactaagccttacccactagacatgtggaagtacggtagtgctttgcaacagaggcccgaagaccggtccttatacggccgaggtgctaccatcaaaaccatgcaccccgagcccagcctaaaaccattttaggagattttgaatacagggggcggtgtgaagccaattccacaataatccaacaattccatagtgtccaggtgatatgaatatttcccaagtctaaagttataaaaccacctaatgttacctaattaaattgcgaagcatctacctaaaatcatactagtgataccacgagtagagtgtccactagttggggttttgtttattctagggtgaacaaggtaataataacaataacaacaataataaggtcataacaaaggtaaataggcaaggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaatcctatttattgcgtcagccgagggagcggggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcgcccgagagagaggagggaagggggaaggcgaacggcggtcctcggctcaccccgggacaacgacgacgacgagaacggcggccggagcggaggaagacggcggcgcgggtcgggatgccgagggcgacggcgctccggcagtcgacaggcgaagcggagcggcggacggggtcggcggcaacacggcgaagcggacggaggtgtcgccgagtaaggaggaagtccggagcggcggcggcggcggaacggagctcggcggcgatggcggagagagcggagcacggcgcgagcacgaatccgacggcgagagcgagcggcgagcggcggaaacggaagagcggagctcgggcaacgtttaaatagcgccgggggaaggaaagagcggccggagagggaggaatcggtcgcggagatttcggccgccatagatgcgccggcgatgaatgcgggaaggaaatcggacgaatccgagggagagagagaggggaaaacgggggaaacgggagagggaatcacgggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagcggcgggcgggcccgcctgtcagcggcgcgcgcgcgcggggaggccgatgggccgcgggggaggagagagagagagggagggagaagtgggccgagccggcccaagaggggaggggggggagaaaaagaacttcttttaggattttcttttttttataaaccttttccactttgtttatttcttttcaattattatttgtgctctgaaaattccactaaaatttgtttaagcattttaggcttttaggaaatatacaaaaatcctccaagcctcgtttgacttttacatttgcacattttaattgttggaggctttcacatgaattttaattattctttgcacaatttcgaggatagattttagagtcgatttgggacgcgacaggacgcatgatcgggcctaattcttttccttccgattgtgccaacacctgacaaccttccctcgtgatgagacgcaggaactccgataggatcggcatcggacaggtaattgacgcagaactcaatagcctcctcggtcgtgtaaccttcaatgatgctccccttgggtttagctctgttacgaacgtacgacttcagaactcccatgtaccttccaagcggccacatttcccttagaaaagccgggccacatagttttgtttgcttcaccagatgaacagggagatgaaccattatatcaaagaaagacagtggtaaaaacatctccaggtgacagagggtattcacaatatcggtctgcaacccatctagattttttggatctataaccttctgtccaattgcattgaagaaggcgcacagacattggatcgtgtgacgcactttcggtggtagaatgcctctgataggaactggcaagatttgtgtgattagcacgtggcaatcgtgagacttcattccaacaagttttagatcgtccaatttaacatacttacttatcctcgcttaatagcccgatggaactttaatatccttcaagcatgataacattgcgattttctcatctttcgacaatgtgtggcaggctggagggaggtacactctacctgtctttgcatctcatatgggctggagttcactgcgaatattcatgtcctgtagatcaaggcgcgtgttcaacccatcctttgtcttcccgagaatattcaacatcaggccaaccaaactctcacacacattcttttctatatgcatgagatcaatgcaatgatggacatcaggatctttccagtaaggtagccgccaaaatatggattttttcttccacatacccttctcctttgtgttgttacgttttcttttcttcccacactcattgcttatgtccttgaccatattgtggacctcatctccgaacaaatctttgggagtaggctgaagttctctcttaccgttaaaatatttcttctttcttctaaatgcgtgacgtggcgggacccacctccgatgacccatgtataccatctttcgtgatttcttcagccactggctttgtgtatgttacttgcaatcggagcatgccttctttccttttatagtttgtctggaaagatcaccgagtgcagggtagtcattaatggtgcagaacaatagaactcttagcttgaacaatatgcatcccaagtttccatactttctttccaaagaatctcaagatcgtcgataacaggctccaggaatacatcgatatcattgtcgagttgcctcggaccttggattaataagcacaacataatatatttccgtttaaagcataaccatggcgggaggttatagttcgcaataagaactagccaagtgctgtgagtactactcatgtcaccaaaaggattcatgccatccgtacacagacatatcctcatgtttctagggtcggcagcaaagtctttgtgttttcgatcgatattcctccattcaatcgaatcagctgggtgtctaagcataccgtcattccttctctccgtggcgtgccaacgtactaagttcgcttcgttcaagttggcaaagttctcttgaaacgatcaatgataggtagataccacacaacctttgccggaccacccctctttgacttctttccttcgtcagcacttttctttcgcttgtatcgagaagccttgcagacaggacaagcatccaagtccgcatattgcttgtggtacaatatgcagtcgtttggacaagcgtgaattctacggacctctaagcccagtggacacagaacctgctttgcttcgtatgtcgtctcgggcaatgtgttctcagcaggaagcatagccttcaaaattcctaaaagatcagtgaaactcttgtctgtccatccactacttgccttcagcttcattaggtccaacgtaactgacaacttagtgtgttttgctttgcatccagtgtacagaggcgtctcggaatcactaaccaatgtgctgaacttcatggaatctctctcattctgggctaggtcctcaacgtcacgtaacatgtcttgcagcagatcgtgatccacatcaaccatttcaccgcccaatggacaaggtataaacatgtcatgctcatcttcatcttcttgattatgcgcaccacttctgtctgctgctgctccacttcctgattcttgctctccatccttaacccaacatgtatagcccttcatgaatccacgttgtatcagatgaccgtgtacatcctctccgctatcaaacatattctcattcttgcaatctgcacatgaacacatgtaatcattgtttcttcttttccgatcctcctccgcggcgttcataaaaattattacgccctttctgtactccgtagaatgatgttttaaatttttcgcatacatccaacttcgatcaattgcaaaagtaagacgtgatcaattacaaaataaaaaaaataaattagaggcacatcttataagatcagtattgcaaaagcaagacatgatgaaattgctcaattaatgattaatattactaacttgattgctccattttgatcacttttggaaattttctgttttccttggaaaaaagacaaaaaatcgccccctacatcctcccaccaaaatagtgaacagtgggatacagttacactaggtggtggggggtatttataccgtgcaacaaatatctgtaacagccctaaaacaatcaaccgtgacgggcatacaagtaatatctatcgggccttaataaaagcctatcaaagaagagtgtcatctgtgatgggcattaaacatatctcaatcgggcctctagtttgtcacgccccgaaatttagcccaaatttccagactattttgtgtattaaatccctgtccaggaatcagccagggtacacaaaatgacaagtaataaacagttccaaatgtaaataaagcgtaaatacttacagaagaggctcttagtcctcacaccgaaaagaaagcagcaatagcggaaaaaagcgatcctagcggggctttagctccactccataggcaaaactcaactggggttggagccttggtcttctaacttcatctccagctcagaagcactacacttctgaaaaaggggggaataaaagcaaggctgagtacaaccaccgtactcagcaagccacaccaatgatgcagacgtgcaaggggattttattgagcaaactgatgcagacgtgcaaggggattttattcaagaatggcttgtggctatttgcataaaggtagttgtaaaacattttattgagcaaactggtaaaacagttgagtaattatagtaatattgaatctccaatgatcaacgctacaccatgttgaacaggcccaaccaacccacctgaactacagtgcattgggtcgatttattaagtgtgggactaatcacggtgaatctggtcgatcgcccataaccgtgggcacggctattcgaatagttttactctagccaaaggtgcacaactatacccacaagacacaatccactggcatgtcaccgtgccatcatgtgcccaagatgaacacgtcaccacgtcgagtgattgtgacaagacccttcatataactctcccataaccatccacaccacgctaaggtttcacccccactcctcgcaagtcagcgggcagtcccctcatgcgccacggtgaatccggcagctggacaaccggacaccccggccgacccaactccattatgcccaccctcgccactggtgcctaggaaagggtcgagctatacttcagatcaagcaattatccactcctgcttgtggtagcactgtaagtcttccagggtttccgtgaaccggtccttaattgacatgggtgcgactcacaaaaccatgcatccacagcccaccattcagtcgcattttagttggataattatgaccaattaaacatgtccgggtgtctcgagcacgcagctcgttctgatactaacaaggtccaatactgtaattatcccatcaactaggctagtggtaattaagcatggttaagcatatagttctagctaggtcacaaaagtaacatgagctagtcaatttattacccaatgttgacaaaggatagatatcaagtaaacatggcacaagcgagaagataggtaaaccctgatcccatgtattagcaagacatgcaattttatttccaaacggtaaaacatttgtaaagtaggatcaaaatgctcaaggggaatgtgtgacttgccttacttcttcactttgatcttctaaactcctttcctcgcaacagcggacttccaaaacggcagaaactacactctagcacgcaaaacgaggaaaaactctaataaaaaccaagaaaacagtacataaaaagtaaacagacatgtacagctcaattttagatgaattttgcaagttgaatcgccctatttggagttcgaatgaattagatatgaattttagaagttgttgagccattaaatgaatttctataattattatcggtttatgacgcattaattaaatattttcacaaaggaaaagggctgccgctgatgtcagcaggggaagccggcgccgacacgcgggccccgcacgtcagcggctccaaggggagggcacacggtggaccaagtccaccgcggcctaggcggcgccgtggaccaagagcacgggcggtccacaggcagcgcccaaaatcggcaacggagggagctggcttgccaggcgtcggtggcacaaggccggacggccaccggcggcggtggcgcgacgcagcggcggaaagaggggaatgggagaggagacggagggggtcctcaccgaggggcgccagtgacggtacgacagagctcgggcggagagggggcggcggcgctccggcgacgggcggcgccaacagaggggcggccaaggggcaccgtgacctgaggaaggtgatggatgggttaggcgagcgcggggtgggcagccggaggcaacaaagcacggcgacggagctcacctcgcgcggggcagatggcgttccggcgggggatggcgatgttgaggaggcagccaagggactcctcgtcattgcaaagccgaaggaggcgacggcgcatcgcgaggtggtctgggacggcaacaggaggcggcaaatgcggcggcggcctcaggttggtggtgggggtggtttttcggtggtggttgaaggaagaggagcggctgccggggtggagctcggcatggcgatgctgacggcggcggcggcacagcgcagcggccattagggcagtagtggtggccggctggacgcgacgggaggcggtggtggctcggatgcacggtggaatggcgtttggcggtggttttgtgggttcgaagtggaggtcggggtggagcttgatgcggcgaagccatcggtggaaacggcacagcacggcggcgacgagaatggcggtggtgggcggctgaacgatgccggcgagcggcggaggttggtggcgcggtggggcggctttccggtggctattggggaatatggagtggctgctgaggtgtggcaaagagcggcgaacgcgatggcgcaagcggcgcggcgcggggacggcggcagcggccggctggagggtcgccggtgagcggcggcacttgggctcgcatggggagcacgggaaagggcacgaggagctcagggaggaaggggaaacggaagaggagagcacggggaggctttttatagcgcgagggagcaacggggaggccggggagtggagaatttggagcggcaacggccggcgacgtgggcgacatcgtgggtgaagtggagctcgatcccagtgcgattttcgggggaaacgtggggagagtgtagaggaggtggacgggaaccgatttcatgcagtttgggcgcgagggtgcgagcgggaggagccagaattggtagcgacgtgggcggcaaatgggcggcatggcggctacggcagtgggtcccgcggtcccacttgtcggcctaagggagagagggagcctggggttatttagacttcaaggacgagcgggccgagggagagaggcctgcccgagaggaaggagggagggggaaacaggccaaggagagaggagtgcttgggctattaaaattacttcttgagctccgaaaattcacgggaaatttcagaaagtattttagggcacaaagaatattacaaaatattcccagccaacgatttttaaaggaaatttttaattccctctgtaatttacttgattaaatttctctaacttttatttaatatctaggaaatggattattaaatgatttttaatcccgaacgaaaatcggggcgttacagttggtgcccgtcacagatgactgtcatctgtgacgggcttcttttagggcccgattgagatatggaaccctcatctcaatcgggcctcaactatggcccatcacagataagtgtcatccgtgacgggctttagttttatgccgatctaccatggctatgcgaccatatctcaatcgggcgaaacttcggctcgattgagattacttacttgtgacggcccgcaaattccagtcttgttaggggccgtcacagatggaaggatctgtactagtgggatttgaatttgagcctcctgacagcatcaacttcaaacggacctagctgccgttcaagaaggaatttcggggtctatgatgacttgatggaaagctaatggagtctacttttatatgattttggtcacacgtcaatattcctaatttgttatctggaatcgacaaaacaagccatgtaactcatccagtccgaatctgatttgggcctttggccttgtaattgtgtcgtaggctaaacctaggggggtgtgcggcaaccctaggacatccctaatcatatttattatgtagccataatagtctagagttgggttttgcttggattatttctgccattgaaatttcatcgctagttcggtttgtggaacccctaattcgagtgtttaatcatttttatgcaattgagttgttatctaccttgttattgcttgtgttatttgattagcatgcaggtttgataaggaaagggatgtggtgctgcaattgcagggtttggatcttgttgatcggaagccggatcgtgtgcgttatgtttctgccaaatcgagtgtccgttaggtaaatttatctacccataaccataaaaataccacacaaaaaagtcatttacctagataatttgagccattgcattgttccgctatattttgtttccttgaattttaagttgcatcgtcgtgtcgagtgcttgttcagttttagatttaattttagttttgagtattgcatctgttaatcactttaggtctagtcacgtgagttttgggtctagttctgcatctcgttggttgttgccggggaccttgaaaaatgaatctaatgatcgtcgagtttccgtttttatggtttgtacaagttttcatcgagcggatttagatttgcttggttgctagggcttatgccatatgcttttgcagttttgtattgcacgtaaggaagcaggaagaggacgagagttgtgtcgattggatcggttgcacttttggttcagccgtgcacgacaagtaaagaccgaggttgactccatgataagtctgactttggcaacccatcaagacctatttgaggttttctccgtccggtgcctatactttgtgttttagaaggtggtgactaatatttgttacggaattgaaggtgttgactatccgaccggccgtctcatctgtcgccgactggtatctccgcctacacggctggcctattatgctgccgttgttgggcgtcaacgacttcactgtcggcttgcctccatcgccgccgactggtgacctcgcctatacggttggttggtcacaccaccgttgttgggcatctacaccttcactaccagctgccgtcatcaccgccgactggtgttttcattgaccattaatggacgactttgt

SEQ ID NO: 80953 - DNA, 11064 bp, Oryza sativa
ttcaaaacatgccatttgcaaactctatgaatagtttcaggccaaaccgctttgatcgccacctccatttgatgacagttatctaaaaaagaagttcacaaccattcgagattaaaaacagaagacatatcattaaacacaccactgatccatccaaataaacatatacctgttaaaattgctgcaggcctattcccatgcattgcatcagtaaatgtttggaaaagccacttgaatgcttcgattgtctcctccctcaacaaagcgcaaccaaaaattgctgtttgaaaatggttatttacatcgacaaaaatcccaaatggcatgttatacctattagtctgatatgtagtatcaaaagtgattgcatccccaaaatggtcaaaacttaatctggaaagagaatgacaccaaaatatatttttaatccttgaagcaccatcaatctgtatggtgtaaaagaaattcttactgcggcattgcatttccctaaaaaaattcagtgtcttctgcacatcattgctacactcatcccttctgatggcatacgccattcttgtcacagccctccttgtaaagggggttaaggacggcccgccgtgcatacctgaaagtaatccatacatagctgtaggtgtcatcccattatctaccatttcctttatgttcctctttgtcccttcatcaatgaaattatgagaccggaagtgtttagtatgctgcaggtcccgtttcatttcatggttgtgctcactaacgaatgcagaaactctccacttttgactttcagaagaacgatttaacctgaccatagccttgcagcctatcctggtcggcggaccagtgacggaattatctctaccctgcataaattacaggaacaccttactacgtaaaacctatgaaatgatgatcctacgcatcacactatagaaccttgccaatcttacaagaatacgaaaccatggttttcaaaaaaaaaaaaagaatacactaaagatttttacctcgcgaatgcagcagaactcttgcatggacttcacgcctccatctttgtatctgttcttggatctccttataccaaaaccagtgaacctagcgtacagattgtagaacgcatagccatcagagtcctcattgaaggtctgcccaattttcggcaacagaatggctgggtcagagagtgaaataggcagcagatcactatcttcctccccctcaaccacgatcctaggatcaaaaaaatgagaattcagctaacaatgcagaaagggaaattgtacactacaatcacactgacataaaaaatacctttccaacggaactacgtccatgggttgtccactatgatcctcgccacctttctccggccagccttcttcctccatagctatcttcgcgaatattgtttctgtccagcacggattctggtagctacccctttcggcaaacagaatttgctatagggcgtcattttttccagctggttggatatatactgacaaataattccggtttattttccattagctgttcaacaacctccccgaaaatcaaggctcctacgtgcgaagcatgttattggactccggaaagtcagccactagcaacattaacgaattctgatgaaaccataccgccacaaaaatagcatctataacaaacattccgagtacgcaacgctacactcacagaaaccaattcgaaatctctgctccattcttgtacaatattctgctcgaagaacttcatcttggtgaaggattgcattcacgatgacaacagggagtttgcagtacacacaacttaaatagataaatgaaaggataacatctcaattttatttcacttcccaaacagcagaagatacagatttctaaacttagatactactcgctttttcctcatagaaaataccatacaaaactagagacagttcgtacgactaatctacgaccgtgcagaaagcaagcccttattacaattttcctgatcatcacactattgtctacatattttcattggacacatgtttgcaaccattactgttgacccgggttgtttcgttgcttctgaaattcatgtcgcaagccgcgcgaatatcacggagtgagcaccaagcgcatctcttcctaggatttctcatgggaagaggatgacatccatcgaaatgaatgacatatttctggagagagtggttcatcacttcactccgagcagcagtatccatgcaacgcacaaaaccattcctgatgaccaaataacgcaataaccagttagagccaaacaaacaaacaagagaaaaaatttcaacagaacataaactaaaactaaacttcaatgtgtacctatctgcggcaggattctgctgcttgtcaccattaattgtaatggttccatcttctgccttcgccatatgatggtgcttgctactactcaccggcgacgacacgcctacggccgccaccgacttctgctgctcgacatcaggcgccgacgagcctccgcctactcgcgccgcggaaggcgacgcaacagacctcgccgacgacattctgccctttccaccggagagtttctgctccatcaaaaacctgcagaacaaaatcttcttcctcacaaatccgaaagataattgtggtcctcattttctgtcctccatcaccgtcaacttaaatagagtatcaatacagcaacctccacactaactactctcctggtcgctcggtcgtgcatgcgtgcgggtaacaaaccatgcatgcagaacattcaaaatgactcaccatgcagaacatagcgcagtgatccgaattttcaaaaaaaaaagaatattcaagtttctgcatcactggtttaatggatcttttctcacaatccgttagtgagttgaagcccgaaaccctgatgtgagttggacaggtgtccgatggttacaataggagtagctactcctgggagtagaatataggcttcctatatatatatatatatatatatatatatatatatatatatatatagtaaatttgtttggtgctccatggtgcccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttgaaaattttgaaaaatttgagtgattttgtacattagataccatggtgccccatatgagtgtcctatatagtaaatttgtcctatatatatatatatatatatatatgtttgttttgtgttgaaaatatttctaattttttctataaacttgtttggacttaaaaaaaatattgactagaaaaaaattcaaaacaacgtaaagaaaggaagtagaatttagaagttgccctattttggccatgtttctttccataagtcttagggctaaaaattagttctagggctaaaacataagtcatctttagtcataccctgtttgtttggagggactaaaagggactaaaacctcattaaatgacctatcttttagcacttcatccaacacctacatgcttcatccattcaatagtaggtgcgctataggcctttagtctaaattagcacctcccctagagatttatggacctaggtaattttagcctcttttagtccctcctgtttagtattttaggggctaaaatagactaaagtgaagggacttatgattagcccctccaaacaaacaacccgaagggagtactgttacatagtgattgacacatgaactgttgacagatggaactgtcagtacacgttggatccatgctttagacgtctcgacaataactttggatttggatatactagggaaacaacgagggaatacaatcttcgaattctagccttcgaccaagtcacccgcgcgcatgtaccttggacgacgatgttgtccacttgccgtgcgaacgtgtggaggtaaagcgaaaaaagactaggtaaaaccatgcaagcagcacacgcgtgcttatttactgtttagttacatggacggatgcaccaaataatttcagctagacagcaatcattccacacgttctcctctcctgctccagctccccatcccagatgaggtggcaacaacactgcttaaacacgccaccatctcggccgccgtccggccggccgtcttcgcgagtgacgcagctcccatcagcagcaacgagctctgctagctttcgtctcagcgctccgtcctgcggtcttttgggtctcgaatcgcctcatgtggaccccacaatcacgttggcaaatagcagctgccctggtgctgcttctcacgttttagagcaagtttaatagtggccactgctagctccaattcatcaatagccaataaaataattgcttactatactattaatatatggtctcatctgtcatacatatattatgtcttagagtccgcgctgcagctggttacagatctatagcctgctgctcttctctctcatcttttatctcattaaaatatgtttacaggctattagcctgctattgtacctgctcttagagagagtgtgtcgtgggtgactattcagtctcccctctcatttctctgccacctcatcacttttgccatcgtggacacactatcaccaggctccagctaatttttttcaattgtacgtgctcttagtcgacgtacgtccaatttctttctccaagaaagaacgccgaacaagcgccgacgaaaaacggttcctcgttatttctctccaacgcgcgcgcacgggctatttctacccccgccgccgagtagttaggcgtccaaagtttcgggagttcatcgtgaacggtgatcgatccaaagaacaacaactcggagcaaagctagctaacgaagttagttccaaacaaagctagcttatcgcgattagctagctagaagagagttagctaggcgccatggagctaggcgtgccactgccacgacggcccgtgcccggtagctacggcgtgccgttcgtctcggcggtgcgcgaccgcctcgatttctactacttgcaggggcaggacaagtacttcgagtcgcgcgccgagaggtacggctccaccgtcgtccgcatcaacgtcccgcctggcccattcatggcgcgcgacccccgcgtggtggcgctcctcgacgccaagagcttccccgtcctcttcgacgtcgccaaggtcgagaagcgggacgtgttcaccggcacgttcatgccgtccacctccctcaccggcggctaccgcgtctgcgcctacctcgacccgtccgagcccaaccacgccaagatcaagcagctgctcctctccctcctggtctctcgcaaggacgccttcgtcccggtcttccgctccaacttcggcgcgctcctcgacaccgtcgagtcgcagctcgcgagcggcggcggcaagtccgacttcaccgccctcaacgatgccacctccttcgagttcatcggcgaggcgtacttcggcgtgcgtccctccgcgtcgagctccctcggcaccggcgggccgaccaaggccgccctgtggctcctatggcagctcgccccgctcaccacgctcggcctgcccatgatcatcgaggatccgctcctccacacgctgccgctgccacccttcctcatcagctccgactacaaggcgctgtacgcgtacttcgccgccgcggcgtcgcaggcgctcgacgccgccgagggccttggcctgtcgcgggaggaggcctgccacaacctgctgttcgcgacggtgttcaacagctacggcggcttcaagctgctgctcccgcagatcctgtcgcgcgtcgcgcaggccggcgagaagctccacgagaggctcgccgcggagatacggagcgcggtggccgacgccggcggcaacgtgacgctggccgctctggagaagatggagctgaccaggtcggtggtgtgggaggcgctgcggctggacccgccggtcaggttccagtacgggcgcgccaaggccgacctggagatcgagagccacgacgcgtcgttcgcgatcaagaagggggagatgctgttcggctaccagccgtgcgccaccagggacccgcgggtgttcggcgccacggcgagggagttcgtcggcgaccggttcgtcggcgaggaggggaggaagctgctgcaatacgtgtactggtcgaatgggcgagagacggagaaccctagcgttgacaacaagcagtgccccggcaagaacctggtggtgctcgtcggaaggctgttgctcgtcgagctcttcctccggtacgacaccttcaccgccgaggccggcaaaaaggtggtcatcaccggggtcaccaaagcttcaacctccgccgtcaatcgtactgcttaagccggccatcacttcaggcgtgggtcgtcgatcatccactcaaccagctccgtcctacgcatatgcaataagaaatactcgtacctgaattcttgcatggctaaacactactaataagtgtatgtattctgtttatttgttcgattccatatttgtaattttgttgttattgtttgctgttgaattacgattgtgtattttacagggctgacagtgtctttaaacacctctaatatgtatcggatcaatctgccctagtcatgtctaatttgtgaagatccactttctttaattattcaatcatgcatttttttttcttctttgtcgtcgtccttcccccacgtacatagcacttcatatctcttagaataaaacaagtaatctttacctgttgttccaatattattactccctctgtgtttttaaatatatgacgatgttgatttttgacagcgatgttaaatcatttgtcttaattaaaaaaatataaatacttttttattttattgtgacttattttatcatcaaaagaagctatatgtaattttaacttatgcttttacatatttatattaatttttaaataagacgaatggtaaacattataacaagtcaacggcatcataaataaaaaaacagaggtagtatattgtaagttgttttgaattttccctaactcagatttatttatgtttgtccaagtttttttaaaaataaaacaacatttttaaaacagaataaatatggtataaaaatatgatctatactgaatataacgaaactaattcgataatgctcaaaatcgaccctccccccgggcacgtgcatgccaggcccgccacatgtcgcacgccgctcccatcacttgtccccactatgcgcgccattgtaacaaatcacccgtatattaagggaattcgtttcaatttttattccaccaaaaatgtttcacctaatatgtcgacgggggatacctgtagaccggatatagagggtattgtggtccgttagtacgaggatctacgtagtacgatatcaagcaaacaaaagacaaggattatactggttcaggcctcttggtaggtaatagccctaatccagttgatatgggattatatgatggaaaccacagattacaaagggaatagcagaactcgatggtaccgacgagaccgtagtcgagttggttcaactagatctcccagcgacttggctcctgtaggctccgacttcgtagctgtgatggatgtattggcggtgagattcgatgccttatgtcctgcccagggggtcccttttataccgcgggtcagttgatctccaagtaggactcggagatatcggacccctcacgatatggtaacgacccagtctcgtccgagtaggactcctcccatatgtggattctgtttctatcacgtgatagatttccttaacgtgtacaggaactatccgtatacgcgcgggtataccatatcagtatacaacgtatatccaaggatagagggtataccttatccgtaacactgacataatgtactcacaatgtttcactatgtatagattcaatgttgcagtgaattgaaacattcttttgcaacaaaatcacccacatattatggaaaccctctattaaggaaattcgttttattttttttctaccaaaaatgtttcacctagtgtattcgtgatgtttcactatgtatggattaaatgttgcagtgaattgaaacattatttcgctatttgctgaaacattgtttttatataaggtgacacccgatcttaaacgattgaaacattttcgatctacttagtgaaaaaattccaatacacttggtacaacagcgtgcaacatttaaaaatagttcaataataagctaattttttttcatcagaatatatccatgtgtggtctaattttaacgatttaattgcaacaaatttaatggtacaatcgaatcatgatttggataaataatttaaaagaaaaaacagtttaaagtggttttgcatgcatgcatgctgacgtcagctgacgtgggcgcctgatttttttacacccggatcaggcgcccgacacctagtcccttcctatttgatatatattgtacatattactattttataaactttattcaatttaagaaatttgacttatgataaaaaccagaaatatcttattttattggaggagtactacatttgtcacgtgaaatcaaaggctctgattctttaattttatttttgttaagtagtcgtgaggcttcggtatattgggcttctgtatcttccagttgaattaattaatggttggttaattcagtactccacaaagacagcatatatagctatacgtatatagaccagctgttcttcagtcctcatctagaattttctgccatgcatatatatggaacttaatcatccgacgtgcgtgaagtcagtcatctatataataatctacagtagaaacgttgccgccgcgcgccgccgctctggcagccggcgagtacgtcaccaagtcatcatcaccaaccaccgaagcgtgacgccgcgcctgtccggcgtaagatacgtgcaggtacgccagtagtgactgatatggtttcaactttagtacaagcttagatcggtagtacgtccaggactgaacggtatctctcacctctcacccggatcggacttttcccggctgaccagtgaccagaaatgtcaactaaactaatcgcatgcagaaaaggagggttgaagtgagcagatttactacgatagcatggtaatttaattcgtactatcttctattttgtccatttcgaaacataacgtattgtatatgcaaaggcgttctaatttgaaaacattctcaccgcgtccccactaatgcaccttccatactatacatagtagctcagatgtgtgtttgaacagttcaattcaaactcatcacgcatctttgttaactggtgtcacgccccgaactagtaccgaccggaactagcccgtgacgctccaaattaacctgttgatcgataccagtcccaggaaacagtgctggtatcacagggagacagaatatcacagcaacaacggtctctttattatagagtacggatacagtcatgttgggctacggacagatcccgagctcacaactgcattacaaaagggaaacggaagcaggacttggaccaaacaacacaggcgcgacttgggaactaggccgaaaccctaaaactcatcgtagccggcttgctcctgaaagaactcctcatcagcaggatccgcttcatcttcttcagcaactgggggggatttatttatatagagcaagggtgagtacgggagtactcagcaagccaagggaaattagtgtttaatgcaggcttcaaggaaaggctgttgtttttgcaattgattttatttgaactcttttctaaaaacgactaagtgagtgcttctcaaacgacacggatgagacagtgcatctcgtccggtcggagtatgtgcaatgcatcagtctttagaattgaaacaaggttggcacccggccaacagcttttcaatggccacccgggccaacaacttttcaaacggccacctgggccaacaacttttcaaacggccacccgggcctagctgatcccatcagctacagatttttcaaacatcgaatcccttttcacaacagcaatttcacaagcagtagtcaaacaaaactacgctaggaatcacctcacatccgcccatgaccgtgggcacggctgttcgaacagtttgttaacctctgcagagggggtacactttatccacacgacattactaacccggatcaccagcccgtggggatcagccacgtcgggagacctccaagctttcgtgacaaggcatttcgaaagccgacacaggtttaccatatgccgacgacaggggtcccagaccaacaacaggttaggtcccagaccatactgtgccaggaagcccaggggtcctccccgacaccaccccggcgaatccacatgtctctcggcatcaaggctcccctgataagctagttactcagccaggagtgtcccattccacccatgtggtcgtacttgacttatgtttggatgaaattccaaggaaacggtccttaagtgcaagagcgggaaatcgtacacccggtacgttccccggtctgcggttttggaaattcatttagttcgtaagcaccgacccaggtgtcgggttttccaagtcttttgtaaaacccaagttttacccaagatgtttatcatattttaagtttgaaggcgaccgtcgatactcgcacagagtgcacggataccgaggcgcaactgggtggttacaagggaacatggtgtaacgattaacaaaggaaggatcaaatgcaacaagttaggtatgcccactaatctgcctcgcagacggggcaaacatattacgtgcaatcctatcaatgcatgatattttgcaagcaatataattaagtccaaatataggct

SEQ ID NO: 80954 - DNA, 8229 bp, Oryza sativa
atttaaaggacatgataagatggcatgacaacaaaactgaaaaggaaaaaaagaagatgagaaagatacttacgggcaagggcaaaatattttccttgtgtcctttctctacaaattctttaatacgctcagggcaatcactgaaatttgtaacgattaggcactaacaataaaacaaaaaatgtgaaaggggcataatgaaagagataccaacctgagcccatcaattggctcccatgtatcataacttggatcataccctttccaccgcacctatataaaatataattcacagggtactttttcaataatatagtaccacactagattaatacaaataaatatgaaattaaaggaatgctagttaactagtaaacattaagtctattaccttaaaccacaagccattttttcctgtgttacttggatcaccatagcatatctcaaggagctcctctacatcgaatatatcttctggaagaggctcatttacatcgtcagcatcatttaagggcatatctatactaggttctagtgtatcgtttttgtggacaacatattttctacaaagtgcatcccactgctgaataagggcaagaaaatcctcagttttctcgttccgcacctacaaagtagaggcaaaagcaaacacatgaatttgtctatgtggtggatgtgcaaggtgatactatctagtggcagtacacaagtggaaacaggaatgtactacctgcgagtatgggtgattatgtttgagacaagcacaagcatatttgtttatgtcaacagcccacctctgcacaataaagcaagtattaacattgtcaatagacaaaagagcttagtaggcagttaggagtcacaccaagtacaaaacgtacagtctctaaatttatgccagaaaatgcaaaacccaaacaaagcccagttgacatagcgccacatcctgagtaaagatcaagcagagaagctgtctctgtttgttcactatatggtgccacaatatcagccgacaattttcccttagaagaattgtcagcatcatcgcaggaaatatttgatgttgcctcactccccaatgcaccatcattatctacaagaaaatagctccctcagaagataagacaataaacattgagattgacaatattgaagcaacaagtgtatttttgcatctgtcaaatattcaaaatagtaatataatataaaatatttttctcatacagtttatcataaaaggtctcttatgtaagttaacaacaaagtgaatgatgcacatacacacctatgataattgcaatgggaaaagaatcatgtaaacaattacctgctggaagatttgcaaacgtggaatatgcaacagagtaagacatgtcatagtacaggtcacaatcagatatagcatgagctcttgcttgaggcgtcatctgaatttgtttaaatattagcaacaacaaaaaatcatctgtaacatgacaacataataagcattaaataggatatatgcctaatgaatatatcacttacatttggatcaacatgggcaatctttacttttgagactatgcactcaatcaagttgtcattcttctcctttgaaagaaaaacacgcttatggttatgtctatgatcatgcacctttaacaacttttatgacaatgacctgcaaatacatgtctcttataagtgttacatttccattaaaaagcaacaaaaaggtacttcagagttcagacataccgtatctgctgtacggaaaaaccactgacaagagaaatatgatccacggtcgactccttcaaaaaattcagtaatccgtccaatgtaattttcctcatcaggaccagcctgcaaattagttagtttggttcatatggacctagtagacaagacatatgataagcaaatagataacgcatgaataatttacaacgatacaccatagagcatatgcaagccaaacgaaatgatattcttattaatctccacagtcaaatcaagttatgtacccatttcccacacaaaattgatatgcacagaacaatgatatgagaaaatttacgtgcgtacaaaatgagtgccaacaaattaatcgaaaacttaatatctcgtggttaacaaccagtagaacaaatagtaggataataagtttaataacaattataatgaagagcaaaacaaaaatggcagaaagtaaaaggtacattaatcatcccttgttagtcagtcatataaaaatgctatcgtaaaagcaatacataaaactaggaaacaacattggttaataaagttctaagaagtgtgaacaagatattcatgactgaccttgacatagacatcatcatcaagatgatagatttcatcatccacattagcagccaggtagtgacatcgagccttcatttcttcatcttcgtcaggcctgcataaatgaaaattctgatcaccattataaaagcagcataagaagagattaagagtactttcagaacaatgttagcgtaaaaacacacatactcctgcttaagaagcgaatcagacccctgcaacaaaaacaaaagagcatgtcagttttatttttcaaaatcatctcaaaatcgaagtgataacaaactttagtattccaggagataactctagaatagagttagaggtttactagaaattcttacctttctactgtacctcacgggccatcgttgtcgcgcttcatcatccggtactggatcgcccacaaagtggtcatctgagtcctccacccttctcgcagtgcttggccgcgccaccctcttcctcgtcgcagccttctcggctgatccttctccgacacacttacccatcctctcctctgcttccagcacgtcggctgcctcctcctcctcctccatggccatctgttcggcgtccggctcatccgcgcacacgtcttcggccagcgcgccacccgcatcgttcaccttcatcttctcgggcgcctgagccgccgacttctcggtcgtctccttcgtcttctccttggccgtcttcttacgggtacgacgcttgaccttctccaccccgcgctgccgcttgccgcgtgactctgcgggcgacaacccactgtcgagctcggtcccctcgggctcctgcgccgccgccttctccacgtcctccggcttccattcggtcgctccctcatgggcactaggcttctccttcgccgtcctgcgctggcgcttgcgcaactcggggcgcggcatctcgcggtcgatctcgtcgagctcggccaccccctccgccgccgccgccttctccacgtcctccggcttccattcggtcgctcccttacgggcaccaggcttctccttcgccgtcctgcgctggcgcttgcgcgactcggcgcgcgacatctcgcggtcgatctcgtcgaggtcggccaccgcctccgcctcggcctccatcgcggcggccgtcattaggcgcctgcgcgtggagcgcctcggctccgtcgccgccgcgggagccggctccgggaccatggagccgcaccggcgcagccgcagcccgcaaccgaggccgcggagatcggagacggagacggagacgacagcgagagggggggagagagaaggattagctagggttttacggctcagcgagctctcgatcgcagagtgtggttcgccttggataggagcggaagcaggaggcgctttgatggcttgcggcgtcgcgacgggaggaggtctcgagcaggccggattcgcgggaatgcgtgacgtcgtggtctcgtgccgacgcggaagattggaatggaaatcggagagagcaggggcggtgggcggtgggcccgtgctcgccgcagctcatgcaaaagagggggtcgtggcttccgagtgggccccacttgcagtgacggacactttccttcctcaaatcctcagttctgttggtcttctttttctctccggtggggatagcctagagactagtcaatggcttgtccttcccgcgatgtcagcagcatctgtgatctctcagtgggacccacgtgtcattgggcgaagactgatcagcgccgggagggccaagagcgggacgattcaaactttgggctttgagattcgtgtagacccattgtctggcagcggcgatcgtccgatcggctggtcgtgtgggtccgccaggagcagggtgatcacctcgttttctggtcacagtttccttttgtgtgaaaaactgaaaatttccgaaactttctggttaccgtttgaattccatcgtactcgtacgattcccttggcatacgttttgtatgggaaaaaaaggaagcattttcatgcatatctctatgctcaatctgtgattgattatacttactgtttgaattttgaatcaccgtgcagaaaaaaaattttgctcggcatgaactattcatcttcgccatggatggtgattggtcatggactcgcggttcgggggctcgcggcaagagtaccaaacatagttaccgctatttcagaagcccgtaactatttcagaagcccgtaacaaacaggccgtgagatacagtacactatttcagaagcccgtaactctctaaccagcaactagctaattgggccgaattattaatggctatggtttcctggcccggcccatagttaccgctactactcactctgccgagactgcattgtctacctttccaccttcccatcctcctcccgttccggccaacaccaccctctcctcccatggcctccgcctccgcctccctctcgctggcgttctcccctctcctcctccctaccccgcgaccccgaccctactcgcgacccatcaacccggggtttcctacccccctacggctcagccttgcgtgctcgccgccctcccgtcgcgccggcccggttgccgcggtcccggacggcgtcgccgtcgcggacgtagtggagaaggactggtccttcctcgatgctgcggcggcggcggcggccgcgggcggcagcctcccccgcgcgctcgcggcgggggccctctcccccgcgtcgcgggtgctggccgtgacccccgcgccgtccttcgtggacgccctcctctcggggcacccctgcgagctcctggtggccgcgcacgagtccctgtacgtgctggcggggatcaaggaggggcacgacgaggtgaggtgcttccacttggagggaggcggaggcggcaggggaggcggagtggtggagggcgtgccggagaggttcgacgcgttcgacgccgtgttcgtctgctacttccccgggatgggtgtctcggccgccgcgctgctcaagtcgctggccaagagatgctccaaaggtgagaagctatcttatctctgttttgctctgttagcttcgcaatcatttgagggttaaaactctgcattcctcgcttaattggagggcctagttgtgggtttgtacataatcagcggaattgctgtgttcactgctcttgaggtggtttgtgatggttaagaaactaggagtacattttgttgtgacaaaatttggtttgtatgactaacagtgacttgagatatcaatgttagtactaggtaacctgttgccttgccatattcatgaaataaattggatacattagtttacaattacatgtggttttgatacagtgtcctacatggtttgaatcgttaatccttgtgtgtgctgatttagtttgcttgaaacaattttgatgcgatttatggaacagacaaacagccgtaggcatgcatatacttgttttgttctgattattttcagttcctgtggttaggctagttttaaatcctaattctacattgtagatggtgtttgtttcatggagtgcattagctcaattcaggcactacttgtatagttgtatgtgcctaaccttgccctctaaagttttaatggggtgatttgcggccttgttgctttatatatgctttatagttcatcttttgcatctgagaattgaatcaagctatcaaaatgtccttgttcttagttcaatagtattcagctgtccttttctcttatatacatttgctccactcctcagctccgacaacccagcttctcacaaagctcttagattagctatcttaacccgttgcttcttattattaacaagacatcatcaaggatcagtcatcaacctttgctacatcccctagtttagccaaatttcatgaacatcgacttgtcagggtgcttcatgtgttgaggtcattctgatatgttgtgattataccacctggatatttcttgtatgcattttgtcttgaattgaaacgctgtatgccgtttgccataggtggaagagttgtcatctttttggatcaaggacggcaaagtttggagcaacatcgcagggaacatcctgaagttgtaactgccgatttgcctaccaggccttctctagagaaggctactgccggtagcaagtttgaaatattagagtttgttgacgagcctactttgtatcttgctgttttgcagtttcaatgatgaacttgttgaaaacaacaaattatatagacagcttgccatccatgccggcgagaatcaactcggctttgtagtttgtagatatgcaagaaattattgcaaagttaatgatccttatggcagccaagttactttgtagtatccctgttgacatatgggaattaccagaagcactggcagttaagggcatttacgattagatgaagccctgcgctttactgtgggatatatggatgaatttatgttaaatgtcgtaggactaatcgatagatttgaccggtttgggttaaatattgtgaaaataatgtgagatgataatttagtatgcttctatattgaggtttagaatataatgaattgtagaagtaattgctatgcatgcatggtgagttttaggtgtttagtgagttgatgtggcatgtttgcatgttattcttttgaatatactaacaactactactatgcttacatatgttgagttttagatgtttagtgggttgtaactttataaaagatataggccttgtttagttggggaaaatttttgggttcggttgtcacatcggatatatggacacatatttgaaatattaaacgtggtctaataacaaaacaaaatacaaattccgtcaggaaaccgcgagacgaatttattaagcctaattaatctgtcattagcaaatgtttactggagcaccacattatcaaatcatggcgtaattagacttaaaattcgtctcgcaatttaatatttcatgcatgtattcaaacattcaatgtgatggatgaaaagtttttgttttggtaactaaacaaggccatagatactgtgacgtagggactagcgagtggcctctccttcacgttggaaccggaaccagggctaggtgaccgttctatttccagtgccctgcaaggcagttcgcacttcacatgaactagaactttaccgcatttctgaaatctatgcctttactaagttttcatacacacgaggaacgtacaaggaggaggctaaaataaagaagacagaggcagccaatacaaggaaaaaactcaagcatcttttatttcgttcggacaatacaaatcactcaccaagtatagtgccaaccacaacagcaacaacagtacagatctcccgcgtgtgttgcttttatctcgatataaatgaaaacatgctgccatttttcgagcaaaacagattgtattctttgacatcagtctgctccctcgagcaaggctgaacttgaacctgagccaacggcgttcttgtagctgactctccactcgtgtcatctttggatgatggtggggcagggggagctattggcaggttgaattggaacaacgagaaggatgcattcccctcaggcgagcttttgttctctcctggagcatccttcaggtccaacggcttaggctgagaaggatgcctttatagagtcgggtctccatgaggatggccaacagtttgactctgatgcaatccatttcggtaaggcggcgatgtatgcatgactctgaagcttggcgtggtcttccgaatcggctccggaggagcataactaaaagcaggagctgggaagtgatgaacattgctgtactgcactggaaaatcaggagactgctttccaggtactccaaatccaagtggattggaatagaagtggctaggctgggcatactgcatgtatccacttgctggagcagccca

SEQ ID NO: 80955 - DNA, 53801 bp, Oryza sativa
  unsure (1)..(53801): unsure at all n locations
cccctccgctccgcccgcgcgccgcgcgcgcgtgcgcgcgagagccgcgccgagtgcccctccctcgctctgcccgcgcgccgttgttcgcgcgcgcccgcgtggtcgtcgcccgcgtcgctcctgcgccgtctgcgccgcccggccccgctgccctgccgcgcctgcagccgctcggccccgcagccagcgcgcgtgcccgagccgcgtcgctcaaaccgccgcgccgcccgttgcttcccgcgcgcgcgtgccgtggtggccgaccgcctggtcgccgccgccgtcagcctctgccgcgcctgcccgcgcctgccgcccgtgtcgtcgcgccgctccaaaccgtcccgccgccatcgccgtcgtcatttcctcggccccgccactccgcgggcaagccgccaagggacggaggcagagccctcctccctatgctgcgacgcccccgctcccctcctccttttcccaaagaagcaaggggcgagccccctttctctccccctttttcctcctttttccctttcgccggcgtcacctcctggcgccgttttggccgccagccggagcgccagctcgcgccttgaccgccctaagtcggttcccaaaccgacattgccatcctttaaacccaagcctccccctttcccttcctctcccattcgcctccgcgccattgccgccgcccccgtgctctgttcgccgtcgccgttcgtcgttgcgcgtgtcggaggagccggcacgagcaaggacgcggaaggggactccgggcgcgccctctccttcctcttccccggcccgaggccggagagattactcccgcgccgtcggcctctcgtcactgcgcccgcccgcacggtagagcatctccccgttctccctcctcgctccatctcctccccttagactcgggtagtagcacaagtagcctcccgtagctagccggcgccgccctggccgttgccgtcgctcaccgtgtgctcgccgccgttgccgcccgagctcggaagcgccgctcgtcgccggcctcgctcggcatagctccgcccaatccgacgctagcaacggattcccgtagccgcgtagatgctctcgccgccgggaattggcccctcgtgacctcgtcgccgtttcccccttccctcgccgccggttgccgccgccgcaatccgccgccgacgcactccctccggcgaatccgagccgttggctcgtctccccttgtcctgtgcaaccacccggtgtgctcgctctcgcctgtatcgccgtggtttgctccgtcgctcgccgctgtcgtccgccgtccgttccggccggcgtcgtcgtctacctcccgccggcccgcgtggcagccacgtgggcccgccgcatccgcatccaccgcgaaccgtgcgcgtgcaccgcgtccctcccccaccctagcgccgcgccgcgtgctccctccgcacggtgagccgagccggtgacaagcgggtcccacccgggaccacgcgtggtgagcccggcccaccggccctctctctcctcccctcccgcgcgcgcgcttgggccgccttgggccggccggcccatttagctcggccggaccgctccgtttctctcgggccgtgccctagccgcccgaggaaaagtctatattcccttcctcttttcttttcttttcttttcttttcttttccaaaaaggattttcctttagaccaaaaatccaataatcttagaaattcaatatcttcccaaccgtaaatccgtttggctccgttcaacttccaaaattcctcgaatctcgagatctatctaatggcacgcttagaggtcattaatagggctttattcttcgccgtatattgagttgttccgtttcgcgtgtagtttcggagcccgaagacccgcagtgcgaggatttcgaggatcaagctccagatctcgagcaaggcaagccacccttgaacatcttgagcctatatttgaacttaattatattgcttgcaaaatatcatgcattgataggattgcacgtaatatgtttgccccgtctgcgaggcagattagtgggcatacctaacttgttgcatttgatccttcctttgttaatcgttacaccatgttcccttgtaaccacccagttgcgcctcggtatccgtgcactctgtgcgagtatcgacggtcgccttcaaacttaaaatatgataaacatcttgggtaaaacttgggttttacaaaagacttggaaaacccgacacctgggtcggtgcttacgaactaaatgaatttccaaaaccgcagaccggggaacgtaccgggtgtacgatttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtggccattctgcacggactggatgatccgggttagtaatgtcgtgtgggtaaagtgtacccccctctgcagaggttattaaaactgtttgaacagccgtgcccacggtcatgggcggatgtgaggtgattcctagcgtagttttgtttgactactgccttgtgaaatttgctgttgtggaatgggtttgatgtttgaaaaatctgcggctgatgggatcagccaggcccgggtggccgtttgaaagctgttggccgggtgccaatcttgatcaattcaaaagactgatacattgcacatactccgaccggacgagacgcactgtctcatccgtgtcgtttgagaagcactcacttagttgtttcagaaaagagttcaaataaaatcaattgcaaaaaaataacagcctttctttgaagcctgcattaaacacttattttccatggctttctgagtactcccgtactcacccttgctttatataaataattcccccccagttgctgaagaagatgaagcggatcccgctgacgagaagttcttccaggagcaagccggctacgatgagttttagggtttcggcctagttcccaagtcgcgcctgtgttgtttggtccaagtcttggcttccgcttcccttctgtaatgcagttgtgagctcgggatctgtccgcagcccaacatgactgtacctctactctataataaagagacctctgttgctgtgatattctgtcttcctgtgataccagcactgtttcctgggactggtatcgattaacaggttaatttggagcgtcacgggctagttccggtcggtactagttcggggcgtgacagccagctggggacatttcattgttttctatgagactgtctaggctcgtttttcttagatgatgaaatagggcattatggtctttgcttaaaagttacagccaattattataatctcacacttaaaataagtgaaattaaaaaaacttaaaaatgaaaccaatcaacaagaagaaacaaactaaagagtaaagattgtcaacctaagataattatacaattattgaattctgtttaaatttggattttatgaaaccaactcattgccccggatgcaacattccaatatgatttatagattgctgtgcattaggaagggtatatacagtggtgtgatttcagctggctgggaaatttggcacgcaaaaatttcaagtgacgtgaagaacataataatatcatctgttcaaacatcttgtagatagttttatagtattatctaaaatactgtaggaactgcctatataatcagttcatttcgtgttaagggtggaacccatgcacccacgtcgtgacgtcgtccatcccattttctccgtcttgccattgctagggggcaaccccatgtggttgcgaggattacattggcgggctctcttcctctctcacaccccatctatattggttgagaaagtttgtattccctctatcccaaatataacaatataaaagaggattaaacagcgtatccagattcattatatctaatcttttttactagattgctatattttaaaagagagggagtatatatctactaataaaaatgacaaaaaattgtgcatatctaacaaataccatcatactatacttgcaagagcaagttcccaacactcccctctcattttccgcgtgcatgcttttcaaactgctaaacagtgcgttttttacaaaaaaaaatttctatacaaaagttgtttaaaaaaatcatattgatccatttttaaaaaaaatagctaatacttaattaatcacgtgttaatagaccgctctgtttttcatgtatgggagatgggttcccaacacccacctccaaacacagccttagagcatctccaaattccactctccaaatacttatatatctaactctttaactgatttgggtaatcaaactaggtgttcactccaacagtctctctatttacatctccaaaataacaaagggacccacatataagcctctattaccttcttcctcttctttctcttctcccacatcgacccatccccgcgcgaggtggacggcgaacggcgacggcgacggcgacggcggcagcggcggcggcggcagctcctcgtgcgggcgaggcggaaggcgacggcagcggcggatccccgcgcgcgaggcgggaggcgatggcggcggcagctccccgcgcgcgcaaggcggacgacgacggcggtggctccttgtgcgcgcaaggcgggaggtgacggcggcggcggcggcggatccccacgcgtgagggcaatggtgttctgggcggagatgatgaagacagtggcgttgagtggcgacctcggcagcggtcgacggtggcgtcggcaacgcacgacgacaaggcagcctcggcagcagagggcaaccggcggcgggcccggcagggggcgacgacggcggagtggtggcgccggcggagctgtatctggggagtggtgaatcggagaaattgcagagagagtgtgggatgggagggggaaaaggtgtgggatccatgtttggctaggccattttggctggccaaagttggccagcgtgagaagtgctttggccagccggatggcttggctatacggttggctagtctgttagagcatgattttgatctaaaattgccaaaatttggcttagagagtggagtaaggaggctgttggagatgctcaactttcaaaaatgccggtttccattagctcatagactatatgtattgaagaaaagtacatttttttcttatatagtagtttgtgcctacggagtcatgtagatatttacattacctcatgcgttccaaattgctgatcacgtggtatattagcagtttgttagcacacgcgagctaacctcgagagacttgtcattaatcaggttcatagcttatgcctacattctaccgaccgagttaggttaggtaggtgcacgatttgtttcagtctgagatatctaatctgctcaaagtccggagccacaactgacaacaacaaaattcggcaggggcggccgcgcgcggtccttcgattttctccgtttctttccaatcctctagacttccgagtgggattggttcttcgattctccccgtttcctgcctttctctcggtctctcgcgcggggaggtcaagtccatttccgcaaattctcaaaaaaaaaaaaagtccatttccgcagcggagccatcctcgcgcgcggtcccgagaccggtaaccacaccaacttccgcaggccagtgggggcgaaagcaagatctaaccgagaaagtgagggcgaagtgaggccccgcgccgccccgcgcgataaggacaaggatttttctccgtttcgtcctgatacgatatgcgtgacgtgacggcggcagcgagcgaagggcggcaggcaggggcattcgcgaagaggggaagaactttccgacgtcacggcgcgcgcgggcaacttgcgcccaacgggaggcaaccgcatgggggacggggcgcgtgcgtccgtgcgtgactcgtcgcgctcttacgccgtggcgtggtgttccgttttgtgcttgcgcttggcttgttttgttttgttttggggtgctttgcttttgcagctgaggtgccactgcccaccacgtactactgtgcaaattggccgcaagaaagcgatgcttggataggtacttgctccgttgctcgtcgtgtggcctggatcagtggatctcggaggggataagcatgcatgtaccgtgcgtgcacctatagaagtgtaagtagcgagaggtgaactattgggcgaggcaactcgaaaacttgataggtggcacggcagcgaacacaagtacacaacatgtagtagtagatctttattttttcaccagtggtatggctaggaacgatcgtggaagcgtgagtgaatacggtgaattttttgcggtgatgtacaacgggccaaccttttgattttattttttatttttctgtgcgtggggccaggttagtgtcaatttcagcgtcgttttccaatggcataaacaatgctaaatgacgcacgcattgttcgtgataggatatccatcccgtctctctctctctctctctctctctctctctctctctctctctggccccggctatcctctccctttcttcttttttaggcgcaacttgtcagttgaacccatctcgctcggtattagctttgcgttcggttctcgtaaagacggaataaaaaaaccgtaatacctttgtgaagtaaaagtaaccaacccccatcattcaatccaatccaacctgaggtacacgtgatcgaatacgaagcgcgcacgatggcacgagaggcgcggcttcttccgcctcgcgcgattcgcaaccgtccgttcctgcctccttccatttaactgtggatccattcctgcctcacccctgcaaatctctgtgcgccttgcaggttggaagaaaaagacaagagatacgaagtggtctcgtttcatctcgtgcgctagaaatgctgagatgatgcccagtttttttaagaaagtttctcgtggaattatggtggtttgagctcacatcagccgcccctgttggaggaaatctaacgtccgaaccatatattacgaagtggatggattaggtgtgccatgtttagtttttcagataatgatgcgatgattagctagcagaattccagcaactaaacatcgtactacgtagaaattagtaattggcatacgcgcgcatttgtctcattgtggaggagtgagtgcttgaagaatctcacctgctggccgtatttggtacgaagccgctaagccatcgaaataaatcagtggaaaacgaaaaactcattgctagtcatccaagaagatggatcaaccaactatgcttaaacgtgcagacgattgttggaaagattcttcacccccacttactagtgttctgttttgtccgatcctgtgtatagaataaatgccaactattcttactcgtagctaaaaaacagagtacagtggttcaatgtgaagaaccgttcctggagtatatcccatttcgttttctcaccgcaccaaaaaccaagcaaagatttaggcatgtattgcttgccatcgcacgatacctgatagttgatcaatggattcactgttatctaaccatcatgaataagacctaagcagcgacttgatgtacgagtagttatcggagttcctctcgctggcattgaaagaaattgagacaggacgctggcagagagcgattggatcactgaaacctttttggatcagctgaatttcaatttgcaagagatagtaacatcgatacattaacaagttgctccataattcttaagaggttataccacttgaaacataacatatcttatgtttccatatttaggataaatgccatgtaagacacatgcatggctttcgatcacctggtgagttgcttgtgatattaataagtcctaaaagagacaacttccattctcaactcgcaagtaatctacattaccatgttacttggaggtgatctataatattaatagggtagaatggttggatatatattagagcactgagtctacctgtatataaatttataattgcttccaaatgacttataatcttgcccacagttattatgtaagaaattcagctactctctccgtcccaaaatataacaacttctagcattaaaaatttatcccaaaatgtaacagcttatccaccaatattctcttcacaaccaatcacaatccttcaccattcaatttcttcacttacctccacgtctcaaccaatcacaatattctcctattttattatatctactttcttaatagctatatcaaattataaaacttctaatattctgggacggaggcagtagcaaattcggtaaagtcatcatagttcacaaatattataaagattatgagcattttcaaaactcgcctatagctctgtactgttctattatattattgcatataaggtgaaaagttcacaaatttttcaacactcgcctatagctcttagactgtcatattgaacgggatagcaaactttggaccaactcactttgcatttgcctccatgcatctcctcattgccaacccataggaagcgcacctcttgttgccttgtcaatatcttgaatggattgttttggcggcttcaacactgtgaggacgtatgttgggatggcacttaggactgagttcaccataatctagcgtccccctgcatataagaacgatggattccatctcaagagacaacccttaatcttgtgttggacaagctgcagatgtatactttgtgcaaatggccaagggtgagccgtagtccaacaagttggtgggaaggtagccctcaccatagaggagttgcacaaaacgtcatcgagatcaatttcctgacatcgtatgggtgccaacaggccctttccgagattgacatgcaactctgttgcctcgcggaagtccctaagaatgccaataagattttcatagctccacttcattccttgctggagtgaggaaaacagccgcatcacccacatataagattttcggatttaaatgccaaagttgtagtatagtactaatataattatatttataggtagataaaaaaatatcggtattaaaaacaaagaaaacgactaaaagtaaatttacaggagacatggatccacactttgagagagtgggaaggggcaaataagcatttaccatttttcgatgtggcgttaaataatttgtcacttatatgtttatgatttgtaggtttatgtggtaaaatattacatctaaaagtgacaaataattaaatatctctgtcgatgaatggagtaaccacttcaggttcagtagttcagtgccgggactggttgatcgccacctgctcttcacttcagcagcagctgaaagttgttggcacaccacattacccgtcgccggctcgccgctaacgtgccgaccctattcactctagaaccccaaaaggcagacggctcaacgagagcgcgggcgcaagtggggctgaaaggggggtgtacgcgaacgccctcccttctttctgcagacgcccccaacattcggggcacatgcatgaacaacactctgattaggatggctcaacaaatgccacgcacttcatcatagagaaaagaagccacgccctccccacctcgttttcctcatttttatggcgtgcaggaactctcgcgatccgagtttttaaagtggccgaggcatcgggcgcagccggggtccccactaggccactcgagcagcggcacgaagatgaccgcttcgtccacttcaggtagcccacctggatgcagacccttcctgttgcatcctggagatagattggaatagagaagtctagagaataaaactagagattagtagtagatgttttgatgacatgtacctgagcaaacgaggtggtactctggatcttcagctaactgaacatctgtttgcagatccagaagaagatgatactactagtagcattttattcatcccagaatctgaaacctgagcatcagagtatctgagtatgcgtctttcagggtcacagaatcgaacctcgtgcagtgcaataccacccggagaacaaatttcattctggcaccagttgcaatttgtaaacaggatgtttgattagaacaacaaagtctcaacctttggttgcccttaacacaacgaaggctgattttaagacagcttacaacaggaggttagtcgtagtcactgaagccggcagtagtagcaaaatttcgtggttgcgatgctccctataagtctggtgccatcacaaccacgtttagccggcttctttgccctcttttctaccctgctgtcaaactaatgctatgcacgaagaattagctacagtgcacgtgtactatatacacctcctcctaagcgactctgtacgtactacactgtgtttctgggaatgggcagaagattgggtcggcatatcacctgggtttgttcaaatcaggaagcataattggtcaaccattcgagactctgcataaaaggattactgcacgttatatgccatggcacgctaaagatccgggtaatagtcaaattgctgcaaactgtgtacaacacttttcaccagaatcataatttgaggagaaaacaaaccattaggcattcaggcagatcatcattcttcgttctcatgtgagtctgcatttatgtgaagagcaagtggttagacatttgtattctttgcaaggatcagtatgttgtgaattggaataagcatgtgaagacctaggtgattcatggcatttgtcatctggctacgagataaaatgaaagcagcaacatacaaaactgagcaaaagttcagaatctttttccttaaggaagttctgaacgaatagcagactgcagatataagagaaatagcatagccagtgatggaagattaaagtatttacctccataaccaaatggcatgatgactcattgtttgtggcaaggcaagcaagggctaccactgcggctgccacagtggagggccagaaggagagatgtttgtggtccagaagtgagagcaaggccaagtacttcgccaggtcctcgactctgtcatctgcattcgcagccttcagatagaacctgcaaagttgaaccaaacaattgtaagtttcttattcattctgtccagctgacacagaaaatgaagcaaacacacaggcatagtaccagaggaaatgatgggttgttgtgacaaagcactggaagtcaaggacctcctgaaccagccactccatggcgacgacctcacttcggctgtaagtattgatccctactttgaaagctttttgaaggatgctgaaagagatcgtattattaggttcctgtagagtgttctaaagaaaaggtctatattgcacattgcccttgacagaaactaggcgcttgaaacaaatgcgcatccagaggcaaactcataagttcaaaagtgatacttcgtgcaaagtagacaggcaaagaagaatagttcctgggttcacttcacatgcttctgtgcagtaataagtggcacataaaacattcatttactagcaagttctcagggatacaaataaggtctactttcaaaaatgttgaagattcatatgagtttagtctttaaaacttaagggaaaacacagagaatatctcgcccaccagagcgctgatgtaatagctttattgtaacatcaaaaacagagaaataaaactatatcaaggagatctatgcaagtgataatttctcaaaatcgcatctctcccaataattgatagcttagttctttttttcttaaaaaacaatagctcaaggatgccaactggcgcggtaaattattttgagagatgcttgatcatagtcaacacaatcaagaaacttctggtgtgtttggttctcagccaatcaaaaccataccaatattttggtctgcctaaaattttgttagctttctttttgtcaccaaattttggcaacaccaatatttttccttggtagcaaactaaatactaaactaatcaatcttgccaaaaagtttgtcaacaaaccaaacaagtcctttgccaagattttggagtggctaaatcttgccattgccaaaaaattggtatggcccacaatggcttagaaccaaacaagcccttcatttctaaaatacccatcgtgtgaaacctttttgtagaacaatggtccaatggtctgagttctcacatgcagtgctcagtattgaaagtgataaatagctactagatgagatatgagttaccatcggatgttcctgttgttattaagttatttatagaacataattaaactcataaactcatgctaatgtctgttagaattaagttcaactttcagaaaaatcaaactatcaaagaatactaaggaatttgcagcattgcaattgagcactatcccatttaataatacatgctatattcaaatgagacgaactatttaggtgagtaccagacaagcagacaccaacaacttgcagaagtattcatactgaaactggtcatttaagggagccattaccaattatagggttgattctcttcaatgcgggttgccaaggtggtgcaggcgattcccagcaactgcaggttcctagagccctttacatatccacgtgtcaagaagcggtccatcagccctatccccatgaacacggtctctggctgcagcttcatcgcttgtgaatgctagcgatgcatagagaacaagtcattctttgcaagttatgtatgaactctatgtaagaacaaacatattctccacaaatgacagtacattattttcagaaaaatcaaattacaagtataaatgatcatatcacttaagtacttatcgctgagttgcccaaaaaaacttcaaacaaaaaacacacagcgatttcattttcaaaggctacctgaagtttcaatgcaaatataaactgatggaactagagttagaaaagattaaattcagatgatggtggatacacaaaaaaagggaatacactggcaatatgtttttctaacacttattgcatatataggtttagaagtaaaaagtgatgcagacatttctggaggccatatgccaatgcccaatgccatgggatttcagatggcaaatgactacagagcaactttcaggtgcgaaaataaacacctagaaaaatcctatgtatctcttttcttttcatacaagcatgccattacatccaaaaaaaatatgcaagcatgccaaaataagcacctagaaaatctttatcactgctctatagaacttgaatgcgatgacataaaagttaatgactagagttacattgaaatcactaggattaccaccacactgctggcagactaacacggggaatgctgcaaaatgtacaggcagctaactgtgtgataaacgaatcagcaaatgcaatgcgtatattggtatcagatagcttcccctacacaaaatatgcaagatcacaaccggatctgctacctcagcactcccacccagcacagcatttacactgcagagtagcatgttagtgcaaaatgcaagcaactactgttcttgcagaacacatcagtcagacagataagctgatagaatctagatcagtacagcactccgaaagtatacatgtgcattatcagcacaatacccgtgcaacaaacatctgcagctaccacacaacaaattgcgctcgagctagatgaattattggaccaaggcaaagtcatggtcgcagcatacgtgtacaatgcagagcatactgacctccatgatccagttcaccatgacaacgcgctgctccacgacggcgcggccgtagctgccgagcatggaggagtacacctcaatgtagtcgcgggctaccacccctcgccgctcgcgccgccggaaccgctcgtagctcacctcattgtccaagtcctcaaatctcttcccctgatacaataattcccatctgattacatcaaatgtcgcactgattcgggagagagcagccaaactccaacaaatttgagagaagctgtgtggaacctgcttacctctcccgcttgtagagcgacatccgtggcggtgggcgttttgggatgcgtgaaggggacgaactgctccgccaaggcgaggaacagggagaaggtgggggagggcacggcgttgtcgtcgtcggacgacgaggacgactcatgaagggggctaaacgagcaatcggtgcagatgcagggaccactgcgcacctcctcctcctcctcctcctcctcggtctccgacagcgtgaggtcctcgcgggctgaggagtaggcggtcgtctcggcgtcgttggcgagctgctcggggcaggcgaggtaggactcgaggacggaggcgaggcacgacgactcggagacctcgacctcggcggcgcgcggcctcgcgccaccgatgatctcggagcactcggaggcggcgggctgctcctcgtccacatcctggtaccgaggccgcttctccgggcgctgagctgcggcgagggaggtggggcaggtggtggaggtggcggagatgacctcgctgtggaagcaggaggaggccgaggtggacgactccgcgggtcgcttggctgccgccgccgccgccgccgcgatctgatcagggagcagaggaggagccgccgccgccgcgcctcgccgccggcggaagggatgggagcgcggcctcgtcggcaccgatgcaagcatggtaggaggcattggcgtgcggcgctgtgtgctttgtgtgtgaattgtgaatttgtgatgctacgggcctacggctatgttcgtttggcttgctagttatatagccgtgacttgaggcgtggagaggaagggggagaggagtgttcagcaaccttcggctgttcgccgcatcgcctgatcggtgaagtgttttttgaacttccaaaaatcctcaagccacgactgtgctgcgacgatgcacatgcgccgctcgcgctccattggatggcctgtgtactccagtccgtgtagattcgccggcgtatccctgtgggtcccagatgcatctggtgcacgagcgatccgccggaataacggccttgcctcccgtgtcccagcctcccaggcaaatcgaggcgtttgcttccagtggggaatgtcgggctggggccagcgcatatgcgggattggcggacggcggccaggttgtcaaaatgctatcctgaccctgattaattccttacccgaacaatctcgatcgaacgatccggttaacccagttgggatcggggaagaattacccaatcccaaccaggttgtctccaattgggtcactgcatactcggatcactacgtttttaaggaagtacagttgaagctcgattgtttgaatctgctggtattccggtggtatttcaagttacacatagctcctttgatttgtaggaaaaatgaaggaattttggaggatttcaatcctatgaaaaaaaaatcctatgaaggcatttgaaacaaaggattgaatcttatccaatcctttaaaattcctatggaatggataatcctatgcacattttggaggaaagttagcaataggtctatcctcttggaacatttcctctgagtctatctctctcatctgattcctgtgtttttcctgtgatccaatcaaatggccattcctgtgttttgcaatcctctattttacaattgtattcctgtcagaatcctgtgtttttcctattcctctgttttttcattcctacgattcaaagggcccttgaaacggcttggataaggtttggagcaaatagctcggtaaagaggaaatgaaagaaaaggaaagtgtatgcatgtagatgggaccctgatggactgattgatagtctgatacacacttctgaagaccgtcatttgccgcagacttcagaaacgtctcctctgaatctgaattctgaacagagtaccgaaaaccttggttcccttgtgcatcaccctggggaaacacaagagttcccgtaaaacaacattcactactaaagtcagtgaactaaaacacttgcatcaaaggatgcaagttggaacattctagctgtaaatcggtaacctgatcttgattagagttggccgctatacaacggaggtcgaagaactactacaagttacagtgtcagcatatgtgttctttaaaaatgtaaaacatttgattgatcaccacttaaacaaacatatctgtttgggagcatactaatgaggaacctgagaattccatcgcaatcatagttcacatgtcctgaagcatcccttggactggaggatctgaacagagttcagaaaaactacaggaaatgggcaagtaaatgaagtaactcatccacattttgctcacacaaatcactctgtgctgcaccctatccccaccaatctatttcagcgtaacaaaccctcaaagccttttcttgctgtaatcatgcagcacggaagcatttttcttgatttgaaatcaaccaagcatgatacttgtaggagggttcggatcacacattggttaatgtgacagcacttcagagcacctcctcagttctgatatttttggtgctagctcctcatcaccatattgctttagcaaatccatcaaacgatcagcacaagaagcctctatgagaatccccctctcagcaaccttcttagccaacgccaaggcctcaccaacatgcccttccacacacagcctaagcaacaaaccattgtagacatcagtgtcacagagcaccccgttctcttccatgactcctatccagtagcaagcatccaatagcctattcctattgcaaagctctctgaccataacactggccgcaagagggctcagccgcacccctttcttcatcatcctctgcacaagcccttcagcttcaccatccatcccaaccctccacaggcaaataagcagcacattgtagcattggtcgctcgacacactcccatcgctgaccacacgctccactacagcataagcgtctgcgaccatctcctctgaacagaatccgccgacgagcgttcgcacgaacacccggttgggcatcacccctcttcctgtcatcctatccagcaagctcagcgcctcccccatcctctttttcccacacaggcatttcaccaaacacgtatacgacaccacgttgggcacgcaccctgcacccaagctccaaccctccatctcttccaccagcctcagcgctgcatccacctccccgaaactgcacatcccgtcgagcaacgcggtgtacacggccacattggtcacgcacccaaactccggcattttctcgatcagctggcgggcaccgacgaagtcccccgcggttgccagcttatgcaccgaggtcacaaccagtgggacgctcggcgagacaccgcacgccgacatgataccgagaacggcacagacatcgccgggagagccggccgagcggagggcggagcggaagcaagcagcatcgggggcgaggccgaaggagcgcatgtgccgcaggagagcgagggaggcggggaatagtccagcgtgtgcggagatgcccaggaggagggcgtagtgcctgagcgggagaggttgcggcgacgaggagaggaggaggggcacggcggacgggagatcggggagcgaggcggcgagcgaggagagggcgtacaaggacgggagcggcgagaaggggggaaggcgccacaggaggaaccggagggagaggagtggggaggggaggagcgggaggagggaggggagcttgccgagggggaaggagtcggatggggacgggaaggcactggagagtgcgcgcgggagcgacgtggaggatgctggcggcgagcggaggaccgagaggagggcggcgaggtcgccgtcccggcaggtggagaggcggcgggtgaggggcgccaggcgcggccgccgctgaggcatcccgtgccggtttggggtgggggatcgcgctcctctgcggaaaggcaaaggcacacggtcacggacgacgggactagtcgacgaggtggatgggtgaatccagtactccagggagaatttactttcgagttgtttttttgaaactcaaaattgattcacctttcttaaaagttaaaatcaatttcagaaatgaactgataaggctgggaagaatttgagcgagatcaaaggcggacaatagttgaaataaaaaaaacaagaaagcttcagaacacaatattcattggaattttggaacaagaaactcacccataaatattgtgttttctattggtttacttttgtgtcggtataattcgtaggaacaatggtttaagtttttaaactgatttttttttacagtttagtttataagtcggtggttttttatgcctcaagtttaatggtgggtcctattaaaagtctcttcttattcatagctccacaatttttcttttccgcgaacgcctagctccacaattttcatggttcatgtattaattctctttatttaagccactctttgcatgcataatgtcacttctctgttagtagaaaaggagaacgaacatgagtgaaccagtttttgataatctttgatcatttcatgggaagtgaaaaaactacatttctattgtaaagccaccatattgcaaggctaattcgcaaacatttgcatggctaactcacgtgagcacccacgctttaatatttctacaaccatatatttccttttttttaaagtctatacaccgagaatttatatataaaaataagtatgttctattcggaatcgaacatttatacaccgaaaaattatatgtccgattccgattcggaatcaaagtttcttatataccgtatgctggagagattctcggttggtgtgtccattgttccagtgaaaaaaatggaaacgtgaatatatatatcgcgatgctctcaaaaatgcatatgaaatggttttcctttttagaatgggtatgaaacggcatctttagaacgtgtatgcatttaccccttgacatatagttggatagatttaatgcgaacgttaaaactctgtgggatccagttgtcatacagagggcaaatgtagagtgaaaaatgtccgctgtttagtttaacgtgttgcgtttctttccttctacagccaagtgccacctttgcctctagcttcataaaaacccagtcctctttggcacagtactatttgctcatgttcgtgaaaatcattgagctctgcaaggtgcaagctttctgctctcagccatcatgtttccctttggctccaaacccatcccgtcaagcaacaaggtaaggaaagagctaggatacgataaattcaatggagtacctccatttctttttgtttgacgttggttagttctttgactaatcaaggctgtaaaaaaaatagagggatcatatgctattttgtttcatagcacctttcttcaaaaaagatttcgtagtatatttgaaaacataatttcttcgtttttgcatatatcaatcttttgggattcttgtaatgttgtaaagcctggttttgaagaccatgaactcaactatagtgttttcagtcgttttttttaatttttgtagaaacggtatgcttaatttctaatatatgaacatgttgtttgaatgattggagattatgttcaatccgtttggattggcacgagaattacagatctctggatatccaagaaaattggatctactgtctttttatttagtcaagccctgaatggatggcaaataaattataaaggggtaatggagggcaaaagccagctgttcacaggaaaccaaaaccgtttgaatttttggcagttctcaaaccttgtctgtcatatatttcttcttttagttccacatatatatcttaggtttaatgataatagcaataacaagatgaaattgcttgcgaagttaagaaaaaataacacttgtttgtgtacttgccggtcgatctgagtgtcttatgtaatttttcagttttctttgtgggggtatggcttgcctattttcctgtcaatgtttaacttttaaaactatccttccaatcttaatgaattttggttagtctaatcctttggctgatccggccaaaataaaaagtatagcctaagctcaattgcctatttattttggtgccaaggaccccatcatttcgcttattgacggaataagcgagaaatgacatatttgtaaacagaaaataatttataaataaaacttttatgtatgtgttcttagtgatctaaaagcaaatactgaaaaataaactacgatgataaaaccccaaaattaacttaaaattttaggttgaaaattcaattttttacctataagcataagcataagccaaaagatattttttatgaaatcaaactatctggcactggcatacctgtcagtgtttcatgtcgagaaaataaaaatgacaacatagttgcagcagagttcatgatcctattatttgacactctatattctacttagtgttaacaaactatttgccgttatcttccccaaaggggggaaaaatccaatctatccaaatacaaactgactaatcaatcagcccatcagtttgtggtgcagcttaagggtaaggagaccagggcggagccggaggtttccagcgtcagcaaggcctcggggggcagcagcgagcacatcaacaagctgccaccgccggtgccggtgcaggaggaggaggaggcgccggaatggctggacgtgctgctgcggacgaaattctgggggcagtgcaagcagcactgggacgcgagccgcgcggaggtttgcatcttctgcctccgctgccgccaggtgctctgcccgcgctgcagccatgacgagcccggccaccggctgctcaaggtccgccgctacatgtaccgctccgtcgttctcgccagggacttgcagggcctcaacgttgacgtgtccagggtacaggtaagtaattaagcgcgtgttggccgtgttttcttcctgtctagtcttcatcaagccaaactccattttaaaacatgtaacattgaaagtactcctaaacatcttatatttaaaaggaaaaaaaaagtacaaattaccccacaaacccgaaatccatatatttttcactctcaactttcgttaccatatgaccccccagcagctttgcaaagcggttttggtctacgtggcagtccaatcagcaaattttttattaaaaaacgatggggcccacctgtcagatctttccagtctatctctttccctctcacacacctctctctctcaaatgtcggcggctgcgacttaagcactgacggcagcggacgacccctccgtcgcctcgacgagctgcgtggcggtggctgcaggcgcttcctccgccgtccgagctccgcccgccgccatcctcggctcgcttccgccgccccctcctcctgccgccccgagctccgtcgccctttcctcccgccaccccttcggccccgagcttcgcccgccatcatcccgagtgcccccttcgccactcctcctcacgccgccatcccgagctccgcccgccgccgtccccttttccgcccactccacccgtcgtcgttccgacctcttcccatcgccgtcccaagcttcgtggccccttcgtcgccccgagctccgcctgccgtcctcgaggtgagggagggagaagagagtggattttggagagagatagagaggtaagggaaaaagagagggtgggagactgacaggaggggcccgctaatttttaaaaaaatgaattcatgtctggactttcacgtagaccaaaaccgtttgcaaagctgctcgggggttttttcatccggtattgatagttgagggttagttgagggtgaaaaacatccttgtttcgtgtttagggggtaattcatactcacccaatattttagggggtaatttgtactttttcatatttaaaacgacgtgactaaacaacgtatagtcgctgtattgtctaaacgcagcccactttttttcctaaatccgtacatatacggatgtgcgtctctttccgaaaacggcactctgctcctttttatgctgggctatctcacaactcaaacgacagatagtcattaccatgtctccaacaattaatgcttaaatatacggctaattcttttagtggtagatgatataccgtcgacagcgaaacgtctatgttacttgataaatcttaagatatattagcctgatctttgaaggtattcataggggatggcatgtatgtattcatggggataaatatgcatcaagttttgaaaaaaaaaaaaaagctcccgtgattgttgaaagcctgaagtactgaaactcaatatgctcacaaattttactcgtgattgcagacatacattgtcaatggccaaaagggcgtgcacctgaggcccatgaggaggtccccgcaattcaagcctcacgtagagacacctcgctgcttatcttgcttctgctggctccgcagtgctcccaacatattttgttctctcagctgcaaggttacattctcttaactattgttctcaattacccccctttctaattgtttgcaaattaaaagcatcgaaattaaaagggtttaaaatctgatttttttttctctttcttaattaccaggttggtgtagatatatctcaggatgatttctcaggacctgaagctgagcgtaggcataagcagactctgggaattgtggtggagtcatctcctcaacagagcatcccacaaccatttgatgcctcacctgtgagaaatgaagatgccaccatggttgaagctgagtgtggtcaagttcagacgaatgcgacggagtcggagtcgtcagcggtaggagatgcagatgaggttatacctaaagttactaagttcaatgttgatatccactctttgaggaggcgagttcgcaagcaggcggcaccacagagggcccccttcttctgaatttttgatatctcgaggaaggttgtgccatggttaagttcgaaagtagtaataaaatctactagctatgacagctaggtgagacatttctgctgcgacatgtttttttcagggtgaacctgctttgctgcacgctgtgatttttttttcattagctactggtttgaatgatgtttttgtagtacccatttggaggtgctaagctctgtaataatactgtaggatcgaatcacaagaactaagccaaccagagaagggtgaatggttggtatacccaaaaaccaaaaacttttagcggaaataaaagttaccctcgaaatcgacggagattggtctgaccgaagttgccttgccggtctgaccgctcagatgccgtcggtctgaccggtatagattaaccggtctgaccgccgaagctgctcgccgcgcctgttgccgccaccggtctgaccaccgtgctcccgccggtctgactgccgtagtgccgccggtctgaccgccggtgagttgccggttagaccgccaaaacccggtgaaacacaaatcgaagaactcttaaagtagatgacgtctttattacttctctctgtgtttacaaagtgcaccaacagcactccttacaaaaatttcgattaaactcgaaaccctaactcaaaactcaactcaattgctctctaaagcgataccgggaagcctcacgctccccctctatttatacatgaggtaggcagcctaaagccacgaaccaaactcatacgaggagtcctaaacaccttaggaaaccctctagtacaagaaagaaactttacataaccaatcgtaccaaatttggactccttccaaatttgactccacatcccatacgcacacaatacctccatcgtatgccatatggaatctccatcaaccacgtgcatcaattctagcctaagtatcccgcatgatctctgaccaccacggacgtcgtcttatccccaagtcgactcccggtccatcaccgcaaatactctcccgaaacatcgagtcacctacacatggaacaaacaaagaaaccatattccgagaccaagctatctccaacttgactcattagcagcaaacaatagtattacatacgtatatagtatccatctggaagttataatcatgaaataaactcggatatccaaataaacaacccgaaaccgaaaccgacacagtgtcggccggtcagaccgcgggctggccggtccgaccgctcgatcaccgccggtctgaccggcaacacctgcccagtctgaccggtccacataaaatgataacctgtagattcacctgtgaaatccaatcatctccaaaaccacttcatgaataaattccaaataacaaaaccaatcatctccgatgcataattgttcatcacagaataataataaaaacacttttgattttacaaatactagcatctcagcgatacctgggactgctttaatttgcactctgctgtagacgtttcttatttctcggtattttctaaaagtttcctatttatcattcttccatttcactaaaatatgaaaattcttctttgtttatcactcctcgtgccactgggatgtgggtctcaataccacgtgtcaatgaggcaatgagcataaaccaggaactggaaacttttacagtgccgaacaaggaaatgctattgctagagtgagatgtgttttgcttttgctaagcgagaggttaggagtcatttttggagctactaactgctacagcttataaaaaaattattttagttacagctgttagaaactctcaaacaatatatatttactctttcatgggtagaatgtactggcggttcttaaacttgtacaggtgtgtcatttaggtccataaactctcaaaatgcatattcaagtctaagaactcatcatagtgtgttatctaggtctcaaatcgccacaaccccttcaggatcctacgtggcgttgatgtaatatgccatacatacatgacgtggcattattttaactgacaaataggacacatttaaatttttttcctttttttcttctcttttttcccctttcttctcctttctctcacccgtgcagaagaaaggaaacaaaagaagaatgagaagaaaacgaaaaagaaaaagaaaagaagaaaaaaaaagaaaatgacatgtcacgtccatatggcattgccacatcagcgccacataggatcgcagaggggatgtgtcaatttgggacctaaatgatacactttgacaagttctgggacctgaatatgtattttgagagtttaggggcttatatgacacaattctataagtttaaggaccgccaatgcactttactctattttgatttagattatgacaatatgtagttgtagcatcgaaaaatgaagtaagttagaagctggaaaatttaatattttcatattagttttatatgaaaactttcgcctgagttagttcaaagtaaaactttgaaaaaaaagcttagcccaaagtatacattactctttgattaatcatacaattcgttgcgttttctgcgccggaatacaacaccttcgaactaagtactaaggccctatttagttccagaggtaaaaagttttgacgtgtcacatcggatataaggacacacatttaaagtattaaatatagactaataacaaaacaaattatagattgcgcctgtaactgcgagacgaacttattaagcctaattattccgtcattagcaaatgtttattgtagcacattatcaaatcatagagcaattaggcttaaaagattcgtctcgcaatatgtgtaattagtactccatacatgtgtccaaacattcgatattacagagccaaaagtttttacgtgggatctaaacatggcctagtacttggaaatgaacatttcaaaacgggaagtcgctccaaatgatattcccgtaatattaaccgccaggaggggccaaagcgcaaaaactgagaactggggagctcaaaacactcctaaaaccctagcctaccggagcgagcgccgacgccgagacgccgagagcccaaggccggctagtcggagagtgcggccgcgtgcgggtggctgctgcgctgcgcgaactcccccgccgccaaagatgttctccccggcgatcaagaagccccacctgctccaccgcagggacaaggaggaggcgtccccctcaccccctcccgctcccgcgcacacgcccgcgcctcgtggatttgccgtccacgaccgccccgccaccggcaccccggcgccgtggacctcctcctccctgctcgccaggttccgtttattccccatttttctttgattttatcagaatcaccgcatttcatcgtattttcgtccccagttgaggcgccggaagcgagcgattcaaatgagctcgtttgccctttttgcagtagtctagtgcgttaactacaggtcattgtgctgcgatagttttataaactttttattttgaaactttttgcaaactagcaggatttcaacatcaacacgaacagacaggacaggggattctggccagatccaaccggtgcatgtatccgaatttccccaaatagttcgaaatgctcaagccaaccttctgcaaaagagtttttccggtaactattcctgtttgatggtcctgtgctagtttttcctggttattagtttgcttgtaccatactgaacagtagatgcttgttaaatacatccttgtaggcaagaacatgcttgctggtggcattgataaagaaacatcccttgcatggatgttatgtggaaatgagctttttatctggagttacctggcttctgttgcaaaagactgtcttgtacttgaggtcccttcttctcttatggggaacaaagaagaaaaatctctatgtggtaatcagtgggcagtttgcatagtgagatggggtagtagtggtgcatcaacacggagcagtggagatatattgcatcgaagaagttcgactggttttatcctgtgcaacaaaagaacacaagctatagcttattggtctgatatctatgctgaaagcagtaagagttcagttcttgatttaattggatatggtgatacatcttcaggtgatggcacatctggaaactgcaggattaattctcttattgcagtggcagttccaggaggtattaatgaatgcattgtgattgcttctcagccaacaggcacattatggatgttctggtgttcaccagctgcagttcgtcgaagagaaattcataagggtacattaggagtttataatgctgatcattctcagaaaaatagtggtggaaggtccttggcttggctaccaagtaaagcatcatctaaggctgctgaacggacgttctttttattgactagtcatgagctgcaatgctggagcatctcattcgggcatgatatcaactgcaaaaaaatagggtctcaggaaattgttggtagtgatggtgatatgggaataaagaaagacatagctggacagaaaaacatatggcttttggacatgcagatagatgatcatgggaaagaaattatcattcttgttgctaccttctgcaaagatcgggtgagtgggtcgaactacactcagtattctcttctgacgatgctgtacagacctaaccaaaagttttcatctgaagataatgtgattaaaactgaaaggtttttggagaaaaaagctccttctcaggtgataatccctaaggctagagtagaggatgaagagttcttgttttctatgaggctaaaaactggtggtaagccttctggttctgtaatcatactgtcaggtgatggaacagcaacaatagccatatactggagaggttcaacccgtctctatcaatttgatctgccttgggatgctggaaaggttctcgatgcttcagttatcccatcttccgaggacagagatgaaggagcttgggttgttcttacagaaaaggcaggagtgtgggcaattcctgagaaagctgtgttagttggtggggttgagccaccagagcggagcttgtcaagaaaaggaagttgcaatgaagcagttgctgaagagaaaagaagaaatcaggcattcaatgctagtgttgtacccagaagagctagttctgaggcttggagtgctggagagaggcaaagaccagcattaactggtatagctcagcaggctgtggttgatgaggagtctgaaatgttattaaaccggttatttcatgattttgttttgtccggtacagttcatgaagcacttcaaaagcttagagcagcaggcgcatttgacaaagagggtgagatgaacatatttgttcgaataagcaaatccatcgtaaacactctatctaagcattggacaacaactagagaagctgaatttcttgcttcaacaattgtttcatccctaactgagaagcagcaaaaacacaagaaattccttcagtttcttgtcttgtctaagtgccatgaggaactctcttcaaagcaaagtatggattttcttttgtgtcattatttatattcattgatttattattttaggcatatatcatcctagctatgatattaatcgaacacattggttctttgttattcaaaatagcataatgaatgctgatgacaattttgatggtattaaaactataggagctgtctggtaaaaaagaagaagaaaatctagatatgctgctgtaaatcatgaaaaatacaaacttcttagctgattttaaagccgtatacagttgtagaactcttcttaccttcatttctgtatacatgattgttgaaactggtgactgagcatgtaactctattggaatctttacctagcgttatatagggatgctaattttggcatgcctgatgggacacggacatatattatgcactcttagaacagcttgcacctttatttctgctaaaagatggtactgttactaacagtacagtatgagctgtaatattgacaaataaccatacaggttagccacaatttttttcaaaaaataactgccagtgcatcattttgcgtgacaacttctgttggaaaagaagtaatttgattgtcttgtaggaactgcgatgctaactgtcatggagcatggagaaaagctctctggaatgatccagctcagagaattacaaaatgctcttagccatcaacgctcaagcatacatttatcacctcagtcaaaaaaccaaacaactggtgcattgtggaaccttattcaattggttggtgagcaatctcgaagaaacactgttctcttaatggaccgtgataatgctgaagtgttctacagcagagtttcagatatagaagatctatttaattgcatatctcatcagcttcaatacattataaccggagaagaaaacccttctgttcagatgcaacgtgcacttgagttatcaaatgcttgcatgaccctagttcaggcagcattgcgctacagagaggagcacaaggactggtatccttctcctgaaggactgataacatggaacagccagcctgttgtacgatctggaatctggcgagtagcatcctttgccatggagcttttgagagaaccaggggctgcggacatgtcaatgaagtcaaacctatggtctcagttggaacgactcacagatatcctactggatgcatatattgggttgttaactgctaaattcgagcgtggggatgagcatggtgtgctaatccaagaatactgtgacagaagagatgaacttcttgggtccctctatgacctcgcaaaacaaattgtagatgcaaaatatcaggtttggtttaaattaaaatcattgtttgctcaatacttttccttactacagtaaggcgctttaccttttgcaatttcacattgtccagctttttacccgttctgtcatatcaatgtagtatcattcattatattgcccatcattccttgagattttgtggttacatagtaaggcatagtttatttcagcaatcatgtgctgttctacccaaattagtggattgctttatgtcagacacatatgcaattatgtatgcaacagtaaccaaggaacccttttttgtcattattttggtagtcacccattcagtaccgaatctgtgttctccaattccatcctctctctctctctctctctttttctttcttttttttttcatttgttgcttggttggttctctttggttgcttccttatagtgacttagttcactgtatggggtatttactacagtctatatggttattgactttagttattctccgatcttagcacaaatattattgggcagctgccataaatgtatgttcgtggcattttagcatttacatacttgaaacaatactgatgttctagctttggttggatggtgtttagccggagttgtggcttagagtgcctgttttatgctgtaaagtaatgttcatcgttgtaacaatagcggttgtacagctcttagcctccatggtagctgtatttgttgttctagtttgaacctcttctcaatcttaataaacttcggccgcgtatcttacgctggcccggcgaaaagtttctgtaagggtgatctcaaaattcaaattataaggtaacattaaaaagttatttttggatgactggcaattttttaattaaggaggcatattttctggattgtccactggtcaagtattctactgttttcagttcttgacatcatatttacatgaaggcatgtagctgtgtagcactgctgttgaatttgatactgttattttttgtactctttatcttaatgtggaacaactaatatttgtattatgcatatattttaggagacgacagaagtcactgacaatctggaactgaaagaatctatattcagagaagtcacttctccaattttggcaacagctaaacggcatgaagggtaccaaacattgtggcagatttgctatgatctcagtgatacaggccttcttcgcagtcttatggtataatcacaataccatatccgcaatttatcccatttaatctttctagggggtacagtgttgactatgttctgcaggcgataacatgccatgtgttattgcaatcaaattgttctttctaccaagttttattaagggacatggttctaatgttgaacttgtgttgcagcatgatagtgtaggacctcacgggggattcagtttctttgttttcaaacaactagtcaacaggcgtcaacatgctaagctattaagattaggtgaagaattcccggaagagctagccaattttctgaaagagcgggatgatcttctgtggcttcatgagatatgcttaaatcggttctcttctgcttcgaagactcttcatactctcgtgagtcctgaggaagatgctaaccttacaagcaacaggaaatcactgtcctttgttgaaagaagacgctttctctatctctccaaaattgcagcagcagcaggttagctgtttcttctcttttacttcatggtatacctgaacctgattaccttacgctgtgcactgccctgaaacaacaatttgttgaggttgcactgtgttaactgttgtggttgataaggaagttgtcattctccatatatcatgctggctctgtgcaaaattggctccaaacaattttttgaaagaaaattctgactatttgatgatggataacttgtatcgaatgctgcgtagcttgattttaaatcagttcatatgagctgtgaacataagctatagttcactttgcagttctttttctgtgcaaaaggacaggcaaacaatgctacttgccatgcttctcgccaagaggctcagtctttttcatggttcaaagaattaattatcctttgaattgctgttggcagtgcatatgtctcaaagtcatgaacattcaatttgatgggggcacctacacctaggtcctgaaatcccgaattccggaacatagttcctgcaccattcttttgcactaattcttgtttactttaacatagttattgtttttttcttatttcttcccttggataaatgcattcctgatatattgcaattttaacaagcaggtaaggatgttgattatgaagtgaaggttgcccatatagatgcagatatccgaattctaaatctgcaggtttgtcatatttcatgttgtacatttatttttctagtcatgatatttgctttcaaacttttagtgtgatgttatgttctttcatatttgccttcacatgtgcatcactttggtagggcaagtgaacccaaatctacgtatcgatgatgaaatctacatttgtgttctctcatgacttcatatgttccataagaccctgttcttttgtacattcatccatcattccattccttgaaaaagacattatcaaaaccagcacactagataggtgtttaactgtccaatgtaacagcctgaccatatttacaacttttacataattgtataattctgtcttatttagctttacgaaagtgttcaagcagtaaaaagaaggaaaataacccatgcaagatttgcatttaaagatgcattgtcttttagtatcaaataagtaggaatgaacagctaaataaactaagttctacctttttctctttcttctctttacaggaagagattgttcagcatgacccagagtatgcaccagataaatatactaccaagccatttcgtccattggaactgatcgagatgtgcctgaagggagatcgagagctctctcttaaagcttttgaagtatttgcttggacgagggcctcgttccggagctccaacaaaggccttctagaggcttgctggatgaatgcagccgaccaggacgactgggttagccttcaagaggaatcttcaggaggttggagcgatgaagtcatccaagaatctcttcagggcactgtcctgttcaatgcctccaggctgtgttatagcccagacgccgtggtgtatgacggttcgtttgaggacgtgctgcctgtgaagaaagaagacgtgcatctgagaggcttggagggcagatgtctctcagtggaggaagtgctgatgcagcacaaggatttccctgatgcgggtaaattgatgatgaccgcggtgataatgggcaaggagctaccttatactgtttccacagctgaacctgttgacatggactcttgatactgtcacattctgtcagggagaaagacctgcaggttgggacctccaaatctgaaatcagagtcaattttcttttctttgcagcacggaatgtgtgcagttccagatgtattcatattgcgggcgaaactatttgtagagactgcaagattttgtcagttcgtgcccttttttagcatgagctgtggcttgaaacgagtttttctcccccgatggaacaaagcaagctgatgctgtatcttaaaattttcttattagtaggaaatgcaaaatgcattcttttcttagtaatcaaggtttttcgtttttggtggaggaaatcaaacttttgatagtgaagagtttaggggacgagaggcccccatcgtctgctccatatagaatcagccgttaccaaaatttaaatttttaaatttgattatttgaaactttaaacttgattttgaagtttttttaatcaaagtttactcagaattggcatttaaatcctaagagcacacatataaaagttttatttataaattattacttttttaatacattgtacggcgtattatcagcgtatggctaaaaacggggaccagagattcgtagtttagtggaggagagtttaggacgagcgaaattgtcggcttgatgatgaaatagtgcacatgcgcatccttgtttgggcttccgtggccttcaattcaagtgcgggccatgtatttttgtgggctttcaagttgggccagccttgcagccaacacagctacacggcacggccagccggcacgcgacccgcgacccactcccctctcaccgagatctcagacgagcaaccactcctggcggagggaggaggaaagggggaggagatcgccgactcgacggcgttgagcgcggtgggcgcggcggcgcggagggcatcaggatggcggcggcgctcgctccgggggtgtcccggaagctgaagaaggtgctggagacgcggacggacaacccggatctgctcgcctcgctgggcgcgctctccaccttctacgtgcagaacaccccgcaggcgcgccgcaacctcaagtcctccgtcgagcagcgcggcctcaccatcaaccgccatttcctcgacgcctccctccctgcccacaaggtttgcgctcgctacgctactggcgcgttgctacccaccgcatcgtgagccagtcgtttttggtttgtgagtgattgtaaatttgtaatttctagtcgttttggtttgtgagtgattgcaatttctgtttcaggcgttggatcgcgtcgagggggaggtgcacgcgctcaacgattcctggaagaagtgagtgtaccatccattccgcgctttcattttgttcctttttcctgtttgcctgtgtggaattgtactataatctcagtccaagactttagattcggctaagctttccccgtaaaaagaagtcaaagcttaattgtatgtagatgtaggaacggttggtgtttggatgtaaaatctggtattagcatcttgttatggatcctaaacaatatttgactcgcatgggtgctgaaatgtatttgcagaaggtttttactttctaccatgagccaagctgttaggttggtttagtttggatgatactattataaccagctgctctactacgtggaatttacattttttgttaacatagtttgacacttgctgcctacttgcctagtactcaaaacaattcaagtgtctagccactaggacatcttcaaaaaagaaactgcaaaatctcttacataattggttatattgttacccaaagttggtcctaaagtagttgtgttttcctcttattatgcgcaatgctcgacatggttactttttctactagtgctgattttattctctttcattgtgttaggattgaggaagcattgggcagttgtagtgcaagtacgggggatatcatcagtacaacggagaggctgcaacaagaacttgaggttatcactcagcgccaggaaattgtgtcatgcttcctgagggattaccaactttcaaatgaagaggtaataccccctaatacaatagaatcaatcaaacaaatgaatcaatgatttggttgccaaactgtgatgtcttattcattttttagtgcatgcaacctcgacttttatgtccatcatatttatctattgttcttctattaatagatacatgcactccgggacgaagaaatagatgagaaattcttcaaggcattgttgcatgtccaagaaatacattcaaactgcaaggttctgctgcgaacacaccaccaggtacaggtgctttatccttgaattttgtaaacttaggtaacagatcataaaaactttgttgtttatcttactatgtacattcctgtaacttaggtaacagatcataacattttagtgcatgttatatcctcagaccttcaacccaagcaggaaagttggattttcagctgccagtaaaaacattcatgagtataccaagattatggaatgtttcccctaaaaaaaagattatggaatgttccacaactattttagttgataggatatttcagttacatttttttttttagcttggaatgttccacaattatggatttatattaacccagtttattgataagaattgagcatgctcaaactatgtgagatcaccctaaactataccaagaaagtagtgtttttttttggctacgattataccaaaaaaataaagccaccatccttatatttcatctctgcccagataaagatgctttggcatgcaacgtgttgcttgtactattaatggctgattttaagcaagagaaagtagtgtttacttcgatatcttgttttctctatatttgttcagcgtgctggtttggaacttatggatatgatgtctgtttaccaagaaggagcttacgaaaggttatgcaggtattggctgtccttctatagtaatcttctctccctctccctccctcccctcgcctctctctctctctctctctctctctctctctctctctcgtgtcatttcttttacttaccttgtatctcagtgttcattccacaatactccctccattcctaaatgatcgtcgcattaccaaaaataaaagaaattcaatttgatcgtcctatttcgttaggaagcagcagaaatcacgggcagacgataacggtgcttcgtattacacagcactgcatgcatgcattggctctgcgagagttaagttgggagctgctgcatgcgtggaattaatgcgttacagctgattggctggttcatgcggcatgcaaaattgatggagcgacatgcatggatacgaagcgtttgtatgttgatcgatgcggatagtaactgctccttggtcttgctgcttaggtgaaatacgacgatcaaattggaacggggggagtagcatttagaatttctattcactagcttttattgccgatgcctctattggctagttcattagtttttgatctattctcttaattatgtaccaaagcatgaatgtctaatttagttttcatgaagttcaaccactccttattttgttactaggtacaactgaggaattaggctgtgttcggatatggggagttgggaactaaactccccgcacggaaaatggagcggtccattatcgcgtgattaattaagtatttgctttttttttttcaaaaatggatcaatatgatttttttaagcaagttttgtatagaaactttttgcaaaaaacacatcgtttagtagtttgaaaaacgtgcgcgcggaaaaagagaggggtgagttgggaactctgggttccgaacacacccttagttatcttgataagaactatagaaccttcagattgactaatctgttatttcattttgctctttataacatgttcgcttgacatttgatgttcaagtggtgtaattcatcttgctttcttttcaggtgggttcaagttgaatgtaaaagattaggtgatactgacaaccctgaagtaagtgaacttctaaagaaggctgttcgatgcctgaaggaaagacctgttttatttaagtactgcgcagaagaggtatgctatattgtaccctttttgaatactaagtttaccttgaagatagtaaagttgccacaatttacatgttatgatgagtgatctgcatcgacaggttgccaatatgagacataatgccttgttcagacggtttataagtgctcttactagaggtggaccgggagggctcccaagaccaatagaagtgcatgctcatgatcctcttcgttatgttggcgatatgctggggtggctacatcaggtattttcttttgtccatccttggtcctagtgtaggaactagtaaaggatgagtgacttcggttctctttttgcccttccaaatcgtgtgcatttacaatacaccttgcatctgtgcctttatgatattgctttggacgtactaaattttcattctctaatttctgaaggcactggcatctgagggctctatagttctattgcttaatccatctgatataactgacatgaatagttatttttctcccaaataacaagcatatacatcatgcatgtgtttctataagacatttctttaccatcccttaattttaaatccttcatttgtgtaggctctggcatctgaaagagagcttatagttgttttgcttgatccggatgcgatgactgacagtggtccaactactcgtcgttattctgtccgagaaggtgatccctccaaaggagagcatgatataacttttgttcttgatagaatttttgaaggggcttgtcgaccatttaaagttcgagttgaacaagttctgcagtcacaaccaagcctgataatttcttacaaacttagcaataccttggaattctatggttacacagtaagtctgacatactattttttgccatttagaatatccatgagctgttctgtttacaaataatgtttttctgttctagatatcagatctgttgggtggagacgctgcactgtgcaatacaatatggtcacttagagatgcaacgcagcagacattctttaatatccttaagagccgaggagaaaagttattgcgatatcctccacttgttgctgttgacctctctccccctccagcagtgagagaaggaatttcattgttgcttgaactcataaatacctacaatagcatgatggttcctgcctctggaaaaaggccaaatttcgatcctgtcatttctgccatactggatcctataattcaggtgagtttttgtgtatttgatttgctttgtagtctgtgtagatatctgaaagttttggttggcatgcgacttagcttgcccacagtgcaaatttgcatagttatcccagctagtatcgatcatctgctaatcacgctgcaatttcttttccaatgaaagggattgcatgctatttttagttttgtgtgtgtagatgtataatattaagtaaatgttaaactaataaacatatatagtatcatgtttgtactcctacacatttggcattgccatatatgatctctcacaattagctccaatgtggtaaactcttgagcttctccaattcttttatgcggttttgtgggacgtgtgttactatgtccaatgattataggagttccatacttgcatcgttaggccattgactaaaaaccgatgtgctcttgtgctattatgtctggtgcaaccagttactagtttactgcagctggtgcaaattttatattttacctagagacagctcttttcttttactttttggatatgttaataattattcttcttgtcttggaatattgggatgttatctacagtatgactttgttgcgatatactgttactgatattcccgacttgctgtacagatgtgtgagcaagctgcagaggcacaaaagtcaaaagggacaattgcacggcgtggtagaactagttctgatcccactggaaataatagagattcaatctcagttgatgctattttatctaagaattcatcaacatcctttctggttagtagcatataattcttttgtttccgctgtatagaatacctggagtatatggaatagtactcacctaattcactggctactgagcacatgttgtaggtaattttaagtttgtaattgtaaaatgtggataatttggaccaagaaaatgtggctcatgtgggactacttaaaaaaggtcaatgtggtttgggattgagatagtaaaactgacaaccttttttctcacctcatttctaatttctaattctgaactaggaacttgctattattgtcgatttctaattcatattttgatgtcattattagatatgggaaacactcatggtttgttattatataaattgctcttacacatgccaaattacatgcaatctgaatttttattatctaacgctggctttatggagggaattgcatgtacataatttaacgattggcatcaccgtctttgagtctcaaccttttgtatttgaaatctgattgatgaaagcatgatttctgatggtggtctaaaacccatttgctttcgaacatttcagctggatagactttgcttctgctgtgccgatcgtttttggacatttgcttatcattttcctcatatatgtcataacatgtgcagagtggtgaatcttcatccaaaatctacctcatcaactgtttgtcagctattcaggaaccattgatgggccaagatgttgctacaagttatattaacaacctgcggtctatgattgaaacacatttgcacaccctagtagataaagaagctgatagcattcttaggaaatgtggactatcaaacaagatgccatacataaaggactatagctctactggcagcaaggatgacgcacgacctttggctgatattgtggagacatcaccgcaaatgttggtggaatgcttgaaggcattctatggtctagtgactggaacagaaggttccttgcctgaatttgagcagctgcaggtaccaaggttgcgttctgatgcatgctatggtttggctagagctctggcggaagcttatgaactgatctataaggcagtggtggatccaaagaattgctaccctgacccaaggtctttagtaaaacactcgcctgagcagataaggactatactagaaatctgaggtctattcacaatctcttcatacatgttaatgagagaacccttttatagagtcaatgtcaatgtggggtatatttgctacgaaaaggtgtgatttcaaattcttttactgaagttgtttacaccttcactgaactcttgtatcatagcgtttctcttgtattaatgttttttctatctttgtaaaagtaaaactgcttgaatcgtagtgtttctcctgtatgtctttgcaccttttgcaagtggatatttagttataaatccaccttttttaatgcatgagtaccctcttaaaaaatggatgcatatgatttgctttttctagaaaactacatccaacgtgccaaccaataaagtcaaactggcagttcggttgctcatatgcagattggtaagtttctgtcttttctcgatccatttgcataaccttctctctttttaagttgcagagcatccaaattaactgtatcctctgtattttcagtactagtgcacacttataattgatcttgtttcagctttccttgtggccccttatagttctatccaagctcctttttgcgctgatttggcgcatggaccagctggagtggttgactgcagcaaggaaagaaaatctgaagtttggcaggttggaaataagtgctgctaatcaggggcaacctgacaagttacacaggtttggttgaatattaggccccgtttagttcgcgaaatgaaaatttttgggtgtcacatcggacgtttgaccggatgtcggaaggggttttcggacacgaatgaaaaaactaatttcataactcgcatggaaaccgcgagacgaatcttttgagcctaattaatccgtcattagcacatgtgggttactatagcatttatggctaatcatggactaattaggctcaagcaattagtttttgtttttatctatatttaatgcttcatgcatatgtttaaagatttgatgtgatgtttttgggaaaaactttttggaaactaaacagggccttactccattcatttttatgacaatcattttggtgtccttaatttccacgagcacgtcttgtttgtcctgttatgacattttctcctttcagaaatcagaactgaaattgggttaggcatgtctcctaattttaactgactggatactttgcggtacatcaacagcaacttcgttgaaaggattcagtaaaccttcaagtttcctctagtacaagttaattccacatcttccctatgaacaaaaacgtattaagtagagacctacaaaaagttggtttgctccattgtcttgatggaatagttaatgtaatgccggtgtcctttactgtgctagcgtactactaactactaatactagtacaactaaattagtttcatctaatctttaaacgttggtctggttgagtccttaattcaccatttcacctattaactccgtatcgacattatatgtgcatggacctcgaacttgaacaaattattctacgccgtatttaccaagaagaaaaccgtccaaccgctccatgttcgtttgtgtcctccgtttggtcagaccgtaggtttgtcgttcagatttggattagttcgagggtttcgtgcgctggcaggcggaccgggcaagtggcgcaacgtgttttaagggtggaactggaacgggtgtgaggcgaggcgagagtcgccggtccacggccacggcggcagggaagaccggaagaacgctgagccgtgacagcgacgggagggaagtgggaacgggtgtccatgagccggcagaagacaacggccccgcattccttgccgtgacgtgacatggccacggccaaagagtaacaggatgaagcgatggataatttagtgatcggtttccatggcagcgttgcacggttgtaccgtggcgttactccgcggggcccaccgatgagctgcctgtgcagtacaggatgggggtaagaagcggaggagatgcaggagtaggttggtcgttggtccgacttggcctggttttaatgcggaattctgcgccaaagaatccaaaacaaagacatcatcgcatcagccgcggcggcaaagcccaccaggccacccacccgtccaattccaagcgcgcgcccggcgcctcgtcgcgcatcgcttgctcagtagctcggctcggatgagacgcctcgcgcggacgcggtagccggtttccgtgggagatgcggggcgcggcgcggctactcctgccactggtggtgctgctgctgcacgcagcacgcggatcagcgggatcgacgggcggcggaggcaacggcagctgcacgcagagctgcggccgcatgagggtgccgtacccgttcggcttctccagaggctgcacggttcagctcggctgcgacgacgcctccggcaccgcgtggctcggcgggacgcgcgggctgggcctgctcgtgagcaacgtgacgccgcgcgccatcgtcctcaccctgccccccaactgctcccgcccgctcaacgagtccctggatgcgctcttcaccgacaactacgcgcccaccgcgcagaacgccctggtcgtgagctcgtgcgacccgcaggccgccgcccgcctcagcaactgcagcatcccacccgaggcctacctcgagaagagctgcaattccatccgctgcgtcttaccttctaccaaagccaacgtcgacgggacaaacgtcacagaccctttcttgaatagaagcgagatgcggcggctcggctcggactgccgcgggctcgtgtcggcgtcgatctattcgaacacggcggggccggcgctgcagctgaccgcgctggagctggattggtgggtgcaggggcggtgcggctgctcgagccacgccatctgcgacgggttcaccccgccgtctacgcagaaggaggcgttccggtgcgagtgccaggaggggttcgagggcgacggctacaccgccggcgccggttgccggagaggtcagtactcagtacattggctggatagtatccactgattagcttcattgctctacttttttcgtccattgatttggtcagtcaaatcctgcgagctaactactctagccactcgaccataaccattaatcgtccggagtagacagtacacagtagagtaagcatatcttgtgcttcgttgactatacacctagctaaccagcagcgcaagaccaaggattggaccaatgaccaatcagcgttaaagatgaacgattaacttgatcatcacttgattgaacagcgaaaggctctgcttaccggcctttcaaaggaaaaaaaaaaagcctctgttactggtaggtgcgagagcgttcgctataacattccttgcacaactgcaagtgctgtcaactgggttctcataccgtcacacatgtaaagcgactggcagttcaagctaattatttttgggtggttcgctgatgtcaaaccgtaatgtactacttgcgcaagtgacataagagtatattcggttatttattagaggatatgtaatcgatttaagtactatcagaacttttgttttctacgacaagttgcttgaaatgtagtgccattgatatattagatattttgaagctctcgaagaaatatttttctgacatgttggctttgatgcttgcctgcctgcctgcctatgtgctgaggaatatttgtttctttcttttgcctgacatcctatatagatggtattgagtcccataattattcataaaaacaagaaccagttgctaagaaaaatacagatcaaccaagtggggtgtagttccacccatagttttttaggtgctgccatgcttaccttctctgtatggcttcatccctggaagaagaattttccaaatcactgcataaattatgttgatttttctcaatgtatgaagtcaactttgatataataaagttcctcgtttgttcccttcttccctttgaatctcacactaatgtttgttttttttcagttccaaagtgtaatccttcaaaatacctatcaggatcatgtggcaagttggttcagatcggccttcttgtggcaggtaattgcttataaatctcgtctgattgtcagagaaaacaatatctacttttggccaaaagaggttggaatttgattttagtaaaaatgcgttgcagtttgctcatcgatcttacaagtagcattcagaaattaaagacagagtatttatgtaggtttgagcttcatccatagagaaacagctcgtcatacgtatggctacatgactgatatttaggaggatatggtgctaatattatttagtattttgttctaagaaaaagtcccctgaattcctacaaaaatctaaaaaccgtcctaaatatctaaaccagacaccattcaagccgaacatttcaagactttcgagaggacccatgtagcaagttcctacaaatatttgtatggaaccaattagtttgaggcagcaatacatgtgtcgaaatagaagaattccaatgtttcaaaatccaaactactctcccatattcagatgataaaatgtattgattttttttctaaaccaaaccttttcaaatttgactaagttcatagaaaaacagagtaacatttctaacacaaaattgtagatttcatttaaactaatttggtgtcatagatgttggtgtgtttttatataaattttattgaacttgaaatagtttgacttgtaacaaagttaaaatgtcttataatttattaaaattgagggagtagcaacgaatgggccttgaactcagacagagttaaggcccagattagagaaagtttaaattgtttgggtagtagagttgaggcgatttcaaattgggctggtatccggactagaaaaatggccttagtcccttatcttttatttagtctagcaggccagatttttggctatttttcacttcctaacgatctcccggcctatttgctcgaagctaagcaaccacaccaaccaaagccactaggctttaaccgcaattgtaattggattgcatgatggattctttgcgctcacacaatgcaggagtcttttttggagccatggtgatgggcatcacctgcttggtgtaccacctgctgcggcgccggtcggcggccctccggagccagaagagcacgaagcggctgctgtcggaggcgtcctgcacggtgcccttctacacgtaccgcgagatcgatcgcgccaccaacggcttcgccgaggaccagcgccttggcacgggcgcgtacggcacggtgtacgcggggcggctgagcaacaaccgcctcgtggccgtgaagcggatcaagcagcgcgacaacgccgggctggaccgcgtgatgaacgaggtgaagctcgtgtcgtcggtgagccaccgcaacctcgtccgcctcctcggctgctgcatcgagcacgggcagcagatcctcgtctacgagttcatgcccaacggcacgctggcgcagcacctgcagcgggagcgcggcccggccgtgccgtggacggtccgcctccgcatcgccgtcgagacggccaaggccatcgcgtacctgcactcggaggtgcacccgcccatctaccaccgcgacatcaagtccagcaacatcctgctcgaccacgagtacaactccaaggtcgccgacttcgggctgtcgcggatgggcatgacgtccgtcgactcgtcgcacatctccaccgcgccgcagggcacgccggggtacgtcgaccctcagtaccaccagaacttccacctctcggacaagagcgacgtgtacagcttcggcgtcgtgctcgtcgagatcatcacggccatgaaggccgtcgacttcagccgggttggcagcgaggtcaacctggcgcagctggccgtcgacaggatcgggaaaggcagcctcgacgacatcgtcgacccctacctagacccgcacagggacgcctggactctcacgtccatccacaaggtggccgagctggcgtttcggtgcctggcgttccacagcgagatgagaccttccatggctgaggtcgccgacgagctggaacagattcaggtcagcgggtgggcgccgtccacggatgacgccacattcatgtcaacgacgtcctcgctttgctcgtcggctccatcacgttgcacggacaagtcttgggggaccgctaagagcaagaggcaggccgcggcaaacgcagtggtaaagcaagagacgacgaagtgtgcagtcgccgactcccccgtgtccgtgcaggagagatggttcagcgataggagctccccttcctcaaatagcctgctgaggaatagctccctgaactaactcaatcaatgtccttgtcatggcattttaggtgtaagtagcattagaacgatctgtaattgatgcaatgatcccttgtgcatcgattgtcgatgtttatatctgcaatattgaatatggggttatacgtcgtggttaaagctacacacagtgacatatatagatggccatatggcctaaggcccgatggcccgacccaagacatggtgatttggcctggccaatgcacggcacgccctgacttgggtcatgcctatgccggaccagcccaacagtcgtgccgtgcctggggtgctacttcggtacgctgcgctggcacgacctggcacgaagttcagagatgcgaaacagacttattgtcaatcacatgtaaggcacgtataaatatagatagccataaggcccgcccggcaaggcccggcccaggcacggcccgatcgacacttcgtgccgggctgagccggcccatgggctgcacctccggcccagacacgacccaccagcagtcgggccgtgccatgctggcccaaaggaacgcgtggcccatcgtgcctttttaaaataagtctattttcctccctcttctttgggctgtgatatatatatatatatatatatatatatatatatatatatatatatatatatatatatatatagctaaaataaatctattttacctccctcctctttggtctgacatatatatatagctaaaataagtctaattttcatccttattctttggacagtggcatataatgtctttttgtactccctattctttatgtgccggcccggcacgaacgtactagtggggaggcccaggcatggcccagcggtcgggccgggctggcacgagcccgactcccgtcgggccgtgctgtgcttgggccgggtcgtcgggcctcgggccttttggccatctatatgcacaaagaataggaaggaaaaatagacgtattatatggcacggcccaaagactaaggacatgaaatagacttattagctatatatatgccagatcccaagaagggaggggaaatatacttattttaaagaaggctcgatgggccacccgtgccttcgagctggcacgacccgactactggtgggccatgcctaggcctgaggtgcagcccgtgggctggcacgacacggcccgaagtgccgaccatgccgtgccggcccgatcgcctcgggccgtgccgagcgggccttatggccatctattgtaaatctctgtaaattttgctaattccttctatactcctgaattttgcttacttccttgtaagcccccaaaatttgattgtgatcccttccatatccctcctgtcatttgaccgtctaatttctgtaaaaatgaccattttaccctttgtatgaacatagaaatttacattattaaaaatgtaaaagtttgtcatatgagactactatagttatgagtttgttgtgtgatgcattattgatgaaaaaaatttatttttagataatggagtaaaaaaatatgtatttattttattttttaaaaaaagtcataaaataaggagcatttatacaaagatagtactaccaatgcacatgatattttttttatgaatgctcctgataaaaaagaatccattgtcctataaaaatttcaaatcaaaattttaatttattacatttgttttattttcaaaatttatgtcaaaaatttctgcgctaattatttagtctcgttagtttcataaaatgcacatattgtgcactcaaacaaaattttcaatcatttttcaaggttatattcaaatctaaatcatcaagggcataaaagacattgcaatagtgaaataaaggaaagtgtaacgacaaggtcatggaagggattaagttgaaatttcaggggtataaatgggatcgagtaaatttaaggagtatgaaaggtattgagtgagttttgaaggatatacagggaatctattctatagatttaggccctcgataagaggatggtcctatttgaccagaggtcggtgtagtattactaagatttgtgccgactagaaaaaaatgtctgtgttgcaacggataaatagtttttctagtgatacaacaactattaagacctaagcaataaattgattcattgaaatcgctatacattgtaattaaaaaagttaatgaaattttttccttggttttggtccgaaagctcattccttttttccttttcagtcccagcctagtctgctaccttgctccactcagcctgcctctcttcgcaccagccaacaagtagactcgtaggcccagctcacacaatgccatcttcaacctccgaaaggtggtcccatacccgtacaatgccggagccgatactccctatcatagttatggatatcacatacctaatagtagttgactaaactcggcagagcccaccacataccaagtcttatacggaatcatatctcgtatatagaaggagttccggataaggaaggacaaatataattctatacggaaacgacaaggactacccggattgtatccatactggtctccctagttctacttgaacaagtggacatctatgggtataaatacaagaccccatagggagagagggaacaacaaaaacaaaaatagatagacacacaatacacaagccaacacacgccaagacaagctgacgaatatcgacatcagagataagcctagacaaacccaatatggtgtctgcggaggccaacaagaggaatctagcgttatcgccgatctcgccgagttcatactcaaggaggaagactaccctgtcgtcaactacgtgttggttatccatactgccaaatagacgacagctagataagttatcccaattattgtacttgtgtgattcagatgaataaagggcaacacctgcttcggtcaacaggagtagggctattacctgtcaaataaggggcttgaacctatataaaaatcattgtctccatctcttttactttaatatcacatataccctgtactaacgatccccatatatactatgcaaaataccgtagtcacgatctcaaacgtcgacactccccatcaaattcggctgaatctttctcgatctctcaaaattggttgagggcttttgatccactcaatctcttctttccattttttccaaaatcggagcgaatcaagctcgtgaactagccatcatcagcgacttttaaatagagattaaattcaatgaattaaagttgaatttttaatgctactcaattcatttcatactacaaattgtattggctttttttagtagtcaaacttctttaggtctgaccaaatttatataaaattttagtaatatttataacacctacttaattccattaaatctaacattgaatatatatatatatatatatatatatatatatatatatatatatatatataggaaaattatatactactaccgggagtagctactccctccctgtccgccaccaattcaattcgtttgcccagataatggtaatgactattaacgggtttattgaatcgaatacttttacccgttttcttttacccgtattttttttccctcggggtcaacaagattgtttctgttctgtagcagattcgaaaattgaatcaagattcctgagtttgttgtagatagaattttgttcggagacagctgaccagatatatttcagggtggttttttcgctcttcagtttgcttatccaaagcgagaaagcaggatgattatcccgtcgagcagaacattatcgatctaaaaccgttctttgcgttttgagagttcttaacccatctaaactcagattagtagcctcgccggcggctgcgttgcagataacgttgaaaggtctagcatggagaactccagttccaaggtttgttgccatattcatctgttattttgcagtgaatgtggtgccggccatggcgacaatgaacagcaccaacccgacattggtacggtatagcagtgtcaggctgcaggctgccggagaggagcgccccaatgtgccgcgtgcacgccgagcgccccaacgccggcgccgtcgaagctcgcggcagccattgatggattttttttcctaatctttgagtctttttttgatcgtatctcttactaatttgttttgtttatgtttttgcatttgcagcacctttgcagtcctgcagcaggtgcgaatgtttcaggtggtggtggctctagttctgttttcactagagcccttcatgctgctcaagcaagaaagatgcatcagcggaagcagctacctggttctgcagtatcaaattccaaaaaaacaagtggcatcaagggtaaaaaggtagtacaagaaaaaatttacaccaggtgcactcctgctattctctcagatctattctcaggttttggtgattagcaaaaagagctagtgaaacagatggagttttatgggttgctttccatgaggctgactaaactgaacaagcaattcggagcatggattctgtgcaagctagacccnnnnnnnnnnnnnnnnnnnnnnngatctagacatgaaatttgtttgacatgtgaggatgtcagcctacttttgggaatcccttgtggacggaaggagattttgcctgcaataaaaaacgaggtaaaagatgttaaggcttatatgtgttaaatctttgagaaagattcctttgatggacttaccattgtaacaattcagaggatattggagaaaaaatttaacaggacgatgactgttcacgaacagattgtattcaagactgcttttataatcttcgttgtaaccaaattcttggctcctcaatctgttaacaatcacatatctataaggtatatgaaggctttggttgatgtagaaaatattcacaagtacaactgggcggaatttgttttgcatgacatcaaagatgcagcagcaacattgcaacacaaaatacgccatcgaaaaagcattggttacatcaatggctgcattatactacctcaggtgagattatcctattattcgttcgaattatttgccttttactttctaatatactcgcaacatcttttcacatgctataatttatactgctcagcttttttatctggacaatctggatttcgggacggacactcccgagcaggaaaacattccaaggattggcgtgtacaatgactccatgatagcagaattcattgagagggatgtaattctcaagaaccggaatcctttccccgcgtatggaaagatgaaggtaaaatcaactctcctgccggtagagtattcttgttgaaatttcccttgtgcagaaacttcagactactgacattttttttgggtttcagctgcgaaacaaacatgatgaaaaatacaatcttggccatcatacgggtgcaatagaggtgcaatctcatgtagtttgtcaatctattcaatataaaaagaatccatttttccataagaattgttgatatatctgtacacaggctatccatgtggatcgtacctacgatgccaggtctgacatcgagcccccaagctttaatctaggaataacacaagatatcgaagaagcaaacatggtggcatgtaccccaggtcatgacatctccaatgtggctgaagactctgacaaagaacaagaactcaactttttagcacgtaccccagatcagccaatctcaaagtcagtagatgcctctgacaaatccggagaaggtaatgcaatgcacaaaactccctcttcgcatggaggtaatgatacccacaagcctatatcagtttttcattttcattcataaccaaccacatgcacataatatgtctcactcttactgttctgtctcataataggttaccaacaaactaaacttagtagtttctctccgtactctatgttgaaagagacgagtggggcaaggattttcatgcgtgaggagtacgcatgtacaaagctcccacctaaatccaagaggagaattatcggcggtccttctgatatcctattcgatcggccaaagaggtcgattaaaccaagccattcggtgaaatcaccatttctgagcaagcaacactctttcgtcaggcatgaccagaaggcacttgatgatttatacacatatgcaatttcaatcactgatgcagaagctcttaagtaagccacctatctgaaacacttgatgatttatacacatatacaacttcaatcgctcatgcagaagctctaatgtaagccacctacctgaaatgttcctttctttcaccactaattgtaaagatatcacatttaacaggaaaatctgggttcacatctcccaacctgtccctatgtcattaagcctacatgacatacaacaggctattcggctagacactcaaatgcaagaagaaacattcaatgttgcagttcaagtattagcagcggatgagatacagagatttggaggaactgattttgtaggctggagacatttcttaaatcaagattttgcagtaagtgcttccaattactctagactattttaattcttaaatatggtgtgttttaacacaatatggcgctgtagatgtttgcaacagctggtgatgaccagtggaacccagaggatcatctcccctcattcaaagatgactccctgataccatatgacgtacctagttgccacctggtttgataattaacagcatcttgaaaaattcagtacatcaagtgcaaatgttcaggccactaacttttgcaatgtcaatattaatttgcagatatttattccactacttcaaccactgcactattctctatacgcatttgatatggagaaaaaaaaattatgcattcttgacccactgagagacgcctcgaaaagatcagaggatacagcagaaagacacttaaaaacaaaatttcacatttcatctgctctgaaggagtgcatg

SEQ ID NO: 80956 - DNA, 685 bp, Oryza sativa
gcagctcgtgtagccctcatttgcgttcgagaatgtccatcgacccccgaatttatccatctcccatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttaggggattttgaatagagggggcggggtgaagccaattccacaatactccaacaattccatagtgtccaggtgatatgagaatttcccaagtctaagttataaaaccatctaatgttacctaattaaatagcgaagcatctacctaaatttaaactagggataccacgagtagagtgtccactagttggggttttgtttaatctagggtgaacaaggtaataataacaacaataacaataataatatggtcataacaaaggtaaataggcatggctaaataaaacagtgataacgcgggaatttaaataaagcgataatgcaataatttaaatcaacataattttacaaactgggattcaatatgctcaaagatgatgtgacttgccttgctcgctttcccaaacgtcggcttcaacctccacgaagagcagatcttctgaagctgcagcgt

SEQ ID NO: 80957 - DNA, 9886 bp, Oryza sativa
cgttgttagatgtgattttgatctgacctctatagattatcttcaaacatatcacttgttccataactgggaatagctctcacggacaagcaactcggattcactttctttacatttggttcacttcccactattctcttcatgttgtcctcagttagcattcaacgtattcctttacacctttgaccttgatgtgttctttcccgatttctcttatcaatcacctttcgacctacttctttgcctggtaataaacatctttttcgatatcttctatcaatcaccttttgacctttgtcaactaagtactcttcactccgagagttgtggatgcttctggtgacgatgtggtacttgagcctgctgcctttcagagaaaccttcaagtggttcgtcaaaagctagactggcggttgttgcctttgatccaaagaggacacatctgaaactctcagtccaaacaaaagtctctttgactttttaatccaacacagtttaattggttttcttttccatcaacaggttggttattaactcgagattagtatatgattcctctgaaatgagaccctaggtctcctttatcagtgagcaattatacacataatcacatatccgcatcttccaaaagaatcctagtagaacttgtctgtattacacatttctcccttattacatgaatactaagcactgcctaaaaggaaaggtgcttgacattggtacattgtttctgctatgggttctgattaacacgaggcctcacgggtacggcgcttgctccagtgaccacaatatgattgggaggtctgcttcgtgtaaattggcagtaatgtggaggtcgactttgccttggttgcaggcagtccctcgagtaatgccctggttctttgcaattgtagcaaatcaacgtcttctttgctgagctatccgtctggggacgatcattctgacttggagttggaattggtggctggaaatccttgctaacattggcatcagtggtaccatagttgctatcaccatcggagtctttctcagagtcacaattgctagggttgtcattttgggtgccatcattgatactatcgtcgacatcttagtgaatgatgttgacattgcacgcttgattcgagtggtcactaatggggcaagaagcatggttgttggtggtatcatcatcatcattagtattgctaatgttgttgtctgcattgtgtccatcttcttggggcggaaactcttgatgcgcaacagaagatccggtgatctgaagtggctcagtgcgctgtctttggttaccacatggaaatactgggattctgacaatccttctcttacagttcttcatccgattatgctcactttcgagttgtatggctttgtccacaagtttctcaaaatcttcataatcctctaggagtagttgcactgcaagctcatcttttaacccctggagaaacttctcttgtgtgtcttcatccgtctccacatcttctggtgcatagtgagccaaacgatagaactcgtgcaggtactctgtgacggtcaaatctccttgcttcaggtagcgaaactctcgttttctcagtgtgatcattcctgcgggaacatgtgatctcttgaatacagatgaaaactcgtcccaggtgatggtatgtccttctggccgtgatgcttcatagctatcccaccactctgaagccggtccaaccagctgaggagttgcgaagccaacccgctcctggtctgtgcactgaatcaaccccagcttcttctcgactatgcgcaaccaatcactggcttccataggatcgacggcaatggcaaaggttggaggctcagttttgagaaattctgataacttgcactgttgctggactgtaggtactcgaacgttggttgcccctgctgggttgttccaattctgtaatagttgaaaggctgttgccaacatgttggtttggttaaccacaatttggattagctctggtgaggtttcgttgatgcttttctcattcccattggtttgggttctttatcttgtacttgatttcttggctgctgtgctggaacatccaaaggtacaatgccgatactagcctcggtcttgtcaactgatggctggggctgaaattgggcattgacaccttgtggtgatgcactcgctggagttggagctgttgcaacgcgggctataggactgcttcgggatgcatggatgacaattcgctgaggagcaagcttctgattgcagggagttgcgtggactgacgtgctggcagctatgtttctcggtttttggcacttgtcggcaaaatgacccattccttgacaattgaagcaacagatatcttcccggactcggcattttcttttctcattttgattcctctgtcctggcactggagttaggctgaaactgtaatcttggcgaggatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctatcgggtggatggtcttcctcgcaatgaacgcatgtagtggcacacgagctggcaacatgaccgatttctccacaacgagagcatgccttacgttccattttattctggttgaaaccttggggagacttctcatcttcatcatctgaggagacttgatctgaatcttcactatcagacactctacctccattagctaaaagatgctctgtcaactgtggtgcacctcggaaggtatttcttctctgacgtttggtcattcctggtggaggccattctgtgctggtaatgatcatcttacggacttcatcttcggttcgcattggtgtttttcttttctgctagggacagttccttgcatagtgcccttgctcatcacacataaaacaaatgatacttgcttcttttgagtcaacatgtggcacgccaccatgggtcttttgggatgctggcggcatgctgacttgtggtgtgagtgattggactgcctccaactgcacttgaggttgtatctgactcaggttcagaattggcgtctgatgctgctgtagtatctctataagcaatcggttctggttaattaggtgttggaccagtgtcacacaactgttgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttcggtgacgggttctcaagatcttcactcctgcttcacagctggcttcactgcttccttcgcttcgctagcggatcctgcagtcttccggagcttcggcaaacaactgacgacatcttcttcttcgcaaaactgaccatctagtactagttgaaattcgaagaaggaagaagggagtaaaccttttgcaaatagcattaggggaaggagaaaaaaggaactttcgcaaatagttttatttataaaacatgtccttaggtttatccacttggcttatcctacagtcgagatggctctgataccagcttgtcgcgaccgagaaaattgcattttcccgaacgctagtgtattaatccccgtcccaggaaaagccgggatacaccatacaaacatgatataaaagacacatctttattatatcgataatatttacattattacaaaggcacttaaggcctgacaatcaaaaataaacagcagcggactagtgggcctacggctccatcttcacaggcgctcagctggggtataagccaggactccacctaagacttcttctccaaagcttctcttactgaaggggggagaaaggtagagcaagaatgagtacaaccacagtactcagcaagtcacaccggcagatgcatgattaatgcaagggggtacaaggggataataatataggggttaagttttgcagtaaacagcatttaaaagtcacttagttgcccaaagccatttataaagacgatcctagagctacacagtattattaaacaaggccgtgaaccctcacgaacctaccttaacccaaggcctacgatgattcagaccgaactggcaacccgaccctgggtcccagctcgtcccaagccaacccaggccaaccattccacattttagttgttaagcaaattttaagaattaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcttagccataaacaagagtaccgacccaaccccacctacggccggaacctccgggacaggtaggcaggaatgagcccccagcagcaggacaccagccctgtgccatgacatctcgactaccgggccgcagctcgtgtagccttcatttgtcctagagatgtccatcgacccccgacttcgtccatctccatccgtgtacttctgtttataaccagactgagccacaaactaagccttatccactagacatgtggaagtacggtagtgctttgcaacagaggcccgagcttaatccttatattggccggggtgctacttcccacaactggcatgcacccaaaccccaccggaaaacaggttttaggggttttgagagaggaagagaggggtatgtccaattccaccataatccaacaattccataatgtccaaatgatatgagaattcccaaagtctaaagttataaaaccacctaatgttgtcctattaatcagcgaagcatctaccctaattcatactagtggaaccataaatagagtacccactagttggggttttattttcctagggtgaacaaggtaataataacaatagcaataataatgtcttaacaaaggtaaataggcatggctaaataaaacagtgataacgcgggaaattaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagatatggccatttgcaagtttatatgctctttaaatggatatttgcgaatttcttcatttaaattttaattaaaaacccatttattgcgtcagccgagggagagggcgcgcggaccgggtccacgggagtggggcccacgcgtcagcctctcggtccacggtggaccgggtgcacgcggctggcggcggccggcgccgtgggtcccacgcgtcagccgcacccgcgggcgcgggcggctgacggccgggccccacctggcagccgcgggaggcggccgaaggcggcctcgccggctcgaccgacgggagacgcgcgcccgcgccccgatggtcaccgccggcgaccaccggcgcggcggagcggcgcccgagagagcggagaggagagggaagcgagagggacggtccacggctcaccccgggacaacgaggacggcggaaacgacggccggagcggaggaacgcggcggcgcggttcgggacgacgaaggagacggagctccggcggtcggcgggcgaagcgaaggggcggacggggtcggcgacaacgcggcgaagccgatggaggtggcgccgagtcgggaggaagaccggagcgacgacggcggctaaccgaaggtcggcggcgacggcggagagagaggagaacgtcgcgagcacgaatccgaaggcgagagcgagcggcgagcggcggaaacggaagagcggagctcggggaacgattatatagcgccgagagggggagagcgcggccggagagggaggaaacgggcgcggagatctcggccgccattgattgcgccggcgaggattgcgggcgcgattcgaacgaatccgagggagagagagagggaaaagagggggaaacgggagagggaatcacgggggtgattttccccgtctttaatgcgcgcggggacggcgggatgcggcgaaatccgcggcggcggcggcgctagggcacgggcgagcggcggcgcggcgcgaggaggaagacgacaggtgggacccacccgtcagcgagggcggcgggcgggcccgcctgtcagcggcgcgcgcgcgcgggaggccgatgggccgcgggggaagagagagagagggagggactgggccgagccggcccaagaagggagggggggggaaaggacttcttttagggatttttctttttataaaaccttttcaactttgtttatttcttaataattattatttgtgctctgaaaattccactaaaatttgagggctccttttagaccaaggagaatttaacaaaaattctccgggccacatttgaatttttcttgtacgtattttaatgtttgccaatttcttttcgaattttaattaattctattattccttttagaaaatgatttttatttcgggatgaatttatcaggacgtgacaattaccagggcaagcagctcccggagcaggagggtgacgatgcagagccccacgctgcttgggaggttactgcagtgatcctcactggctcacccgagaggacgtcgttggcggtcaccgcgggtggagattccttctccgccgcttgccagaacgccgcactcctcgccatcggcactcttcaccagcgctacccggacgagttgcagcactcgccctactgctaccaccctcgtcgtggaggagcccgcgactacgccaccttccgggatgctagctcgaaggatgacgctaccatcatgcacctggcgcgcatggtggaggcgtacgacgcggcccgtatcgacttccatcagatggtgcgtcgcgggttggtcgagaacagcatgaagatcctggagctgcgtcaggagaatctgcagctgaagaaggacctagacgcagtggaggcgcagctgcgacagcttaagatcgcccagggagaggtctgtcgccccaagcgtcaccgcgtctgccgcagcctgaagatcaccgcccgcaagagtacctccgggcccgagcttgttcgtcagtccctggtgtcgaaactagatttcggcaataataaaagggggtggctatcaagctggaaaagtgtatgggtttggagacgaaggatttatacaggttcaggccttcttattcaagaagtaataccctactcctgtccggggatgaatccgccgagtgtcttattgattgtataatttggagaaaatcaacaactgcccctagaggcacccggatcccccttatatatgggaaggagtccgtgttacaaaagataatctatatccctaacggaatatgcagatacagataaaatacagtcgtaaccgactaagtctcaaggtaattccttgacgtacaagttgagaaacaaacccgaaatacaaataagatattctatccatattcggtatcctatattcagcccaaatatcatcaccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgaagacaaaataatagcacaatcgtgcatcatatgacaaaagcatacgcggcacctaaagaggtattatagccgactgctttttagccataataaaaggaatccgagtggttaacactctaaaaggttcacgaatgaacatacttgacaggcatccgaataaaaaactccaaagattacccaccaaatattataaaaattatagtaatgaataagtctaatagcctaggctatgactatttaccataatgaaaacaggcatataacataccaaagaaatgactatggtaaaaacaagtcatttcaagttaacccagacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaagcccatttgcacctccgatacccttaacaataaattccgagatccaagcgtcacttcgtcttccccgccggaactctcgccattttccccaatccctgctacagtacagagctgcgccaacaaactagggttcatcattccactcgaatccaccttcgaaaagttcagcaaaatccttcccgtgatccaccgccgcaatccctcacctctccctagccatccctcgaatcaaatcagcgcattcgggtaaaatcgatggcggaagagaaagaaagctttgaaggccaatgggcaccatccgacgtaacggaggagaacctgaaggagatggtggcgcacggcgttctccctgccaaggagatcatcgggtggcggccagcatgcggtgaggcttttccgtcccccgatacacacgaggttgtagtcttttcccatttcttctatggcggcttcgctcttccgacctcaaaatttttccgcgggatattaagcttctatggaatcagcttgcatcacctaaatccaaattccatagtccacatcgccaatttcatccatgtttgtgaagccttcttgggaattaaaccccacttcgctctatttcgccgaatcttctttctcaaaccccaaccgaacaagagtaagccatgtgtagtcggaggggccggatttcagctgaggggaactctgagccagaagtacttctcgatgcccttcaagacttcaaacaaaggatggcatgcgaactggttttatgttcagaaccctgagcctgctcttcccgagtactcttgtcttcctccggtgtaccaagatacttggaactctcttccgatcggggatgaagctgctgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggagaaagataaaagcgagctaagcctgaagacttgactcctgcagcgggcgactccattccacaggcaatccttgacgggcagcgacgaaaccaacctcttcgagacatcttcaactggg

SEQ ID NO: 80958 - DNA, 42671 bp, Oryza sativa
gcggaaacggtggagtgaggcacggggagcgtttatatagtgttgggagtgaaagagggcgaccggaggggaaggaaaccggcgcggcgatctcgggctgcatcaatggcgccggcgaggtttgcgggagtatttccaaacgaatccgaggaagagagagagggaaaagtggggggaaagggagagggaatcacggggagtgatttccccctctttattgcgcgcgggggcggcgggatgcggcggaatccgcggcggcggcggcgctggggcacgggcgaggcggcgggtgcggcgcgaggtaggggatgacgggtgggccccacccgtcagcgagggtggcgggcgggcccgcccgtcagcggcgcgcgcgcgggggaaggccggatgggccgcgggggagaggagagagagggagggagctgggccgagccggcccaagaggagaaggggggggaaaaggacttgtagggtttttctttttataaaacctttttaactttgtttatttcttaacaattattatttgtgctctgaaaattccactaaaatttgagggctcctttttgaccaaggagaatttaacaaaaattctccgggccacatttgaatttttcttgtacgtattttaatgtttgccaatttcttttcgaattttaattaattctattattccttttagagaatgaattttaattttgggatgaatttatcaggacgtgacagctgcactgcacagtgtctagctttttccccacggcatgcaaccaatccaaagcatccacggggttattggagctagagaaggtaggtgggcggatgcggaggaactcggcgagtttagagtgttgtgggggtggtggtggagcattctgttgtggcgggttttggaggtggtggaggaaagcggtcatcatgttggcttgctgggcgaggatttgggtgagaatggcgttggtgtctggtggtggtggtggaggcggaggaggaggtggaggtgggttgccctggtggtggtggttgctgccttcaggttggtcgccatcaccggtagcagcatttctcctggtcgtcaccatctgaaaaccccacacagaaccagcaaacagagaaagagctaacaattaaaactaaccacccacgactaccattattcttaattttattactgctattaaattggttcattaatgttcaagttgcttaggcaaataaaataagacaggctccgacatagttatgccacacaccggcataaccatgccccacacaactcaaaaagacaaacgagaaagaacacacgcgcaagcctactaactgctcgtctactgctgcgacgggccaggacggaaggtgagcaacagcgcaccctccgtgctaccaacgccggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcggcagatctctccctgggcgatcttgagctgatgcagctgtgcctccaccgcgtcgaggtccttcttgagctgcaggttctcctgacgcagctccaggatcttcatgttgttctcgaccatcccgcggcgcaccatctgatggaagtcgatacgagccgcgtcgtacgcctccaccatgcgcgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgctctggcaagcggcggggaaggagtctccacccgcggtgactgtcaacgaagtccgctcgggagagccagagaggatcactgcggtgacctcccaaccagcgtggggctccgcgtcgtctccctcctgatccggaagcggcctggcctggtagtccactccgtgtggataccccagggccacgcacatgcctcgcagctccaagacgaagccagtcatatccaaaccacgacgggtgacgctgccggccatctacaaacaaaaacaaaaagagaaacaacattttaaaggtcagattttgatgataagtgaagcagcaagacagagagagactagacagttttcacaagtaacaaaggatttttatttttgaaaatattgctaaggcttgggatctacggctcgtcctagggtcaaggggggctctgataccaacttgtcacgaccggaaataacccaacgggcattcctgacgtgcgtgcattaatccttgtcccaggaggcaaggtacaccaaaagttgatacaattcagagtttaacaagcggaagcgtaaatagttaacttattacatgggcaacggaggcccagcacacacaaagacaaacgggaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaatggaattataacataaagggttagggttgcagtaaacagcatttaaagacatttagttactcaaagctattctgtaaacacgatcttagaactatacaatattattaatcaaggccgtgaacccacacgaacctgccttaacccaaggcctatgatggttcagaccgaactggcaacccgaccctgggtcccagctcgtccgaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaaccccacctacggccggaacctccgggacaggtaggcaggattgagcccctagcagcaggacaccggccctgtgccatgacatctcgactaccgggccgcagctcgtgtagccttcatttgccctagagatgtccatcgacccccgacttcgtccatctccatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttaggggattttgaatagagggggcggggtgaagccaattccacaatactccaacaattccatagtgtccaggtgatatgagaatttcccaagtctaagttataaaaccatctaatgttacctaattaaatagcgaagcatctacctaaatttaaactagggataccacgagtagagtgtccactagttggggttttgtttaatctagggtgaacaaggtaataataacaacaataacaataataatatggtcataacaaaggtaaataggcatggctaaataaaacagtgataacgcgggaatttaaataaagcgataatgcaataatttaaatcaacataattttataaattgggattcaatatgctcaaagatgatgtgacttgccttgctcgctttcccaaccgacggcttcgacttccacgaagagcggatcttccgaagctgcagcgtctacacgaccaacggaaaaggaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaaccgggtttattgcgtcagccgagggagagggcgcgcggaccgggtccacgggagtggggcccacgcgtcagcctctcggtccacggtggaccgggggcacgcggctggcggcggccggcgccgtgggtcccacgcgtcagccgcacccgcgggcgcgggcggctgacggccgggccccacctggcagccgcggggcgcgcccgaaggcggcctcgccggcacggccgacgggagacgcgcgctcgcgccccgatggtcaccgccggcgaccaccggcgcggcggagtggcacccgagagagaggagggaagggggaagcgagagggacggtccacggctcaccccgggacaacgaggacggcggaaacgacgaccgaagcggaggaaagcggcggcgcggttcgggacggcgagggcgacggagctccggcggtcggcgagcgaagcggaggggcggacgaggtcgacgacgacgcggcgaagccgatggacgtgacgccgagacgggaggaagtccggagcgacgacggcggtgaaccggagctcggcggcgacggcggagagaagatgcgacggcgcgagcacgattccgacggggagagcgagcggcggacggtggaaacgtaggacagaggcacggggaacgtttatatagcgccgggagagagagagagcggccggagagagaggaatcggccgcggagatcgcggctccatcaatagcgccggcgaactttacgggaataaaatcggtcgtatccgagggagagagagaggggaaagtgggggaaacgggagagggaatcgcggggaataattccccccactttaatgcgcgcggggacggcgggatgcggcggattcggcggcggcggcggcgctagggcacggacgggcggcgggcgcggcgcgaggaaggcgatgacaggtgggccccacccgtcagcgagggtggcgggcgggcccgcctgtcagcggcgcgcgcgcggggaggggccggtgggccgcgggggagaggagagagagggagggagagttgggccgagccggcccaagaagggaaggggggaaaagaagacttttagggatttttctttttataaaccttttcaactttgtttatttcttttcaattattatttgtgctctgaaaattccactaaaatttatttacgcattttaggcttttaggaaatatacaaaaatcctccaagccttatttgacttttaaatttgcacattttaattgttggaggctttcacatgaattttaattattctttgcacaatttcgaggatgaattttagagtcgatttgggacgtgacaggtatactcacaatcagaggaagaccatcagcagcatctccgtctggtgttgggaaagttgcgggaacaccaattgtatgccaagctcagcaagtgtgagttctggttgtccgaagtcaagttcttagggcacgtgatatctgctaaaggagttgctgtggatcctgaaacggtgaccaccgttactgattggaagcaacccaagacagtcactcaggttcgtagctttttgggtttggcaggatactatcgaagattcatcgagaacttctccaaaatcgctcgacccatgacacagttgctgaagaaagaagaaaaatttgtgtggagcccgcaatgcgagaaggcgttccaaactctcaaggaaaagctagtttcctcgccagtgttaatcttaccggatactcgcaaggacttcctggtgtactgtgacgcttcgcgccaaggattggggtgcgtgctcatgcaggaaggccacgtggtagcctatgcctcccggcagcttcggccccatgaaggcaactaccctacccatgatttggagttggccgctgtggttcatgctctaaaaatctggcggcattatctcattgggaatcgctgcgaaatatatactgatcataagagtttgaaatacatcttcacctagtcagatctgaatcttcggcagagaagatggttagagctcatcaaggattatgatgtgggaatccactatcaccctggtaaggccaatgtggtcgcagacgcgctgagtcgaaaaagccgttgcaacactcttggcgtccgtggcattccaccggaacttcatcaacagatggaagccctgaacctaagcatagttggtcgtggattcttggctacgctggaagccaagcctaccttgctcgatcaaatccgcgaggctcagaagaatgatccagatatgcatgggatcctcaagaatatgaaaaaaggtaaagccgctggtttcacagaagatgaacatggaaccctatggaacagaaatcgtgtatgcgttccggacgacaaggaacttaaacagttgatacttcaggaagctcacgaaagtccctattccatgcatcctggcagcacgaagatgtacttggacttgaaagaaaaatattggtgggttagtatgaagcgggaaattgcagagttcgtggccctttgtgatgtgtgccagcgtgtcaaggcagagcatcaacggccggtcggatttctccaacctctacaagtaacagaatggaaatgggatgaaattgggatggatttcatcaccggacttccaaaaacccaaggcgggtatgactctatatgggtagtcgtggaccgactaaccaaggtagctcggttcattccggtgaagaccacctatggagggaacaaactagctgaactctacttcgctaggatcgtgagtctccatggcgttcctaagaaaattgtatctgatcggggaagccagttcacctctcatttctggaagaagctccaagaagagttgggtacctgcttaaatttcagcaccgcgtatcacccacagacagatggacagaccgagcgtctaaatcagatcctagaagatatgcttcgcgcatgtgtcctagattttgggaagacatgggataagagtctcccctacgccgagttctcctacaataacagctaccaacccagcatacagatggcaccgtacgaagcgttgtatggccgcaaatgccggacaccgctattgtgggaccaagttggggaaagcgaagtgttcgggactgatatcctgagagaagctgaagcgaaggtcaaaaccattcgggataatctaaaggtggcacagtcccagcagaagagctatgcagataaccgacgccgtaacctggaatttgcagtggatgactttgtgtatctccgggtcacgctgttgcgaggcatacactggtttcagaagaaagggaagctcgcacctcggtttatgggtcctttccgtatcattgcttgacgcggagaagtcgcttaccagttggagctgcccgcctccttgggcaacgtgcatgatgtgttccatgtgtcgcaactcaagaaatgtcttcgagtgccatccgagcaggccgactcagagcagattgaagttcgcgaagacttcacctacgtggagaggccagtgaaaatcctggacaccatggagcgcaggaccaggaaccgggtaatccgtttttgcaaggtccaatggagcaaccacgccgaggaagaagctacatgggagcgtgaagacgagctgaaggcagcccatcccgatctcttcgccagttcttccgaatctcggggtcgagattccgtttaaggggggtaggtttgtcacgttccaaaacgactctaaaatatatcccttaaatgatgcctagaataattaaaatccgtgtgaaagcctccaacaattaaaatgtgcaaagttaaaagccaaataaggcttagaggatttttgtaaatttcctaaaagactaaaatgcgtaaataaattttagtggaattttcagagcacaaataataattattaagaaataaacaaagttaaaatgattttataaaaagaaaaaccctaaaagtcccccttccctcccttgggccggcccggcccatctctcctcccccctctctctctctcctctccccgcggcccattcggcctctctccccgcacgcgcaccgctgacgggcgggctcgccagccaccctcgctgacgggtggggcccacccgtcatccccttcctcccgccgctcccgtcacctcccccgcgccctagcgccaccgccgccgcgaatcctgccgccacccgccgtccccgcatgcaataaagtgggggaaatcactccccgtgatcccctctccctttccccccatttttcctctctctctctcgcgttcaaacgggcggatttgcccccgcaaatctcgccggcgccattgatggtggccggacctcccgtgccggtttccttccccaccggccgctctctcccccttccaacctatttaaaccctgcccgcgcctccctcgcccgtttccgccccttgccgcaccgtctccccgccggaatcgagctcgcgccgttgccctctctctcctccatcgccgacgacctccggccggccttctccgctcgccgggaccgtctcccgcctcggcgtcgcctcctccggctttgccgcaccgccgtcgaccccgtccaccccctcgccgagtccgccgaccgccggaacaccgtcgaccccgtcgacccgagacgcgccaccgccttcctccgctccggccgcctttttcgtcgtcgccgtcaacctagggtgagccgtggaccgccgcctcttttcccccttcccttcccctctcttggccgccgctccgccgtgcctatggccgccgccggcgaccataggggcgcgggcggcgccacctgccaaccgcgccgagtggccgccttcgggcgcgcagagtggccgccgcgtgggggccggctgtcagccgcccgcgccctcgggtgcggctgatgcgtgggacccacggcaccggccggtgcgagcccgggtgcgcccggtccaccatggaccgtgaggctgccgcgtggaccccactcccgtggacccggtccgcgcgcccctccccctcggctgacgcaataaaccctttttaaattaaaatttaaatgaagaaattcgcaaatattcatttaaagagcatataaacttcaaatggccgtaacttggccatttgaactcggaattggaccgttcaagtctctaatttttccttaagaagtcaagaacccatttttgtgctttgttcctgcttattatatggagtttattagagtaaaagcccttttttttccgttggtcgtgtagacgttgcagcttcggagatccgctcttcgtggaggttgaagccgacgtttgggaaagtgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggaatactcttatcacctggacactatggaatggttgaattattgtggaattggattcacacctccccctctattcaaaaccctcaaaatggttttagggtgggctcggggtgcatggttttgatagtagcacctcggccatataaggaccggtcttcgggcctctattgcaaagcactaccgtacttccacatgtctagtgggtaaggcttagtttgtggctcagtctggttataaataaaagtacacggatggagatggacgaagtcgggggtcaatggacatctctatggcaaatgaaggctacacgagctgcggcccggtagtcgagatgtcatggcacaggcccggtgtcctgctgctaggggctcagtcctgcctacctgtcccgggggttccggtcgtaggtggggttgggtcggtactcttgtctatggctaggatgggttggaaactatgtcatgtcttctgtccgtatgccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcctaacagctaaaatgtggaatggttggcctgggttggcttgggatgagctgggacccagggtctggttgccagttcggtctgaatcatcgtatgccttgggttaaggcaggtccgtgtgggttcacggccatggttaataatattgtatagctctaggactgtgtttacaaagtagctttgagcaactaagtgacttttaatgctgtttactgcaaaccctaaccccctatattatagctcccttgtactcccttgcatttattctgcacatgtgggtgtgtcttgttgagtacggtggttgtactctgtcttgctcaatttttcccaaacccagaagaggagcccctggatgatgaaggctttggtgtctagctcgtgcctgccgtcaagcgcctgtggtcgtcgccctagtcttgcgctgtttcccgtttgtctttgtgtgtgctgggccttcgccgcccatgtaataaagtaactattcacgcttccgcttgataaactctgaaatgtatcaacttttggtgtaccttgcctcctgggacaaggaataatgcacgcacgtaaggaacgcccgttgggttatttccagtcgtgacatgcattgtggacgaaacttttaccattatgtggtcgacggcgctatcgaccgatgttggattttccgccaactcagttgatgcgcaactgctgcgtttttaggtgggacttcctaactcttcatacgcagcagcagcggcggcctgggggttctgttgctcttcttggatctcttgcctaatcttggccctcattgactcgagcttttcgtcgaattcagatgtcagctcagctcttattgacgcccggatcttggcttcaaggcgtgcatctttctccgccttgttggaagtccgcttcttgtactgccacgcgtagtctggaaatccatacttctagggaacggaagacccaacgccccgtgtccgtccacgatgttccttgttgcccaacgctttcgtgagaaggtcgtcctcgcgtctttgagagcaggcctcttgcgaggcttattgctcggcaaccaactccttctgcattataatttagtggggttaaataaactgcacgatgggaaacaatgtgaatatctagtttgactagacacttagtatagcttcgtacactcgttgatcttctggattgtcacgtcccaaaacgactctaaaatacatcctctaagatatgcctagaataattaaaaaccgtgtgaaagcctccaacaattaaaatgtgcaaagttaaaagtcaattaaggcttagaggatttttatatatttcctaaaagcctaaaatgcgtaaataaattttcgtggaatttttagagcacaaataataattattaaggaataaacaaagttaaaatgattttataaaaagaaaaactctaaaaagtcccctttcccttcctctccttcttgggccggctcggcccatctccctccccctccctctcctctccccacggcccatccggcctatccccgcgcgcgcgccgctgacgggcgggcccgcccgccaccctcgccgacgggtggggcccacccgtcatccccttcctcccgccgctcccgccgcctcgcccgcgcctagcgccgccgcctccgcgaatcttgccgcctcccgccgtccccgcgcgcaataaagtggggggaattattccccgtgattccctctccctttccccccatttttccctccctctctccctcggattcgtttggaaaccgttcccctaacctcgccggcgccattaatggcggccgggtctcccgcgcccatttccccctcctccggccgccctctctcactcccaaccctatataaaccctccccgagctcccaccaccgtttccgccactcgccgccctctcttcccgccggaatcgagctcgcgccgtcgctctctctctccgccgtcaccgccgagctccggtccgccgccatggacgccccggaccacctcccacctcggcgccgcctccttcggcttcgccgcatcctcgccgacctcgtccacctctccgtttcggtcgccgaccgctggagcatcgtcgaccccgtccaccctagccgcgccgccgccttcctccgctccggtcgccgtttccgtcgtcgccgtcgacccggggtgagccgtggaccgccgcttcgtttccccctttccctcccctctctcgggcgccgctccgccgtgcctatggccgccgccggcgaccataggggcgcgggcgcgccgcctcccgccggccgcaccggtgtggccacctccgggcgcgcctagcggctgccgcgtggggcccggccgtcagccgcctgcgccctcgggtgcggctgacgcgtggggcccacggcgccggccggtgtgagccgggtgcacccggtccaccgtggaccgtgagactgccgcgtgggtcccactcccgtggacccggtccgcgcgccctctccccggctgacgcaataaatccattttttttttaaattaaaatttaaatgaagaaattcgtaaatattcatttaaagagcatataaacttcaaatggccataacttggccatttgaactcggaattggaccgttcaagtctctaatttttccttaagaagtcaagaacccatttttgtgctttgttcctgcttgttatacggagtttattagagtaaaagccttttcttttccgttggtcgtgtagacgctgcagcttcagaagatccgctcttcgtggaggttgaagccgacgtttgggaaagcgagcaaggcaagtcacatcatccttgagcatattgaatcccagtttataaaattattttgatttaaattattgcattatcgctttacttaaattcccgcgttatcactgttttatctagccatgcctatttacctttgttatgaccttattattgttattgttattatttccttgttcaccctagaataaacaaaaccccaactagtggacactctactcatggtaccactagtatgatttttggtagatgtttcgctggttaattaggcaacattaggtggttttacaactctagactttgggatattctcatcacctggacactatggaatggatggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacatgagctgcggcccggtagtcgagatgtcatggcacagggccgatatcctgctgccaggggctcagtcctgcctacctgtcccggaggttccggccgtaggtggggttgggtcggtactcttgtctatggctacgatgggttggaaactatgtcacgtcttccgtccgtataccgtggtggtatgcggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacatgcttaacaactaaaatgtggaatggttggcctgggttggcttgggacgagctgggacccagggtcgggttgccagttcggtttgaatcatcgtaggccttgggttaaggcaggttcgtgtgggttcacggccttgtttaataatattgtatagctctggaatcgtgtttataaaatagctttgagcaactaagtgtcttttaatgctgtttactgcaaaccctaaccctttatgttataacccccttgtactcccttgcatttatcctgcacttgtgggtgtgtcttgttgagtacggtggttgtactcagtcttgctcaattttttcccaaacccagaagaggagcccctagaagatgaaggctttggtgtctagctcgtgcctgccgtcaagcgcctgtggtcgtcgccctagtcttccgctgtttcccgtttgcctttgtgtgtgctgggccttcgccgcccatgtaataattaactatttacgcttccgcttgttaaactctgaattgtatcaacttttggtgtaccttgcctcctgggacaaggaataatacacgcacgtaaggaacgcccgttgggttaattccggtcgtgacatggatttggcatgaagattgtgccatcagcattcttctggtacctagccctggccctgttcctagcccgagggtgtgggatatcgccaaagacgagcggcgtgttcgattcctccgcttcttcatcctcatgctgtcattcctctttcttaccagcatatccggcggtgccaagccggtgcggatgctggttcttggtctggagcaatcgatatgcctcgcttctagctttggactcgggggtcgacttcttcgcatggaattcctcctagacttgttccgtgatccaaggaaatttctctcttagatctggattcgccgggttgtagacgaactcgccgactagcttagtcttgaagttcttccaagcattgcccataaccttgaaagcagtctgcctgatacagtcctcttgctcgataggataatcgaagctctccttgaacattagcccaacaatgtccttctctgcggccagcatgtgcttgatgtcatcttgcagaatactgaatttctgccgacctatgaccccgcagatagacctaaatcggctcaatattttccttggagttgttggcaaccctacttggtccaccgctgttatgcggaaccgttccttagggattttgttccctgtcctaggagtacgtgcccttgaggacccactagttgtcgtcgacattggttcgccttgctgagacatcgtctactttttttcaaaataacgaaaatacacaattcagtgctaaaatctattacaatgaattgaatgtcacttataaataaatgaaacatatcaataaactaaattgcacatctcatccttataaaatgaattgaatgtcacatataaataaactaaactgtcacgaccggaaataacccaacgggcgtttcttacgtgcgtgcattattcctcttcccaggaggcaaggtacaccaaaagttgatacagctcatagtttaacaagcggaagcataaatagttaatttattacatgggcggcgaaggcccagcacacacaaagacaaacgggaaacagcggaagactagggcgacgaccacaggcacttgacggcaggcacgagctagacaccaaagccttcatcttccaggaactccttttctgggtttgggaaaaaattgaacaagactgagtacaaccaccgtacttaacaagacacacccacaagtgcagaataaatgcaagggagtacaagcgggttataatataaagggttagggtttgcagtaaacagcattaaaagacacttagttgctcaaagctattttgtaaatacggtcctagagctataccatattattaaacaaggccgtgaacccacacgaacctgccttaacccaaggcctacgatgattcaaaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctggccatagacaagagtaccgacccaaccccacctacggccggaacctccgggacaggtaggcaggactgagcccccagcagcaggacaccggccctgtgccatgacatctcgactaccgggccgcagctcgtatagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatacggccgagatgctactatcaaaaccatgcaccacgagcccagcctaaaaccattttgatgattttgaatagagggggaggtgtgaatccaattccacaataatccatccattccatagtgtccaggtgatgagaatatcccaaagtctagagttgtaaaaccacctaattttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaacatacttttataaactgggattcaatatgttcaaggatgatgcgacttgccttgctcgctttcccaaacgtcggcttcaacttccatgaaaagcggatcttccgaagctgcaacgtctacacgaccaacggaaaagaaaaggcttttactctaataaactccatataacatgcaggaacaaagcacaaaaatgggttcttgacttcttaaggaaaaattagagacttgaatggtccaattccgagttcaaatggccaagttatggccatttgaagtttatatgctctttaaatgaatatttgcgaatttcctcatttaaatgttaattttaaaaaaagtttattgcgtcagccgaggggagggggcgcgcggaccgggtccacgggggtgggacccacgcggcagcctcacggtccacggtggaccgggtgcacctgggctcacaccggccggcgctgtgggccccacgcgtcagccgcacccgagggcgcgggtggctgacagccgggccccacgcggcagccgctcggtgcgcccgaaggcggccactgctgcgcggccggcgggaggcggcgcgcccgcgcccctatggtcgccggcagcggccataggcacggcggagcggcggccgagagaagggagggaaagggggaaacgaggcggcggtccacggctcaccctaggtcgacagcgacgacgaaaaggtggccggagcggaggaaggcggcggcgcggctcgggtcgacggggacggcggcgctccggcggtcgacgagcaaaacggaggggtggacaaggtcggcgaggatgcggcgaagccgaaggaggcggcgccgaggtgggaggtggtccggggcgacgacggcggcggaccggagctcggcggcgacggcggagagagagagcgacggcgcgagctcgattccagtcgggaggaagggcggcaagaggcggaaacgaacggatgaggtgcggggagggtttatatagggttggaagggggagagggtggccggaggggaaggaaactggcgcggcgctctcgggctccatcaatggcgctggcgggattaggggagggtttccaaacgaatccaagggagagagggagggaaaattgggggaaagggggagggaatcacggggaataattcccccctattgattgcacgcggggaggacgggggcggcgggattcgcggcggcggcggcgctagggcgcgggcaaggcggcaggagcggtgggaggaaggggatgacgggtgggctccacccgtcagcgaggctggcgggcgggcccgcccgtcagcggcgcgcgtgcggggagaggccggatgggccgaggggagaggagatggagggggagggagatgggccgagccggcccaagagggagagggaggggaaggggactttttagagtttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgcgacaaacctaccccccttaaacggaatctcgaccccgagattcggaagaactggcgaagagatcgggatgggttgctttcatctcgtcttcacgctcccaagtagcttcttcctcagcgtggttgctccattggaccttgcaaaaacggattacccggttcctggtcctgcgctccatggtgtccaggattttcactggcctttccacgtaggtcaagtcttcgtgaacttcaatttgctctgaatcggcctgctcggatggcactcgaagacatttcttgagttacgacacatggaacacatcatgcacgttgcccaaggaggcgggcagctccaactggtaagcgacttccccgcgtcgagcaatgatacggaaaggacccacaaaccgaggtgcgagcttccctttcgtctgaaacctgtgtacacctcgcaatggcgtgacccgaaggtacacaaaatcgtccactgcgaattccagattacggcgtcggttatctgcataactcttctgccgggactgtgccacctttagattatcccgaatggttctgactttagcttcagcttctctcaggatatcagtcccgaacacttggctttccccaaattggtcccacaatagcggtgtccggcatttgcgtccatacaacgcttcatagtgtgccatttgtatgctggcttggtagctgttattgtaggagaactcggcataggggaggctcttatcccaggtcttcccgaaatctaggacacatgcgcgaagcatatcttctaggacctaatttagacgctcggtctgtccatctgtctatgggtgatacgcggtgctgaaatttaatcgggtacccagctcttcttggagcttcttccaaaagtgagaggtgaattggcttcccctatcagatacaattttcttaggaacgccatggagactcacgatcctagcgaagtagagctcggctagtttgttccctccataggtggtcttcacaggaataaaccgagctaccttggttagtcggtccacaactacccatatagaatcatatccgccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttccctttcaagtctaagtacatcttcgtactgccagggtgaatggaataaggactttcgtgagcttcctgaagtatcagctgtttaagttctctgtcgtctggaacgcacatccgatttccgttccatagggttctgtgttcatcctctgtgaaaccagcggctttaccctgtttcatattcttgaggagttcacgcatatccggatcattcttctgagcctcgcggatttgatcgagcaaggtaggcttggcttccagcgtagccaagaatccacgaccaactatgcttaggttcagggcttgcatctgttgattaagttcgggtggaatgccacggacttcaagagtgttgcaatggctttttcgacttagagcgtcggcgaccacgttggccttaccaggatgatagtgaattcccacatcataatccttgatgagctctaaccatcttctctgccgaagattcagatctgactgagtgaagatgtatttcaaactcttatgatcagtatatatttcgcagcgattcccgatgagataatgccgccagatttttagagcatgaaccacagcggccaactccaaatcatgggtagggtagttgccttcatggggccgtagctggcgtgaggcataggctaccacatgaccttcctgcatgagcacgcaccccagtccttggcgcgaagcgtcacagtacaccatgaagtccttgcgagtatccggtaagattaacaccgacgaggaaaccagcttttccttgagagtttggaacgccatctcgcactgcgggctccacacaaatttctcttctttcttcaacaactgggtcatgggtcgagcgatattggagaagttctcgatgaacctccggtagtatcctgccaaacccaagaaactgcgaatttgagtgactgtcttgggttgcttccaatcagtgacggcggtcactgtttcggggtccacagcaactcctttagcagatatcacgtgccctaagaatttgacttcggacaaccagaactcaaccagagctgacaactaaaactaaccactcacgactaccataattcttgaatttatttctgctattaaattggttcattaaagttcaagttgcttaagcaaataaaataaagacaggctccgacacagttataccacacaccggcataaccatgccccatacgactctagcagaaaaacaaacgagaagaacacacacgtaagcctactaactgctcgtctactgctgcgacgggccagggcggaaggtgagcagcagcgcatcctccatgctgccaacgccggaggctccatcctcctgaggaaccacgggcgcgggcttggcacgaggggtctcgacgaagcaggtccacgccaggtgtggagattatggatatcccatatctacacggtgatgatatttgggctgaatataggataccgaatatggatagaatatcttatttgtatttcgggtttgtttctcaacttgtacgtcaaggaattaccttgagacttagtcggttacgactgtattttatctgtatctgcatattccgttagggatatagattatcttttgtaacacggactccttcccatatataagggggatccgggtgcctctaggggcagttgttgattttctccaaattatacaatcaataagacactcggcggattcatccccggacaggagtagggtattacttcttgaataagaaggcctgaacctgtataaatcctttgtctccaaacccatacacttttccagcttgatagccacccccttttattattgccgaaatctagtttcgacagttggcgcgccaggtaggggtagcgtcaagcttctcgccgatcagtgcaatgggttccgtctccggcatcgacgacctcgtcttcccacccgggcagacgtttcggttcggcagcctcgacttcgtcaccaacaacttcggcaagatctctctccttgactcggtgtcagaccagtcgggagagaaccggatttcagtcccgtttggactcccaaacgcggctgaaagttacttcaagaccatctcaatcgagtcggcttcaaaccactcgggtgagatcgcatcttctccaacgacaccagatcaagatgatggggcttacccaccgatcctgatgaagttccccgacgatttggcggccatctccatcatgacagcgtctccatcccgtaggcctaggcggaagtcggcttcaacaccgatttcgcctagcttcagggaagtcggcgtcatcctccaaccactcggcacggtttcgacggatcagctggatgactactacagctcccccaccgtcgactcgcgccccaccgacatcgtggagtacgacgagtattgctctcgctacaacgacccggatctcgacgacttcgacgaaagcctagatgacaactacacccctctctacttcggcgtcttcatggccgataacgagacggaggagcaacgccaagcccgggagaccgaagcacgtcgcgagactgagcgtcgccgactggaggaggagcgtcaagcacaagaacaagaacggctacggcgtgagcagcaggagcgtgagcggatgtcacgaccggaattaacccaacgggcgttccttacgtgcgtgcattaatccttgtcccaggaggcaaggtacaccataagttgatacaattcagagtttaacaagcggaagcgtaaatagttaacttattacatgggcagcgaaggcccagcacacacagagacaaacgaaaaacagcggaagactagggcgacgaccacaggcgcttgacggcaggcacgagctagacaccgaagccttcatcttcaaggagctcctcttctgggcttgggaaaaattgagcaagactgagtacaaccaccgtactcaacaagacacacccacaaatgcagaataaatgcaagggagtacaagggaattataatgtaaaggggtagggttgcagtaaacagcatttaaagacatttagttgctcagggctattttgtaaacacgatcttagaactatacaatgttattaatcaaggccgtgaacccacacgaacctgccttaacccaaggcctatgatgattcagaccgaactggcaacccgaccctgggtcccagctcgtcctaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcctgcctacggccggaacccccgggacaggcaggcaagactgagcccctagcagcagggcaccaaccctctgccatgacatctcgactaccgggccgcagctcgtgtagccttcatttgccctggagaatgtccatcgacccccgacttcatccatctccaatccgtgtacttttgtttacgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccatttttggggattttgaatagagggggcggggtgaagccaattccacaatactccaataattccacaatgtccaggtgatatgagaatttcccaagtctaaagttgtaaaaccacctaatgttacctaattaaattgcgaagcatctacctaaatttaaactagggataccacgagtagagtgtccactagttgaggttttgtttaatctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgctcaaagatgatgtgacttgccttgctcgctttcccaaccgacggcttcgacttccacgaagagcggatcttccggagctgcagcgtctacacgaccaacggaaaaggaaaaggcttttacactactaaactccacataacagcagaaacaaagcacaaaaatgggttcttgacttcttaaggaaaaattagagacttgaacggtccaattccgagttcaaatggccaagatatggccatttgaagtttatatgctctttgaatggatatttgcgaatttcttcatttaaattttaattaaaaatcccatttattgcgtcagccgggggagagggcgcgcggaccgggtccacaggagtggggcccacgcgtcagcccctcggtccacggtggaccgggagcacgcggctggcggcggtcggcgccgtgggtcccacgcgtcagccgcacccgcgggcgcgggcggctgacggccgggcccacttggcagccgcgagggcgcgcccgaaggcggcctcgccggcacggccgacgggagggggacgcgcccgcgccccgatggtcaccggcggcgacctccggcgcggcggagcggcacccgagagagaggagggaagggggaagcgaatggagcagtcttcggctcaccccggtcgacggcgacgacgggaacggcggccgaagcggaggaaggcggcggcgcggttcgggacggcgagggcgacggtgctccggcggtcggcgagcgaaacggaggagcggacggggtcgacgacgacgcggcgaagccgacggaggtgacgccgagtggggaggaagtccggagcgacggcggcggtgaaccggagctcgtcggcgacggcggagagaagatgcgacggcgcgatcccgattccgacggtgagagcgagcggcgaacggcggaaacggaggaggagagcacggggaacgtttaaatagcaccgggagggggagagagcggccggagagagaggaaacgggcgcggagatctcgggtccattgaaagcgccggcgaggtttgcgggatgaatccggacgaatccgagggagagagagaggggaaaacgggggaaacgggagagggaatcgcggggaatgattcccccctcattatggcgcgcggggacggcgggatgcggcggaatccgcggcggcggcggcgctagggcacgggcgagcggcgggagcggcgggaggaaggcgatgacaggtgggccccacccgtcagcgagggcggcgggcgggcccgcctgtcagcggcgcgcgcgcgggggaggccgatgggccgcgggggagaggagagagagggagggagagaagattgggccgagccggcccaagagggaaggggggggaaaagaagacttcttttagggtttttctttttataaacctttttaactttgtttatttcttttcaattattatttgtactctgaaaattccactaaaatttatttacgcattttaggcttttaggaaatatacaaaaatcctccaagccttatttgacttttagatttgcacattttaattgttggaggctttcacatgaattttaatttttctcggcacaatttcgaggatatattttagagtcgatttgggacgtgacagcggactgcgaaggaggctgaggatcgacggcagcgaactttgcaagcagggcgccgagcgcgtgatctcatcggccaacaagatgttgaagggacaccggttttccgcacccctcaacagaatgcggttgccgcgatcaccctcctcgacaccctcctcaaggaaaacgagctcaatcaatctgatcacgtcgtcaacatcttgaaccagacgaagaccatgattgcagcttcggtcccagttaactccgaaagcgtccacacgccgactggcagccgagtcccccacttccgatctcatgactaccgtcatccaagcctcagcatcaccggcgcaggatccaatcgcaggagcaggggtcacgacgagcggtccgttcactcacctcccgaccatcatagggagcgccgagtggaacggcctcgctcaccacctcgtcgccgccccgtcgatcttcgcgacacaatcatacagcgccgagcagctcgaggccatcatcattcgccggaccgccacgacgacgaccttgacggagtagcagccttcaccgacgacctgcgtcgagtggattggccagccggcttcaagccgactggaatagagaagtacgacggtaccactaacctagaatcgtggcttaccgtctacggtctcgcaatccgcgcagcaggaggagacagcaaggccatggcgaactatttaccagtggctttagcggattccgcccgatcttggctccatggattgccccgtggtacaattggatcttgggctgaattacgcgaccacttcatcgccaacttccaaggcaccttcgagcgtcccggcacacaatacgacctctacaatgttattcagaagtccggagaatcccttcgagattacatccggtgattttctgaacaacgtaacaagatctccgacatcaccgacgacgttatcatcgccgcattcaccaaagggattcgccacgaagaattggtcggcaagttcgggcgtaagcctcccaggacagtcaagcttatgtttgaaaaagccaacgagtacgccaaagccgaagacgccgtcaccgcatcaaagcagtcgggtcccagttggaagccaaacaagggtacgctggctacgggaggaggtggaagtaacaaccataaggaccgcaagcgtaagcctgaggaacttgttgcaaccgccactcactcttcccgacagcgttcgcgcgtcaacacgttcgacaagatcatgaactcccaatgcccgcaccatcctaactccaaccacgtggccaaagattgtttcgtctacaagcagtttgcggagcaatacaccaagactacacggaagaactctgacgaagaacaaagcacgtcgaggaagaaggacgacggtgacaccccggcaggatttcaagaccaccgcaaggagctcaaccatatcttcggcggccccctggcttatgagtctaaaagaaaacaaaagttgactgaacgggagatcaatgctgttcagcccgacacgccccaatatcttcgatggtcagaaattgcaatcaagtttgaccgctcggatcatcctgaccgagtggtccacccggggcggtaccccctagtactagacccagtggtccgtaatgtcaagcttcgcagaaccctcatcgacggcggcagtgcactcaatatcctcttcgccaagaccctggatgatatgcagattcctcgctccgagctaaaaccaagcaatgcgccttttcacggagtaattccaggattatccgcaactccactcggccagatcaccctcccggtcacttttggcactcgggaaaacttccgcacagagaatatcagctttgaagtcgccgatttcgagacagcataccatgccatactcggacgcccggcgttagccaagtttatggccgtcccgcactacacttacatgatgatgaagatgcctggtccccgaggagtcctatgcctacggagcgacatcaaacaagccgtcacatgcgacaaggagagttgcgacatggcccaaacccgcgagatggcgtctgcccgagaggatatccgactggctgcagccacggcgagcgaaggagaagtgcccgctaccaagatttcaaaaagtggagaaagcgaagccaagactaaaaagattcccctagacccttctgattctactaaaactgctgtaataggcgcctagttagattgtaaataggaaagcgcgctcatcacctttcttcagaacaataaagatatctttgcatggaaaccatatgatatgcccggtattcctagagaggtgattgagcactccttacatgtcaaagaagatgccaagcctatcaaacaacgactccgccgattcgcacaagacaggaaagacgcgatcaaggaggaattaaccaagctgttagcggcaggcttcattaaagaagtccttcatcccgactggctggcaaacccggttctagtacggaagaaaacggggcaatggcgcatgtgtgttgattatactgacctcaacaaatcttgccctaaagatccttttgggttgcctcgcattgaccaggtagtcgactcgacagccggctgtgagcttctcagttttttggactgctactcggggtatcatcagatccgactgaaggaatccgactgcttgaagacttcattcatcacgccctttggagcatattgctacgtcaccatgccgttcggactaaaaaacgcaggagcaacttatcaacgtatgatccagagatgcttctcaacgcagatcggccgcaacgttgaagcctatgtggatgatgtagttgtcaagaccaagcaaaaggatgatttgatctcggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactgaagaaaacagatgatttccagtggggacccgaagcacagaaggccttcgaagatttcaagaaactcctcaccgagccaccagtcttagcttcaccacatccgcaggagccgttgttgctgtatgtatcagccacctcccaggttgtgagcacagtcttggtcgttgagcgcgaggaagaaggccatgtccagaaagtccagcgaccgatttactttgtcagcgaagtcctagccgactccaaaacgaggtaccctcaggttcagaagctgttatatggtattctaattactaccaggaagttatctcactacttccaaagtcactcggtaacggtggtcacatcatttccactcggtgatatactgcacaaccgcgaagcaaacggacggattgctaagtgggctttggagttgatgtctttagacatatcattcaagccccgaatttcaatcaagtcccaagcgttagctgattttgtcgctgaatggaccgagtgccaggaggatacccccgcggagaagatggagcactggaccatgcattttgacggatcaaaacgactttcgggcactggagcaggagtagttttaatttccccaactggagagagattaagctatgtgctttggatacatttttcggcgtcccacaatgtcgccgagtatgaggcgctccttcatggactgcggattgcaatttccctagggataaagcgtctgatagttcgaggcgattcacagctggtcgtcaaccaagttatgaaagagtggtcctgccttgacgacaacatgatggcatatcgacaagaggtacgcaaattggaagacaagttcgatggactcgagctcagtcacgttcttcgacacaataatgaagccgccgacagacttgccaactttggatccaagcgcgaggcggcaccctctgatgttttcgtcgaacacctttatacgccgacagtacctcacaaagatactactcaagttgcgggcactcatgatgtagctatggttgaagccgattggcgagagcccctcatacgatttttgacttctcaagaactcccccaagacaaagatgaagccgagcggatttcaaggcggagcaaactttacgttatgcatgaagctgagttgtacaagaaaagcccttcagggattctgcaacgctgcgtatctttagaggaagggagacaattgctgaaagacatacattctgggatatgcgggaaccatgctgccgcacgcaccattgtcggcaaagcttaccggcagggtttcttttggcctactgcagtgtccgacgccgacaaaattgtgcgcacgtgcgaaggttgccaatttttcactagacaaattcatctactagctcaagagttgcagaccatcccattgtcttggccgtttgcggtttgggggctcgacatggttggcccgtttaaaaaggcagtcggcggttacacgcacctctttgtggccattgacaaattctccaagtggattgaagctaaaccagttgtcacaatcacagcagataacgctcgcgacttcttcatcaacattgtgcatagatttggagtgcccaatcggatcattactgataatggcagacaattcactggcggagtttttaaagacttttgtgaagactttggaattaagatttgctatgcttcagtggcgcatcccatgagcaatggacaggtggagcgagccaatggcatgatacttcaggggattaaagcgcgtgtttttgaccggctaaaaccctatgccggcaaatgggtgaaccagctgccatcagtactttggtctttgcgaactacacccagtcgggccacaggccagtcaccttttttccttgtctatggggcagaagcaatgttgccaagtgaagttgaattcgagtctttacgctttcgaaatttccgtgaagaacgctatgaagaggaccgagtggatgatttgcaccgattggaagaagtccgcgaagcagctttgattcagtcggctcgatacttacaagggttgcgacgatatcataatcgcaatgttcgatcccgtgcctttctagtcggcgacctggttttgaggaaaattcaaactacacgagatcggcacaagttatctcctctatgggaagggccatttattatctctgaagtcacccgaccaggttcctatcgactcaagcgcgaagacggtactctcgtcgacaactcttggaacattgaacatcttcgtcgtttctacgcttaggcttatcattgtacttccctatcttgactgtcaacatcaagttttcttcttgaagttgtcagtcgggggctatcatcataataatggagtggattttttatcaattcaatttgcttgctcggtttatcattgccttgtttggttttttctacttagtctgcgaggactgaaagtttttaatagcttctttgggttttaggctcaacaaagcttgataaaagcttttaagaaatcaacgacttggccagaattatcaagcacagcataaatacaccagtattgtacaagttgagcctccatttgttacatttatactcagtcagaatcagtcttttcatcatcagaattgttactactcggctgaaggtcggtattgcggaattgttctacaacgtcatttgcaatcttgtcagccgcgttttgagcattgctgataagatcaagagcagcttcttcgcttgtcccgtctgcaaagccatcaatggcgtcaatttcaatccttgggtacaaggatttggtcatcgccaatgccatgctagctcccatacttccagctttcttgatattcttgaaatatacatccggagcaactctcagcttgtcgaagatttcggttgcgtcgagtgcactcggaccactgttattgaggaacatagcttggacaagtggtgtagcgacattagcaacttcatctcttgctccttcaagcctcttgatcttaccaaccaggacgtcaaattgagcttgagatttgattttgcggtctacaaaacacatttatggtaaaaatctactgcattaaaaagagagaagtttagattgtcagctggcggtaccttcaacctccttcaaggccgagtccctttgcgcagccagttctactttgtctcttttcaaggcttcaatttgtttctccatttgagccatcctggtggcttgcgctgtttgcaatccgaacggttgaggatatagttctgacagcgtaacttaatgggacagatctagagattaccttttgatgaaccactcagctcgaagtttgaatcctggagctgagcaattcggtcccttaattccttctctgtctttttggcaagctccttggcctcatgtagctggtccctaactgcttcaagagttcccaaatgaggaaccagcttttctaaagttgcggtcttggcctcattgcgaagatggattctctgcatgatggttcatggtttagttctgctaaagagaaaacaaagtcatcaaaggcagtcgcctggaagatttacattcacaatacgagtggcttctccaagcgccttcttcagctggcacacttcctcatcttctttttgacgatttatgacgatgccggcagcttgtgagttctcgtcccaccatttgagtaagataggagggcgagagtcgtcagccgcctttatgcggggaatttcttcttcgtcatcgcctggtggtcctgatgtatttccaagacgttaggcgaataagtaagagttgttcaaactggcatcacttgagaagatgagttacctgagggtgttcctagctgagcgtgaggtgatccttgttctttatttggagacccaatcatcgagtcgttaccagcctcaggtccttgagaagtcgtcgtctgcgcttcaacttcgggaatttcttgatctggacctacatccgactggtttccagtcgggggctcttgagttgtcgtagtttcagttgctgccgactggtttccagttggaggctggtcactcggattggctttatcacctgaagtatgggcgccagtcggctggctctcggcagtcggctcagaatccttggatgaacttggctctgtcacagccggatcaagatcttttccagttggatctatgtcggatggtttcctgcaaagtgtcctttcaatattcagtattatttctatgagagaagcatgtcaaagggaaatggtaccgagaggtttatacctggaagatgttctaatctttggcattgggcggccagccagttttttcctgggagtggtatgctttgggagttttttgggcaagtctttgttcccagatttgttgccgtcgtcgccttcgtcgtcgttaagcaccagctttctcttgcgagaacctgtctgtccagtcggattggaggtttgaggttgcggatctgatctgattgttggccctccacctccctgaacggtgtgttggcgaggagaccggcgctgagtgattggggggtcagacttcatcaatacatattcctgaataagatacctctacggttagttaactcaacatgaagacaagattatgttttggtcatgggttgaagatttcggatacatacctgcggaggcggattgaatgcgttatatggcacaactggcagctgatgtgagtagctgacgacaatagcgtttgagaagattttatacattctctccttcaagattttaaaatccagagagtctggttcttcacgattaggatcatgcttgccgtcaaactcgaatgccgtacgggatctttctttaattggtgccaatcggcatttgataaaatgccgagtaatctgctctccttgtaagccttgttctttgagttttagcatgcgatccatcaactccaaggcttgggcagctgtcacaccccgaagttttcctcccaagccaaaattgtaattttcaaatgaccccaagaaaatgcaggtgaaatcaggagaaaaccctaagaaagtaatgcaaataataatcggacttgacatgtggaatttttcttgagttctacatgtcaaaattcattaacaggatttttagtggaattttcagagctctagaaataatttcaaccaattaaaattgagcaagcaatattttattccagggaaaatcctttttcctttttctttttctttttcctctctttttcctcctttttgtcaaatgggccgtcggcccatttctccttttcctccccctcctctctgttgggccggccgcaggccgaggcccagccggcagccggccgcccgcctccctccctcccggggtcgccgacaggtgggacccacctgtcggacccgtctcccacctcccgcctctcccgctcgcgccgccgcgcccgcaaccgtcgccgcgcccacgtctccgccttcctcgggccacgtcgaccacgcccgcgcgtgcgccgcgtctcccgcgcccattcccctctctctcccgctcgcgcccgcgcccgagatggccgggattcgaaaaccgaatcccgcctctctctcctccccactcccccgcgtcggccggcgattcccgccgctcccggccacgtccggttccctctccccctatttaagcatcgccggcaccccctctcgctttttccccatttcgccgacctctcccgagctccccatcgctcccgcgccgtgcaaccccttgccgccgcctttttccgctctccgggcgccgctagccgccgctaggctcgccgccgtcttgcgccgtcgccgccgttagattcgcggggtcgagatctacctcgtccgccccttccccgttgaggttcgccgccggagacccatccccgtcgtgcgccggtgagtgacgccatggccgccgccttcggccggcgctctcgctctctcgcgctcttccctctccctctaatccctctccttttgttcgttaggaggttccggagctcgtcccgccgtcgccatcgtcctccgtcgcccgccgtcgtcgaccgttgtcggtgaggccctcctcctcgttttctctctcccgcaccgtttagccgccgcgtcgccgcctagctgcgtagccgccgctcctcctctagccgccgctctccgccgccggtcggtcgccgtcggccgtcgccttgcgccgctgccgcatgcgcaccgccgccgcgtgagcgctgcgccgccggcgccatggtcgccggttcggcttgcgccgtgcccgcgcgccccggccgcgagctcccaccgccgtccgatctacccttgggtagatcggggccgtcggttcggccgccacgtggagccgccgccccttccatctcccgtgtcgctgaccggtgggccccgcatgtcggcgccgagccgcctgtgctgacgtcagccctggaatatattgcgcaataattaattaaggactttttctttattagtaaaaacacagtgaatcttctaaaattcataactaattcatccgagctccgattaagtccattcaagtctcagtaaattcataaaaatgtgtagaatccattaaaaatggctttgttatctgtttcagtagtcttatagcatgttttgcttgtgtgctttgtttgtcgcgtagatttcggccgtttcgtcgatccgtggtttctcgaagacgttgctgtggttccatcattgcgagagcaaggcaagtcatgcaatacaattgatcatattgtacctaatttacaaatgtcccgcatttctattaaatattgcattgttttacaatatcatgtgggatgggtcctattactcagctatatgttgttttccttatgccattgataacttgggtattaaaatgactagatgttggtttaggagatgcttagccatgcttagttcaactagtgcataaaaggggaccacattaaagcatagacttgattattggcaatagctctggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgccggcgcacggaaacgtgtcgtggggctgtgtcttgtgggtacagttgtacacctctgatcagagtaaaactattcgaatagccgcgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtggggtttttcaaaacaagtcagtctagggttttagtaaaattattgggatttattcgtcagacagttggggtttgatgggtgaaatgcattaggtcctagctctataacatgggttgcaaggtgtttatgcttcgtttgttattattaatatgtatctaatttctcattattttgtcattatgtgagtctgtcttatttattcgctctcatgcaaaatgatctatgcataaaatttcgcttttattcgtttcccttatttgagtcttttattgctttatttaaatttggatttgagcatgcattgattcctatccctctgtactctttagatgtcagacctattctccgatcgcaagcgccgctccaagcttcagagtcgccacccttagctttatcgtcttcttagtctgtttgcgtgctagtttttgtgtttaggtttgttgcttgtgggttagtcggcagtcgatatcatgtgtgagtggtatgacagcctttattaggagttgtgtgcctctttttcagtgttttaatcaagattaagatgattgcacttaatcttataagaaagattagtttccgagccgtctgttttcttcctttctcttatttctacctatcctcctccagatggtgaagacaagggacgatccccgtgactccaacgacgccagtggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaacgactggcttcgtgctattgagaagaagctgatccttctgcaatgtaacgaccgagagaaggttgcttttgctacacatcagttgcaaggtcctgcttctgcttggtgggatcactacgtggtgacccgtccagatgcaacggaggttacttgggcagagttttgtcaaagcttcaggaaggcacagattcccgaagggattatggcacaacagaagagagagttccgtgcattgcaacaaggaaccagaacggttacagagtacctgcacgagttcaaccgcctcgcgcgctacgctcccgaggacgtgcgcaccgatgctgagaagcaggagaagtttttgtttgggctcgatgatgaattgaccaaccaactaatctccggagtctatgaggactttgagaagcttgtggacaaggctatccgccaggaagagcaacgcaacaaaatagaccgaaaaagaaagacagctcagatcagctttcctcaggggaacaatcagaagcctcgtttcatgacgggacagctaggtgggccttccaccctgatcgtctgtcagcaccgtccctatcgcccgagtaacttcaacaacgattacaatggtggcagtcacaacaacagtaagcagcacaaccacaactcgactccacccccactaatggcaccagctcagtcagatccgccagctgtgtcagttcagttagaacaacccaagaagggggctgtaggaaagccaggaccctgcttcaactgtggcaagcacggccactttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcacgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcagcatctccgcctggtactcgagattttgaaggagcaccagctatatgccaagtttagcaagtgtgacttctggttatcggaggtcaaatttctgggtcacatcatttctgctcaaggcgtggcagtggatccatcaaatgtggagtcagttacaaagtggaccccaccaaagacagtttctcagatccggagttttcttggacttgcgggctattaccgtcggttcatcgaaaatttctctaagattgccaggcccatgacacagttgctaaagaaagatgaaaaattcaaatggtcagctgagtgcaaccaaagttttgaagaactcaagaagaagttagtctccgcaccagttctaattctgccagatcagacgaaagacttccaggtctactgtgatgcatctcgccaaggattgggatgtgtgttgatgcaagaaggcagagtggttgcatatgcttcgcgacagttgcgtccacatgaggccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacggatacgtagctgccctagaggcccggcctacgctcgtggatcaagtcagagcagctcaggtaaatgatcctgaaatagctgagctaaaaaaaaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggtcagcatgagaagagagatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcggggcacgattcaatctgggtggtcgtggatcgactcaccaaagttgctcattttattccagtacacactacctatactgggaaaaggttggcagagctttatctttcaagaatcatgtgtttgcatggggtacctaagaagattgtatctgatcgaggaagtcaattcacttcaaagttttggcagaaactgcaagaagaattggggactcgtttgaatttcagcacggcttatcatccacaaacagatggtcagaccgagcgagtaaatcaaatcttggaagatatgttgagagcttgtgcacttgactttggtggagcctgggataaaagtctaccgtatgcggaattctcttacaacaacagctaacagtccagtttgcaaatggcaccgtttgaagcattgtacggacgaaagtgccgcacaccacttttctgggatcaaacaggtgagcgccaactgtttgggacagaagtgttaaccgaagcagaggagaaagtcaggaccgtcaggaaaagactgcgaatcgcccagtctcggcaaaagagttatgctgataaccgccgaagagagcttactttcgaagcaggggattatgtgtatcttcgtgtcactccgctccggggagtacatcgttttcagacgaaaggcaagttggcaccacgcttcgtgggaccatacaaaatcttggaacgaaggggagaagttgcttatcagctagaacttccatccaacatgatcggcatccatgacgtgttccacgtgtcccaattaaagaagtgtttaagggtacctgaagaacaggctgattcggaacacattaatatccaggaggacctaacttatgtggagaagccggttcgcatacttgataccagcgaaaggagaaccagaaacaaggttacccggttttgccgagttcagtggagtcatcattcggaagaggaagcaacctgggaaagggaagatgagttgaaagccgcccatccgcatctcttcaccagctcctccgaatctcggggccgagattccgtttaaggggggtaggtttgtcacaccccgaagttttcctcccaagccaaaattgtaattttcaaatgaccccaagaaaatgcaggtgaaatcaggagaaaaccttaagaaagtaatgcaaataacaatcggacttgacatgtggaatttttcttgagttctacatgtcaaaattcattaacaggatttttagtggaattttcagagctctagaaataatttcaaccaattaaaattgagcaagcaatattttattccagggaaaatcctttttcctttttctttttctttttcctctctttttcctcctttttgtcaaatgggccgtcggcccatttctccttttcctccccctcctctctgttgggccggccgcaggccgaggcccagccggcagccggccgcccgcctccctccctcccggggtcgccgacaggtgggacccacctgtcggacccgtctcccacctcccgcctttcccgct

SEQ ID NO: 80959 - DNA, 11673 bp, Oryza sativa
cgaactttccgctacctactcacctcaacaaaatggtgtagtggagatgaaaaatcgtacattgattgagatggcaaggactatgcttgatgaatatggtgtttccgactccttttgggcggaagccataaacaccgcttgccatgcaacccataggctttatttgcatcgtctcttgagaaagacttcctatgagctaattgttgggaggaagcctaatgttgcctattttcgagtttttggttgcaagtgttatatttaccgaaagggtgttagactaaccaaatttgaaagtcggtgtgatgaagggtttcttctaggttatgcctcaaatagcaaggcataccgggtctacaacaagaacaaaggtattgtggaagaaaccgccgatgttcaatttgatgagactaatggctcccaagaggggcatgagaatttggatgatgtaggtgatgaaggcttgatgagagctatgaagaacatgtcaattggagatgtcaagcctattgaagtggaagacaagccatccacctccactcaagatgagccatctacttccgctacgccaagtcaagctcaagttgaagtggaggaggagaaggcacaagatctacctatgccaccaaggatacacaccgctctttccaaggatcacccaattgaccaagtgttgggtgacattagtaagggtgttcaaactcgatctcgtgtcgcttcgatctgtgaacattactcgtttgtttcttgtcttgagccaaaacatgtagatgaagctctttgtgatccggattggataaatgctatgcataaagagctcaacaactttgcaagaaataaggtgtggactttggttgaaagacttagagaccacaatgtcatagggacaaagtgggtctttagaaacaaacaagatgagaacgggttggtggtgagaaacaaggcaagatttgtggcgcaaggtttcacacaagttgaaggtttggactttggtgaaacttttgcccccgtgacaagacttgaggctatttgcatccttcttgcatttgcatcatgctttaatataaaactatttcaaatggatgtgaaaagtgcttttctaaatggtgaaattgccgaacttgtctttgttgaacaacctcccggttttgaagatcctaaatatcctaaccatgtttataaactctcaaaagctctttatggtttaaaacaagctcctagagcttggtatgaaaggttgagagattttcttttgtcaaaggatttcaaaattggaaaagttgacaccacccttttcacaaaaatcattggtgatgatttctttgtgtgtcaaatttatgttgatgacatcatattcggttgtactaatgaggtattttgcaaggaatttggtgatatgatgtctagggaatttgagatgtccatgattggagagttgagcttcttccatggacttcaaatcaagcaactcaaggatgggacgtttggcttggaggatgcgaagcccatcaagacacctatggcaaccaacgggcatctcgaccttgatgagggaggtaaaccggtagatttaaaactttatcgttccatgattggtagcttgctttaccttactgcatctaggccggatatcatgtttagtgtttgcatgtgtgcacggtttcaagccgctcctaaggagtgtcacttagtggccgtgaaaaggattctaagatatttaaagcattcctcaactattggcttgtggtacccaaaaggtgctaaatttaagcttgttggctattccgattcggattatgccggttgcaaagtggatagaaagagcacatccggtagttgccaaatgcttggtagatcccttgtgtcatggtcatccaagaaacaaaacttcgtagccctctttatcgccgaggcggaatatgtttcggcgggtagttgttgtgcccaattgctttggatgaaacaaatcttgttggactatggcatatccttcactaaaaccccactcctatgtgaaaatgatagtgccataaagatagccaacaacccggtccaacattctagaaccaagcatattgacattcgccatcacttcctaagagaccatgttgccaagtgtgacatagtcattagccacataagaaccgaggaccaactagccgacatctttaccaagcctcttgatgaaacccgcttttgcaagttgaggaatgagttaaatgtcatatatttctctaatgtggcttgagatggtgcaccatggttgcttcctttgcatattgtatatttgctcctatttgctcttatgctttggatttattgccatttggttcttcattgcgaaaatggagcatatcacattaagggggagttttgcactcttgcatgtgctctacttccttttatatgtaagcaaatcaactagtggtgctagtagtattttcaaaatgcccaagtcaacataagtcaaaacttttgcaaaatcaatgtaatttgaaaactatctcttggaaaatgtttcacaaggttccctatatgttttccaactctcactttgtaagaaaaatgatttttgaatgaaaatgccattttggccttcttttgaagaatctagaatcttgtttttggtcaaaatgagattaaaccccaaaatgagattgagaaggaatttgagaaaagtttcaaaacaaagttggtagtgaagaagatttgaaatgtttttggtattcaaatcatattcaaaaaccaaatatttcaaaagttgtttgaaaatcaaattcgcccaaaaacccctatagaccataaatggtcacctcctagcactcaagtgagttttgttgcaaatcttcataaatttcaaatattatgaatggttggcaatatttcaactcacacatttcaaaattgctccaaaaattaaatttttgttgaattttattgtgtgggggtagccgaactgtgcaagggctgtgcacagttggctgggggccaggcggtctgaccggcgctatatgcgcggtctgaccggtctggtggcgacggtggcccggtcagaccggccgcaccccggcagtctgaccggccgtgtatagccggtctgaccggccggggatggtgggcccgggaatcttcccttttcttctctcttcttcccctacccgactccatctcctcccattcatccttcttctccaactcgaaatttcttctcatatctcctctcccaaaccctagtcacctccctccaccaaatccatccggttcaaccgtcaaaatcactccgattacaccgtaagtgattctcctccgcttcctctctctattccatggattgatttgagtttttattgagtttgtgatccatggcatggaaccctaggtgaaggaagaggtgttcttcaatttgcaccaatagagggtagtttcttggtgtgattcaactccttcaaccggtaaatcactctctctctcttgtgcattgctctcaaatcggtctattttaatctctagggttaagggtagtttcccccattgcttcaatctctatgaaatagacctacaccttgatgttcatgttccaatcttgtgcaactttgtcctagcaatttttagaatcatttgtgtggattgtggaatgattcggttgtgctactgtcagcggcggtctgaccggccgtgagacgccggtctgaccggcccatggccgtcggtctgaccggctttggctctcggtctgaccgcccctgacaggcagcacccccattccttactcttcactatgtggcttctaaaattgttgcttatccatcctttgctccttgtttttcagctatgcctccccgcactcgccatggtcatcgtgagcccacgcccaatcccatcagtgagaatgaggaataaagcggagatgagtatgttcaaagtgaagatgaaaatatggaaaatgttcagggtgatgagatggaaggaagtgatgatggtgatgacaatgggagtggcaatggtgaagatgatgaggcaagtgatgatgggagtcctctcgattccaccatccaatttgtgcttaatttgaggaatgctcaaaaatacactatcctccgtcatcatcatcaattctagaggcctaacgattgtaatgatccaagatttcatacacggttccaaaagtccgtgtatgaacaagtgtatgccaacaaagccttcgccgaacacaagtggatttcttggaggcacattggtgagacaccggagtttgaagatttgcaagagatgttccggaccgttgggattgatagaattgtcaccatgaagcaaccttttgatgaagatctcatccggcaattctatgccaccgtatgagtgtccggcgattgtgatgcaatgaagtggatgtcggggacccttcgatgctctatcaaccgccgtgaattcaaggagctcttgcacatccgcttcaacaacggggatgaccttcatgatgagcacacccacaaccccttctccattgatcacttttctcagttttatgaagaagggggaaggcacacatatggaaaggtggcgggtttgagggctctcccaagtgtgatcaaccgtatagtaagggccaccatcctcccaagatgcggcaacaatgatgacatacgcggagttgcttggcatgtcattgatgccattttggatggtcgtcggtttgatgttatcaaccttataatgaaggagattgccatctcaaaggggactattgaacaaggaatctattatgctccctacataatgaggttgattcaaagcaagttgggacaaattggtcacaatttaaaagaacataaggagtacaagcctcgtctccaactctccactcctagagctccttgtgtgcgccaaccaacttttgatcaaggtgcaagctcaagtgcagcccctcctcctcctcatgggtatgatccaagtgattttttccatccacaatatgcttattttggaatgcaacccaacgagtacttcaacccggtacttggggctattaataccctgagtgaaagcattcaacgcttgtctaccgggcatgaagctttgcatgaggatgttcgtggcttgcgcaccgatgttggcaacttgaatacttcggtgggaagattgcatactagggtgggtgtcttggattctcgagtccaaactttgaagagtacccaagcatttgtgtatcatcgtcgtcgtgatgctcatcatccttccacttcggcgcgtcctccttctccaccacaagaatgaagacctttttggtacttgatgccaaaaggggggaaaaagtgtgttcctatgtctcgtgggttgggactagtagtagtgaggttagtcacctcatatctaataggttaaggaggtttgggctatattatgtatgggtatgggctattactctatattgtgtgttccttttcgttttgttgatctctatgtcatttggacccttcgtggtcttgtaatagcctatatttatttgtgagccctttatgtggtcttaatgtgaacttgtgctatgatggatggttggtgtgacattgatatacttgtgaccatcttatgcattcggttgattcatatgtgaagttcacattataatttgtctatgtgttgtgctatgttgatttgtgaaattgaattgtgcattggctccatatttgctatttgtgattgttatgcacatgtttagggggagcttttgcttgtcaatgcaatatatgtccatgtgctctatgtttgattatatatatttgtggtgtttatcatcaattaccaaaaatggggagattgaagcatctaggcccccggtgttaattttggtaattaatgacaagcgctaattgtggactaaccattgtctttgagctatacattttaagttaggtccacgtcatatgtgcgcatggatgattatcgatggattaaaattgacggcgcaaagcaaagggaaagaaaacggtaaaactagcgctttaatttagaattgatcgaggtgtagggcgatcaaatttgctagtttatttttagtttcgccgtactattaaaaggggtaatgacctagcaaagagatgattttaattgccacattaggtcattatacatttagacttgtgctcacatttcacacacacacacttcactaggttcggcttgaccaggggtggtcagaccggccacatagtggcgatctgactggcgtgccctggccggtctgaccggccgcaagaaggcggtctgaccaacgcataaggccggtctgaccggcggcacatgcgcggtcagaccggccccctggaggccgggatggtgctgctcgggatggccgatacagagccgacggagccgtattcggtcagaccgagccgatggcggtttgaccggccaccccatgtcggtctgaccgaccaggctgatggggccctctgacagggctacaacggctagttttctagccgttgcagagtagcacggtctgaccggccacatacctccggtcagaccggcagagcacagagttgggggatttcgctcccaacggctagttttggtgggtgggagtataaatactcccccaccagcagcaagggggctctcttggcacccaattcaattgcatacaccccttgcatctctctcacactcacttgagctttgtgttcatccatctagtgtgttagagggttgtttagccaagagtcaagtgcatttgcttccattgtagagctagtgtggcatttgatcatctccacgccgggtcattgcttgttactcttgaggattgccacctcctagacggcttgtggaggagttgcccggtgacctctccgagaagattgtgaaggaggcccggcgccggtttgtgagtggtttgggttcaccaccttcggagtgaaggaagaactaccctggtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctccttgtctcatttgattgtcgcatttacatttgtgcaatttacatttctagagacatactttgacataggagtgtgatttactttcctagagatataattgagccactatcaccctaggtttgcaaaacataacttagttgcttagttagagttcaccctcaccaagcctagcaacttaggttagttttgattaggtgttatttagttttaaatcgcctattcaccccccctctagtcgacatctcgatcctacaggtggtagtaattaagatagaaaattaaacgatgcatgcaacccaattatcatgggagtacctctcaaaaaaaaactcatgggagttaattggtttggggccggcctcctcgctgggctagactcacttgataggttgtggtctgcagaccgaagctacatctagactaatcacagccttgaaaataaaatctaacgggggtaaacaattctggtgacgtggatgcaccacaaagtagaaaaatggtattaattatagttagcggggatcaactttaaaggaatataggataaatggatggagcaccataaaacattattggttgtgtagacttgacggtgccactagctctgtcactgccatgacctattgaatcctactacctaggtttttatattttgggacagagatagtataaagcagataaaaccttataattgctcaaaacaataatatggatgtctcacacaaaaatacaaaaacacaacattccaattgattaatgtatggctgataacctatagataaataaaagaagagacaacaataatttataggtacaatttttatatatgtattatttgtgattgaaaccaatgttgaaaatagactacgagaaactccctttcctctcctcgtccacacaaaattaactttaaaatcaagtttaacattaaaacttagttgtggttgataaacatggttaaatgatgttacgacgagagaggaagattatacgtatcaaaagttttttttcataaaatattaggttatacctaatgccagatttcttcaaaatatgaagagttttcttttctattctataaaaatctctttaaaacaatatatactacagacaaacaaatgacttagttattttttttgaattgattttgtaattttttttcctccaaaacccttctaatcgcatttcactatagaatcgaactcaggcggaagtcctggagggcggagaaaatcctgagcatcacaagtcgcgacctcacagggaggggcggcggcgctcgccgtgaggcgcgggagggggcgcgctcgcggtggtccacggtgaagtgcggcttgctcgccgtggggagtgcggtgaagagtggctcctcctcatctagcagtctctgctccagtcgtctggttccccccgccagccgccactcgcgcatttcgtcgaacgccttcgcctccatcccctcccaccaatcaatccacgtgctccagaaccctaaccctcgtgggggcgacgggggagaggttggcatctggcgatggcgtgttgctgcctccgtgccagcacggcgccccgcttcctcctcttccgcgccgccgcgcggcgagccccattgccggtcgcggtttccaggaaggtacatgctatagcgcccccttctcttccttctgatcccttttccttggggagtgcacgaatcgaaaacaatcagcatattagctagacgcaatgaggtttggggcagcgcacagccattccaccaatgcttcaatgacattgccaatgtttgttgttcatcgggccactgttgtaatgttatgctgcaaattagactatccaaacatttttttctcttattatagatgatagttattcaagggttatatacggtcacactgtcattcaatccaatgatttgaatgtaagataattaatgttactgaaattttctatgtaatatcagggtttctcggaacagtccgtattgccaatcacagacatgatcgagaattttcaaggaccatccatggagaacattccacgaattccattatatgatgatagcttgccctcaagcttgttgacaacttctccgaatcctagtgatagtgtagctcatgctgacccttcaaagagtagaataatgcttgttgatggaacctcagtaatgtacagatcctactacaagatattgggtaaatgtttcctgattctctttgttacatctgtattggtatattatgtttggcttctcctccttatcaaggtaaatgcatgtttagaaaataagtgttttgatatttatatttaaactaaattccactggcatgattaatacatgggaactgaacatttttattcttcctataatgtgaaggcacaacagaatgttgcaatatgtcctagatacacacagacacatgcacaaagggcaaaagaagttgtacatgtgcccacacttgatgttttatttcatgacatgaaaacattttctcaatttattctcataatttgggcatgatcttttgataaaaaaaatatgggcatggttttttgtggtttaacttctctgctgctttcctaccctgagaacacccatccattatctcagtatatatctgtcttgttgaactgtgctatgctgtcatagcatcttataagcagcagaaagtttcattattggtttccggtagtatgttcctttctaattcctttaggataatcatgtcaaaggcactcaaacaaaatcatgttttgcaaaactaccatagtatttttctgcacaaaactggttcagctgctcacattaaagagcactaaaatccagggttaatttggagttaggtgcccaattgcattaattgttggattcaacagctttattttttttcctcatgtatgcagcacagctgcagcatggtcaattggagcatgctgatggaaatggagactgggttttaactatatttaaagctctgtcactggtaagtatatttttttatagatttttttgtggcatacttgttaataagcttaaatttattcatagttcgttttccgggtccctttaatgatagtccttttttttggttgcttcacctaatgttcgtctgaaacgcatcttctaggcttctagcacaatggtcttcatctgtgtttctagttaaggttgactatggtacatgtgtttgtattttgttctcattacaaatctatcatcgtacaagtaggaagtgcaacattgttgaagtggagaaatattaagcaacgtcttttgtagataagcaaggttttcaaactgctatgttgcaaaacgtggattgggtagtgaaattttgacacacatgctgtctttaagtggcattgtttaatgaaccagcatgagataagacttacttgcgatgaataagtgtgatgacagaagatacacttttttctttagtatgcttgagatgaactgttggtatttggagttgttggaaactgatgatttactaaaaacatcgcctgtttgaaaaaaaaaggagtatatgttagcctcataagtttatccccggttgacatctgtcctttgtggatcgttatagatttttatcatgtggcggtgttacaattcaacatgttaaccttctgcctctacacagaatcttcttttctcgttgtaatattttatgacatgcgttcctttgttgtgattccacttgattttgtttataacatgtgtgatccctattataactacattgctttttatatctccaggttctagatatgctggagttcattccatctcatgcagcggtacgctcatcttttttgtagcctaaaattatatggtcttgttcatatctgtcatttttctcatggaacttttgttaaaataaagtgttttagaacattgttggatgaatcatagagaatttttaaaacccttatatataactaagatcacagacaccccttgcaattccaatcatatttcttgctaacaaaatgtgaaagtttcatgtctatccttaggaactggggagcattaacacatggtgctaaaccatggtaatgagaagtgcatataagcaacttaaattgtatgtttagcccataattaaggattcaagggccaatgcgccaaaggagtatttattttaccattatactggaacataatacttaatatttccagaatatttagaggttactggcttactgctaggaaaccaataaccaggtgcagtgtaagcatcatttgtagaaaccacagtttgtttctgtatgtggttttatgttttatgcctcttagcattccttttccttatggtactttgaacacatatgcaggtggtgtttgaccatgatggtgagctttttcaattggataattctcatattcactgagtaaactttcactttattattttagtattttgctgtgattgtttgttgattgctctctgcagcaaacacttggtaaatttttctctgtaagctttgagcatacgtagcatgagatcttgtcctgtctgcaacttgttaaatggcaacggatggtggcagtggtcagcagtgcctgtaatgg

SEQ ID NO: 80960 - DNA, 1465 bp, Oryza sativa
tgaccaaaataaaagttgtagatcttgatgagaggatcaactttgttgttgttgactttttcatttgaaatcatttactatttacaaatgctgtttaaattagtcatattgtgaaaatcaatttcaagctgttgggaacaaagttatctagacaaatgaccaaaataaaagttgtagatcttgataacctctacaattttgttgttgaccatatttcgatttgaaatcatttactatccgaaaatgtattatgactaataaaataaattattatatagctgctatatattttgtactaacaaatataaagacttgattggaaaaatgcaaaaaaagtcatcggtgacgggccttagttaaagcccgatagagattaatctatctctatcgggcattatcttagagcccgtcacagatgagtcatctgtgacgggcctgaatgtcatctcaatcgagcattagtatggagcccgtcaccaatgagtcatctgtgacgggccctacggcaatgcccgattgagatgacttatcactctactataacaagggtttctcatatcggatcgaaaaattttctaagtcctgctacagtttcacacctccttagaaccctagcgccgccgccttcgtcctccctcgccaccaccgccaccgagcccgccgcttccaccgagcctctacaccgaccagcgtcggccttcctcgtcgtggtcgcctgcctcttcaccgacgcgaatagctgacccccaccgagcccggcgatgtccttcctcatcgtcgtcgcctactcctcaccgacgcccgacgccgacctgcctgaccggcgccgccctccaccgagcccagcgctaccgccgcgaactccttcgccgagcccggcaccaccgccaccgagcccagcgccgcctccaccaaccagcgacgccctccaccgaacccggcgccaccaccaccgagcccctccccccccggctgtcctcaggtgagtcctccatcgcgccgccctctgctacctgtggtgaatgatgaaatgtggatgttgggatgaatttagtgatagatgattttagtgattgatgacatgttgatgaatagatgaaatgtggtgcattaatgaatttagtgattgatgatttgtggtgaacgaatgattttttttatttatgacatgttgatgaatagatgaaatgtggtgcattaataaatttagtgatagatgcatgatatgtggatgaatagatgatatgaggtgaatttatgattttaggatttgatgatatgtttatgtcgcgtcccaaaacgactctaaaatacatcctctaaattatgcctagaataattaaaatccgagtgaaagcctccaacaattaaaatgtgcaaagttaaaagtcaaataaggcttggaggatttttgtatatttcctaaaagcctaaaatgcgtaaataaattttagtggaattttca

SEQ ID NO: 80961 - DNA, 2046 bp, Oryza sativa
cactcccgtggacccggtccgcgcgcccccttccctcatctgacgcaataaacttttttttaaattaaaatttaaatgaggaaattcgcaaatattcatttaaagagcatagaaacttcaaatggccataacttggccatttgaactcggaattggaccagtcaagtctctaagttttccttaagaagtcaagaacccatttttgtgctttgttcctgcttgttatatggagtttattagagtaaaagccttttcttttccgttggtcgtgtagacgctgcagcttcggaagatccgcttttcgtggaagttgaagccgacgtttgggaaagcgagcaaggcaagtcgcatcatccttgaacatattgaatcgcagtttataaaactatgttgatttaaattattgcattatcgctttatttaaattcccgcgttatcactgttttatctagccatgcctatttacctttgttatgaccttattattgttattgttattatttccttgttcaccctagagtaaacaaaaccccaactagtggatactctactcatggtaccactagtatgattttaggtagacgcttcgccgcttaattaggcaacattaggtggttttacaactctagactttgggatactcttatcacctggacactatggaatggatggactattgtggaattggattcacacctccccctctattcaaaatcctcaaaatggttttaggctgggctcggggtgcatggtttagatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaagctacacgagctgtggctcggtagtcgagatgtcatggcacagggccggtgtcctgctgctgggggctcagtcctgcctacctgtcccggaggttccggccgtaggtggggttgggtctgtactcttgtctatggccaggatgggttggaaactatgtcacgtcttccgtccgtataccatggtggtatgtggcacgtggttacacgtgaggaagatatgtcttgtgggtaaagatgtacacctctgatcagagtataatctattcaaatagccgcgccctcggttatgggcaagccgagcaatgtatccaagtttgtgttttaattcttaaaacctgcttaacaacaaaaatgtggaatggttggcctgggttggcttgggacgagctgggacccagggtcgggtggccagttcggtctgaatcatcgtaggccttgggttaaggcaggttcgtgtgggttcacggccttgattaataacattgtagcgttctaggatcgcgtttacaaagtagctttgagcaactaaatgtctttaaatgctgtttactacaaccctaaccctttatattataattcccttgtactcccttgcatttattctgcatttgtgggtgtgtcttgttgagtacggtggttgtactcagtcttgcttaattttcccaagcccagatgaggagttcctggaagatgaaggctttggtgtctagctcgtgcttgccgtcaagcgcctgtggtcgtttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccgaagcttctcttactgaagaggggaaggattgagcaagaatgagtacaaccacagtactcagcaagccacaccggcggatgcataattaatgcaagggaggtagggctgcagga

SEQ ID NO: 80962 - DNA, 78488 bp, Oryza sativa
atcatgcgctgtttttcgtcaatatgtatacagtaatatatttgcatctttctgtaccggtctaggtcgtctatatatggtgtatatctccttgttcacacatgatataacactagtagaaataaatagggactgcatcactttctaagaacccacaaaatataaatatctccaactccagcaatatagagacttgctatttatttctcctgtatttctacttatactatgtctacgtatagtttaacaccttaagaattcaaatatgaatatttctaatgttagatttcaaccatattcaaattcaaacgtcataatagttaaagttcgaatccttaaaggctcaaacatgggaaaatgggaatgagaaatcctgcgtactaccaagtatccaagaactatagtcaatagataaagttaactctctatacacttttccaatacaatctatctgagaaatttttttttaaaaaaaaagctccttcaaattaatcctggaaaataccctgaagttataaatcacaatttgagacaaaattaagaacaagactgaagaatcattccaattaattccccctctacctcataaacttcagcgcatgcagtgtcaattttagaaggtcaaaagccaatacatggccccgtttagataacacccaaccatcttcaaataatgaagcgtacgtatgtcttgctgcaggaattgaacaaattaacatcgatgattcgaaagctctgaacggagctaaaacaacatctctcatcaagtttaaatgttctgataggacttaactgagcagtccagtttctcgaaccacttcctcctcctaaaatgttacggagtagcatattttaggtggacacacgtattaagaacgtagatgaaaataattggttgaagattgtgattggttaagatgagaaagtcgataaagaaaattaaatgaaaaataattgtgattgattgggagaagatgataggcaaagaaatacctttattttgggacagacattcacttacaaaacaccttatatgtaccggatcataggtaccggtttattcaaaaccgacacctattaccatttcccacctctttaggatgaaaattttagataaaaactggcacctataggtgctagtttgttaaaaaaaactagacctatgcttatattataggatttggttatagctagataaaaaccaacacttatagtagtactacttttttttaaaaaaaaatcagcacctataataaactacaggtgcagccgaaccggcgctccaccacgagccgcccctcttctccaaaccctatccactccccttgcccacccccatcgccccatctctctctctctctctcactcactttgggccttgaataataatcggcatcatgatgtacttttgcttcatgcacaaccaagggggaaggttgtaaacacatagggtcacaggccaagcagtggcggatccagaaaatcgattcattggtgtaataacgtgtctattggtgtcatagtatgctaattatgcttagatcatagcgttataatatatggatgaacagttttgctataggttttgctgaaagtcgccggtgtagcctgacactggcccttatactgtagatctgccgctgaggctaagtgctacgaccgctactcatctctccaaatggattcatgcgattcgtactaaaaccaaaccttatattccttgcatcattaccgaagtcctcaaatattttgtcgatctttcgccactatgacccgtcgacagggtgtctcaacatcccgtcttgtttacgttcttctacgtgccagcgcatcattcaagcatgcgctttagtcttgtacaaatgtctcagacgtggtattatagggaaataccacatcaccttagcaggaactctcttctttgaaggttgtcggttaacttcatcggggtcatctcgtctaatcttgtatcgtgatgcattacaaaccgggcatgcttcgaggttctcgaactactcaccgcgatagaggatataatcgttcggacatgcatgtatcttctagatttctagtcctagagggcagactaccttttaagcttcatacgttgtttccgacaattcgtttccctccagaagaatattctttacgagtttcaataacttgccaaatgccttgtcagtaacgccattattttgccttccattgcagcaattccagcgtggtacccaaccttttgtgccccctgttcgtaacctgtgtacaataacgttttgtggtccactaacatacgctccaatttttggacctccttttcactttcgcagtctttctttacgtcgcacaatatctgacctagatcatccgcaccgttgttttcttcaacagctccacccccatcgcctgttgtatctgcaaatccaccgtattgagcccagtctggaacgttgtcattttcttcatcatcttcttccattgcaatcccaaagtctctatgcaaggtccaacaattatagctaggtatgaattctgattgcaataagtgggtatgaagagtccttgatgcaaaatactctttctagttttgtactttttgcatggacaatatataaaaccttaggcctgtgggcattggccacataaaaaataatgtacaccatcaacaaactccttcgatcgtctatccgcggtatgccggtatacatccattgccaattcatctacatcaaataaacaaatgttaaggaaatccacgaaagtgaaaataattaaataatcatataatatttaaaacatcataattaaactcacaactgaagtcacaaatctctctgactatttctttaagaaaattgtaaatatgcttttccatgtattatccttttaaaaaaacattttacaagtttttaaaaaaatgaaaacatatttttaatgattttttcttatttctaactattttaatgtgttaaaaatggacttagttttctattttttttcttcattttctacaattttcctttgttttatttttttaaaacatttttatcaaatgtgtcttattttctccaaatatttttctctccctctttttccatatacttttttgagagataatgacatataaaaacatagctagaaatgtaatatgctaatcatacatcaatacagaataaaattgctaacctttcatatcccttcgatttgtgtaatatcaccaaattattttcacgaaaaattttggcaacacctcctttccttctccaacctcttggcagcaatgacacgggccgaaggaggaagaaggcatataatttttagtactggttggtgttaccaaccgataataaagatcatatagtatcagttggtaacaaaagagcccagggtgcttaacatggtagtactgacaaagttcaaccgggactaaaaacaatctttagtatcggttggtgttactaaccagtactaaagattgtattgtgtcgtgagggttattaaatagtactaaagacggcatctttagtctcgattggtaatagaatcgagagatttgtatttttgggaaccacaataaaagatcagttctccggtagggaatgcgggacacaggcactatgcaaacgccaccacgtggcaaagcatatgacatgatatatagaaacattaattaccctctattgatacatgtactctctccatttcatattataagattttctagcattgcccacattcatatatatgtcaatgctagaacactactacatgaaagattttcttggacactagacccttttgtttccaggcggaccataagtgcaaccgcacatgaaaatgagggaagggcgtcgggccatcgcccacacaggaaaatcatttttcgtgtgcggatcacttaacagacccgcacaggaagataagcctattttcgcgtgcggttgttaagtcaaccacacaggaaaatagcccaccccaagtgctgcccatcatcccatcttcctcttatcctcctctccatcctcccatcacgcgcgcgcctcactcatttatggtcctccccatcctacctatcctcactgtccctctcctcctccccatcctcccatctccctctccctgtccctctcctccccggcaacggcggtgccctcggttagggcggcgaaggtggtggcatcggcgggcgtggaggcggcggcatcggctacggtgttggcggcggagcggatctgtctccggccgccgcgtaaaggccagatccgttgccagccgccgcgggaaggcaagatccgtggcccgccgccgctgggaggccggatccgtggcctgccaccacggggatgtcggatccgtcgcctgccaccacgaggaggctggatccgttgccggcgaccgcggggacgacggcggcaggcctcaggcaaggtggcgatgacgatgacaggcctcgggcaaggcaacgatgatggtggtggccgtggtattgacggcggctaggttagggcttgcgggtggattttgattttttttgtttcagttttttatttttcccatgcgggcggccaaagcgcccacacgcgaaaatcgatttccgtgtgcgggggcgtcacccgcacaaaaaccaggatttttgcaaacgttgccttccagacgggtggaagctccacatgtgaaaatcaattccacccgcacggaaaaatctttcatgtagtagtggaaagtcttataatatgaaacggaggaagtacctatcatgtgtttacatgattcacgtccattaattaccctctattgatatatgtacctgtcatgcgttacatgattcacgtgtgtatgaacacgggagaccaaattaagttggcagtttgtcctttttacatcatctgctgctcccagttaaatgcaaaatagttcgtttgaaaaccgcttgagattgaaatatctgtaatggcatacatttatatcttttagataatgacatacatcctctcttactataaagttacaattaatccactaaatcctaaagcttaccatataaaaatgtcacattattatccactaacaatatgccaaatcaccatccactaataattactctctcggttccatgatataaggcacaactattttttttggatgttccataatataaggcatatatgcatgtataaaattaatcaggacctcttctccattaaattattactttttaaatcctccaccctcaagatctctaattctattggatgcatgcattatatttattagggtgattcaaactaggatatgataataattattttttggtctttgcgttaaaggtggtcgtgccttatattttggaacggagggtgtattatatttaaacatcatacaagcatgctatattatctatagttttatattttattaaattttagagcttttaaaatgcaaacatgctaaatcgttattccacataattcacataatattttaatatatatatttattattttttataatatcatatatacctgtatagttcattctcacttagttaatgttgtttctctcttctcttattaagcaatattacattaattgtttttagtccttagatgattaattaatctatgatccaaattatatatcttcttttttctctcattaagccatatcacctcaattgtttatagctgttagatgattaatctatatggtccaaactatctccttcgttttgttctcataaagccacatcactttacttttatatttatatttgaatcattattctatatactatttaaatttaaattatcataaaccacatcaacttacataagcttatattatcttgctatcttatatattatttttacttattgttattatactaaaattttataacaacacgcggagtttcacctaatttatatagattcggaatatgtgttcacatagataaacggcatgcatgccattgatcatcttttattaatatttatgcgggtgacactgggtagaaagcagtgcccaacataattattcagagatttatataccatcaaggtattctatcttacctaggatattttaaccactacttcatataccacacactactacaaaacatcacaacagtgccgccaatcactgcaggttagttaaaaaccgacgctctctataaatcaatgactgttaattagactgtaaaaaaaacacagggatcaaatgagagagacatagacttaaaggaaaattttcaagagataaaatgcacgagaacacatgcatgtttcctagtttttaagaaaattgacgcaaagttacttttgcgaaagctgaatgcttcaaaaaaaaccaaacggccaggttaatatagttaatttaggaaaaatgatgccatattaatgacttaaaatgaccagtaaaccttttattgtaacagcagttgcttcctaacaaaccaatcatacagcacagccacgccagtagacccagccaacattgaagagcttgccgatgatcctcccaagaacaccagtggtggcagtgggaccagcgtgttatcccgacgagctaccttgacagtgacctatggctgtgtttagttgagggggaagtttggattttggttaaaattgaagatgatgtgactgaaaagttgtatgtgtatgatgggttgatgtgacggaaaaggactgaagtttaaagtttagatccaaattttgaatctaaacacagcctatatatcattggaaggcgttggtcagcacaacataggtcacctcagctgggccataccatgtgatgaccgtctcgactatggcactgttgtagtcggtgaagtcacaggtgcaggtattgcagaatatctccccaacgttatcttcctcatcgtcatcttcttcttcttggctaccgtcatggagattgatcaggtcaatgccgacatacaccgagatggcaaaagatgggccagttagcacgaggttcccctgttttgagagaaaacataacccaattaaaagtggtttaagcattcttcgaaagcataaaatttacataattttcacaaaaattatattgaatcccatgaaaatattttcgagagttaatttcagtttggacccttcttatcgaggtttaacattggaccttatttactccataatttcaccttggacacctttattttacccttagtttttcctctgtactcccttttattcatactcaagatttgtctcagtgtgctacaattatctgcaccttggtcatacttcacactcatcttgtctcgttacgtccggaaaaatacaaccatttttttaaacgcttattgtattaatccctgtcccatgaacacgccaaattcctcgctgttctactgctgcctttctttgtttcctctgtttcttctcatcttcttactctccaagtcttccaaatcgccgtcgttgcggcagagctcctcggtgcactagctctaattttgattgcctccggttagttttatggtgatgattcactcggcttcttctttatggactgctcgttgctgctgattgatctacagtgctgcttgatcaccatcgatactgtaagtatcatgtattcaacatgttcttctactaatctccaggcatgagttgcatcgatctagttaattagtgattattgcattttctataatttagtatatgtgcaaaagctatgcagggtactgttcatgtagattatatataatatcattgcaggagcctaattatcgactcacttccaattatgtccgatgttctatgcattgcatgcaacgcaattgtttaccaactagtgggaagctctgcagtattttcattcatggattcttctattgactacttttgttattgcagcagtagattacgttcttaattttgttaaggtcattcgcgatgatattaattcatgagctccgtttgatgcgtgtatggcatgtttgattcgatcatttcaataagctgcttaaaaattgattttttttagacacaccccctttattttttttcaaacgggccgaaaaaagacccatacgtacaaagattttcgaggtggccagcaaatacctgtatgtgaaaattaattttcgtgtgcgaaccttgtgatatgttcgcatgcacaaataggtaaattgctttatttgtgtagacaggcctgttaagaggcgtgcctagtaaaaaatcaaccgctcaatcctctccccctcttcttttctctcctctctttaaaaaaaaaaatctaattccccacttctctcctctcatctcctcctttttcaccagccccctcctccaccggctggccacgggagcagcaacaacggtcgtgatgaaggcagcgacaagagcggccacgacgcccggagggacaacgatgtgagccgcggaacaggcttgagctggcataaatggacccacgatggccggatccaacggcggtggccttgccacagttggatccagcggagatggcctaggatgacaacctcaacaatgacgatgaccccgactgtttgcgcgtaatggtagcgggagcagccaccgagcgccttggcagctcctcctccactaccactggcaggcttgcaaaggccggatccggcgctggcgggctcgcgacagccggatcctgagaaggtggccccgggtcgatgattccgattgctagcagcggtggtggctagggtttcttgaccggagggcatggatcgatggcggcatcccctagatctagtgagaggggaaggaagcagtggagagggcttcggatccaacggtggggtcgtcgtgttcaccccgatgaaccctgtttgacagtgacccatccttcgacgacgttggtcagcactgcgtaggtcacctaagcggggccatatagcctcgattatggccatgttgtagtcagtgaagagaccgttgcatgtattgcagattatctccacctcgttctcatcattatcttcattttgttcgctaccgtcatggagacaatgggtacagataacaggggcatatgccaaggtggcaaacaatggactggttagcatgatgctgccctgttttgagagagaaaaaataatccaattgaacctagaatatgcattatttgaaagcatcaattttacaagatttttaaaaaatatatcaaatcccacaaaaataattttaagagtgaaaattcagtctggactccttactgaagttccatgttacaccccctttagcccatactagaaaattggctgccggttggctcgccttgtagctagcccgtccatatggctttaaaaaaatcatttaatcaatatagcctcttatattgctacatcgatttctattttgttgtaacctatagcaggtagtatttttccttgtcatatgctaatcaccatctattacatatatgcaggtaattttcagggcaacgcactggctccggttttaggcaagctacaaagatgtgagtatgatggggagttcctaaaggttgcatgccgcaggttggagtcaatgcttatgtaactatttgctaattatgggtgaaggttaacaaatagacttcaataaatgtgttcttcttaaatgtgttcttcttattttggctaggttacctttgtttactcgtttctggggtgctactttgtaataattggatgtaactctttttaagcaaatgctgggatgatatattctattatcttaaaaaaatgcatattggctctgcgctagcttgttgcaacccgcagggaatggggttagaccggctgtgctgtgctcgggtggagcatgctaaggtatagctttgtaaaaaaagaaaaaaaaaagtacgaattacccaattacagtactagactattttaaccctaaattttttaaactggataaattacctcctataactcagctcgaagcggttttaatcttagtctcgaagcggttttaatcccacaggcacacaagtggcagtctaatcgataaaaataataaaaaatagtgggccccgcttatcagcatcttctctcttttgctttcttccacctccttcccctcccatccatctctctctccagtcaccaaggagcactgagtaatggcagcaacggcatcaccaacgcgggaggagaggagcagcaggtagcgtgcgtcttgcagcctcaacggcacgcgctaggggtggcggaggacggcgcgacagtctaggcgagggcggcggcagcattcccggcggcaggcggcaatggtgtgcgagacgagggcggcgaaacgggatgcggcctcggcttccatcaacacgcgggagctagggcgagctccggcgctgaacctctccggtaaccggctcaccggcgagttactggaggggttcttctcgctggcgctgctcgagaaggtggatctctccgggatgccggcgagcgccttcctcggcacgacgctctgcggcgccctgctcgccccgtgcgccaaccccgcgctgctgccgtcatcgctcgggaacagcaagggcggagggaagctcacccgtggcgcggtcatcggcatcatcctcgacgtcgtggctgtgctcatcgtcatgcttgttgggaatagtcccacgttgaaagtttagggggagtgacaccaacttaaaaaggggaggggtccctcacctcatgagctagcttttggggtgtagaaaggctttctcccggttgggccaacatctcccggttttgggccaacaagtggtatcagagctgggcccacaatctctctaagtgccgtgcacactcgtgtggtgtaagcccgaagcccagtggaccgcgggtgtgaggcccgtatgtgcctatgtgttgggccagtcagtggaccgcgggtgtgaggcctgtatgtgctcgtgtgtggagcctggtcagggctaaggggcaccaatgtgtgacgggagagattgttgggaatagtcccacattgaaagtttagggggagtggcaccaacttaaaaacgggaggggtccctcacctcatgagctagcttttggggtgtagaaaggctttctcccggttttgagccaacaatgctcgccgtggggtacttggcatgcttccggcgctgagcagagcaacggctggtcggagcaccaccaccgcagcggccacccccgacatgacggagcccatcacggtgaccgtggcgaggacggacagcgagacaaggacgtcgccgtcaagcagtcagcagtcgcactcgctggcgatgatgacaggcgaaggcaacaagctggtgttcctcgacagcgtgccggagcggccgtacgacctggacacgctgctgcgcgcgtcggtcgaggtgatgcttgcgcgggtggtcgattacgaggagtgcggcggcggcggcggcagcagcgaggtggtggtttgctctggtggtggagagaggtaggaggggagtgacctgatagtgggccccaccgacttttttaaatgaattgatgactggactgccacgcatataccacgtaggaccgaaaccactccggattgagttaagagggttatttgtccggttttaatagttgagggtctaaaaggtctggttttcgagttcgagggggtaattcagtcgtctacgatagttcaagaggtaattcgtactttttcctaaaaatacaacgctatgtttgtacattgacttagcataatatcgttgcacgcatcatggtattgataggatcatcacttcaaatgagttcacgcgcgatttgaaattattaccttcccatatatatgattgatgtagcattattatttaactttactttttctccattttcttttttactatagcccttttgtgccttcagtatttttgagttagtttataattttctttggagatagcagtgctgttattttattggtgtttcaaagtttggtagggtaataaacctttgttacatagttgtacaatgtatgtatttgattttttttttagaaagtggctaagtccataccagtttgtttattagattatatatgctcagatttttgtaataaaaaatagtcgtgacatccttttaaatataaaattttataattttacacttagctttctttacaacatgtaggagtgaaatagagcaagaaaagaataataaggaagatagagggaaaaaaaaagaaaggggggggggggcaaggcaggcccaagacaaacaggcccagcacccgtctcctacctgttgggccaggcgagctgaagcccacgccccagcagcagccagtttggctctagtgcgggcgtagcgcgagcgtttgatgaagcggtagcacgcgttgcgcaactattggtgccacgtggcgcataattttgcaagagaacccgtcaattttagaatattagatttttatttttgttttttatacattttttttgtttcactttgaactcctttttacctaatcctcaatgttactctccgtgtgacaacgtaaactgcactctggtgctcatctcgaccatgccgttgcattgatgtcctttgcatacccaaagacggcagggttcaggaaaatgggactaaagtgaatcaagaagatgtttaaaaagggtgtccaaagtgaaaatatgctaaaccaaatcgaaacttgggttaaatactaaagttaatctatttctttcttgattaatatgaatgctagttgcaaatatacgagttcaaaatttttgagtttttcatttgcactataataagaaaaaaagcaatgtacttgtatgtagcaccaataattattggtccggaacaaattaaggagctacacaaatcctgaattgctcattcgccattactagtcacgggaatattaggccctgttcatattatagccaaaataaaacttaccaaattttagcaatgccaaaattttgacaagatggtaatattgttaaaattttggcaggatttcttatgtatttaacaaatttagcgacaacctaaacatagatatttttttgacagcttaaaaaaaaagggtatggttgaaaatggcattaaagtgaacaggcccttagtcttgagactcttgtgtaggtttagactctgttgtacagttttagctaaggcccagtttagtttccacaaaaaaaacttttcaccatgttaaatcgaatgtttgcaactcttgtgtaggtttatcttgtgtaggtttagactctgttgtacagttttggctaaaacccaatttagttcccacgcaaaaattttcaccatgtcaaatcgaatgtttggacacatgcatagagtattaaatatagacaataaaaaataattacaaagatttgcgtgtaaaattgcgagacgaatcttttaagcctaattgctccatgatttgataatgtggtgctagagtaaacatttgctaatgacagattaattaggcttaataaattcgtctcgcagtttacaggcggaatctgtaatttgttttgttattagtctatgtttaatacttcaaatgtgtatccgtatattcgatgtgacacgccaaaacttttcgtctcacgatctaaacacagcctaaattcagagtatgaaacaaagtctgatggtttacgcaggaaagctgatttatgagtcagattctagaattgtggaatacgatgggagtcttacacaggggcggaacccaatggaccaagggggtgcccaggaacccggcccaaaatctaaaataccttgttaccctcgtacctagggaaaagtacacccaaggccccttaacttgtcatcgagatacaaaatcgtcccccaatcataaaaccagataccgggcgtctctcaactaacaaaaccattcgctttaggtttctcggtggttttgacccggttttatcccacgtggcggctgagtcagcgtgggacccacgtgggtcccacatgtcaggctatccatgtcagcctcctctctctctctttcccatccttccccttcctcatctctctctctcatttttctcctcttgtccgacggagcaagcgagccatcgctcggcggcgacgatgcgggagaaggggagtgcgttaccgatgcagtgggcacggcaggcccggcgggggaggagcgcggcggtggctcctggaaaacacggcctcgagctcactcccacgcgcttcaaccgcgcgtgccggtcccaggaggctgtcgtctccgatgatggcgacaacggcgacgatggagacgcgctaccaccgccgacaacgacggagccgctccgacgatctaccaccgacagcaacgacggagccgcgcccgcgcgctcctgattcctaaaggcggtgcctgcttccgcgcttcgtcgcccgtcacctgattcaagaaccgatggctgcggcgacggcagccgtgcagcagctggccgcggacggtgaaggtgacggcgtaggcgcccacgccacgggcccgcgcgtagccgtcggcggcgtaaccggcgttgagctcgttgcagcagccaacgatgtggaggccgggctcggcgatgaggtggttgagaatcgtgaggttcaagtccccgggcacggcgaagacgtcgctgacgcccacctgcacgaggcggtgtgccaagtggcggccgagtgtggtgtcgccggaggcagcggacggcaccaccgcctccttaggagatcctcctccgccggtggtctccattgtccttgttatcgatcgatcttaattactccgcatgcgggcgtatatatatgcatgatgaagagatgatgtgcgtggtggctgttgtaaatatgtggttgtcgatcgatcttaattactttgcatgcgggatttttcgccgccgctgtcctcatccgctcccgctgctcctttgatggtgcccgcgatgacggtaccggccctaggaggttgtcgccgacggcggtggcggcaacgacgacgaagacgcaccaacgcgctacatccgctgtcgccgctgacgaagccgctcctgggcagacgtgctaccgccgccgccgccgacgcgcggacgcgctactgccgctgctgccgatgcgctacagtcgtcgccgccgacggaaccgctcctgggcagacgcgcttccgccaccgccgtcgacagagccgacgactcatctgggtgtgtgtaggagagaggaagagaggaggaagggagaggaggctaacatggatagtttgacatgtagggcccacgtgggtcctacgctgactcagccgccacgtcagacaaaaccaggatcaaaaccaccgagagacctaaagtgaacggttttatcagttgagggacgcccggtatcagattttgcgtttggaggatgattttatatctcgatgacaagttgagggaccttggatgcactttttcctcatacctacagcatagaggcaccacaccctcctctcgtccggcccaaatttgaaaggcccaaccagaagaaagccccaaaaccaaaacgattttgctatatctcactcggaagattttttcttatctctcactcgattttctcacttaaatttacagtgcattttcttgtaagttacagtgtaatttatgaaacttacactgtaacttttgtaagttacactgtaatttttgaatcttcacatgtaaattttaaattttgtattggatttggtctttttctcgaggatatggtaatttaatgttcattatggtgtttcttaattgctttttgctttttattatatctatcggattttaatacaaatattaaaaatctgtgtgatacgattataaaaatcttttgaaagatgtataggtactcccaaaccaaaaattaagcagtgggagaaactgaaacgtccaacgacgcttcccctcgaagcctcgcgtgataccgaagcggtagtttcgattttctcgcctgagtcgcctcaacgcccaatctctctcctcgcattcgtctgacctgtcacctctccccgggaggtcgcccttttctcgccgcctcaccggggacccagcccggcagccccaatcgaagaaatttctcatgtgtaaagcactaaagcctttccctggtaggtttgcctcccttttccaaaattttgcactgattaggctagcttagggcttgcaactatagaggcatatagagatagatgacgggggcaggaggaggatgactggaggaggacggcggcaagctgcaagctagcaacggccaatagctggagcttgccggctggccgctcaccctagcttatcgatctactctgagccccacaaaaattgcagccagcagcactagctgagagcaactgaataagtgaactctttctctcaatttttcttatccttagtttgtagttttgtgccaaaataaacttgaaaatttttatttggtcttaatagattgctatatagcactggatagtacgaacaatatgaagaaatttgttttaatttgtaccaaatcatttcataacttattctcggttgaaaattaaactatattttcaaggtcattatcctatggaggaatgaagacggtgacattcgcatgatatattcatattattagttgatttcttcattatggtacgtattttttatttttttatgtatttcttgtggtatattcccttcaaatgaagaaataatgcttatatttatttattggtatgcaactatttagtataatatcgctctataattatagatgttagtattacataaataaaggtaggaatccctcgtcttttctctagctccgcccctagtcttacatgggtgtcgcagggcggtgggtaggtggagtcgtcagtacggctgcggctgtagatgacgtcgttgcagaagctgatggtgccgcagggcggcggcgcccgcgaagatctccgcagttggtcgtacgcggccagatcgtcgccggtcggggcgtcgctgtaccccgtcgccgccgccatgaatgagagatcgaatactctcgtcgatcgatcggcacccgcccaccgattaccgaatgtatcggggacagtctgcactgagcgaatagtatcaaatcagtgggtagagaaagacgcaaacggaaatcaaaaccagaaggagaagaatcaaggaggaggaagctggagtggaggaggagatcgatcgtcgaaccttgcggcgccggagcaccgatcaccgctgtcgggcgtggagtagcactctaggagagaactagacaaaaaggaaggagagaagatcgaacgactactcgacgaggattgccgggatgcggcgggccggggagcagcgtggaggctggatccgggcatgacgacgacctctctctaggccgcaccgccgtgtgcgtgtgcccctcctccccgagccgccccggccccgccgcgtgcctccgccacgatggaaaatttttaatgtgttttttctacttttgtatttttcaaaagaatttctcaaggaaatagtccaaatatcaccttagactttggacgaaattccatctagaatcatgagttttaaaacccgatatctaaccccctaaattttatattaccctctaagatgattttggatggtggtttttcatattttgaaagcttacatgaacaactttgaataactaatataatatatttgcataccatcaattgtaagtcaccaatttatactcatacagtgatactatattattattatacactggttcttatttataaatgtgagctaacgagtgataaaaagaaagatttaattaagtggagattttaatatatatatgtccaatttgtatatcacatgatcaaattcatccaagttatatacaaattagataaaaatcactaaacaaaatcaccttaggggataatatgaacgattttgcaaagtttagggagttgaatttctagttttaaagttcaggatgatggatggatttctatctaaggtttatggggggtatttggattttcttcatttttccaataatgcattctaaaagggccctgacagaacaaaatgattctctgataaaatttcattttaattttcctagatggaaatcacacgaaccactgttttcaaaggttcgataatacaagttgcaaatgcccacggtaataccattgtcttcttccaattaattaatgtcgatcagtatatagtcaactgcattatatatatgcctcacgtctgcaaaagggacgtgtgtattaccttctcccacagcgcgcacagtaagcagcaaccaacaagcacgctggcacacagtagatagctagatgagattattacttcaatttattcgttgcgcatataattaagaagaaaccaagatcattctgtactgctgccaatttatagctagtcagtccggtgtccatagacgcaagctctactgctgttgctcgatcgaccggtgtttgcaattatcatgagcctggtcaagaagtaagtttttaatttgttcactttattgcctatttcattatctacagattagtgaaatactccttccgtccaaaataaaaacacactaatctccttccgtccaaaataaaaacatatagtatagattaatggacaaagagtttttcagatttgttgtattagtaggggtcatatttcgattattttttattttcggatggagggagtacacatttatggcatagtttagatctaaagtttggatacaaacttcagtcctttaccatcacatcaacctgtcatatacatacaacttttcagtcacatcatctccaattttaaccaaaatccaaactttgcgctgaactaaacacagcctatagagagcgagatagcccgcaaaattgatcgactctatgccgctgaattgacaatctcattccaagtttcccacacgatttctgaggaattgtccgtggtacggcgttttttgaaccagaaaaggtccgcaaaacgaagttaattaagacaaacatatagtacgatctatattttgctccagatctccgatgttttagagaaaatatagttttatatatactcaatatcgtaatcatattctcttgagctatcccaacgcaattgtaaaagcgtgcgttgctaattgctctaggactgcaggatttctcacataatttcactgatatatcactactacgaaaccggtttttgcaaacgggcgaaaaacatttttgtatgtggttggaccagccgcatgcatgaaaagatcagcgaaagtcacgatttttgcatccggctagggcaaccacatgcgaaaatcgctattttcgcatgcggttgcttacataggccgcatgcaagaataaaaatccaaaaaaaataaaatcgcaaaaaaaaaatcacgtcggccgcgcaccggcgtcgtgccctccgctcccaccgtcgtgggagccaccactgcccgctcccaccgccgtccactccagccatcggatctgtgcaggacaaggcccgccgccgccggatctgggtgggaggaggcccaccgctgctgctcccaccggcgtcgtggaagccgctcccaccggcgtcgccgctagccgctcccgctgccagacctgggcgggaggaggccgtgcgcccgccgtcgaccgctattgccacctcctcctcctcctcgtcgacggttgcagcatcgggggggaatggagccggtcgccttctcgtcgttgtcggcggcggcggtgagttggggatggcggttgcgccgccgcccactcactggatccgccgcctccgttgcgcgcctgccgtagccatagccggagctggccctcctgagggtggcgccgccggatgcgctgtccgtcgacgccatcgccgcccagcctgctcctggccgccagcgcccactctcggagagggagagggagaggatagaagaaagagagagagaggagaggagagaaagagagaggggagagtaaaataatagaggggtagagagaggaaatgagttagaaaaaaattgaagtggtgagagggaaaagagagtggagggatatgaaaaaaataggggtggcatttttgcatacgggtatcttaagtggtccgcaattttacatgcggacaacttaagcgttcgcatgcaaaaatcatgcggctttctaaacttcgaatcgaattttataatactaaatgaactcatgtgaaaaaattgtcaaaaataaagctgcaaaactcattgagatctgccaatttgcttttggtcatttctccatccgaatttgattgcactatataaaatttgaattttaaaatataagaaattcaaataatttttcagctagtaaatgatttcaaacggaaaaattgtcaacaataaagttgtataaagcatcaagatctacaacttttgttttggtcatttttctatatgactttgtttcaataatttgaatttgaattttaaattatgacaacttcaaataatatttcaaatactaaataatttcaactgaaaaagtcatcaacaacaaaaacaacaaagttgtataagtcatcaagacctataacttttattttagtcatttcttcatccgacaaagttataataatattgttcaccaatttaacatatatctcatatggttttataaattataagagagatatgtaaattttttgaacaatgttactatcactttgtcggatgaagaaatggctaaaattaaaattttatatcttgatgagttctacaacttttatgttcatgactttttcagctgaaattatctactacttcaaaatattatttgaagttgtcatctttttaaattcaaaattttaattgataaaacaaagtcacaagaaaaaatggccaaaataatagcattaagaacacaataacatgatagagcatgattttaaaaatatttaggaaaaaaccatccaatttggagttcatatgagtaagataaactagtttcaaaatttcaaattttattttcgcatattttcaaattttattttcgtatatggccccttcaggaaaatcgatttttccatatgggcgtcttaaggagccatatgcgaaaatgccgctcgatttttccagacacggtaagttatggtccgtttgcaaatatcgtgagatctcgtacacaaaaatcgtttgtggactagtgtatagagctgttttaaagcgtcagaacacacgaatttgtactccgtaactcattaagtcataggttaaaaaacactcatttgtagtgttacaaagtactccctttgccctataaaaatccaatcatgtatatgtctatatttaaacgcaggattgggtttttacggaacaagggagtacgttgtaactatattctttacaaatgaaaaaaaataatgcaaaaccatatatgtagcgcaaacttaaatattactgtagattccagaaaagcatgtctgagacttatcaacgtcattatgagtacaacaagtagggatacaatttataaataacataatatcggaataaaaaatattaatttttcagaaaaacacaatccatctagaaacacaatgatgacaaatgacaataaaaaagggagaagcaagagggccgcgaaggagcagggcgacagtggttgatgtgacatctaaaaatataaataaacatcaaatagaatcccaatgatgattaagaggagggacgacagccaggacattaggcatctgttaagccgatggttggcggaacttctataaagtaaaaaataaaccacaatgataatcaccatgatttttaaaatctcaatgacaataaaaaggaagggcaacaagtgtaaaaactataaacaaaactccaaataaaatactagtgatgattaataggagagatgacgggcaactcgttaagcatcacaatcacggtggttggcgagacttttagaaagtaaaaataaaccacaatataatcacatttgattttaaaatattcaatgataattaaaaaaaagtatcgtgcagggtgtagaggacttctagatgacggtttggcaggacttctataaagttaaaagtgaacaccgatactaattatgttcgagtttcaaaatctcaatgacgataaagaaaggaaacggacggacagtagaggagtagagtggcggcatttgacgggacttctaaaaattataaaaatgaaagccaacaagatatttaactctaaaatttataaggtgcaattttaaatttccaaggaggacgaatagaagccgtaatagatcgagcatgcaaataaatgggtgacaaaggagtaagaggtagtgataggtgtgacttttaaaaactacaaaattagaaatatggagatgataaggttcagtcttttaaagtccgaaaataatgagataaccatttaacaaattttaagtgaactcatatgtaaataattttgtatggatacttgtcgtgcgattgcgtgggccacctagctagttcttattttatcttatagtaattatcaggtttatactacatattttcccacaaagaattcatttaacacttgatatgtgtgtatacacctatagtaaaacaaccagtgaataatacagaactgtaggcaaataatacaaataatttgtaaaattatgattgttttgtccctatcataatttgttactaaaaccagacatagtggttaagtgactagacacaggaccactaccaaaaaaaaaaaaacctcatcggtactgcccaagaagacccatcagtgctggttccctgcctggcacaaccatttgggcaccaatgcacgccgttcggggtattttgctatgttaagatgccattcggactgataaccgcagggaatattttccagcgcacggtccagggcgcacttagcgaccagctcggcaacaatgtcgaggcatacgtcgacgacatcgttgtcaagaccaagacaagcgactaattgattgacgatctgcgggaaacgttcgacaacctccgacgatatcgcctcatgctcaatccagagaagtgcacgttcggagtaccgtcgggcaagctgctcggtttccttgtctctagcagaggaatagaagcaaatcccgagaagatcaaggcaatcgagaacatgaagtcgcccacaagactcaaggaagtacaaaaactaaccggatgcatggcagcactaagcaggtttgttgccaggatgggagaacgaggacaacccttcttcactctgctgaagaagcaagacaaatttgtatggacacaggaagccgaagaggcattcgttgcactcaagcgctacctatcaaacccccctgtacttgttgctccccaacctaatgaagaattattcctctatattgccgccacgtcatattccgttagcaccgtcattgttgtcgagagagagaaagtacaacgaccagtctattacgtcagcgaagctctccacgacgcaaagacaagatatccacagatccaaaagctgctttacgctgtaatcatgacatcaaggaagctacaccactactttcaagcccacatagtcacagttgtctcctccttccctctcagtgaagttgtgagaaacaaagacgttgtcggccgcattgcgaaatgggtagtcgagctgaaacaacttctgacgtgtcattcagcctcaatcggccaactcatagattcccctccacctcagcacatttggttgcttcaccaagcacggaaagccaaaatatgatacctgttcctcatcaaaactattactctaggctcacacaatttcgtgtcccgtgccctccgggaagagagaaaggaccaaaggaggagaggcatccacaccaccgagctcgtcgaaaagagagagaaagaggaccgggctagcgctggcgacacagccaccgcggacaagaaccggaaggggtgaagaagggaggagggggaaaggggagctcgacgtcgatccacgccgccgcttaagcctcaccgccgccgccattgttgggggtggaggagagggcgccgacgaagacaggaggggggagagggagaggagctctcggtcaacccgtggtgccggtggaagaggaggaggggaggcgcggcagccggatgaggaggggaggcacagcggaggtggtgctccacccccgacggcgccggctaacctcgtcgtccaacgctactgtgccgccgagctccggtgaggaggaggggggtggtgtgccggcgagcactaggccccaccgcctggctctctatggtagggaaaactgggaaaggaagaggggagagagggggaggggaaaagtgaaaagtaaagtagtagtggtgggacccactataaacatcttgcattgtagaacatgtggctaacattgtttttggtctaggtggcatgcgaagtccaccaaagcttcgtgacacactatgaaagcccttagtaccggtttagaaattggcattgatgcgcatgtacgagcaaaaaagaatatgaagcggcggctccaagaatcggctctagccgattcttcgagcccgcccccatgatccacgttttcaaattcatatcccttaatcaatccccttcgacaacaagaacactcaatcccagattgatcaaccggaagattaactataaatcaatcacaagcaagaacatgaagagggtctggacattcctcaaacaagagtgaaaaattataaatattaatttataaaggtgaggctgaggatctgtacaccggagaaaaagagggcaacaactgctagtctgctaccacctctccctagggtttatcttatcgtttgggccggggttaccgtcactccgtggtagctcgataactgtgataatcacgcggtgaccgcctataatcgcacaaaaatcacttccaaaaaattgaattcaaaactctatggtttcgcggtttcaccgcggttaccgcacggtttaccgcgatatgtgggatgtgggatttgaactcaagatctctcacctcaggcctcacgcgtgttgccatcatacctactacacacatctagcttggataagatactttgttttttaattaaccctgaagacatctttagtactagttagtaacaccaatcggtactaaaatatcttaagttcagattgatgttacagtgctggttggtaacaccaacccgaactaaagatcctctagctttagtctcggttggtgtgttaacaaccggtgctaaaaatgtttctagggacttatacttttagaactggtagtaaagcatctttagcactgttttttaatctaatcaagatatttgtgttttgggggtgtaggatataaaagatcatttctctagtacttgtgtatgtatgttttttttttgacatattttctattcaaatttgtagtattagaatgtatatttgtttagatttatgatattaggatgtgacttattttatactaggttggtttattttgagattgagagaattaatatattagtatatgatatgcattgttttagtacttgttacactaattaaaattcctcgaccgaacgaaatcggcgtggcaaaataatcttggctagctaagtaataaatcggaggatggagagaacagtcgtcgttgagaatgtggactacaatatcatgacaagcaactacagtgatttcatcatcgacctccaaagcaggctcgctgagcatccagaacaggctaacttccacggccgtcccgtgctagcaaggcaatgccatcctaaacagccggcgagatggttgtacattaaccttgtgggcgagaacaacgatagggcaaccctagccgtccgggatgacaatgtctaccttattggcttcaggaacctgaacggaaaatggttccatttggggttctcgctgaggagcgttccgattcttccggaaccatccacgtttttggagtgcgacgtcacttatcgaagcttacttggtggaaatgtgaaagatgttctggtgagggtggacgtgcggaagatttctgtgatacatgccgtccatagactatcgggctacgcgcagcgtcgatgtggagtcgatggagccaccaaacgggatctagcacgcctgattgtcgtgatctgcgagtctgctaggatggctgcacactacaacacggtaaacgatggttggctcattcgcaacaggcaaattagactcgacctttggcacgtggattacctgtggaactgggggcttatgtcgtgggtggtgcagcagcagggagggaagatgtggcccatcaggcttataaactccggaatcaacagcataagtgaggcgctcgcagtactccaactgctgcttaacacggcgagaaggcctttgccagatctaccacgagcttcaccgccgccgccagtgctctatctgccacgtcaggcggcaccggcagtaccctgcccaccggcgcctccgttatggttgccatcgccatcggtgccgtcgtcattggcgttacatgtgcccctctttcatgcgtcctccttagaaagatggagtcctacagcattagctatggcgccgccgtcattgccgttacgtgtgccgttctttcatgcgtcctccgtagaagaaaagactcctgcagcatcaactgatggcgacgaaggatctaccgtcgactactgtgttggacgcttattagtggaggtgttggccgtgtggtccagctttgacagctgtaccatcgcagtatttgacgggaaacgcggccagatcatctacgagaaccaccgaggagatcacgatggcatccacgattctcaggtaaggaggacggagtatatatatatggactctctccgtcccataatataaaagattttgggtggatataacattcgtacattgaattttaacagatcgtctatttagatttattataccaagatatgttacatccatctaaaattttttatattataaaacggagggagtacgtttctagctatagtcttaccgttacttcttgtgaaaatgaaagatggcacattcgtggatgtgcatatactactccagccagtacttctctctgtcctaaaatacaataatttgaaactggattgaacatattttagtcgtaggttgtattttttttagaattaaatagtacaaagcagacactcacaacgcacgcacactcacgaatttgaaaagcttataagggtggtatactaaccgaataatacctattggattttaaaagtacgatttcttcatgaattttatccgttagcgttgcatgataaatttaattttgtcatttatagaattacctgctggagattgggttcaaaaattatggtatctagggcagctgactcttgaagttccattagaaaaatagaaaaatagagaaaacttatattgctataaaagacattagatatataaccatatataaattaaattacgcctgcttttttctttatcagaatttttagaattttctttaacttgttaagagaatatttaggagcattaatcacatatttgatttaattttaaattttttttgtgttgtttatcaatcataaaatccaggtactatttcttacttcgtgcatgcatgcctgccgggcatatgtaaattctggtctatgcaactgcaagcttgtcacacagagacataattaaccctaacgtggtatttgcctatttgatggggtcacgtcatgtaactggattgggatgaccaattttaaattttttttgtgttgtttatcaatcataaaattcagggactatttcttacgtccatgcctatatgcctgccggacatatgtaatttctggtctatgcaactacaagctatgcaactgcaagcttgtcacacagaggcataattaaccctaatttggtagtatttgcctatttgatggggtcacgtcatgtaggacatgggtggataggacatggcggcccattttttgtgggtgtttggttgctgggcaggggtgggatggggcggcccgaagaggaatattctcctcagatgctggatggggggatccgaccgatttgcccggatccagccgcccgagcgcccgggcaagctaggcaagcgagggaggcggtcgcgtcacccgcgagcgagggagggaggcggtcgccgggcgagctggccggcaggatgcgggcacggtggccggcgcgggtgcggcaacgggaagcgggagcggcggcagcaaggagaagagggggtggcggtgagcccgaaggcggcagcagcgggaggagggaaggagacgacggcggcaatgcgagttcggcggcggcgggaggcaagctcggcagcggcgcgggatgcgagctcgtcggcggcgggaggcgagctcggcagcgacgccagatgcgagcttagcagtggcgggaagaggagcgacggtgagcccggaggcggcgggagcagcgagctcggcggaggcaccggaggccttctcttttttttttcctatctccttctctctcttttttttttgggggaatttgtgatttgtagtatatatgaatttgatgaggggggtatgctcaccctttctaagtgagaggtgaccacacctgctcatccacctacttcctccaaccaaacaaaaaattggatcaccaaatccatcttcatccctacaaccaaataaaaaactggatcgccatatttacccaatcaaacaaaaaactgaatcgccctatccaacaaaatatggtccgccatatcccatccaacctatccaatcttgaccgtgaaccaaacacaccctagctggattcggatgaccggggtaggcccgagcacgggagaggagggtgggcctgggatgacacctttgactttttatgtatatgtttcatcatccgtctcaattttaaaaaatatatgtgattaattttttttcggggaatgtgattaatttatagatgaactatttttttcatatttatataaaatgtttgaatgagatggatggtcaaatatatatagaaaagttaaagttcacggtgtcaatctattaaaatcggaggaagtaataaaatgtataatgtgcaggtatagggatcacactatttttttatttgacaataaatcatagtccatgtgcaccttaaataattgattgaaatgtcatgatataaaaaaaagactaatcatcaaacaactcaacttataaaaagttattcctagacgatcacacatatattagctcatgtctccacatgcatgtaggcttgcatgagacacccgtaactgggagattaggctatctatccatggaatttttatttaaaatcagtaacaaaataatgatttagatcttaaccaccgtggagaaaaaaaggggagggaggagagacgcatacacaggcgcgtgaggggaggcgagggcaacgacgccgtacaacattggacccacacattcaaggaaaaatcatacgtggcagtctgagagcgtttttaaatcgccatatggtcgtttgagagcgtttttagaaagtttaatggaagaaaaatcatatgtggcagtctgagagcgtttttagatcgccatgtggccgcttgagagcgtttttaggaagtttaatagacttttagtatataatagaagataaatttagattcgttggattaggatatgtcttatccaattatagattgttatattttagtacggaggcagtatatgtgtagttgtgtgcacacgtgtgtgtattagaaaagtacttgttgattgactgaaactctgaaggtgctatatatacagggtaatttgatgctgactggaccgtacagggccatctcagccgacgggagcttcctgatcgaagttcataccaacaatgctggcgatgttgatggtacgctgttttgggactgctacgacgaccgcaacgaccatgagcacgacataacattgactaacaccatcaacacaagccttggccccgttgaggtgacctacgcggtgctgaccgacgcagtggaggccaccgtgcaggtcaagctgctgcatgcttctcgccggatacagcaccgccacgcggtcgctgccaccatcttcgtctacggtgatatcaccgcgcgcagcgaatgcttcagcgtcgggagcgtgctcttcagccgtggctcgcagaacaaggtggcgctcacctcgggctccacccttcttccactgtcgcgatgcgttgttgcggtgccacttaacgaccaggtcgagatagaggtgaagctgtatgttggaacttccagcgaagagagtatcaattacacttttatccatcgtattctcgtgttctactcgggcggtgaacagctggcacaacaaatattcctccatggcaacccagcgattgaagtcacttggacaccgtacttctgaaggcaagttgaactatcaacctacttcaaattaacgttgtatgttccttcttaattacattttttggactcatatattagattgaccatatatatcatatatcttccaatatttaattttacagcgagtgctaaacagcataagttgacaaggagattaattatctgcagttacaactactacagtggctgcaaggacagccaactgcatccatccagaaaatatgttgggtcggtatatatctagatatctctcaattactctacatgactatgtgttccagtaaataaggctctttacataaacggaattgtttaaatacgacgatttcagtaaagaagcaggttagtgtgtgctctatatatgatctgtactagtacaatatatactatgtgctcctatacgttctgtgatttgtccaagatatttatcatacaggtgattaattgtgtgtcagtgtgtggttgtgaactcatattgtactagccacttagtcgtgcgttgcacgactttgaattcccatatgaaagccatgtatatatacatcgtaattaaatcaaaatcaccaatgatgagcgaattaaactcattaagatgagactgaatagatttaccttctgccatgcgaattgtgtacgggtgttatttgaggcataatttgttggcgagacttttcttcatgtatataaaaggcaggtgtataatcatgaaattatatgcttgaaatttgaatatttgcaagattgtatgacatgataattaaatctagaaagacctttatttccaactaaaaggttcaaacgttatattcaaaattgaccgtttactgttggttccaataaaaaaatgctcattttatgctcatactactgaagtgcttgttgagttcctagtatgtttttatgagctggggtaaaagaattaggcaagcacagcatctggcccctcgttggcttcttcccgatgtctctagactgtttgctctttttgtactgagcttctttcactagatcgtacggcatggactgaatttctgttgcatccaacggctcacattaagcagatccgacggtggtcgtttaccagcagttgtatcggacggtccctgttttatggatgacgtggcccaaccagattgcaagaaactttatttctttcaatactttagatccctcgaatagtttgattgttaactataatatacaagtatgtgactattgattgtcgaagctgctcctgtttaatttttacattaatgaaaatggattacatctccagcttctgttatgacacacaaccataaattttatagtaataaaaaaaggtaaagataaaagtaaatcaaaatgagaaataaagtgatgggacaaatctccaactcccctttactattgactagcgttaaatcacataaatttttttagttagcaattataatggaactacatcacccatagtggaataatagacccttggctaccgattcgaagagtgtagcaccattgcgcatagtatcctgctcctcctgtggtagcattttagaccaaaagtggagccagtaagaagacattaagataacctgcatagggttagataattggttaccattaaaaactttatcattacgacaacgccaaattgaccaacatacaacactagcttggaaatgctactgggcgagcgattgccctcgcccgcccagggcgatcagatccccctcctcctccccctccctccctccacctggtttccttttttggcgccgtattactttcctattttagtaaatttatacacctaaagtttatacacctcaagtttacacatctaaagtttagagaccaaaagtttatatatccgattcaaatttgaatttgaattcaaatattttttatatatagtatttctatacatctaaagtttatacacctaaaatttgtagacttaaagtttatagacctaaagtttatatatccgattcgaatttgaattcaaatatccgattcaaatttgaatttgaattcaaatattttttgtatatagtatttctatacatctaaagtttatacacctaaagtttatagatccaaagtttataagtcaaaagtttacatacccgattcaaatttgaatttgaattcaaattttttatacataattttttctaacttttgtttttttaaaaaaattttgtggtgtactgtaataggaagagaagaaggggaggaggaaggggagaagtgggaggagtggctatagggggaggggggcgggatccgatcgttgggcgatcgccctggcaatcgatcgcccaatagacccctccgcactagctcctattagaataatctttttaatggacctagatacccctctaagccaattaccaaaaatatttttggcgtcacggggtggagggatattaaagcaaaaaacacacatctctaaacaaaccgagcaacatgacactaaaaaaaagatgttggattgtcttttgtgcatagtagaatgaacaatgtttgtccccaagttttatttttgccaggttatctttcgctagaactactttcttgtgaagaaactacataaagaccttgatctttagtgaaatttttaagtcccactagaatttacagttcatgatcgcgccatacatagatttgattaaaatttggccattcttatggaacgaccatacaaaacagtccttttcatttgacagaataatattagctagcctgaggatcaaatcgttccactcgacgcgcgcgctgccgctgctgcacttcaccctctcgctgctcgccggcgaggacctcctcttcttgaccgccctccgcacccaccactccaccacgtcgtcgccgcccgccgtctccctctcccgctttgtctcatatggttcaatagaacctagaagatgagcgagggtcattcagtaaagtatctttttcaaatggtaaaaaatgataagagcaccactaatagtgattaacaaattgctctactttggagtgctctcagatgagtagctacagtaaatggtcatgagagcactaccaagggaagtccaaccatgagattgttacttggatctcatcaccacccattccaataacacgttgtacatgttgatcactagtctaaggttcaaattcgacggcagctctgacaatctcatcaccggaaaaagaacgcaagtccaaatcgatcgtcaacagcatcatatatagctggttctgcgaacgcacgccctgccaatgggatcaagtagagatggcaatgggggcccgttcaccgtttccccgcggtgaattcacctattaggtgacggggatggttaatatctactcaccatggggaataaaatggttaaaaccctctcaccatcggggatgacggggacggtgaaccattaaccgtccccgccccccacggtgacccgactgtactgtacaagggaggaattctagactttttagatgtattgacccacaatattgaagcccatttaacaggcacatatataatctaaccctaagtcaataggtcaaactccaaatcctccacccacccaaatccacaccagccaccactcccggccgagtcacgcgcgccgccggtcgccagtccgccgggagccgcgcgcgccgccgttcgccagccaccaccgacgccgccgggagccaccacgcatgccaccactcgctgccttctctcgccgggagactgaagccgccgtcgccatggactgaagccgtcgttgctggcctccttcgtcgatgcgccgccgggcctgcagccgtcttcaccgggagccgccggcagcctccgtcgacgcgccgccagcctgcagccgtcttcaccgggagccgtcgtcggcgcgccgccgagagccgccgtcgccgccgccatctgtcgaccatggcttcggcctctcccccgtaagctacgacagcgacgatgcaaggtgagcatactacaatccctaatcccttctctgtgcggggacgggttcaccacgaggaaaaattcaccgcgtggtgatcagggatggagaaattatagccccgtcgtggttgacgggggcggggacggtgaaatattttcaccacggtgacggggacgcaagcatgacccccgacggtgaattcaccgttgccatctctaggatcaacccgttcgatcctatatgtgtgccgctacttaagtcgctgtagaacaggacgcaaccaacatcgagaagcttgttgcgtgcgacaatcctcccaagaacgccggtgcttgcaatggagtctgttggcaactttttgtgacaagttaacaagcacaatcacaacactgtacctaaacgccttacggtgattgtagagtcaccaaccaccctaacccagcaagcactaggtcaagatgggttttgatagattaaaccagctagcagagccgatttagatgaaaactagggataactatccatctcgtaggcaaatggaaggttttcagaacaaacctacaaagaggtgtcgcactctcacagcggcagtggataatttacaacgcaaatcgacaaagatagacgaactaaactagaactaattgaaagtaaaaaagcaatattgaaaaaaacgattctattgattgatcgttggatagattacaattgaaccggccttgtcccttatataggggttgatcttaccctctacaggctctcctccacgtccaactcgggatagaaaccaaaagaaatccgaaacatgccttcccaagcaagaaaaattcgagacccgacaaaacagactcgggctcggactctgccggtcagaccagccacatgtcggcggtctgaccggagttcaggccacggtctgaccggcctatacacggcggtcagatcggcctgctagaggaaaacaccgttggatcccaaactttggcaattattcctatttcaatcctaggtgctaaatttgggtgtaaacacataccccctacctttttggtgaacaacgtgaacctgaaggcatagaacatgttgtcttagggtgataatccaattaccggccatagaactttctaaatatcttgccaaacactcgggaagtatttcttcaagtagttcccattgactgctctctgaaaacgctctccatgaagtgtctccaaaaaatacgcgttccctgaacaatcccgcatactcgataaggacattcccaactaggagaccaattaccgaactccttagatcgagtaccctctcccacttgaaacaattttgctttcacccttttgttgtatgctttagccactctcttcttctctttctctatttcttccaaagcctttaaacgtttgttgataacatcatcaagattatccctatcaaggtcttgtagtctccactcaacaaatcgtcttgcttgatataccgaagagagtcaagatttacctcgaccgacaaaacggcttcatatacataaatcaactcaaaaggagtgaccttagtagcaccatgtttagatatcctatgcgcccataatgcttcagaaagcaccttatgccacttatttgggtgttcttcaatcttctttttgactaatttcaacaatgttttattactcgattcagcttgtccattagcctgagcgtagtaaggagaagaactcaacaatttaataccgtaagattcggcaaaattcttcacttccttagacataaaagaagcttaaaggtataaattcgtaattacaacttaaaataaggacaagaaaacaattaccctttaaaaaacttaatttaatagtggaccataaaaaaaaccttatttcaaaaattcgactgtaacctcaatactaagtccgaagatgatgagatctaacaactaaacgttgcatagggcagcaacctctctgccgccatgctgccctagtgagttggtggccaccgtgaaaagggggtcaacactcaacatcaagagttttggcgcggacctcccaacctcaacgccagtgattctagcgatgaagtaaaggattttttttattagaagttctagatctcaacaatgctatgactgcactagatgtgatgaggctagacaataacaacggtggtgtgtagaatagcaatgagttagtagcggtacgggagtctggtgacgctaaaactcgagttggatgacatcatattatctactcccgccggtttgataatacttatcgtattggacaagagcatagttttcaaaaaataattttgaccattattttttattataacatgtataaatcgttaacaaatatatgattttattaaaatactttttaagactaatatatatgtagtcaccatatttaaaagataaatatttaaaaaatgatttataatcaaagattcgaaagtttgacctcactcttgttcaaaaggacaagtattatcagtctggagagagtagatgttgtagtcattttgagctcatgatcaaggcccctatctcattgctaggtccatttgatgctgaggttatttgaagacactaaccacccgccatgttgatccaccagatcagactcgtacccatggcggtagggaagtcacactactagaaaatcaatttttcacgcgtttgaaaaatatttttcatggcggctaagtggaaaaaccgccagcgcaaaaaatcgtgggggtgagaggtcaagggccgccagtggaaacacatcttcgctagcggttaacttaagacggccgccagcgaagataggatatcttctctggcgactctcttaagttgacgccagcgaagatatggtaacttcgctggcggtaaggggacatggcccgccagcgaagatacctacatcttcgctggcggccctcttaacttaactccagcgaagatgccatatatatcttcgctggcggtgtggtgacgtggaccgccagcgaagatacctacatcttcgctggcggccttcttaaccctccgccacctcaaattattttcaatggcggttcaaacgaaccgacatatgacgaccgtcaggaaaaatgcgctgaactatatcacccagctacagtaacttcgagcaccattaggagcacgattttctctatgcgcagatcaacattttcactggcctttgctttatgacggctgcgatttccgccaacgaaaacccaaaatagctgccacgaaagatgatttctataatagtgtttagtgctagtctcgttggcattgaaatggtgaagctcagtgttacttggcattttaggttgaggtttacttttaaaacatttaaataagcttttagcacgcggtccgtttttaaaatacgtacgtttcttgaaggattagatttcctttttttttctactcctgtttcgtccaaccttgcattgcactcgatcttggtaaccatttacttcactatacaaatcctgctgtttatataaatcgaggtgcccgtggaaactgatctgtaagcgtctgtctatttccggtgcagcgcggacagcgccagcgccaactgtttatttattggttcgctggtgacctggtgtcaacgtaccccgggcagccaattaaccaccccttgtcaaggaggtagagtaattaagagccatatgacagtctctcttacagtctgatgatctcaatatcacacgaattatactgaccaaggacaatatttatatgatggattgagatgtttgcattaaacatgtgaatatatactgcttaccgtatggcttaccgtgtaattcttaatgtggtttgacttcttctatgccttttgtcaactaaacttacagcaaaatcgaaatgtcacagcaaggagaccggccggaaagcaatctgaatgcatgcttttcacaagtcacgaccaggccgtgaaaactacggctaggctgacctgaggtcaacctttctttttttctacgttggatattatatagtacttccttcgtcccactgaaatgatactaattcgattgatttgttacgcctataaattaccaacagatcgtgcctgcaactctgcaactgtcatactgtacctcttagtttgcgaagctagcaagtctggtgtccttggacgcaattagttgttgtttgatcgaccaatcgatcgaataccgtcatccgagcagtaagcaccacttcttcgttcagctatattacccgtttgattatcttagttctcttttcggtcataaatacttgaatttcaatttgagccagctttaataggcaaagtttcagcatgaactaggaccatgcatgtatagttaccctcctttgcactttggaccatgttccatccatttaacaaaatggcacttaactcactgcataaaatacatgcaggtaaaatgatttagacaaagtaccaaaagttaccaagatatataattattgaatacaaaatgtcacatatttatgaactgatggactatacaaaattattaaaggagtaacatgttaacaggcccccttttctccaagcaacaactagcattatagcaatcaagtattttggcggaagaagaagaaaatgggagataagaagtttctgtgagtttctagaaactagggaaagggttggaggtaggaggaaaggaagatcaagttaatttcaagccttccccgttgccattctgcatctgttgtttgatccccttaaaaaaaccgttgttgcttttgttatctgccttgggctagctttagtgaattgttgtaacgaccatttgggagcccatccggtcctaacaatcccctctcttcgaaattcagcttgtcctcaagccagtaaagtgaatcctcttagatcccatggttgtccaagatccttctggctagacataaaacaataattggaattaattgaacaggacaattattttcaccccatataacttcgtagtccatttaaattctccatgtatgatgaacgatagcagcactgcaatgaattgctgttgaacagtgagctccaacaacatgtccaggagtgtgctcatctctcaggattctcatttcaccagctctagcaacaccacgtctcatctatttattgatagtgtcgaaactcaattgatctccttgagaaggctaatccctacatgcgaattggagaacacgaacaagaacaaaaaagatgacaactcaattgcagatgaatgatttataaagaactcgaagttgggtttccacaaaccgatgaacggcaaaattgcaataacaaaaataatctaagcaaaacctaaccctaactcgatgattaatactaaatatatagattctagggtcaaccttggacccattgatgtgtccccattgtactccaacacgatacacagcccaacgggcccacctggacagattctagatgccttcttgtttcaacaaatcatgttgactcagaaggaatttaacgtgggaccagatccattggaaatgtgctctcgttggctttccatgcatacgtggactttcgaaaacagagtccgaatgcaatctaggctacaattttagtgttgactgctcctggagtctgaggtggactcgatatgagcccaaaattgcctattacccctgttggaaatttggtcataattctgcatattttaatccaaaataataagataataaacatgatattcggaatgggatttgatccagtgatagtggtaaatataatcaacatgagcatgcttaatatagaataagcatcaacaatcacatagtaacgcaatgctgacattgcgattaacagtaaaaattctaattgaatagagagaatggaagtataccccaagaatggtcctccactagatggtgagacattataatgggtatacagtgtcttcggtattcacagaccctaaggcggccttcttgggccagcccactagttggcgaagggcctctatgggccgctgggcctcccaagcctttagccaaaggcattccctattccaggcgatggccttatgcttcgcacaacagccttcgcccgcgatggatcttcggttgattggcaggctaggaggcgaacccttcggtcttcattccatggcttcgccctggcatgatggcgaaccatttggtcttcgtcattcggcttcgccccttggtgttcgtttgggacttagccaatgctagatggtttgaatggtttcggcaggttggctgaaggccctcgtgacatacctccaacaggagctaattcagggctaaaaggtgggggttaataattagcccatggaaccaaacagggccctggtggcccgcacacgaaaagaaattaatgattctataaagtgaagttggagataccttttagagcgagtttaatgtatagctaacttctaaccttaagtcagctataatcaatctagtagtcttcatgctatagttaagtacctataaatatatatatcacaccattaatatttggtcccacctttcatacacacatagtgtattggagtttgtgctgcagttagctacaattatgtagcccactttcctttctctcttctcccttatctcatccacatgtgtttataagacaatcttatctcatccacatgtgtttatatgtcttatagcctgctattgtaattgctcttacttaatattctccttttagcttattttttataacatgtggatacaagttagatataagtgctcactttaagattaaattaacttggacgccctaatgtaggtgagtggatattatgtgttaaaactaaaaaaataagtgaaatctattaacttattaagtgttcgctctcgtgacctagaaaattctcatattaatcggagaaaaaaaacagagtccatattggaatacaattttaaaatagctgaaatttggaattaaaaataagaaatattgttagagaagactacagtccatacttgtatacagtagaactaatggaaattcggaattaaaaaagaaaattaaagtagatgttacagtccatataggaatacaaatagaaataacaaaaaattgaaattaaacaaataaagaatattggaataagaatatagagtccatatagaaatacaatttataaataactgaaattcaaaattaaaaaaagaaatatagaaagataagtttagagtccatatagaaatacaatttagaaataatattattttaattaaaataagaaatattggaagaagagtatagcgtccatataggaatttagaactaattaaaattctgaataaaaataataaaattaaaagaagattttagagtacatatagaaatataatttacaaataactaaaatcagcaattaagaagggaatattggaatacaatttaggagtaactgaaatttaaaattaaaaataaataatattgaaagataagtttagagtccatatagaagtacaattataaataatgaaaattcggaattaaaaaaagcattactaaaagaaaagtctagagtccatatggaaatacaatttataaataatagaaattcagaattgaaaaataagaaatattgaaagagaagtctagagttcatacaggagtataatttagaaaaaaaactaaaattttgaatttaaaataataaatataggaataaaatttattaataaaaataaattcataattaaaaacacaaagaatgttggaaaaggagtctagagtccatatagaaatataatttagaaataactaaaactagcatggtggcccgcgcagcttgcgcggctagcatcattatattttctctcatataatagtatatatgttttctcaatatattattcaaatatattaaaatgacaacataattttaaattttgcaataactttacgaaactactaatgggtaatattcatattgtattttatatatatgttagttattaattatttttaatatcaaattttaattatttgtaaattatatatattcgtatatggactctagactcgtcttttaatatttatctttttaattccgaattttctgtaaattgtatttctatatagacttcatgctcttattctaatattattatttttatttctgaattttttttatttttaattgtatttctatgtggactctaaactcatctttcagtattctttaatttttaatttcgaatttcagttacttctaaattgcattcctatattaactttaaactcttcttcccatgtttttcttaatctcgaattttagttatttgtaaattgtatttttatacggactctaaactctacttttaattttattatgtttattctgaattttagttagttttaaattcctatatggactctgtatatactctacttctaatattccttatttttttaattacgaatttctatttttttcttaattgtatttctatatagactctatactctacttctaatattccttatttttaattccgaatttctatttttttcttaattgtatttctatatagactctatactctacttctaatattccttatttttaattccgaatttctaattgtatttctatatagactctagtctcctcttctaatattccttattttttaattccgaatttcaactatttctaaattgtattttatatgaactctagtctcctcttctaatattccttttttttaattccgaatttcagctatttctaaattgtatttctacatgaactcttctttttctttttctccgattaatgtgagaatttctagaccatgagagcgaacgtggaggcttctttttctattcctttaataatataatagatttggtattaaaaaataattaagaactatcacgtatatacaacacaaaatgaatagtaaacattgatagtttggtcaagttagtacaaaatttaaattatgttgttattctaagatattttaataataaaataagaaaatatatatgctattatatgagagtaaatataaagaggctagccgcacaatttgcacaggacaccatgctagttcaataataagtggacataaaagttctataaatttataaaaagaattactaaaaacatgtgtaggcatgaactatattaccgtcaaatctagcttaagtccaaacttaacttaatttgaatgggaaaaaagatctaaattacaagttacattgtttttatctgtttgatagttttcactggatatttcctctggatataggtgagctaattcctggagatgcatggatcgaaccgaagaaaattggttatggaggtgagagttgaggacgtgaactacaacatcatggcagacgactacagtaaattcatcgaggatctccggaaaaagctcgccaatcatccgcataaggagatgatccatgatgttcccgtgctggcaaggcaacaatctcctagacagccggctaggtggatgtatattaatctggtgggcaggaagaaggacagggcaaccgtagccgttcgggatgacaatgtctaccttatgggcttcaggaacatgaacggagaatggtttcacttgggcttttcgaagtggagcgtgcccattcttccggaatcatccaagtttttagaatgcgacgtcgcttatagaaacttacttgatgtaccacaaggagaacaggtcatgagtaggttggtggaggtggagctgcggaagacggtggtgctagatgccgtccataggttgtcgcgctacacacagcgagggcaagatgatcgtattgatcgattcaccaaacgggatctggcacgcctgattatcgtgatctgcgagtctgcaaggatgaggccacactacactacggtaaacaagggcttcgttcacgacgagacaaccagcctcaccaagctgcacgtattctacttgtggaactgggggcttatgtcacgggcgctgcgccaaggctggcggccatggcccatcagacttgttgaagatgcccgggcagtagtccaactgctgctcaacgctgcggccgcgatgccgttgcgaatgaccgaaacggaggctgcctcctcgtcctttgccaatgacatgccttttgcctcctcggcctttctcgatgtcatgcattttgcctcctcgcccgatgagatggcctttgcctccttgccctttctcgattggatggattttgattactccaacactaaagctaaagccactgaagcaaacgagcagcctgcagccatagatgacatggcgccagtaaacgacgaggagcccgcagtgacgactgatgacttggcttgggaataccatgaggagtcggcagcgagcgatgacattgatgacctggcgtccgaagaccatgaggagtcggcggcgtccgatgacttcgcgcccgtagtcgacgaggagcctgcagcgacggattacgaggacgaatttacaggtcaagtccatggccgacgattagtggagttgttggccgtgagttccgacttcgacagctttatgataagtatctttgacgggaaacgtggccagatcgtctacaatcaccaccaaggacatcatactgtcatccacgactctcaagtatgtattactcgaggttgttatgtgtaacgcgcaactttttttaaagaaaaatcattggtctaacttatatatggagtacatgtggttttacgaaattaggacatgtaataagtttttagaagttgatgaccgaacagctgattaaatatatataatcagatggagtacttattatatagatggtctcttgaggtcatttatatatggactatatatattttcaaaccaatgaatataagcattaatttgcccttcacaatgcatgcagcgcaatttggtgctgactggaccatatagggccatctcagctgacgggagctttctaattgaagttgataccaacaatgaggatgtccatcctgataagaaaagaaaaaacaatgagagcgaggtctcatctgatgatgttgatggcactctgttctgggacagctataacgattacaactacactaggtctgacaggatattggctcacactatcaggacaagccttggccccgttgaggtgacctacgcggtgctgaccaacgccgtggaggccaccgtgcaggtcaagctcctgcttctcactggagacggcgccgccacgtttgctggcagtgacaccctcttcgtctacggtgacatcacggtgcgcagccactgcttcgacgtcgcgagcatgctcttcagccatggctcgcagaacaaggttgcagtggcactcacctctgacaccgcgaccattccactgtcgcggtgtgttgttgcggtgccactccaccatcgggttgagatagaggcgaagctgtatgttgaaacttccaacgaagaagagagtatcaattacacttgtttccaaggtaagctggacttcgccgccggccgtgaccagcagatacaacagatatcccacggcgacaaccctgcagtggttgaagtcacctggtcgccggacttcttttgaaggtacattgaactctcaacctatatttcaaatgttttcggattagttggctatatgcataattttcagcacttatctttcacacttacagggatcgagtggtaaacagcatagatcgagacgacggtcgatcggcggagattctctatggtgaaaaccacaaaagtattgtaaggtgaaccaataaatggttcgttctagaacatccaggtatctagctatatcgcttaattattctatatgggttctgtataaataaggctcttcatataaacggaattgttttaatacgaggatttcgatgaggagaagcagatttgtgtgctatactatgatatgtaccgtctataaaatattgtgtgctctgacgttgtgtggcttttcgaagatctatcatataggtgattgtgtatggttgtgaactcataaaacaacaattattgtatccctccaatagttttgtgttaattacaagtatgtgactattgctggtcaaaattactatttaatttgtgtatagtgcaaaattatagttatgggtcgcaaagagcatggccaaacaatccaatatgctgattatacaatggaaccccggaaacgccaactcacatttcaaatttcaaacgttattgtattgaactttggcaaagagaagcaacattagatccacggttgcaagaggttaaccacacccgaccccatctgtctgatgctcacctccaaatgcctttctgtcggaagaaaatgtgccacacacagatgagcaatggaaaagtatgcaaccaggtagctcatgttgctgcacaatcatgaaatggtatagaattaaaattatcaagtccatttgtcaaataaaagcattggagaacatgagcacagcttgaatagaaccaaatcaaatcagatggtagaacgaagcaaaacggatcgaagagacagagagaaaaaaaaatcatagacaacaaggaacgagggggggttcaagaggtcaaaaaacttaaccatgcttgttgccaaatcccatgatgaagcgtagcttctctgcagtggcatgctaggaaatgcgctaccgtgagctgaatgcttcttctgatttgtgcgacacctaattaatactgcaaaagcattaacatagtggctttggtgttaggctcaactacaaaagtgtgataaagacatcaagctaataaatgatacatgtcgtaaacttgagtcaacggtcatgtaaatttttgccaacttcggatgaaggttcactaatagaattcaataattgtgggtctttcgtcttgtgttggtgcttattagtttgtttcttttctttttaggtaaatgttgctacatgatacccaaattttgtgtaatttgcttatagacattgaaaaacatgtcatggttaaaagacatcctaaaaaacttgtaatttgctatatgaatttttcgacttaattgaaaagataaattgttaagaaagacaagaatgcccctagatcacgtgcttcaaacacaacgttagagtaaaaatttagaaattatgcaactttaaatttagcatcacccttagtacatcactagtaaatattatatttcatctttactctagtctcagctcaaaaacttttgaccatagtttttctagattataaaaaggtaaccacaaatagtcttagactctcctaaacggcttatatataaagctaggcgacattgccgatcttaggtcttaaagaaacattaaaagcccaaaaagacatttgaaaacttttgtatctatacggtgaaagcagcaagctttcttacacgagaatgtgtcacatcatcacaaatatattagccgtcggataaagagtttggataaacaatggccattggattaaaagggtatatgtatttaaaaaacacaaatgggctaaacatatggaaatttctggaggtttctggcacctcctcctagacacatgataaaaaagagagttaaaagagagaagaaacacaagacttctagtgattgctcttataaacatataatacaacttagttaaatctataattggctagcgaaatcaatacttatatcaaaacatttttaaaagcttaccttaactaatagaacatatagaaaagttcttaaacaggattaaaagtcgcgcaacgcgcgactatgtggctagtcttccagaaggaaattcgcctccaaacaggttgggctttaaaagcccaaaaccagacctccctcccgtaaggccggcctggacaaaattctggcatgggccctaatctctgaaaaattccaaactataataataaccagattattgaatcttcccatggctgacaagtgggcccttatacagagagacgctgacgccagcatgacgctgcggtgacgcccaaaatttcggggaatgggaccaaatggcacgcagacgcagcagcaggtgagaggcgacatgcatgcgccggccggttctcacctcttccatttcagcaacagctggaaaaagcgccaagaaacaaacacctcatcatcaagccaatgcaattcaaccccacaaaaaggccttccgaatgatacagctcacatcatcacaccagccacacatctgcacaaggtctctgtaactgctactgctgatgatgaatcattgttcatcaggatgatatatgattcacatgaagaacagaagtgagcacaacagaagaagctcctctccatttcagaagtgagcacatcttgtgaacaaaaagctcatggaaaggagggcactgattataatgtgaacacgtggcagatgaaccagcagggaagccattataatgttgtcactaattggagaaatactttaggttacagaggatacaggacagtgactggatgatgatgatggaaactcaatactacattttcagaggtaaaaggaggagatgatcactataattgaggatcatcagatcttttcttccaaccttgtgcttcttctgcacatcattattgaccttttgccacaactgtgagaaaatgcatctcaaactagtgggttttttaggtacatcagaagctgaatttttcctctattggttatgtacaagattagcaaacactctcaggagtttcagttgtgagttgtgacatgcagaagcattcactagttcaaaacaagtggaaatgttcacttgttcaggcctgagttttggtgtcagggacaactacaagtccagaaccatgaaaaagattgcacagaagactgaaatattagggtcaagtacatcaaccaaagtagaaatattatacaggagtacatctaaccaagctgaactacaaagccgacatgcacctattcagtgaatcaggttattgtttattaacatatgacaagatctgcactagtatcttttccatcctaattttataatagtttggtagcagcactaatacagtttgacctgatcttttatgtcagatagaattatgcaggagataagaagatcacctagatatagattattgacaatatcacacagacaatcttgcaggggtcttatcattattggcactagaatttaactcataagtgtgtgtaatgtgaaatctgttactccgcactctatccatgttgatctcctaatctaattcttaatatattatattttctgctggcaagaagccttcaaataaattggacaacagaactgatccatcacaaactgcaatccacaatgaggaactcttaaaaagattcccatattgaatataaaaccaaattaaggatttcacagaaccatatgtagaactgaaaggatggaaaaagtctacaccgctacagcagtacttcataatgtcaaacattgctgaattttgcacgcatgatagtttcaagatttgaccttttgattaaaccatccaaatatcaggaccaaacatgaattatgacacaacacaatcgaactaaaccacagtagatttttttttcttgtttaatttttttgtcgacattctcgacaacaggccacatttcatagcgacctcacagatttttcaactataagttactcccagaattagccgcgcacacatggaggactaacaaaaatgccatgatatacaccaaatgcagcatcaaaacatgggaagaaggaatcatctttacataaagatggttcctttcctttccccccttcctttacagaacggcacacattttataattactactagaccaccacaagtgaggaaaaaaaccaagaacaggagagctacctataaccaccacatttgcgcgatcaaatccaaattctcgacggttcgatcggcattacctatcaccaccacattgcgcgatcaaatgtgaattctccatgtttcaatcggcgttgagcatcggcgaatcgagcccctccatgcggctgcgaacaatgcggtggaacacctccctgacctgcctttcgagaggctcaaggccggccctcatggcggcgcacacggcagccagctcggcggcggcctcccgtacctcggcctcgcgctcaccggagagcgggacgggtgcggcgtcgatcgcctcggcgagccgctgcgtgcatttctccagcgcgtggatttccttgaggaggccgcaggagttgcgcctgtccttgcgcttcccctcctcggtgaggcgctcctggagcgcgagcagcggcggcgcccatgggaacgcggcgcgcggcggcgcggcggggaggtggtgcgcctggagcgcggcggcgcggtccgggcacggcacggcggcgacgagggcccacgcggcgaggtggagcaggcagcccatggagtacaccggcgccacgagtcccccctcgtgcgcgcgcggcgccgccaggccggacccgatggcctgcagctgcctagccgccgaccagttgcgggagacgctccacgagagcgagcggaagtgggaggaggaggaggacgacgacgaggaggatgaggaggaggcgagcgtcgcggagcgggagggcgacgcgcgggcgcggccgaaggagcggttgcggtgggaggagaggaaggaggcgacgccgccgccacccgcggcggccgcggcgtcgtcgatgaggagcaccgagaggtcggagagcgccttccgcgcgcggcggagctggccctcgtggatctcccctggggcgagcagcacggacgccgcgatgccggcgagccgctcccaccgcctgacctggtcgacgccgtcgcgtgcggcgttgcacacgtcgagcgccttcaccgcgcgctcgtagaaatcccccaccatcttctccgccgccgccgacagcgccccgcggcggcgcgccagcgccaccaccacccggaactcctcctggcacagcaggaacgcctcgagcagccgccggatccactcgatggacaggagctcgtcctccccgcccctgagatcggcgaggtgcgccgccacgtgccgctggaacgcctccaggtcggcctcctcgccggacgccatggccggggacgcgccggcggcggcggcggggctgtcgcggcggagcgagaggagggagcggccgaacgaggagaagggcgacgggtgggagtgggtcgaggaggagccctggtagtcggtcgccggcatggtcgccggcgagatcgccggagaggaaaccgaagcggatcttggagagagagcttagcgggttaacgggtgagatggatggagatggtgaggtggtgatgtgtggatggatggatggatgggtgtatatatgtatgggattgtgattagggaggggattagtttaatgatattttggggtttagggggaagtggtcttagctaatcatgattgtttggatttgtttaatctttggtttgtaaatgatttctttctgtgggtgcaaatattcttctggaactgagaatgtttctagtttttgtttagctttctctctcagggggttttggtaggaggggctctaaaagggttgtaattactcctgggtccttacaaagttaaaatgaaatattgtcatcttttgcatagaatgaggtacgagcattttactatagtggaatacttgaagagcccttcttgtttgagccgcgatttctaagttgttgctaattttacgtcgtaattttagaattaattcaatggtttatttgccgaccttttaactttggaactgctaagagtagaagtacaaaattgttatcctatttttttattgttatgatcatgtattattggtttatatatcgcaaccatagaaataccttccaaatcggccggtctcctcttatcattgttaaaaatgtattgccttgaatacgttaacgagcatgcttgtttgagctacgacttataagctgtagctaaattcagaccctaattctagaattagtctaatgggttttctcaaccttgaactttttgactgccaagagtacaatcatatagtttttatcctaaaattatctttcattccttcagtcgtcgcgtattttggttttatatatcgtagccatagaaataccttccaaataggccaggcccctcttgtggatatgaaaaatatcagcaaagattgttgtttgtgtattcatcttcttctcactgtgctactacagtgatcagctgactatactgacaatctgacatgatgcacaataattggccatacttcatgttgatgcatggccaatttgaggcagacacaaaaaccatcaatcctggagggcttttctgcaaaagggcaggatcagcagccagattaattggcgaggtttagcttaaccaaatcgcaaaactaaacaaatccgatcaaactccggtgaccagtcgccatttgcagaggggatcattagatcaattcattatcatcaaatcaaaagagaaaagtaaaccaaaccgagttaagcccctcgagccgagacgaatcaatcagcaaaaagctagtgctacgcggggaggggagtggtacacgcggcccgagagtccctgccatgtgggcccgacacgcgtaacccgcccctcccacgcggggcccgtgcgttcacacctccacccccacgattttacctttctaccccccgcactccagtgctcgcgccggcgaccgacccgggggcagtttgggaataggactaccgcggcgcacgcggggcgtgggcgcggccggtgggcgggtgccacgcggccaccggtgaggcgcggcgcggggcccgacgaggtggggcccaggtggcagtgggaaacggtcaagcggccgcacgggcgcgggtcggaaacggttgggatgaggtgagggtggcggagccggagtgtggtgcggcgcgtgcgggtggttgtacggacggaccggacctggccgttgttggtgccggtgaaacggggtgaggtgtacaaaagcctatcagggactggagtcgtgtgcgtgacatggtgagctggcacgtagtagaggctgctggttatggttggagttttgtgatatgctcttttatattgcaggattttatttttaaaaaaaatcagtaaactcagtcatttcaattttagagagatgaattagaggagttgagaagaaatagtttcacattataataggtgtggaataaatctctttcaaatcttctcaatcctctcctggactaagggaaatttttcatactctgaagttctgtcctagctaaattctcagtggtgtttatgtacagtgagatgttattgtattgtttaaatggaatctgattgtttgcttgttgacttataagctgaaattcaaattttcaatcttagtttctgttgtctcactttttttttacggcttatcagctgaagccaaccaataaaaccataaatatgtaaacaatttctcttaccatggaaatatagttgttcaattttaagtcctaaatttaagatgggtgctcgtatttactgctaattatatttttagtggtaggtgatttatatccatcgatagtgagatgtttgtaatgacgcaatcaatttaagacgcactggtttagtccctcggaaagtggatgtggtcatagtgtcatgttgtgtgtgctcgactgttcgtttatacaaataagtgtgcatatatttgtacggatttctgtacaatatttttgttggaattaatacgtgggctactaaggctcatatggagattaatttttttgaaaaatcaataaaggtcccctcttggaaccttcgtccttcgacattctgtatcgggagaagacgataattagctttttggaaacggctcgcgtgactgcttgctggtctttcacgacggctcgtcttcctctacactctagggacatccagcaccgccgttgttcctgcagtgcgcgctgctcctcatcaatctaatccacaacaaaccagagctttcgttatgtgttcaccatgtatcatctattcgatgtgctcagggtttactgtttagtatatatgtctagatcgtatatcgtggttatgttagtatacatagtcaataacgtgatttatttatgaaataaattaaatctacgtgtgcttatattaccgttaatgttttgcatcggaatgttctgaagttcttggccgctttgtaacccgtactaatcgaagcaacagtgggcgaagtggtcgcaatcatgcatcaatcttcggggatccacactacttgtgcctaacgtttggtaggccgtcaaattacaaaaaaatcggcgatgctttttggccactcgatcttgtacgacttttgtcattctccaagccacactatcagcaaatgtttcaccgatggtggcattcgatattagccggtgtggatttttttttctttctttctttcttaaaaaaaaacagcatatataagtacttctattatgaaaatgtcaccgggaacatctattgtctaataataattgggatcgagcaattcatatactcccagatatgtctccttttttcaagacaggattcaataatcaacgtattaagctatggaactttattttagatcttgttcggttaatacatctcttaaagtattgaagctgtggaattaatttggagaattcctttatcacagattaactacacaaatcatgagaagagagttgacttaaaaataagaggtgatgcaagaaataaaaaaacactaggtacgataaatcaaaaaaagcaaaggtggggcattgaaaatgctactacaatgacgtggagaagtggtggccagaacccaaaacgcataaaaaatggctcgttaacaaacatggtactagtctcgtattaatcgagggtttaccttatcgtttccagatgaactcatctactctccctcgattcaccgatcaaaaaccgagcaaattaaaatcggtctgtgcaccaatacattaaattttaggtgtacaaataccctgcaaatatttatgattggtaaaaaaacatattaaattgttctagaagaagaaaagtcacaaaaccattgcttgcaatttgcaaatactccagtgtaaaggggagtactccaagaaaacaattctgccagtgggcccaggtggcgtggccggacacgtaaaccagcgaatgagaggatagcatagccaagggttggttttccggggaacacacggccggcagccgttgttgttgtgacttgtgagggaaggcaaatccaagcctgccttgctgttgccatcgtatgggaagaggacttgttgcttgtcttgtctcttgcatgctcagtgctgcatgcctagctagccggcatgttctaattggacaaactcactactgtttgttcatccattccgatggattatgacatggacatgtggtcttctatgcagggtctcccaaaccactgtggccggggttaccgcgtcccggcggtaagcacggttaccactgtataaaaccgtgtaaaatttatcaaaaatttaaattgttttttaaacttatttgaatttaaggaggttaccgcggtatttatattaccgtaccccgtgataagcccggtaaccgcagtaaccgcgcagttatcggcggtaaggtaacccctgcttccatggctatgtttcgagtagattttaactttttttcttcaaacttctaactttttcgtcacatcaaatgtttgaacacatgtatggagcatcaaatgtggacgaaaaaaaaaccaattgcacagtccgattgtaaattgcgagacgaatcttttgagcctaattacaccattatttgataatgtgatgctatagtaaacatttgctaatgacggattaattaggcttaataaattcatctcgcagtttacaagaggaatctgtaatttgttttgttattaatctacgtttaatacttcaaatgtgtgtttgtatactttaaaaaaaaattggcacacgaactaaacacagtctatgtacattgtttagtgtcccttctaccggccaattttgacatgcttagagcaaggtcaataacatagcccgctgttggcttcaaaaaaatagccatgacatctatagtaagcagtgtagctaatgtctacaatagaaatactataacacgaatattttattgttttgtgggacccaccatcttctcctacctcacattctctttctccctcctatccccttagttcatgtcttcatgtcttcttctttcttgagctagcttcgattcgctgtcaccgacaacggaagacggcagtggcagacgcaggagatggcagtggaggtggaagacggcggtggccgtgcggcgggcgtcgaagatagcggtggccgggccgcgctgcagaggcggaagacggcggcaaccgtgcaggcgagggatgacgggggccgtgcagcggatgtgggagacagcggcggctgtgcgtcggcacctgtgagtctaagggcagcggtctggtggccgcgggagttggcaacggaggcaggccaacgcaaggcatggccgatgcttctccatctaggtaggccccacaaactcctcaagcggcgcatgcagcccgacaacaaattagtcgttgtctctatctctctctctctcttcccctctctcctccagatcatcacaaaatcctacgtggaactactactgcccattattaattgtatctgctcttattaaacataggttaaattatggagtaaaatgcaccagcggtccttaaacttgtcaggaggttttacttatgtccacgaatttgcaaagcgcacatcgaggtccctaaacttggtttattgtatcatcccggtccaaagccgtgtttgaccgtggtcttgcctacgtggcatgccacgtggacgatgacatgaattttttatatttttttctcccttcttccttctttttttctctttcttccttgtcgaaaagacgaaaatgcctcgcacacgtcatcgtccatgtcatcgttttttcataaaagagaaaaaagaagtaagaagggagaaaaaaaatataaaaaatccatgtcatcgtccacgtggcatgccacgtaggcaagaccacggtcaaacacggctttggaccgagatgatacaataaaccaagtttagggacctcgatgtgcgctttgcaagttcgtggacctaagtgaaacctcttgacaagtttaaggaccgctggtgcattttactcttaaattatgcaatagtttgttaccatatattactttagcattaacatatactatctccgtcctaaaattaaccttaactacacttcttcacgaaaaccttaaacctgttgaacacaggatcataaaatagcctatggatctgtctggttacatgtcacatattgccaaaccaaatactattagactagttgtagtttgttaggttagtgtttggttggttgttgaaattgtggcaagtcacattttactactttatagacccacatatcatagatacaatttatagccaaacattaccatacttgtgatgaacaaattattggccatatgcccaaattttgtatggcaaagccccatacttatgacaaatttagctgtggaaagctaggcacaaccaatagaagccaaactaaccaatagaagccaaacaactagaggtacatttccatatatcccatcatggaagttatgcttttttacataattctacttgttgtgtgtgaaaataattttttttatcgtaatgtacgggcaattaactagtcatgtgttaaaaatagagttttgacaagggggattttaaatttcgtcactcaagtaggaatttaattattcactataaaattaataatgtaaacatagtaatggattcgaagaaaaatatctgatactcttaatacgtgaaaataaaagggaacgtacagatggacctggtctcatgaaccggtcaaaattccagctgaagtgttgaccatgcgataccagtagcggtggtagttgttcgttgaacaagttcagaccataagctaatttcaaccagagaaaaaagttcagacttgaagcctgaccacacacacacttggcacttgtatataggcagagacacatgcactgaacctgagtactaagagtatcagataaaatacctacagtacctggtactgagtactgacacgtcgtcatttcatttgcttgggaatcaagaagaattcaggatacatcaagtttgcattcattagggagcatctgctggttccctttctttcttttttctctcctaaagtggatggatgcttcatggcctcactcacacaaccctatcgtttcgcctaagcttataagtcaaattttgtattttaaaaactaattttgaaatcaattttatgcttttttcaccatagttttattttacaggatttgcttttgaactggtagggacacctgtacaaaagttgtgttcataaattattatttgttttctaataagccataaagataagaatttaagcataagcgaaagaatgaggcggtcagtaatctcagttatcagaatggttcgctctcagtgataggaatatatactatctgaattgatgtttttggtcccaattctttagtatttcttgggctgcaggaaatgtgttcatgcttgccaagttgatcgattacatttgacagttcagtcactgctactagatacctcctgatctaaacaagatatatttcaccttaattcagggtaaagccaccttttttttttataccggtaaaagttgattgtaatagaagcagatgttgtatcctctactgtccctttctggccacctaactctagaaagagaagcactgtatctaaaataggaagtcactttcgaatctttatttggatggagatgcaggcttacatggattgtacaagatcggtttattttagtgcctgccgtgataagatctgcatgatttgggttgcaaaagcctaactattggtcactcttggaagcaaacatagtatgcgctttctgatggtgacactggactacttgagcctaatacaaggtacaattatccacctcacaactgaaatcatgtggacttgaatcaccaaattattagctttctcagttaataaatcactggagaacagtcaaatgaattctgcgaaaattatccgatgcacatacagaatacctgttatagagagagctatgggtcaaaaagaaataaagataacattcaattacaaagcaaaatcagaataaataagctaaatgctaaaataacaatttgccttttgttgcttgggtgtttctgagttaacacatcatcagtaacatacaacagaacggcgtcccaggctaaacttggggatggtcagctccatccaggggcatgccctcagggcgtcaaataagaagcatccatgatgtttctggcctgcctggaagttctattcgcaggccagcttggtgtcgaaactactcagggagatagcaaatgcctggaaggctgagagcgggtagtggtaatccatggtgaacatgtccttggcaaccttcccgaattgcagtatgaccttatcatgctctggtgggggtggtggaacaggctgtgatggagttggggctcccgcagcaggctgcgtggctgcgatgagctggaagttcttgacagaagcaacagttacccggccccggaagtttaagcaccagcactgtagctgctcatgccatcttggagccttgttttggagaatcaaaggtgtctccttgcactcctcatcatcgctcaatacccggcccccaatccttgggccatctccaattgagatgtcagagaactgagcactgctgaaatgcatggaatggtccataacggacgatttcgaaaaggagacactcctaaaggaggattcattgagggaatgggcaaggatgctatccggctggctaggaacagtcccaccagcctcaagagatgaggcagggatggagtgcattaaacagcacatccgcctaggaccccgagttccaaagacgtttagctcatatgagatgtttgctatgctatatgtgctgcagggatgctttgctgttcccttgttggagaatcttcggcttgttttccctgactgtgaatcactagttgcattgtacggagtgtgggtatcatatattacaaactttgtgccaaggaagtttgacctacaattcaaaatggagacatattagcagcagcaataatttttagattaaaatggggtaagttctgaaataaggttgtagtttcttcgggttaatacctcaattttccaatgtttgtgttggtagacctagataaattgttagcattcatagatatcacatattctgtacatgttgcatgccagtttctttttgctgatagaaggaatttgccattgtcaacaagcacagctgcagaaaagggaaatcaaaacatctaaaattagtaaatgctggtactgaaatactaaaagtattccagcaaggaaacaaaacatatatgtgcaccagtgacggagcacgcgcaaaaattaggtgggtcagacacacaagacatactgaagtaaaagaatgacaatgcttgcatattaaaacggtacaactcataagacgattaaaaataacaaacaaacaacggtttccaccatataatattaattcgttgtgcataaaaatattatgagaagttaagaacatatgccgacatcaaagcagctcaaatatgtcttgcatttacacacataaaattagtaaatgtctttccatacatctcatcccgagattccctcctattttgtttcgtcgtcatttcctaatatatctagtcggcaattagctaagctcacttgatgttactagcaggcggacgcaaggcaacagaagaggattgagttcgcacaacagggctcaaagggctagcagtggtcgactttgaggcccgtgccggccgatggcagagcttgtgcagctaggagctcaatgcaagcacgctgagctcatcgcctcattctcacgatgcatgcgtgcacaacagtatagccttgaggccctttgtatctgatgtgcactatgttacctataattggaaaccaacaatgacagatgcacacccacatggacacagcaaacagatagcatgcaattccaatcaagcaaaggacacagcagctcaaattacaattgcacagaaccagtcccacttgtgaatatactcgcaccatatgggtgtcattgaactattgaagtggttcgaatgcaaacaatctcaagagaacaacctacttgtgcataacaacgggaatatattttattagtgtactgttgcttaattgacattatcatggatcaggtcaactttttttccagattgtcaagtcaagtagtaaataccaagtggtataggtcaggtaaaacagtagaacaagtgcatgacagaggtatacaatactaaaaaatagcacttaattatacataacaactattgtgtgctgtatcctattattttggttacaaaaatgagacaacttattacagaattgtagttataaagaacctaacttaactgtatgaaagccaaggaatgctgaatgatctgttcacaagttcgcttgtgcatgattgtggaagatagacaatgacaaataaggaataatatgtttctagcatattcatgtcaaatgataaacatggcaccaattaccatcccaaggcaccatctaccctatgcaagggctataagaaagaacagctcttcatttgctatgcaatacaagcatagttttggcagaatatatgcactcattcagcagctcacaagtatatacaactacatatgaatcttcttatgcagaagcaaatatgggctctggtacataggcgcatacaacataaagcatatgagatgtaacaagtaacataccagagccaagagagaggtacaaatagtaggtctgcgtagacttatccctcctaatgaaacactgcatagttccatctcgtggcccaggctgtacatagaagcggaataacatgaacttattagcatataagcaaacggtaatcctgcaatatgtgggtgttctttctatttttgtgtttcgaaattccaacaatatgttgaaggacaagcacctaacatggacgaactgatattgcttgtaaaggatataaaactaaaaacaacacaatttgcatgatcacctgcctcagagaaatagggaaggtgatcttcccacacaactctggattcttgacgatctctttacacatctccctccatgttctgcagacacccgcacaagcaaccacatgcttcctagaaggccatgtagcctcactttcttccaacctctcaatgatatcacgaagcaattccggaggcaagctagcccagcagctgctctggattacaggcaccgggtcatgcaactcatggacagcaccatgagacttccccctgcgatgccccagaatcctgacctcaaatcccctcctcgataggctcccaaatccatccctcacatcgcgcacgatgctgcgaaacgacatctactctctgaaaaaattgagatctctcctcagctaccaaaagggatctatacttttcgccaatgataacatcccagagtaattccagaccaactcaaattctcctcattattgttgaccccgcaaaaagaacctgcagcacaaatgaattgaattggtcaagattaatcttcgattattctttcttgaaaaagatgggagactagacgacggtgccgcgcacgatggcgacgttgcccctgccctgcgggaatgcaggtcacaatgcccccaattatctctctccacaccgattgcagcagcagtagcagggcggaagctacgagggggcacgcgaaaatgctggattcggcaagcctacctaccaacctactccccggtctcccgcgccgaagatgcccaatcgataaacacgaaacaaaattctctgctactgcaaaccttgtcgtgctcgcgcgaagagggtagacgcatcgtggaagagagcgcccactgctccgccggatcgagcccgccccccgtcgccgcccgcgtcgagccccgcgcgcgcgctgcccgcaccggatcgagcgagcgagcccttccgcgcgtagggtttggtcggggcaaccaattgggcggaagggggagaggggaagaggaggaggtggtggtggttgccggcggcggagatggccggagacggcgggatcggcggaggtggggatgcgatgcgaggcgtgtggtgtgagaggagacgaggcgagagtgtttgggatttctttttatttattttaacgtgtcgtggtccctacttcatacggtgcggtggtgtgtatattcattcccaccaatataaatgtgaaaaattctagaatgacttatatcgtgatacagatgaagtatttgatttgtttaaactttatgttaagatataatcatttctctattattccctccgtcataaaataacataacttcccccacccatttatcgccgcaaagactttattttgaaacaatcaaatatattagaatttaataaagttagatacatacatcgagatgtgataaagcgaagattattgtaggcattgttttagatcccatcccaaaactttacatcatgtcacatcaaatgtttgaacacatacatgaagtattaaatataggctaaaaaataactaattgctcatattgcgactaatttacgagacaaatcttttaatcctaattgctgcatgatttgataatgtgatgctacaataaacatttgctaatgatggattaattagacttaataaattcgtcttgcggtttactgacagattctgaaattagtttttttagtagtgcccgaacaccccatgcgataccctatataatacgcgatatgagacaccaaaactttatacacctggatctaaacacccccttagtcttttaaacattgtatttgtaggtgtaacaccgtcacctcttatatcaactaaggtaattatttatctggatactgccaataataaaggataatctagttttttatcttcgtgaaaaacttcaaagatattatcccaaaatacctttggatacttcggagtattttaattttaagagtattcacaattaaaacttgactgttgattttctttcaaaatatgcttttagtagttataaaatcagagtctgaaagcatttttagtattgaatgttacaattgttatacggtaaatatatttgcagtattgacctactgttgatttaaacctataaatttcaaagtattactatctaataaaaacgacataagaaaacgacatgaataatatgataatcatttttgctccaatacaacaggacatatatgttgattaaattatcggagtcatcatttggcttatatttatgcatatttgtattacttattagcaaccaaataataatttatagatgaaaagtttatatacgtatttttagcaatttaaaaagtaaatactgccaaataaactacaatgataaaaccataaaataaacttcaaatttgaattttaaattttcaaaattggtttataaacatacatagcgaaacaatgggattatctgtgtagtgctgctgatgcattagttgtcagcttctgctattgcatcagcattgcagacgttctgcatccatagcaaaaagatggtggtgtatgtaaaaaaaatcgtttgcaaattgcgagttacggaagcgctgtgttactccatccgtcccataatataacaaattttaactttctacttacactgtttgaccattcgtcttattaaaaaaatttggaattattatttattttatttgtgacttactttattatccaaagcactttaagcacaactttttattttttatatttgtacaaattttttaaataatacgagtagtcaaacagtacccttatattaggggaccccttatattacggggacggagggagtacatttattgcaattatgcggtcgaattttccgtacgctctctctgcccggcagcacgtactgtactgccgatgatgctgcagggtcactgtgtatggtcctccgttctgcatctcggcgatggctctcatcccgggcccaccaaggcctggtcaaaagtcaaaactaacagccatatacgccaatatgacatgattactgtaaaacgaaggtggtaaaatgtgatattacagcaacaacaagcagcagcaaagatgcccggtccatgcagctaccattcaacatacgagttgaccagtcaacattgaccgagggccccacacacagagacccactgctttcttttcacatcgccatctggctagcaaggccaccacattttgacttgacttcagcattcatggtcaggaagagtacccccttgattgagtaaaacaaagttggatagaaaaaaatgatgaaaactttagaatacagatggagcccagtatcacatggaaattttacaagtagagagaatcaggagatataatgatatataaacaacaagaggagaggatcactgagctagctataaagcattgaaattgttgtcacttgtcagtagtcacagataatctgccacctctaccatcttgcataaacaatctgccacctctaccatcttgcataaacacggtcctgaattgaattgatctgcaacctgaaattaacaatccggggaacgaattgagtttcagacaaccattattcagttctagagagaacttggaattattggaagagcatggaagaaacaaaactcaatgcagaaaataacaggatgctaccctgataaccatctgcaatccattttagaaaaaactataacaatgtaatctgttttagaggcaaacgttcagagttaagtcacatattttcgctaaaattagccataaatttaagatttaaaattcaaattttggctgtggttgataagctaaagagcaaacgatggagttggctaagcataggtgaaccagctaagctagactcatcagttatatacttacgagttttagagtaaactctctgtaataaagcataccatcatatttaaaagcagtgttctacatacagacaaactgtaaacattgttcgtgcaattgaacaaatataagctacttcttgtcaagataacaaacaccataccaattacccattaacaacttatccatacaagagtaagaactaatatctgtttaatcaggggaaaaagaaaaatttggatattgttgactttgaatcatgaagattattggatattgaaactcagcttggaagtgccaatctgacagcacacaagatcaccaaatccgagcagcatcactatttgtatcttggtgatgcagttgcttcccttttgttatcttttattcgctgattatgtttacacccaagtacaccatgtatagaaccacagtcattgcagttgatcttaatactagtcacgaaataactcccagttgatagtacatatctaactgatgccttctttgctgtagaacagtaaaatctccgtcaaaaactgatgccgcctctatctatggatgggactaatttttgtactacaggggtttgggactataaagctgaagtaaacactatcaataggaaacagccccaatgcatgatttccatagttccatatacactagtagcacagtactacctaaaaacttgtcatgaaaaaactcccacaagaagctacccaaattataaacattgagcattttttagtaaaagtaactgaaaatctagtccatttgcttaccatattgcgaaatgaagtgctaacagaacaaagatcatggatgattagcattgccctttatcttaatctcaagttctagctccttgtgtcttaggtcaagctcaaaccgcttattctgaagcatcatttgttcattctccaacgccaacttttccaattccaagtccttgttcttcctgaacatctcccacttgagacgttgctttgcgagttgcacagccttggtttcaatctgcaaacgatgtttttgaatctctgctgctttcagagccaagtctttttgcaccaaagccaaatcacatccatctggaaagggtttgttgatatccaacacgtcatagggatcagacctcccactaccatcattcgagcatgaggtgacaaaacctacatcaccatgatctacaacatgccacatccttttatgcattgaggggccccttatattggtatcaactgctcgatgttcttcctcattctcctcataatctgaatcttcactctgatcatcatctagttcagcatctccacttgcatgcctcatgaaatcattatcctctttacatctaagagcaagctgtagtgactgctgaagtgcgggatcttcaggcagacttatacggttattattatggtaggaacacatctcttcatagaacaagtgtttggagttcagtatcttccttgcatcctctttcatcttctcagaaatatccatgtgatcaagaagtgagtgattctccacaacattacaagcagtaccccttccaaggatatctgttagtcttttgtatctcttattaaggtcattgaacttatcctcacactgctgtggcgacacatggcaacctctctcgcccatgacctttgatattgctttccattttcccttcttttgcatcattgaatagttcctcctcccaccgcctaaatcagctccaggatcctcccctgtgtaggatactgcagtaatcaaaagcttcaccattgaatctgtccacttcatccgatgccatggagagcccttcttgtctttgccatcagcagcatcctcattcatatcgtgctcctcttcatcactcccatggttctttgagtggtgtctgtggtgatggtgatgatgggcaatcttcccatgttgtcctaactgaactccatcagagatgttatcaggctctgtaaccctatccataggaatggtaaaattccctggtatctgaggctggttgaagccctgatttcctgagtttggaggatgcatttgcttggagataccatgcaaatctaaactcccataggaaggtccctgtgtcatattaccaggtgggttgctgccttccatttccccaaagcgatcacccaaacacttcaacttcttgttggtaccatataagatggacacaggagtgcacgaggatgcacatgaatataacctgaaatggcagtttggtatgaatttttggaaatccaacacatgtatattgcacatttctatacatctcaatcttcagaatcaatttgctaaaagaaaaagatcttcagaatcacacaatatatcttaactagagtccatatgtaatcagggccacctaataagaaataactaatgcacaaatttgaagagattttaaatcagtgttacacaataaagggtaatttcagcctcctatagttgtcataattgccaaagcaagataatattggagcactaaaaatcagagtgttctgaagaatctaaactgcatcaaccaacaacctaattaatcagcagcacaaatgacaaatcaaaccatattactccactgggtaatgtgagtggaacaattttaaaacattattgcagtggcaagtggcaaccaatcaaccactagccaaaacaaaaaaatgttgcaacctttccatgctactcataactaacgagaagaaaatgcatggggaaaaataaatcaatttgtcacctcacaagaaaaaatagtaaaaacaaagtgtcgtgcgcaaattagctgtccatgtgtaataataatccacgaaccacaccaaaatataaactatcaaattctcacacgcacgatcagtggcagaggactaaaaaaagaagaggtgtggctcatgaattatcatgagaatcaacccaagaataatgggaaaaaaattctcaaattgcaccacattgtaccacacaatattatcttaacaagtctatattaagcatgacaacaacccctcatgacactaaaaattacctcaagtaatgaagtttcagcagtacatgggatagccaaaggaggatagacatataaataatctgcaaaacagatactcctagcaaagatggatcgattaataggctatctttaaggtggataaggcaaatagcaaagattgaatcatcctgttgatctgctgctgctgccggcctgccctgctacttgttggcccgccacctgctactgccgcgctgcccaactgcagccacagcctgcagcccacccagccgcccttgccggctgccgcagctgcgctggcggccctccgccgcctgtcgacgtgccacctcccgctcgcccgtggctgtcgtcactcatcagctccgccaatcgcacgagatggggaatcaatggagatgggggaaccaagcacctcggcagcgcgcgaaaactgcccggctgcagtggattgggagcgggaggtattctctactggtggagaacggaaacacgggattagggtctcaaaatttttggaagctggtttggatatctgttggatccattttttttgctcgaaaaaccccaaaatttgaaattgggagtagtaggggaactcttggtgatgctagtaacacacaaaacaagcccaatgtgggtctccaattcaacggcgagaggccaagaagcgagaacgccttcgcctgtcggccgtcgctcgctcgtctcgttgagtccgtccttctccccagcggcgacgccgcgctctgcgccgccggacggcgcgaggtatggcgagccctaccgagtcctccgcacgattaaaccccggcccccaagcgctccgcctccgaccggggtagcccccgagctcgggatggcgtacgtggccgcgacgagcctacgcggagtgctcgtcgccagcgatccgagcggcgagtacccccccccccccacacacacacacacacgcacacacaaaaaactcattgggtttaacgcccccacgcgatgacagcggaagccgctgcgaccaacaaagcgatgcatcgggagggaaaaggagagctgactcacgacggtatccggcgactgaactgaacgccggcgaggagacaatccgcctccgcctccgcctcagcctccgccgaaatattgggcctcgccgagcacgaggtttctctttctcagaagaaaatgccaaagctgaacggaaaggaaggaaagagtacgaaaggtaccataaaaaaaacaaaccaaaaaaaggaaatcgccgaaacgacacgtcggaggcgcgattcctcgtggcacggtatcggctactgtcgcctaccgctgacacgcggggcccaccgacagggggcccaccgaccagggggcccacatgtcatcttcacggtgatggcgtggggacggtgaggcacggcggcgcggttcccacgttccgttccgtttcgcgttacgggggtgggtggggcccgcatcacagcggggccatgacggcagcaaccgaaccccattctctctggttggggggtttattattggttatgggcttgtggcaggatgcagatgacacctgaagaaaagaaaatataaacacacttggtgattaattgttgcatttgcatggagtttaatagtcaaaaagtgatttcactggatgttatgatgcgaaaggagtcgtctaattgcacttgtaatggcgttgtttttgacaaaaatctatttgttgacttttggttatgtcagggtgtccggttgttcataaattctgatggggaatgtcaaaattgtactgcaagggtgaaaaagattgcagagccaggacactcttccgaatcagacgagtgcaatacaccaactgtgtattgtctgctgatctgacgagctcaatcagtagacagaagtttagttcggagcatttggctaacgtgtttcctaaaccatcattgatttgccgaatttagaaaacaattatcacaccaaaatgaactagtatactgaaccatccagagatgccatgcctatctcttgggcatcatcaagaggcagttcgctgattcctgaaaatattttctgaaactttcagcacaccaacttggagagtagcagtactaaatttactcttggcgatcgcatgatccgaggaatctttgaacaagctacggacaaacaaaacaaacaacgcatgacgtcaaccacgatctgatcagaacatttctttactcccattaatttggtgatcctgctttgtaatcttccattgacagaaaaaaaaaaggctcctctgccaatctgccatcagggcttgtaatcaactgctccctcttgttaccgaccctaatcctatcaagacaaggcccaaaggcacaagacaaaggaagcccaatacccatgtgagtgggccggactgggttgtgtaagggaacatctgagtctataaagatgttacccaggcaaggagagaggatcgttgaaaaatattatgtacagactatcttccccaaatcaattccaatcctctctcctctcccaactcctctgttcttcctggactcttccttccttccttccttcctcgttctcaagttgttcgaccgaattctcaagaggggttcgtgacaaatctggtatcagagcagtcgatcctggagtacttggagaaaccccgctatcactcgcgagcgcaactcaaggcaaacaagatggagcagcagctgagcgagctcatgacgaccatggcgacaatccaaaagcaaaacgacgccatcaaggtgtcgataggggccatcgaagaaatcaagccaatggtggtggagctggtggggtggaaaccggcggtggagaaggcggtgaccgagctgcgggaggagatgggggatctcagggcgcaagttcatcaactcgccaaggggacgacgccggaggtcaaggccgacgagcgaccagcgccttcctcgactcctcccaacattaagcctgacgagttacctgcgctgcttccaactccaccaggcccgaagctgaagcagatgaaggaggaggagcgctcgattccgcaggagcgcggtgaagaatctcatgggctatttagccatcgcgtggacttgaatcaccgggggaaggctgtgtggggaaatccctcttcacagtttctcccggtcaaggtgcgttcaattccttttcccctactaattatgttcatgaatttggagggaattcgcggggtagggtttggggaattcaaaacactacatctagggttgagtgtccagtttttgatgggggaaatcctaaggcatggaaactgaaatgtgaaacttattttgggttgtgtggaactcattcagatcactggattggagtggctattcttcagttcacgggtgctgcattgacttggttgcagtccacccatgctcatgaagttagcggtagttgggaagaatttgcagcgtgggtgtgtgggaaatttggtagggaggagttccagcgtttggtgcgctagtttaataggttgagacaaactgaaggggtgatggcgtatgcagagaattttaatgagttgatgcatgggttgcacgcgcatcatccgtcttggaactctgaattttttgttactcaattcctagaagggttaagggctgagattagggctgctattgtgttacatcgacatgccaatttggatactactgtggagttggcttgtttgcaggaggaagtgttggaaactaatctcaaggaaggccgtaagattgactcacatggcagaaatactttgcgtgctacctccactctggcacgtccatttgggggacagtggatgaaaggggaagaacgactgaaggctgaagtgccagctgaagataaagttgctgctcttcgtgcttaccgttgttccaaaggtttatgtcatacttgtggagagaagaggagtcaggagtatcgttgtggaccgacagtgcaattacatgtggtggaggaattgttgcaattatttccctcagaggatgttgttgaatctgacaccaatgatgctactcctgatgaacctgaaacagaggaattgctggccatttctagggaagcagttctgggcattgagtctcctaagacaatgcggttgcaagggttaattcagcgccatgaagtcttgatgcctgtagattccggcagcactcatagctttatcagtgaacaattggcaaatcgattgtagggaatatgtgcttctgtatcgccgttgacagttaaaattactgatggaggtttactcaagtgcacaagggagtttcctgattgtcaatggtgggttcagggagaatctttcagtactcctctgaaagttttgccgttgggttgttatgaggtaatacttggcatggactggcttgagcggcatagcccaatgcaaattgattggaaactcaaaactttgcagttccagtggcagaatcggcaagtgacattacagggagttatacctgatacaagtgattgtcctccggtgacctgcaatcagcttaagggtttgctgcatcataatgttgtcttgcaggcagtggctctctgtccggtggacacacctgtgaaaccttctcagacaattgtgccagctgatattgaaactttgttgttggaatttgcatcagtttttgatgaaccaactgggttgcctccttctcgtgtgtttgatcacagtattccacttttgccaggggcgtcgccggttaacttgcgcccttaccattacaaccctgcgcaaaagactgaaatcgagaagcaagtgtcagatatactgcagcaaggggtgattcagcgcagtgctagcccgttctcatctcccgtgctcttggtacagaagaaggatggcagttggcgattttgtattgattaccgtcatattaatgcgattactatcaagaatcgttatccgttgccaattattgatgagcttttggatgaattagcgggtacatgttggtttacaagtttggatttacgggccggataccaccaaattcgtatgaagccggaagatgaacataaaacggcattcaaaactcatcatggacattatgagtttaaagtcatggcttatggattgactggggcaccggctactttccaaggggtgatgaacactatatttgaaccattcttgcgaaagggggttctggtttttatcgatgatattcttatttatagccgaactcttgaggatcatattagactacttcgagcagtcttctcttttctcaccgagcagcagttaaaggtgaagaggtctaagtgtgtctttgcctaatcttctttaacttatttgggacatgtgatcagcgctcaaggagtgtccactgatgctcgtaacatatagtctgtgctcaattggccagttccaagtaatgtgaaagaaataaggggatttttgggacttgcgggctattaccgcaaatttgtccgccattttgggttactaagtcggcctttaagcttctcaagaagaacgtggtgttccattggacctcagaaactcaagcggcatttcaggccttgaagaatgcacttacatcagccccggtattggctttgccggatttctccaaagtttttgagattgaaacggatgcttcagcttttggcataggagctatgttgatgcaggatggacatcctcttgcgtttttaagcaaggcattgggaccacgcaatcgaggactgtctacttacgaaaaagaatgtttggccattttattggcagttgatcattggcgctcatatttgcaaggagctgaatttgtgatccgtactttagcggagtttgatacatttgggtgatcagaagttgaccacaccttggcaacagaaggctatgacgaagttattggggttgcagtatcgtttggtctacaaaaagggtactgacaatcgtgcagctgacgctctctctcgccgtgcgcaggatacttcaggggaagttctttccatttcagtctgtgtacccgtatggttggaagaggttcagcgtggctatgctcaggatgatcacgccactcaactgattgccaaacttaccctgcaaccggatgcctgtccacctttttcctttgatgctggcattttgcgttatcagggacgaatctgggtgggagagaatccttctttacagcaccaaatcttgcagaccttacatgctggagtgttccattgcttggtctgggctacggcgttcagttaaatcttttgtcgaaaattgcacagtatgtcaacaagcaaagacagagcgtgtgcgctatccgggttttctccaacctttacccgttcctgagcatgcctggcagatggtatcacttgactttattgagggattaccagtgtcttctaggtttgattgcgtgatggtcgtggtggataagttctccaaatatgctcattttgtggccctggcgcatcccttctcagcttttgatgtggctcaagcttacttgacaaatatttataagttacatggtttgccgcagtctctcatctctgatcgggatcgtatttttactagcacactttggactactctgttcaagctggccgacactcaactccgaatgagtactgcttaccacccgcaatccgacggtcaaacggagcgggttaatcagtgtttggagacctttttgcgttgttttgtacacgcatgtcctaagaaatggtttcattggttggccctggcagaattctgttataacacatcgttccattttgctctcggcacttccccttttgaagctctgtatggccatccacctcgtcactttggagttattgatattgctgaatgtgttgtgcctgatcttcaagatgggcggaaagagcgtgtaacatcccagcccagggcttaataggattaatagaataatcatataaacaagttgcaacttcttttccgaaagccgatctccaaagaactccagggttaagtgtgcttggcctggagcaatttgggatgggtgaccgaccgggaaattcttcccgggtgtgcatgagtgtgcttggcctaaagcaatttgggatgggtgactgaccgggaaattcttcccgggtgtgcatgagtgaggacaaagcgggcccgtcctgggggaaggcgggacgttacaaaatatcagatgtaagcgggcccggcctgagtgggcccgtcctggacaaaatggtatcgtcctgggggaaggcgggactctcacggtttcacgggcgtgtgtgtcgcagttgtgcaggcatggtgcgcatggctggtgtggacccgaagtggtcacacagcatggcacatgcgctggcactggacacacggacgaaggcgggactctcgcggtttcacgggcgcgtggacccggagtggtcacacagcatggcacatgcgctggcactggacacacgaacgaaggcgggactctcgcggtttcacgggcgtgtgtgtcgcagttgtgcaggcatggtgcgcattggctggtgtgggcccggagtggtcacacagcatggcacatgcgctggcactggacacacggacgtggccaagaggggacgttcctggcctggggttgatcgacgggggcgtcaatctctcttaaggggacgttcctggcctggggttgatcgacgggggcgtcaatctctcttaagggggtgagggtgtaacatccccgtcgatctctcttaagggggtgagggtgtaacatcctggcccagggcttaataggattaatagaatactcatataaacaatttgcaacttcttttccggaagacgatctccaaataactccagggttaagcgtgcttggcctggagcaatttaggatgggtgaccgtccgggaaattcttcccgggtgcgcatgagtgaggacaaagtgtggagggcagtctatgacctatgaaagctacgccgatgtaagcgggcccggcctaggggaaggcgggacgttatagagcgcagtatcattacatccttactgcggcaacatttgcatcgagctcgacaacgtatgaagcaccaagctgataagagacgttctgatcgtcaatttgctatcggcgattgggtgttcctcaaagtgcagccgcatgctcagacgtctgttgctgttcgagttaatcacaaattaaggccgggatgttatagaccgcagtatcattacatccttactatggcaacatttgcatcgagctcgacaacggatgaagcaccaagctaataagagacgttctgatcatcaatttgctgtcgacgattgggtgttcctcaaagtgcagccgcatgctcagacgtctgttgctgttcgagttaatcacaaattggctttccgtttctttggtccttttcaggttgctgcacgagttggtaaagtggcatatcgattggtgttgccagcctcgtgtgcaattcatccggtggttcatgtgtctcagttgcggaaggcatctcaacctcaagtacctgatgctccagcactccctcctgtggtcgcggaggttgatccagttccagcacaagtgttggcgcggcggcttgtccgtcgaggagcggccgctgtgcctcaagtcaaggtgtgttggactgggtgttcttcctcggaagcaacttgggaagacttggagcgattgaaggagcgtttctcggatgctccagcttggggacaagctggttctcaagaagaggggaatgttaccgaccctaatcctatcaagacaaggcccaaaggcacaagacaaaggaagcccaatacccgtgtgagtgggccggactgggttgtgtaagggaacatctgagtctataaagatgttacccgagcaaggagagagaatcgttgaaaaatattatgtacaaactatcttccccaaatcaattccaatcctctctcctctcccaactcctctattcttcctggactcttccttccttcctcgttctcaagctgttcgattgaattctcaagaggggttcgtgacacctctgtccaatctgaacatcgtttgctacattttaggatggagggagtatattcataatcaagagaaggtggagttgtgggtgtatgactttagacactaaggtg

SEQ ID NO: 80963 - DNA, 6287 bp, Oryza sativa
cctaatccaacaaatgtagcttaaatatttgccttgcagtgtttttttacaatgatcagttaacttactttcagaattatttttaaaacaaaaaaaaagagtcaagggtgacagggttatctcataccatattaaactacaagaaaaatacaaggataagtaatacacctgtgctgactgagcgtgagatttctcagcccatttaaattgatttttttctaactcgtagaatatctttgacaccaccaattctccctcatctttctctgtgctttcgatatgatattgatgtaatctccagtcagtgatctgaggattgttaccatctgtctcgtaggcatacaatacaaatacttccttgcaaccttgaagattcccatccaaagttattgatataggatttccacttttttgccatctgatacatttactgttctcattggcgcactccttgaagtttttgtgaaagaaatatgatgcacatccatcctgcctaatacctaaaatatcaatcaaaatgtagcatgtgacagtaaatcataaaaggaacagacatgagagatatttacattgaataatagtgaactacctggtatatcttgagggtgagtataaccaaatcctatggtttcatcaacagatttaataaactcgttgataaaaggatgacgacgagcctgaccatttccaacttctgcagccagatgccagagtagatcgctatcggtaggattaaactctacacctctgggaagacctggccaaccctgcagcaatacaataagcacaacatttaagtaaagaagcaatttaacatgatgcaagcatttgtacggaagatcttggaattgctcttggcgcatttggagattttttaggagcgcagttttaaaagaaacacatggaagaggtttccatacaaacattaacagaaacagttgataccagcaagatggcaatccacataagactccctcctaaagaattaattttactcgtttcaaaggaaaaagaaatgtcctttgtagctgctattagatgtagataaaagtaatgttcaacaatggtggagggtgagaaaaattgaggagcggtgatgactgattacaaatttacaatagctgttcaattatttctcataaaggtatattccgtcatgttcagctctgaccaaaaccgcacgtccacaaaagcaaaagaacggtaacacaagaaatgcggttttcattcgaatgccggacgacaagagcaggaaaagatttacaactttacaccgtctaaccgtctaataaccacacgcaaaaatcaaaagaaacccacctgctgcgccgctccgccggaatcctccgccgccgccgccgcggcgctagcctcccgcctgcgccggaacaacacaaagatgaggactccaaaaaagaaacatctgcaggacagaacaaggagaaaagggaggcgcggcacctctccggagcgggaggctttgactccgccggcgggcggagcagccgccgccgtcgctcggcgagcgggaggtcctcgtggtcggagtcgacgcaggggggaggaggcgggccgacctccttgtccttggccatcaccgcattagggtttgagcgggaggaagcgggggtacggaggattaaggtgagatttaggcgagatgacggcggatttgatcgccggtgagaacgtgggtttggggatggttcacggtgagaaagtgaggctaatgccgatcaggttctcgggcgagctcgcaattttggcccagagcgcgaacgtccaaaatgtagcgatctggcccatgtatcattgaaaatctgctcggtttcgatggcggatctcggcctttacccaacagttctatgggccttgggatgctcgagtaggtccgagtcgtgttaattgacggcctttttgcacacttgggcagatcatgttcgaatacatgacactgcgcgcgttgttgtggaaactgatgactacaataggataatgaatgttgagttatctggaaattaaatatagatagtagctacatatagttaatatgtattggatggttacgattaagtatgtgaattatctaatggctcttactttgtatgagtggtatggcttaatgtatatttagctcttagttctagctatatataatttttgtagatagcgactacaacatcagaagttgcaacctattatcaccatcagatcaatggagccaatggccaaaattgacactgcaggtctgcagcactgtcccacttcgtatgctacagtacccataccgggatccgctacagtagtcccctgaacagcatctgctggcgatataagctgttgatccggtggcaaaagattgctgatgttgctgtagcaccacggttgctctggagtattggatcttgtttatagacttgcttggaactcattcggattacctgtttggaaactcgagatgcatcagtctctaccttggatatgctcgttcaaggttcgaggttatttcgaggttatgtcttgatcaaacatgaggtacgtcgtctggtctctgctacaaattaaaacatatgctataaatatttatggctaggaactattgttctactaataacaaagcaaatatttacttgcaccgtctcaagaaaaaaacaattcccgactagtacgaactaagacataactatatccaaattcacacctacgaagtagttccttatagaatggtgggttctatgttatacaattgaagttaccaaataattggtaccgacaagttgacctcaatacaaacaagccatcaatcttttttaaacaacttagaagtgcatattttagaaatgcatgttgacgtgcgaaacactatatgcagtgatgttgattgtgttcggatgtttgctaaacttaaccatatcaaaattttggcactgacaaagtttagtcatttgtgagaaaattaataaagttgctcatttggtttgttggcaaatctcttgaaatgtgtgtgttgctggttttcggttaccaaaattttagcaataaaccaaatgaggtatcatctcctcgccacaagctaggcattttttattacaaaaccctactctatgtggtatgttgtatcatatcattcatattttgctcctctccttcccttcattgtctccgtccatattcatgcgattccttgatcctgtttgctaagcgtgaattattggtgcgaacttggcccacctccgctctatctactgtcgacaacaaacaagccattgcacctcaatgtagaggcaagtggcctatctcgacaacacaaacattcatgtcaacctaagccagttcaacggtgaagcgcaccggaccggagagaataccgttatcattgtggaaacggttgaaagtccttctgaaaacgccaaacatgagttgaaaggtcaaatgggaggagagaaatgtgaacatgggtgagatgatacaaacatgctccaaaagagcagggttttgggataaatgtttttatcacatggatctgtgatagatgtgttctaaaatatggggtttcgtgatatctactcttatttgtttggtatggttagatcagttagagcaagtttaataactactggctccaaatcatttatagtcaatctaataactcattcatacaataattacttataaacatatactacatcattaacatatggtccacctcttatacacatataacattttggaattcgtattgcagctggatataaatttatagcccgattttcttctctcttctctcctctctcttttacatgtgcttatagctgacttgtagcctgctattgtactcgctcttaggccctatttagttcccaaataaaaacttttcaccccgtcacatcgaacgtttggacatatgcatggaatattaataaaaaaaactaattaaacagattgcgtgcaaattgcgagacgaatcttttaagcctaattgcgccatgatttgacaatgtggtgctacagtaaatgtttgctaatgatgaattaattaggcttaatgaattcctctagtagtttacaaacggaatctgtaacttgttttattattagattacgtttaatacttcaaatgtatgtccgtatattcgatcgtgacatgcaaaaacttctaaacatggccttaggtcttgttcgtttctccaacaagtcggagatgaaattttggatactcgtggcacgcttttcaaactactaaatggtgtatttcgtgcgaaaactttatatatgaaagttgctctaaaatatcatattaatccatttttcaagtttataataattaaaactcaattaatttttatattcatcttaatcttcaggagattcaaacaccacctcggtgattcagtgaatcaaacgagtccgttgtgttggtaaataaaaagcgttggtcgcttcgttggacagtaaaacgaagtcatgcgcagccagccagtccaggccgatcaaatatcatcgttggagtaccaatcaagtgctgtcgcccaggcagaaagcagagcaaaaaaaagcgctgcatcccatcccagtagtcgtttgtactcgccgaggccggcctgcgaagacgaccgttggggctgatgccgaaagccgcgcgaagccatcgtgccgtgcgtgcgggcggcgtgcccagtttttgccacgagcgccgcgcccgcgcacggcgcaccacacccaatccaccccgagccacgccctactctcctctccacaacacgaccaaaccattctctcgcctgctcgccgctgcttccgccggtcgcctctggtcgtggtgcccgcgaaatttgaccgttgctgcgccacgtcacgctccgggccccgcatccccctcctcgtttcgcgtgcccactgtccaccagtctgagagccactgtccccatcatcccatggtcccacgcccgacgctgtagctgacaggtgggtccacaccatatcggccccacatgtcggtgggaggagggctcgctttattggagtttgttcgtttctttcccgttgtcctatgcccactgccagccgcggcccaccagagacgctgacatgcgggcccggatttccccgaggtccacgaagcgatccacgtagtactactcgaaacagcacggcctcgtcgccgctccgcgagatcgcctcgcagccgttggatgcctgacatgcgccacgtgatgcgtgccactaaaccatcggctggccagagcgcggcgtacgaagagagcttttacaccgacatgtgggtcgcaccaacgcgttgggcccagctgcagtgggagtagggggcttgggaggagtactcgggcgcgtagctgatgcggttttgacaccgtgatgggcacctccctaccattgggcccttgccccttacttttgtacaaaagcccctccttttctgtattctcatatttatatcccatcaacttgcaactcttcattccagttcgcttcctccctcccacctcttctccacttcttcttcctcctcccctttcacactccacttctttggtctgctcttcttggtatccttctcctacgcatagttaagctccgagctcaggaggtaggttggtaggtttctattgcttcttctcagctgggagagtgaaaataccgaggagaaaaggcacatcaagattgtttctttcggtttcttgggcttctcttgcggcaacatgaagaagctcttcttcttcctcttcctgctgatactggccgcctcggttgttcacggcgaggacggtgagatttcccttctttctttttctcttgtgttgcttgatctcatattgacccttttgacactgactctgctatcccattcttggatgtggttgcatggctcgatctcgccatctttgctattacatcatcgataatatctttgtttattaggctagttttcttgctgcaatcctggagaccttgaatgatagcgactgtgattgggactggtcgagtgagcgatgtccctttctacccggatttctgcttgtcgtattgtggtctctggtgttattggagttgtcctgtaccccttgatggttaaagttcaccgttggtagtagctttctcttgacaatagattaacacaaatcacaaaacatggctaatcttagttaatgagttattactcctagctagagtggtctgtaatggagtacttgtagtagctacccagtcagtagtagcttttggggtttggatttgactactcatcctgctcacccttattctctgcttgt

SEQ ID NO: 80964 - DNA, 17644 bp, Oryza sativa
gcccaggagttgatgggcctcaaatgcatcctggaagctcagcctcagcatagcccatgggctatataaactctctttgcaggctttcaacaataggcgaacctgatacagagtgtcagagtcacaggaagcacaaactgaagatcacgctcagaaagaatccagtgaggtactgatcgcttaaatgcccatttgttccctcataaataagaggctgaagctaggagcaacatgaactcatcccaatcatatcggtttcatgattcaatattcaaatgaacccctcgagcagcaaatgtaaactaaatcatttttcttagtgttgacaagaaacatcacagatcacaccacaatagaagattgcaggatgttaaccaaacccaggaggcacatcaggatcctcctcatcatcatccccagggcagctaacggcgttgggctcaccttcatttggtttcacttggttatgattctcagtatttgacgactgctgctgctgagttgccatgatgttgctgcgctgatgatcactgaaaccaaatcctggtggttcctctggatcatcatcttccagctggactgcaacagaagttgatgcttttgctggggacacttgctcctctttggcattcctcttcagtttctttgaaggagggtcctgctgctgctcagggttcatcattctattgtagacagtttcagaagttcctcggatatcaatttcatttgataggatgacaccccatatctcgtctgagatttgacccattattttgctcctggttcgaaagcacatcacaataacatatcacattattgatatctagtccggtgtagtaaaaaacaacaataaagaaaaactaaaatgtagttgttcagcttacccgatatcttggtaaatcgcatcagaaagatctttcagctttaacttttcagagccatcttcatttattaccactgactgcttcacctctgcaattatgttgctgcgtagcacctcctgcatgaaaataaattgcagccaacttatacaactacacagcattaaggtcttatctggtcttcagatgtgtgcttctgctaggccagcagtaaatcagagtgaaacatgctaagcttgattaaccatgtatgctggatgtacatataatacacataaacttatagaaacacagcatttaaaacttatctggctcacagtatgtgtgctgctaggccacagtatgcaaatcagagtgaggcacactaaggccctctttgtttaggcttaggcttattggcctagacttttaagtcagcttattggcttatatgatttataagccggtggatttaatgtcctaggtttagtggttgagtcatacatctacctcacataaactaaaaaagcttctccaacctagtttttggcttaatagtgttagagtggcttatggcttcaaaaaagctaaacggaaaagctgcttgtttgtttaggcttagacttttcgacttataagttggcttataagcctaaacaaagagggcctaagcttggttaaccatgtatgctggctgtacatataatacacacaaacttatggaactacacaacattaggacttatctggctcatacctgtatgctattgggccatagtatgtaaatcagagtgatacgtactaaactttcagccttgtttgcaggcaaatcagtatgaagccaagactattataaaaaacaaattctatactctaggatacaactcttttttgcagtcatgggatgcatttacaagtttacagttgtgggatattagtatatatcatgggaacacgtttacagtcacagcggtggggtgctacaaacgtcttgggtactagttacctcttccacataaataacaatgaaggcatgccaaatttatggcataaaatgagactatcttcaaccttcaatggggttatggggcgcttgattcttcaatccattcactgtatccctttcgacacagctctacagcacatttatcttttatttatctataataatccttactatctatataagtacaatccactaattgcagttaacttaggccattcccaacccaatgactaggatgttgtccatagcattaaataagctaccacctaggatgaaagatgatgtgccaagtgaataaatgaggaaagagaagaaaaccaggtcttgcatgagacatggtttctacacaacatccaagatatcatgtgagataagtagcattaaatttaagtatgaaaaagtggtgtttgcattgaaatctagtactagtttcttgatgatgtagagtttatgaaaactatgactagtgtcttgggttggaaatggccttatggctatgaagaagccctcacgttgagccaggtcatcataattgtttcagccattagatgtctgacagcccaacggccacaccatctttaaccaatacttgcaaatttccttgtttttttacacaattagtcggttcaaattcctgcagcaacgccttggttaacccaccagtataatagaaagatatgtcaacaatgtgtaattgtgtatgcttcccaattcccaacaccaaaactagaaaacacaatgctactacaagaaaatttccaactttactactcacatggacaaagtaaaatgactattgaggacgcaatggtttcattggacaatgtaagaatatatggacctgaaacacaatttccgatgatatgaataagctggtaatcaatatgactcatttatgacgaacaaaggcgcaaccctactcacattcatatgtcaatagatgactgtataagatatgcaaggttaccaaacaatgtagtaatgaagtaaagcacacaaacagaagctgcaaaattttcttacgttccaaatttcctccgaatatattatcaagttctaaatgcgttgctacagcaacatacgattggttacattcctgataaaacttgaatcacgtagttctggtaattcatgagaacagacctgctcagagcatatacattcacacccaatgtctaaaacttaacacaagaaggcacattgcagttcgcctgaagttgagataatgcaggatgatctatgctaaatccactgtccccatggatgacttcaggaaaatcgaacccacccaatcgcggctatactgtcagtgaccccataccaaacgcaggatcaacgcaattctcagcgagggtttcaatctagagcgaccccttacagcaaatcctgcggtatacgagggggaaagtggggagcgtatgatgggagcttacgttgtccttgaccttgcggatgatggcgcggcggagcgcgtcgaagtccccgtcgtccttggcacgccccaccacctcagccctcgacggctcccgccgcatgccgagttcgcggagatcgctcatgggagcgcgggggtggagcacggctccgccgcgggaacctgattcaccggcgtacgccgccgccgccgcccttcgagttcgttgcagattggggagggaggggactccgtgcgccgccgcttgcttccctcagaaaattttggggtttcgtcggagagagcgagaggcgagaggacgagaaaaaaaagaaaagaaaagaggaaaatactcacgcggtacgtactcaagcctagtccctcggtcacatcaaaacccaacctaatcaaaatttacagtagaataatatgttatattcaatactaaattggttatttaaggtacagaggcagtacgactcaattcgtcccggtgataaaattgtctacctcgtcctggtgataaaactgtctagcgaaacaacccgtagaatttttcagtttcattggttgacaacattccctaataaatcaaaacagtttattaggaaataaaaaaaattatagataaaacttttatatgtttattcgtagtgacttaaaagccaacgctaaagagaaatggcgttgaaaacatcttaaaatcaactttaaaaattcaaattttgacttttattttggtttattaagtcaaccaatggagctctgagaacaaaagacaatggtggtgtttgaatctcttgaaaatgaagataaagataaagataaagtgtttcacgtaaaacgaggtagtaataacatgtgattaattaagttttaattattacgaacttgaaaaatggattaatctaatattttagaataaatttcatatataaagtttttgcatgaaacagaccgtttagcagtttgaaatgcgtgtcaccaaaatcttcatcttcatcttcatccaacacttgttggagaaacgataaatgcatcagacatcgaattcagaagaaaacacaacgccttcgcaattttccaagaacaacattctatcaaaaacagcacagatatcatcagccgaaggagaaacaggctagtatgatttttcttgtctaggagacacgatgcctcaactggcaatcggcaagcaaaccagatagtactgaagaattcacgtttcaggtcacatattcaatttcatgcgggatacacagagatattcacgatggctacaagctctcatattcatgtcaaatggtagatgctcgcgacttgagagaatcgcaacgcgactggagaaaaatgcaatctgatttcttctgctcacgcattcaaagtttctgtccataacatgagtgaagctctcacggctcaacggctgaaacgctctgaaatcgacttcggtatgaggctggttgtgtttgactgtttctccagcctgcgtcaagaaacgaatactgttaggattacatgtaaacatgcacgcaacatgtgcaaggggaaggcagcaggaagtaagaaccttgcaatctcttcgacagatctcattatttgctctgaacttgtttcaatcacttgtcccccaagtatcatttcatctaaaattgtatgcagctgcatttgatatttcaattagcctaataaaaatagtgattacctttaagcagtaacaatcatcactatgacacttccgttaaaaaaaacaatcatcactatgacacgagcaaagacagttgagatgaattgttgtaatgtttggtattgacgactgagggcagcattaccaaaggtgtgggcttagcccctagctctctctctctctctccgcaacaaaatttccagtgttactttttttttaccatttgtgtactaacaaaacaaactaacttactagcaaaacaatattggtcctctcttgtaaaggaccataagcatgctttatgaacttgacccttttatattcttcaagcccagcctcaatggagcatattcaaagtaaaaggatcaaaacatgagaatcactttaccttgttgaagttaaatacgatgtcaagctcacacacattcttgaagcatctgtccaatgtttcaacaaaaactgtgcacaagataaagttttctacagattaattgatctgctgcaatcatggctgataaaacggggagttaaagtgaacttaacagaagtgaaaagagctgagtagttcagcagctacccagcattggacgaacaaacagtgcatgtttggggttgggatttgaggagtagcaaaccatcaattattgagagaatgctaaatactagtaaatagtaatgtatgaacactgaaactgaaataagtgccacagtcatcagctatgagtttgaatctaaaagaggaattgatataaagaagcgcaagtgacattacaataaacatgtaaaataaggcaggtcaaacaactgaacaagcatgtagtaagatcgaacatgaacataacaattatttttggcatgggagcgtaaaccatgactgtatggttgttgccttgttggcatgtcacatgagtcaaacaattgcagtaactaataaacagtttcatcaataaggcactagattaccttgtacaagatcaagcaccgcaagttcattttcagagctatcaaagacaaaaacaaagtacaatgtggccaaatgtttgtagaccaatttcgctccctgaaagtgcaaaagaaaaggttgaccatcatgctatcatatacaaatcgctaaaaaagttgtttgtttccttgctacagtttgactgacatatagaagagaaacagacaaacagtaaatttcatgaggaagcatgaacttgtacagacgtcagttttttttcctttacttttttttttttgaagaaagtgtttgcaattgcatacagattgactaaaagtctaagatagtggcaggttacataacaaacgagagaaatcaactgacattagagcaaggagctttcaaaaattcctatgtcagttccagcatatgcttgtattttagcaagatttattacaagatcagtcttggagagggttcattaccggtccaaagattgcatcaaccttgacgaaattgctgacactgtccggccttgcagacaacactgcaaaacgtgcttcacaaatcaagcatactacgtataatcgtatacaaaaggtgaagagcaggaaagtagactgtgggtgatacatacactggaagacgccgcggacgaggtcctgatgcttctcggggggctgcatccaataaccaatccatgaagcagagaatagatagaaggggagagcaaagtggtcaaaagcatttcgtcaatcacgtaagctgctattggtcttgggtggggaaattgacccagcacttgtcgggtgggcgaagattggaggggtgggtgaacggggtagaatcgaaacctggtagctgtagaacttgaggaggcgcggcttgccctgcgtgctcatcaccatcacggcctggatcatggctgatggggatgaggaagaggcgagcgaaatcagtcgggtggtgtttggttagagtctgtaaacgcaaatggtaactgaatcaaataaaactgttaatggaatcagattcaagcaatcctaaactttgtttggcttgatggtgtaatgaaagccatttcctttattgtgttttgaatgaatacatttaacggtagtaagattgcatagcatacaaaatcttcctacaaagttttttttttttttgatctcaggcaaatttcattacccggctttagagaaaagcccaaaacagacagagtcttcctacaaagtttgggtatcaagattatgtgcatgtacatttttagatttgagcgaatacaaatgtgagatttatctacaatgatgtacagaatacaaatatgtagatacgcaagaacagaaaacatgaaaaacatcaacagataaagagaagaaattacaccagcaaaccaaacaaagtcagtaaaacagacggtttttagtcagtaaacctgcgtgatccagtcgtcaggcaggaactccgcggaggcggcggcggacggcccacctcacccccccccccctccccccggctcgccgaaaccctagcggaagctccggcgatggacgagtgcggcggaggcggcgctgctgcaaatgtggtgcccggcggctgtgcagcacaacagccgcagcacgcgctccgccacgaggacaatcttccgcgcgcgggggtggggggagcggcgccggcgaagcggagagcttctctttagatcgtaacagctcgccgctcgcgtcgcgtgtgtacaaggaaggggaaattgtgggggcaatgataggttaacgcgttcatttaaaatttgtttcaacgctcaaacactgagcgcctgtagctcagtggatagagcgtctgtttcctaagcagaacgtcgtaggttcgacccctacctggcgcgtattgtttcgttaaccaattttattttttttattgttttgtaatatatgcgcgtattgtttcgttaaccaattttttttattgttttgtaatatatgccaaagactaccttcgatgttaaataattttagtttgtattttcctagtacaagatttcatctattttgatttggtccaacacattgaacaatgtacagaacatggccatctaggtgttagcaatttcatcatttgttgattacgagtcatggcgcttattaggaaaaaaaatgtgtaaaacttttatattttttttacttaaaaactacttggaaaataaactgagataaaaagaattatcattttttttgcgagggagaattatcaaaattaattgtagtgtaagttttaaagtttaactagctgggtgacccgcgcaattgcgcggctagcacacatacaaaatttatatatttttaatctgattttacttcaaatttattaaatagctatctcattgtcttaagattttaaaaaaccaaaccttatcatccccgtgttttctaattttatagttctaaaagtcacaccagttgttatcccttacttatgtcatctcattttttatttgcttgctcgatctaccacggtttctattcattttccttggaatctataaaagttggattgtatagtttttagagtttattatctcgttgggttttatttttataatttctagaagtctcgttaaacgccgctattatacttctctacggtccgtccacttcctcttctctttattgtcattgagattttaaaaatcgaacataattatcgtttgtgttcagtttttttactttctagaagtcttgccaaaccatcagcggctttgccactgcactcctctacggctcgcccgctgcatgcactcctcaacggatcgcctgctgcatcccttctttattgtcattgagattttaaaattgaacatgattatcattggggtttactcaccttgtagttttaagagtttattgtctcgctgggtttcatttttctctaatttttagaagtctgatcaaacgttgacactatactcctctaaggttcgtccaacaccaactctttattatcattgggattctaaaaattcaaacataactatcgttaaaattcattttttactttctaaaagtcccgccaaccgtcgacggctctgccactgtactcatgtacgactcgtccgctacctgtcctttttattgtcattgagattttaaaaatagaatatgattatcattggagtttattttttttactttctagaagtcccgccaaccgccttgatcggttgcttcacggcctgcccgtcgttaatccttttaatcgtcattaggattctatttggtgttttattaatagttttagatgtcccatcaaatgccaccactctactcctttatagatctgttacttaattaatctcgttatatgttttagatgatcttttttttcaatagtctttattttttatcaccaattttagttatttataagttgtcttatttttctttttctaatttcagaatttattttatttgtatatcgaattttaattaatattgtattgtgttcttttaatatttttatttttattttcaaatcaagttgtttcaaaattgtattcgtacttgaactttctttttaatttgtctaattttggattttttttattttatacttaattcaattaatctcgtattagattcttatatggactcttctttcaatatactttatttttaatttcgaatttaagttaattttaaattatatttctacttaaactcttattttcttttcttttttctaatttccaattttaatttactttttattcctaattttaattaatctcttattgggtttttatatcgactcttctttcaatattgtttaattttaattctgaatttcaattatttttaatttttttttctacttgaactcttcttttcttttttgctaattttggattttattttattttttattttgaatattaattaatctcgtatcgagttattatatggactcttctttcaatagtgcttatttttaatcccgaatttcagttatttttaaattgtatttctacttagactctcattttgtttttcttcgattaatgtgggaatttctagtccccacaacgaacatggtgtctcctttgaaagagataataaaatatgaatagtattttatgtttgacttatttttttaatattttttgaaaactcatgtttgcgcttaaaataggatgatcaaagttggacaccaaaactcatgtttacgcttaaaataggatggagggagtaaggactaaatatggccctgtttacattccaacttttttcttcaaacttccaacttttctgtcacattaaacttttctacacacacaaacttccaacttttccatcacatcaaactttcctacatacacaaacttccaacttttccgtcacatcgttccaattttttcaaactttacacaacatatattgaagaataattgtattggtagtctagatgtggtgtttttttttccatctgcggccagttttatggtatgctagcttctggattttatttggctgcaagtctgaatgcatcaattaaattgggtttgcagtggacagatctagtgatagttcaattcctttttcacttcaaaatccaaatctacgtatgtattgaagccatccgtttgatttatttttttctatttggaatccatatggtattcaatttttttctttcccccaatcggacaacatcctagccaaatacaataaggaatcagacatgcatgcatgcatatttgtgatgtacctcaaagatcagagttactttcctatttgtatcgaatagagtttgattcatactgagagaacttttttctgataaatctacaccctttaatttaatccattacaatctaatggtatagattttttctctttttctccgattaatatgggaatttttagcccccacggcgaatgtggtgccttcttttcgagctgtcttaataatataatagatagatttttagttatggatgataaactaaggagcagaccgatgcatgtttacagtctcattttgcttattggagaatcagaagcagtaatagattttttgtttcccgagatatggcggagatcttacatatcactatcaacaaaattgttatatgtggcaggaaacagttgatggagactagtaagactaccattaccaagttcaagatcttaaacactaggctatacttcgtttgttaccagccacctaaattcatgtctttgtagtttgtaacatgaatgctactggatacattttcagccactttgcaaaaatgatatcgacatgtcagaaacacaaaccacaaaaaaacagagaaacaacaaaatacacaagtggtttcatgtcctttgtgtgtgcataggtggctgtaaacgaaatacgtatgtgaagctaaataatagctgagatgttggattcgatgttttgccactatttagattgggcaattgaacgcacgttaaaaggccccaatcagttacatatgggcatctgttcacagttacacattgagaaattaaataaaaaattgccatcaaaagcaatttccattttccttcatggacaactatatattttattatttccttttactttttcgaatggcaactttatatttttttttcttctgggctgccaaaagtaccaaacggaattatgcagtcatgcatgaagaggtgttttttggactttcgtgtgcaatgtgtgaggtgtcagttgagggatttacggggctcaattccttggagaaataaattcgtataattgagaggaaagcctcttttcaggactactagtccactgttcgtctcttccttagcatactgtgtgcataagtgaagaggggaagggggagccaggcatcttcgagcctaggagctcaatctggtaaggaattatgtccttgcttagctctgtgctcttcgatactgttcatggaaacactacgcaggattccttgtttgggagatgcttcaggtgttcagtgttaagtcagaaactggaaatcaaatttcttgttctctgattccccaaaatcttatactctgtgcaagtggggatcatgattatgattacattatgattttatcatcctcttcttccccgttccatcttatgcaggagtatgaaagaactatcaaattattcagcagtacttcatccttagtttagaaaatcaaaggggatttctaaaaggaaccttaacactgcatcctaataagttcttgagttgtttgcgagtttgatttgcttttgttaaataatttctagttatgattcttatcattggggaaaaaaattcttccatttatgtcctgtatgcagaattcatcgtagttcttgagaagtatccggtatctgtatgtatttcatattcagaatttagcaaggtgttcgtccaagaatctatcttctgctcctatgttttgtatgaataggtcataggttttcattttcatccgtcatgtcctatgtagaattcataatacatgagcagtatcagtgtcaatgacttgcacagttgtgctcggctgaaaaatttgtcatatggtgcagttcatcacagatgcctaaaatccttccattttaacaccttttctttagtttttgattgttgcagatggaatacccaaggacactcacttcctgaccgctcaaatatcccatccattccatgctctgatgtgagcaactcggttccaagaatcttggaaacatggggaaaattcccggatcagcagtcgccatggccacgccgccggagccgtcgtcttggctgagcctcaaggtgttcttcctgagggtgagcaggtgcgaggtgaacgagtccatgctggattctgtgaccgtcacccacgccccgctcaccccggacaccgtgctcgaggtgagcggcggcagcgtcgccagcaacggccacgtgtcgctccgcctggaccgcgccggcggcgtcggcgccgccgccacggagggcggcgactcctgcaccttcgtcagcacggcggacgtcagggtgtccgggagcgcgcggttcgacgtccagtgcagaggcgagcggctcgtcgtcgggatcctggacacgcgcgacgccggcgctggcggcggcggctgggtgatgaagtgccaggtcgcggcgcagcgcgggtcgggcctcgtgaggcgcggtagcaaggaggcgaagccgccggtggtggaggtgtacgtcgccggcctggcccgcggcgcgccggtcgtcttcacgagggcgatgcagctgcggttcaggaggcggcgccacgtcaaggccttcatggagcccatcccggagcacggcgagccggcggaggactccaaagaaacgctgcctccgaagcatgaaaccgaggtaaaaaaatcccagcattttctttctctccgatgaatctccgtttattttatcatcgtcgatttcttgaactgaaatgcttgagctgcaccgtcaatgtaggtgtcggagtacaggtgctacaagccggagcaggacgccggcgacgccgactacgacggcttctacgtgaagcctgcaggcgaggaagacgacgacggcgatttctcgtggttcaccgccggcgtcagagtcggcgtcggcatcagcgtaggcatctgcctcggcatcggcatcggcgccggcctcctggcccgttcgtaccactctacgtcgaggagcctgagaagccggctgatctcgagtctgttctgaacatcaacattgcatcaagatcactgtccatctcaaaattcagatatccctctgttggagatggactagtccagtgtgtgtgtatatatccttgttagtatagttgttactaccgtcgtagatagatgagatgtgctatctttggcactgttggttcactggtttatacttatatgatcaggcattgtcaaattgagaccctttcatatctacccagatcgatcaatcgatgtcattgatcactagtgcatctagtctagagccctatgttgttagactaatttcatttgaagattgcacaagtctattccgcacggttattacttgatgcggctattcttgaagattgtggcgggcatcgccggccggcggccatggcggtctgatagtcacatcgctggggagggacccaacaggaatagcgggaaactcaaggggctccaccggaaaactcatccgaattggtaatttggtatggatcgggcgatgccgtcgctagcaatggtagcgacccaacacggatgggacaagacacggcccatcgttgtttgcggacggcaaggggggaggcgcgccatgttattgggctcgtattcggacactaatacgaaggaaaagtacaccgaaggtccctcaacttgttgtcgagttacaaaatcatcccccaaccgcaaaaccagatatccgacgtcccttaactaatcaaaaccggtgacaataagtctttcagtagttttaaccccggttttatcccacatgtcggaatgccacgtcatctctctcccctgttctcttcctctctctccgcctgttgagcgcgagcgtgaggctctccagtactgagctgcaggcgagcaaaagtgggggaagacgtcggcgccgcgggggaagcaaccgctcctggagcaccttgagggaggatggtagctcgacggcctcaagctcaccggcagagtcggaggagagcggcacctccgtactccgatggcggcgcggccgccttcgaggaaactgccacataagcgccacgtagtatgccacataattgaggagactgcacactgaaactagcccatacgactctttgtgggccgaaactgcccagttacgcagcccatgccgtcgagctgtcggcaaattgaaaacagttttgctagcattgaaaactataataaatttgtagtggcaaatttagacttttcctcagcggtcaagcgggcccacatgcagtgacggagagctcgtattagtggcctccctcaatctctgtgttcacgcatgacagccgcatcagttgccgcgctccaacgtatataaaaccatcacggatcgttcaagttgtacagcaccgtcatcgtggatggcaacgcgcgtcgaggacgaggaggaggcggcggcggaggagagagcgcccgccgcggcgttgctccgccggatcatggcgcccatcgcatggagggcggcgcccacggcggcgtcggcgtcgtcgtcgtcgtacctggtcgccgccgaggccggcggggtggagaagatatccatgctgtccggatacgagcgacttccgagcgtgtatggcacggcgttccacgacgacgacggcggcggcgcgtggtcgtcgtcgtcgtcgccgccggcgtgccctccccgcgcggccaggctgctctggggggcgctcacccgcgccgtccagaggcctgggaggtgcaggtgccccggagacgaggaggcgggggtgacgacgaccaaggagcggaggcggtcgtcgtcgtcgtcgtggcggccggaccccgacaggcggtggccggtgcagggctggagctagccgtatttgaatgtatttcttggggaaatttgaatgtattttctgttggtttgatgactgttcaacgaaattcagttgcaaatatgaacataaattacgtcgcaaccgagactgtggttagaccggaacagaggccgaatctacattctgttcgagcccatctcttccatttggaagcccatttcagaggattgatctgctcaagcaaattgcgcgggtagatttctgcagctcgatcagcgaaatgcttcccatctactcgtcccgtgaatcttaccacgcaagttggcatgtgtacatgtaaatgttcagatgctatgctttaccttgtgacaaagaccactgctactcctgcgcaatagcgcaagcttcgctttgaggcgtgagttacagacttacagtaatacagtgcacatcgagagcaagtgttgccatctcaaagagaaataaaaggaggtgtttacacttcacagtgtcaggtaaggtatatctcaatcagaacattgctatgcttttcattttcttagctacaatctccctgttcttttccgagtgttactacatgataagaatatgcagctaatagcaaagttacaaaaagaaagaaaagttacaagcttcaattttgtactacctacagtaagcagagacctgtacatcatgaattgattatatgagtgttagtactaatcaaatgacactgccaaaatgtactgacacccacagtcacaagcttcaatctgtgagttctgaaccctggtaaggaatatctgaaactgacctttcaacagcaatgggcttttgacctgtggatcccaggatttcctcccagcaactgccagtacaattgtgcagagagacgagctagcacacacgcaattaaatcgtggcagtacgattcaacgagcggttaagtgttcaatttacgcagctgttcctgtcctacgggtgagcatatataggtgtccgaggccaaggggattggagatgcccaataactttaggaatttttttcattgctcactgtccagatccaatcaaagcactgaaggctggggaacttgagacgtcaagctcaacattgattcggttcaagcccctcataatttgcagatatattgggggggtgggtatcgtgtcatctctcaaggaggttactcgttttgggagttcgttgggggtgtgtgcattcttgttggatatgcacagcatcccaaagacacggacaccaaccgatcgatgctgtgatggtttgaagctatggattattgaaaatttatagatttgccggcgtgtgcgtatttttaatcgcttcttcattcttctgtttttattcttgttcgggcaagattggtttgccgatgctgacggctgaccgccaaattaaacatgcatgataatgccaaaatctgatcgttttggatgcatcctgatccatgtctgcctgctcccagaacaaggccactgcaaaactgaagatgcccacaacgaatcaaagggtaaagaactaaagatgccaagaatctcttgcaggttgcagctgctgcctttaccctgaagctactacacagccaaggcagcaacaaagccaaaaccaaagcaagagaccctttcggtgcttatctactgactactgtgttgctgtgcaaaccttagctgaccaaacaggaagaaagaaatccggacgatcaaacaatctgacttgacaacagaacatccctgtgcgatgacaatgcacgtacaactacaacggtataattgtccttacttttctgcacatgatccgagctagtacgtacagtatgtactagctgggtacattgttcgatcgatcgatcgagcgatgagcaggcaggcacctcaccttggtgtaatttaattcgggggctgtacgtgttagctcccatttcgcatcacagcgagtagctgggctaaagtagtggtgacatgatctctccgccaacgaccagggatcagggatcagagatcagagaggcagaggccatgcatggccgcctctgcttaattgcgagtccacgcacggtcatttcagcccttatttggatagctgaaaattcaatgagattttacgagacaatgtgaatatgaaaaagcttatctattcagcttttggttagtttatttttacagttttataacttttgattcttccaatcttg

SEQ ID NO: 80965 - DNA, 9022 bp, Oryza sativa
gtgcgccgcctcccgtcggccgtgccggcgaggccgccttcgggcgcgccccgtggctgccatgtggggcccggccgtcagccgcccgcgccctcgggtgcggctgacgcgtgggacccacggcgccggccggcgcaagccgcgtgcacccggtccaccgtggatcgtgaggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgagcatattgaatcccagtttataaaattatgttgctttaaattgttgcattatcgctttatttaaattcccgcgttatcactgttttatctagccatgcctatttacttttgttatgaccttattattgttattgttattattaccttgttcaccctagattaaacaaaaccccaactagtggacactcttctcatggtaccactagtatgattttaggtagatgcttcgctatttaattaggtaacattaggtggtttttcaactctagactttgggaatattcatatcacctggacactatggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcaatctggttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaataactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagttctagaatcgtgttcacaaaatagctctgagcaactaaatgtcttttaaatgctgtttactgcaaccctaaccctttatagtataactcccttgtactcccttgcatttattattcacttgtgggtgtgtcttgttgagtacggtggttgtactcagtcttgctcaatttttcccaaacccagaagaggagcccctagaagatgaaggctttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggataaggaataatacacgtacgtaaggaacgcccgttgggttatttccggtcgtgacataaggagcgcccgttgggttaattccggtcgtgacaagttggtatcagagccccccttgaccctaggacgagccgtagatcccaagccttagcaatattttcaaaataaaaatcctttcttatttgtgaaaatcctttagtctctctctgtcctgctgcttcatttatcgtcaaaatctgacctttaaaatgttgcttttctcttttgtttttgtttgtagatggccggcagcatcaaccgtcgtggtctggacctgactggcttcgttttggatctgcggggcatgtgcgttgtcctggggtatccgcatggagtggactaccagggcaagcagctcccggagcaggagggtgacgatgcagagccccacgctgcttgggaggttaccgcagtgatcctcactagctcacccgagaggacttcgttggcagtcaccgcgggtggagattctttctccgccgcttgccagaacgacgctctcctcaccatcgacactcttcaccagcgctacccggacgagttgcagcactcgccctaccgctacaaccctcgccgcggaggagcccgcgactacgccaccttccgggatgctagctcggaggatgacactaccatcatgcacctggcgcgcatggtggaggcgtacgacgcggcccgtatcgacttccatcagatggtgcgtcgcgggttggtcaagaacaacatgaagatcctggagctgcgtcaggagaatctgcagctgaagaaggacctagacgcgctggaggcgcagctgtgtcaactcaaggtcgcccagggagaggtctgccgtcccaagtgtcgccgcgtctgctgcagccagaagatcaccgcccgcaagagcacctccaggcctgagcttgttcgtcagtccctggcatggacctgcttcgtcgagacccctcgtgccgcacctgcgcccgtggttccccaggagggggaagcctccggcgtaggtagcacggaggatgcctgttgctcaccttccgccctggcccgtcgcagcggtagacgagcagttagtaggcctgcgcgtgtgttctttctcgtttatcttcttgttgagtcgtgtggggcatggttacgccggtgtgtggtgtaactatgtcggagcctgtcttattttatttgcctaagcaacttgaactttaatgaaccaatttaatagcagtgataaatttaagaataatggtagtcgtgggtggttagttttaattgttagctctctctctgtttgctggttccgtgtggggttttcagatggtgacgaccaggagaaatgttaacaccggtgaaggcaaccaacccgagggcagcaaccccaacccccaaggcaacccacccccaccaccaccaccagacaccaacgccattctcacccagatcctcgcccaacaagccaacatgatgactgctttcctccaccacctccaaaatccgccacaacagaatgctccaccaccccctccccaacactccaaactcgccgaattcctccgcatccgcccacccaccttctctagctccaacaatcccgtagatgcgttggattggttgcatgccgtggggaaaaagctagacacggtgcagtgcagcgatgaggagaaagtcatcttcgccgcccaccaactgcaggggcccgcatctctatggtgggaccatttccaggctacgcagccagaggggcagcctattacttgggcccgcttcaccgccgctttccggagaacccatgtgcctgccggagtcatggcccttaagaaaagggaattccgagagttgaagcaaggcaaccgctccgtgatggaatatttgcttgagtttaacaacctggcccggtacgccccggaggaggtacgggaagatgaggagaagcaagagaagttcttggcaggaatggaccctgagctgtccgtgcgtctggtctccggggactatccggatttccaacgtctggtggacaagagcatccgcttggaagccaagcacaaggaactggagtcgcacaagcgtcgcttggcgaatttccgcaaccaacagggggctaaccaaagggtccgctacaccaatccctatccagggggatcctcctcgcaacagcaacagcagcagcaacctcgctccgcgccccgacctcaattcgtggtgcgcgtcccacagccgcagcaacagcagagttagcaagggactcgtgcgccccgtccccctacgccagccgtgcagcctggccaaggccgtagggacgttcaatgtcagcagcgtctgtgcttcaactgcttcgagcctgggcactttgcggataaatgcccaaagccgaggcgccagcaaggccaagcgcctccccgctccagcaacggtggtaaggatgtcattcggggtcgtgtgaaccacgtgacggccgaggacatgctgacaactccagacgtcattgttggtatgttcctcattcattccatccctgctaccattttgttcgactctggagcttcccactcatttatatctgtgccattcgtggggagaaatcagttgggggtagaaaggcttaggaaccctctgctcatcaccacccctggaggggttatgacagcgaagtattatagccctgtcgttcctatagaaattcagggaattccttttccctcggatctgatccttctagacaccaggaacttggatgtgatccttgggatgaattggttggctcaattccaaggagtagtggattgtgcaagacgcactgtcactctgtaccgagggccggaacaaccggttgttttctttgcacccccaacctctgtcggtagttcagaacttcatcagataggactgtcggaaatccccatcgtcagagagttcggagacgtgtttccggaagaactacccggtatgccgcccaagcgagagattgagttccggatagatcttgctccaggaaccactccccagtacaagcgaccctaccgtatggcatcaaatgaactggccgaagtcaagaaacagttggaagagttgaaagaaaaggggtatatacggccgagtacttccccctggggtgctcctgtgatttttgtggagaagaaagacaagacgaagaggatgtgcgttgactacagagctctcaatgaagttaccatcaaaaacaagtaccctcttccccggatcgatgatctgttcgatcagcttaaaggtgccactgtattctccaagattgatcttcgctccggatatcaccaattgcgtattcgtgaagaagatatcccgaagaccgcgttcaccacgcgttatggactgtatgaattcacggtgatgtcgttcggtctgaccaatgctcctgccttcttcatgaacttaatgaacaaagtgttcatggaatacttggataagttcgttgtggtcttcattgacgacatcctggtgtactcacaatcagaggaagaccatcagaagcatctccgtctagcgttgggaaaactgcgggaacatcaattgtatgccaagcttagcaagtgtgagttctggttgtccgaagtcaagttcttagggcacgtgatatctgccaaaggagtcgctgtggaccccgaaacagtgaccgccgtcactgattggaagcaacccaagacagtcactcaaattcgcagtttcttgggtttggcaggatactaccggaggttcatcgagaacttctccaaaatcgcttgacccatgacacagttgttgaagaaagaagagaaatttgtgtggagcccgcaatgcgagaaagcgttccaaactctcaaacaaaagctggtttcctcgccggtgttaatcttaccgaatactcgcaaggatttcatggtgtattgtgacgcttcgcgccaaggattggggtgcgtgctcatgcaggaaggtcatgtggtagcctatgcctcacgccagctacggccccatgaaggcaattaccctacccatgatttggagttagccgctgtggttcatgctctaaaaatctggcggcactatctcattgggaatcgcagtgaaatatatactgatcataagagtttgaaatacatcttcactcagtcggatctgaatcttcggcagagaagatggttagaactcatcaaggattacgatgtgggaattcactatcatcctagtaaggccaacgtggtcgccgatgctctaagtcaaaaaagtcattgcaacactcttggcgtccgtggcattccaccggaacttaatcaacagatggaagccctgaatctaagcatagttggtcgtggattcttggctacgttggaagccaagcctaccttgctcgatcaaatccgcgaggctcagaagaatgatccggatatgcatgggctcctcaagaacatgaaacagggtaaagccgctagtttcacagaggatgaacacggaaccctatggaacggaaatcgggtctgcgttccggatgacagggaactaaaacagttgatacttcaggaagctcacgaaagtccctattccatccaccctggcagcatgaagatgtacttggacttgaaagagaaatattggtgggttagtatgaaacgggaaattgcagagttcgtggccctttgtgatgtgtgccagcgcgtcaaagccgagcaccaacgaccggccggactcctccaacctatacaagtgccagaatggaaatgggatgaaattgggatggattttatcaccagacttccaaaaacccaaggtggatatgattctatatgggtagtcgtggatcgactaaccaaggtagcccggttcattccagtaaagaccacctacggggggaacaaactagctgaactctacttcgctaggatcgtaagtctgcatggcgtccccaaaaaaattgtatctgatcggggaagccagttcacctctcatttctggaagaaactccaagaagagttgggaacccgattaaatttcagcaccgcatatcacccgcagacagatgggcagacctagcgtctaaatcagatcctagaagatatgcttcgcgcatgtgtcctagatttcgggaagacctgggataagagtctcccttacgccgagttctcctacaataacagctaccaagccagcatacaaatggcaccctatgaagcgttgtatggacacaaatgccggacaccgctattgtgggaccaagttggggaaagccaagtgttcaggaccgatatcttgagagaagctgaagcgaaggtcagaaccattcaggataatctaaaggtggcacagtcccagcagaagagttatgcagataaccgacgccgtaatctggaattcgcagtggacgattttgtgtaccttcgggtcacgccattgcgaggtgtacacaggtttcagacgaatgggaagctcgcacctcggtttgtgggtcctttccgtatcattgctcgatgcggagaagttgcttaccagttggagctgcccgcctccttgggcaacgtgcatgatgtgtttcatgtgtcgcaactcaagaaatgtcttcgagtgccgtccgagcaggccgacccagagcaaattgaagttcgcgaagacttgacctacatggagaggccagtgaaaatcctggacaccatggagcgcaggaccaggaaccgggtaatccgtttttgcaaggtccaatggagcaaccacgctgaggaagaagctacttgggagcgtgaagacgagctgaaggcagcccatcccgatcttttcgccagttcttccgaatctcggggtcgagattccgtttatggggggtaggtttgtcacgtcccaaaacgactctaaaatacatcctcaaagagatgcctagaataattaaaaaccgtgtgaaagcctccaacaattaaaatgtgcaaagttaaaagtcaattaaggcttagaggatttttgtatatttcctaaaagcctaaaatgcgtaaataaattttagtggaattttcacagcacaaataataattattaagaaataaacaaagttaaaatgattttataaaaagaaaaactctaaaaagtcccctttccctccctctccttcttgggccggctcggcccatctccctccccctccctctcctctccccacggcccatccggcctctccccgcgcgcgcgccgctgacgggcgggcccgcccgccaccctcgctgacgggtggggcccacccgtcatccccttcctcccgccgcctcccgccgtccccgtgcgcaataaagtagggggaattattccccgtgattccctctccctttccccccatttttccctccctctctccctcagattcgtttggaaaccgttcccctaacctcgccggcgccattaatggcggccgggtctcccgcgcccatttccccctcctccggccgccctctctcactcccaaccctatataaaccctccccgagctccccaccaccgtttccgccactagccgcctctctccccgccggaatcgagctcgcgccgtcactatctctctccaccgtcgccgccgagctccggtccgccgccgttgtcgccccggaccacctcccacctcggcgccgcctccttcggcttcgccgcatcctcgccgacctcgtccacctctccgtttcggtcgccgaccgccggagcaccgtcgaccccatccaccctagcttcgccgccgccttcctctgctccggtcgccgttttcgtcatcgccgtcgacccggggtgagccgtggaccgccgcttcgtttccccctttccctcccctttctcgggcgccgctccgccgtgcctatggccaccgccggcgaccataggggcgcgggcgtgccgcctcccgccggccgcaccggcgtggccgccttcgggcgcgcagagtggccgccgcgtgggggccggctgtcagccgcccgcgccctcgggtgcggctgatgcgtgggacccacggcaccggccggtg

SEQ ID NO: 80966 - DNA, 1386 bp, Oryza sativa
ttgtttctggccatcatcgcttgcccttgttgccctgtcttgtaagcaacgaactcgtcccaatgatcccttagctttgggaatacgtcgaagttcggtgttagtcccttcaggatgtatttcttgtagagatctcccttgaagctctggaactgttctgccattttcttcagagtccactatttcactaagttatccgtacccgcgggtagcgtgaacgtctcgagcattgtggtccacaacatctctttctctgagttcgggacaaagctgtcatcatccccgcgtgcccttgttctgcgccagtacaccgtgctgacaggcacgttgtccctcacaacccaaccgctgtggcgtacaaaattcttggctgcttctgccggtgcactaggtcagtcgtcttcgtccacctcagttatgatgtgccgaccctctatcttcttcgcggcacctcgttgtccgcgtgccctcttctgtccagcagagggctgacttccactagcctcctttgcatcgttcccctcctcgttcccctccgcatccctctccacgttcccctcctcgttcaagtactggtttggatcctcgttcccctcttcttcgttccagtactggctgcttccctctgcgattgtatcgtatagtatctgttcctcatcgcgatcggccatctgtgcatacaaaaaatatttgttaggtatataggatgtatttgctaaccgtaatattgaaactctgctaatcttatattaaatctcttataatcttatattaaatggctactaatgtcatattaaaattgtaataatcatttatatatgctaagtctaacaatcttatattaaatctctaacaatcttatatttaatctctaataatcttatattagaattgtaatagtcatatatatatatatgctaagtctaataatcttatattaaatggctactaatctcatattaaaattgtaataatcatttatatatgctaagtctaacaatcgtatattaaatctctaacaatcttatatttaatctctaataatcttatattagaattgtaatagtcatatatatatatgctaagtctaataatcttatattaaatggctactaatgtcatattaaaattgtaataatcatttatatatgctaagtctaacaatcttatattaaatctctaacaatcttatatttaatccctaataatcttatattagaattgtaatagtcatatatatatatatatatatatatatatatatatatatatatatatatatatatatatatatatatatatatatatgctaagtctaataatcttatattaaatggctactaatctcatattaaaattgtaataatcatttgggctgcaggaatt

SEQ ID NO: 80967 - DNA, 34535 bp, Oryza sativa
accatccccgttgccgtctcggctcctcgtccgccgccctcacccgtctccgccccacccggctgccgtcgttggtccctcacccgccgcctgcagccgcctccgcgcctgcctgctgctggcctcggctcctcgcccgccgcccgagcccgcctccgcacccatccccggcgccgacctcggctcatcgcgtgccgccagcagcccgcgcccgctaccgcctcgcctcctttgccctcgccgccgcctccgctggcggcaacggctgcaggtagaacctctccttcactggagggcagtggtaggaggccaagcttgatgggcttggcggccttggtgagcgctgcctgcgcgagggcgccgccggtgatcccagtggcgacgaggccgagcatggcgcagcggctggtctggacgttagcggcggtgtcggccgtgacaggcgtggcctctgatggaacgctgatggagaagagagagagagagagattgggagagagagagactgacaggtggggcccacctatatttttataaatgaattgttgactggactgccacgtaggatcaaaaccaccgtggattaagccagaggggttatttgtccggtttgcaaagttgggggtgaagaatgtccggttttgtgattaaggggggtattttggtcgaccgcgatagttccgcggggggagggggtaattcgtactttttcctttttttatgattaattataataccacgtaaacgtaacgttagatgaagattaggtcacgtgccacgcatgcacttgtaggatgaaatcatagtctcaaccccttgtgagaccaagacgggtcggttttaataattgatggagcttctatgtcatgttttgtggttgaaggacgataatcatactgagatgatagagagagccatctttttttttctattttgcaatttgttggactggaagtccatcttttatgcggtgcagccgtgcaggttctgccatctgccgttcagggagagagagagagccttagggtccatagagcgttaagttacaaacaaagttcgtagaagtaactaagtatatgtcagatcatggattcgacaaatcttggctatacgaactgaattaaacatggcaaagtgtccctcacaaaaaatgacagtgaaagtttatcaaacagatgcattatcaaccgaaattcgccccaaaaactgttcggtgccttactataaagaggtggtggtttgatacaagttgatgcgaaacataaaaactagataggtatcccgcgtattgctgcgggagaattacgtgataatatagagatatgagttctaaaattttctttcttacctattatacgatttattttcatgtgtttatatattttttgtacctttatcaattatcctaaggatggttgtatggtgtttcttttggagggaagagatggaatttacacccctgatgaatcatccaaaggctaaaaacaattgagatgatgtggcttcatgagagaagagagaattagcattaactacatttagtggagataaactttatagatatataggatgtgataagataacaaggtgtagcatggtaattctctcagcagccaattcacaaaacaaaaacaacagaaactctcacatcatattaaaaacaacacaaactcttcaatgcacaaatcctccgggctaaacgccgcgcaactgctaaaatggaagatcaaagcttcctaatcctatgacaacaattttctttcttgtgctagtcatattccctttgctgatacatacatggaacggaatgcaaagtagtatatagctgtgtaaagttgcaaatgaaatcccctggaatgccagtgctgcatctgcatgtatataaattaaccgggtgttcttcacgagcgcacaccgttggggaaggacgcgtccagccatccacccttcttggcgcgctcgacgtagcagcataactgcttgccggcgtccggcacgtcgagcgcgaggtcgtcgacgcagccggccacccgctcgaagcccttggtcatctggttcggcgtgatgaggccgcggccgtagcactcggcgaggaggccccacagccgctcgtccttgccacgcttctccatgatcgccaccagcgccttcttcaccacctcgtggtggaagaatggcatcccgagctccttgatgcactggcacgcctcccggatgtcgccgccgcagtcgtactcctgcagcagcctgccgatcttgtccttcacgtcgtccagctcccacccggccttgccggtggcgccgccgccccagcaacgcagtatccgctccgcagagagcttcgcgccgagcagggcacgggcgttccggagcgccaataagccggtggaggatccccctggcttgccgcggccggcctcctcctccattttctctaggttcgatggcgcgatcacctcgtcgaccactgacctggcgaagaacatggtcaggtcctcgacgatggcggggttgtccagcgcggcgtcctcggcggactcgatcaggaggtggaaccccgacacgacgtcctccggcggcattccgagcgaggacagcagcacggacgccatctccttctcgcggctcttccggtccatcgcggaggtgatcagcttcttgacgaagatggcgttgtaggaggaggaacacgcgtagttctcggcctccaggctgctcatcacctcgatgatgtcccctgtcaagaagtactcctttatgatcgacaatgtcttcgccttgaactgccgcaccgcagcgtcgtcctcgacgacggccttcttcggctcggggcccagcggcttcagcgacgacgcgcagagccatccctccgacgaggccttcaggatcatcgatttcaggaggcgcctcgcgtttggcacgtcgagcgtcagatcgtcgacggaatcgatgaggcggttgaaccctttggtgatctggctctcgttgatgatgccttcgtcggacgccgacttgaggagatccaggatgtgcccctcggcgccgccgccgcgctccatggcgagggtgagggcgcgcttgacgatgtcgtggtggaagaaagagatcttgaggcccctgatgcaccggcaagcctctccgatgtcgccggcggcgaggtactcctcgaggatgtcagcgatcttggccttggcctcctccaccgtgatgctcttgctcccgccccacctctgcaggatgatctcgccgtggtgcggcacggacaggtagcttttctccgccctgtgaagaacctcggcgcccttgcatccctccggcaggcacgtcagctgcttggccaggaacgccggcgggagtatgtcgtcgatgatggcgcgggcgacgaacacggcgaggatgtcgacggcgtcgggcgtgtcgacggacaggtcgtcgcaggactcggcgagcttgccgaaccccttgtacacctgcggccggtcgatgacgtcgccgtacagcgaggacagcagcacggccgccatctccttctccctgtcgtggcggtccatggccaccgagaccagcttcttgacgaagtagtagtggtagcacggcacgcgcagctccctcagctcgttcgccgtcgccgcgacgtcgtccgtggagaagtactcctccaagatcgtcgtggctttcctcttgaactgcatgaactcctccgacgacaccgtcgggcttcgcagcaggctcgcgtcctgatgacaaattaaccacctcgccatgatagttaaaagaaaaaaaacgcagaggcaaaatcaacgcaaatacggatctacctcggcggcggcgcattggatcgccggcttgtgcatcgcgggaggaacaagatcatcaggacgggactccatgggggacatgctgcaactcgttcaaactcaaaccatccgagttccgcaagctgcagatgccccctgctgcatgcagggggagacacctgtaacctcggttattcttgacgtggcgtccaccaaatgcatgcaggcgccacgatcctcaacttgttacatgtacagaaacgatcggtgatgagaagaacaccagaattattccgccccgagttgtcgagatcgagaggctgccgtgttcatctggtattatttgcctttggcagggacagctctagctcagggagcgattgagagagagctgtgaggagcgagggcagcagaggccatggcttttatgtgttcggttcgagcctcccgagcaagcaggaggaagaatggccacaccatgcaaatctctggaccgagtcactgggaagtgggcccgggcgttccaggtacaggatgcaggcgtggacacggtgcatgccgattaccgagatgggaatttaggcagttggatccgatgaaccgggtcgtggcccccgcgggaaacggccgagcggttgaatcggtctctgcatccgtgcatatcaaccagatttggagttgcctattagccgcatacggcggatgcgcgtgaattttcgtgatgccggtgtcatgctggattccaactcgatcatatcctaagttcgaaccgagttctaattgaaaccagtgtgccaccctatatacgaaatttttatactcacgctctgaatactagaaaactctctgcactcgttcaatcgatcaagcaattcgcttccatggctgttttcacacgatcgtaccccatggacgtcgacgacgagttagccgatgatctcgaccggatcagtgccctccccgacgacttgctgcacgtcatcctctccatcctgggcgacgcgaccatggtcacgaggacggccgtgctctcgcggcgatggcgacgcgtgtggacccatgcccagaagctctcctttgtcgacacggatccgaaaatacgagccaagccaggccagttcggtggtttcgtggactgggcactcgcccaacgcggcgatgctaacatacaatctctcagtatctccatgcccaccagcgacagcgccacgccagagcagatcaatgactggctccgctacgccatgcaacacaccatcaagacattcaaactttgttcgccttatcattcaagctatgagacggatgatgatcacccgctgccaattctcgagttgcccagcaatgcgaggacgacgtccatcgagctaagactgtcctcttttcggctccgactccctgtatatgcatatacacgatcgaacaagcgttcgccatctcaggaaccttggcctacgcatgcgcggacagtactcgtgcaatactgactacggtttatggctcctcaagaactgtcctaacatcgagcatttagacatatatcttcgacacatgttctccatgaatgggctcattgacctgatggacaagggcgcacctcgtcttcacaaagttaggagcatggtagtgaaaacatcttacttgtggccggaacatcgttttgtgacatgtgtacggccgttgctcctgatgtgtcctggcctaagatcgttttgcgtcaagattagtggtagggataaggtgagttgatttcctgaaatatatatctagtactatgttgttctctatataattagctactatatatatgcaatatcgcatcctcaaaatacaggcggcttacattaatgcttttctgttttctttatccacagataccactatttgaggacccaaatacattggcgagccaacccaacattaccatggatttcctacatgaggcaagtataattggcttcacaggaacagatcaagagatgcacctcgtgagtttcttgtttgggtgctcaacttcaatcacgtgcatgactattctgccagaatgtgatgacaacgacgatccaaaccgtagccaactactagaaattccatttactgggcacggttgttggcattttcaaagagataaatatacgtggaagcgaacgcaatatgaaggtgcacaagggaagagttgtgcatattgagatttaaccatccctgtccctccaaccgagagaactggtagacacgagggctcgtttgttttgcgatgatgcatcaaacatttgggggaaatccaaatgttgtccatgaagacctatgaactaccatatcataaagaaatagacgtctgaaatttatccacatcactatgattaaaacttttattcacaaatttaatgatgagtaaaagttttacaaagagtaaaagtttaactcatggagatatggataaatctcaaatgtttacggtagtttatatgtttgcactatatatgtggtttgcatcatgtatttgcttcatttgtatcatatgcatcaagcggccctcgtgttgtgtttctagtatagtttgttttcgacataaaaaatatgtaaatatactcttgtcttgggagttcagcggacctttgactttttttttcttagcaaacgaaatacacatagttcaattggttaggtctctattggttaggtttctagtgatgaaactcgtccactagagtctctgatatttatctgccgcattgttcgactagtataaatggccaaatgagccacccagcccggcccaatctgagatcaattaggctggcacgacctaacctacacgtcgggtcaggttgggtccgcccatgggctacaccaatgacccagacatgacccaaaacatttgggccgggccgtcctaaaggcacaaaaactcgtgaaaacccattgtgcttctccttgcaataagtctattgtttctccctcatctctttgggccgtgtcttatatgactagaataagtctatttgcatccctcttctctctgggctagaccttatatggctgaaataagtctattttgtctcccttatcaattttgactccgtgatcattggaccatgccaggctagcccactgttccaaggcagagacccggacacgatccaacttttgggccaggccagacactagtcgtgtcgtgccgtgtcgtgcctaagccaagcctagggctaggccgtcggtactcgggtcttatagctatctataccgactgcttttactacgccgtggcccgtggatgcgtgagggggtgagatgggatgcggagaccggacggctgtgtcctgttcaattccgatctgcatgcccgattggatgctctagttgggaactcatccgattccccagttgtctctctacagtataaactcgttaatcgatcgatcaaatcttgattacgtaaactgtgcaggaatttcgctctcatggcaactttcgcacgtgctgataccatggatgaccacgacgatccagccgatgatctcgaccggatcagcgccctccccgacgacttgctacacatcatcctctccaatctgaacaacgcgactacggtgacgaggacggccgtgctctcgcgacgatggcggcgcgtgtggaccaatgcccaggcgctctactttgccgatatgaatcccaaacgacgacgggccatcaagccaggccagttcggtagtttcgtggactgggcgttcgctgaacgcggcgacgctgacatacaatctctcactatccacatgtcctaccgcaagagcgccacgcaggatcagatcaacgactggctccgctacgccatgcgacgcgccgtcaaagctttcaggttttattacttttcgaacgcacgtgatggtcaggacctgcagctgctgccaatcgtcgagttgcccagccatgcgaggacggcgtccatcgttctatttctgggttcttcccgtctccggctccctgcgtccccggcggcatgttacgaagcgctgacagagctgaaccttcgctgggcgtcgttcgacgaggaagagggcgccagcgccggcggccgcaccctcggcgacttcttgtcgacatgctgccctcgcttgcgtaagctggagatgtcgagcctgaagctgttgtctcggctagttctgcgcaccgagtcactcgaagagcttcgcatttcctacgcaaacgatctacaatcgctggacgtgacggcgcccaacctgcgcgtcttcacccacacattctgctggtacggtttaactctcgatgacatcaacgcgcggtcggtgatcaaaatcgtggcaccgaggctggaggagatcgccatggacaaccaagtgttcatgaacactccggatttacatatacatggcttgaaaagcgttcgccgtctttgtgaccttaacctaacggtgcatggacaatactgcagcaaccgtggctacggtttatggctcctcaagaactgccctaatgtcaaacacgtagaccttcttcttaaatccagcgtgttcaccacggacgaggagcttgctgatctgacggacgagagcgcaccccggcttcacaaagttaggagcatggtcttgaaaacatctaagttgccgcaccaccattttacggcaagtgtacggtcgtttcttctgatgtgccctggcctaagatcactctgcatcaacattactgaaaggggacaggtgagttaattttccagaaaatatttagcaccgtactactattctctatgagatttgctaccgtccagcagagggaggcggtaccaaatcctagccgtccgttgggacagatcaaacggttgagattgctcggtaccgtgcggtaccattagctcttatagtggtaccgtttctttaagagaagtggaagggtagtatagacttttcgcatgtaagggcgagacgccggcctccagggtgcgtggtggggtgttgatggcggcaccagactgtgggttccagacccgatgtcgattgcggcggtaggtagcgaggtgcgctgcggggccagcatcgatggacggcgaggtctggggccagcgttgatggcggcggcggcgagctgcggggttcaagggttcaaggtggcgtgcagcctgcgagatccagccccagcttcgacggcggtggcgagcatcagggtgtgtcacaaggctagcatcggcgacgacgtgctgcgagatccgatcccggcgtcgatggcagggctgcgagatccgcggccgtgtgcggcatgtgtggcctgcgactctgcgagatccagtctcggcgtcgatggccatggcgggcggctgcggtggcggtaggggcgctgccggccgcgacagcgaggtggccgtggagaggtcagactaggtgccacggcagcggcgggggtgttggcggccgaggcagcgaattggtcgtggagttgtcggattaagcatcacgccagcagcggcgagtcgtcggaccaggcggcggcactggcggcaaggaagaactgcaaagacgcgcatatgagggaggaaataatggacgcaagcatgcagcggggtccaagaatgagaatttttcttttttgacgaagaactcaggaacgagattaattgactcaatattgggagagatttttactcattcccaatcctacccctaaacattggatagccagatttgtttcagtacctagtggtactggtaccttgggtaccaagtgctggacagtagcaaatctcattctctatacgtagtactagctgtgcacaaaattctctctcttaaactgcctacgtgtttttacgtttttcctacttttctttatgaacagatatcactatttaaggaccgagatacattggcgaatcatccgaagttaacgttggaattgcttcaggaggtaactataactggcttcacaaggacggatgaagagatagacctcgtgagtttgctgtttgggagctcaagttcaatcatgagcgtcaccatacatgccactgaaaaggaggatacagagaaagtctcgttgaaaaatattatggcagaagatgatgacaacgacgatgatacaacaactcatcagcaactactggaaattccatttactgatcacggctgttggcgttttcaaggagatgtatatagctggaagcgatacacaacagaggacgcactgagtgactcagtgacaagtggtgcctgctgaaatttaaccaactctctgtctcagatagagagaattaaacatcagagctatagcccactgttaactctaatttatctatagtcaatctaatagcaaattcatacaataattgcttgctatactattcatatatggtcccacttatcatacacacaccacgtcttgaagtccgtgctgtagttggctacaaatatgtagcccgctgctcttctatcttatcttttatctcattaaaatatgtttatagttagctaatagtctgctattgtatctgctctcaaaggctagctagctattcggttgtgttgcgaagtcgaatccaacatttgtactatgctgttggggcaccattgcgttcgatttctagtatagatcgatattctttttggcttaaagattatgtacaaatcttctcatattctgatctttgaatcttgaaattttctgtagcaaaactgaataaaaaccttaaactggcgtggtggtgttgtgttgatcactcgctcggccgtgtgcgctttatccgtgctgcccaggaaaactcttttaatcaccggggtttatacatggcctgacaagcgttcgccatctccgcgaccaaactccattgattcatggacaatactgctgcaacactgaccacgtcttatggctaataaagaactgtcaagagcatctttcctaggtaccacgaggtattatgaggtacgaggtaccctgagataccaatctaatctaaccattggtttagcatggatatgatcggcctaacaaaaataaggtctcctctcttccatctgctcgtatcaggttgtccgtgccggctgtctgcgccgcgccgccgtcgcatcgagcccaccgccgcctgctgccgtcgcgcgaatatgaggttgctgtcgtgcatcgagcccgccgtcgcgtgaagatgcttgagcagtaggaattctgaaggaagatgaaggttgtccaatcgaagatgcttgagcagtaggaattctgcaagagatggaagtttcttccaatttatacaacttcccaattcccaaatctaagctaataagatttttcacataggcttttgcaatccagtatgggattttagcaccagcataacctgaaatctttaggttcttcatattagaatttggctcaaggttaccaagaatgattgaacaatcttctctgctgttggtgccatcatcctctgaccattctagagataatgagccgagatgtcgtttttccttcagcttcacattcttggcttcgcattcgaaggtgctttaactttgccagtttgcccataaaatcagatgtgtggaacaataccgttttaaacagacgcaaagatcgtgcccttggccatatctgacaccctcgaccacgggggcggccggatctggtaacgaggtgacaggagtggaggcgctagggaaggggaggaggagggctccataggatgaggaggagcggaggagacggcagccgacgacatcggcgtccatgctcgaacgcgaacggaggagatggaagccggcaaccggcggcatctgttcaccgtcggtgggagagagaaggggaaagcgacgtaccgtacgggagaggcgggggagatcgctgggttgggtgttattgcgaaattaccatcttaccggctaggctggtcctagctgatccagcagcgtcttcggtcgctgggcctggaaacatgggccggaccacaacgggtaaaggaggaggaaaaagtacatggaaggtccctcaacttgtcatcgagttataaaatcgtccccaaccataaaaacagatatatgacatctcttaactaatgaaaaccggtcacaataggtccttcggtggttttgaccccggtttattctaggtgacggctgaatcagcgtgtgatccatgtgagccctacatataaggatgccatatcggcccacactctctctttcccctcttctctcccttcctctcatttttcccctgggcgtcgctggatgccgccgccgctccgctccactctaccggccgctcgactcgcgatcgtacgtctggccgtttgccacgacaacggggtcgcgcattagatcgagagagattgggcaccggaagtccgacggcggtgccggggctcgatttcttgtatcagcgacagcacgctcgccttcagcgcctgctccgcctccggtgccggcgagcaccgccggcactggcgcgacgcgagggcgaggacgtcgagcacgtcgtcggcgaggcccaggcgcccagctcgacgaccggcaagaggtcgagcagcgtggccaggtcgtggttgagctcccgtagctccgcctccatctcgtctgactccagcagcagccgcatccggcttcgcaccgagcaatcggcgacgatcgccttgaaccaggagcacctcccgcaggcacagcgacgccaaccgcggcaactccccggcggcgccgcacagcctcgatatctatatcagctccccggcggcgccacacactcataatgcaaatgaaaacattcagttcagatctatatcagctttatctgtcatgaattctcagaagcagaactggcatggtaagctgaaagtttgtttcatcattgccaaaccgccaaatctaacaaagtaaatctaatgaacgaaaacacgaatattttagaggaaatatgataactgaatgtatccattacgctgacacagaccaatcacgagctcgaagcatcatgacctgcaacactgaatggcatggtggatctagcacagtcattggggattcattcttcaaaggattccagtccgacaagcccggggttagcactgtgcatgaacagaacagatataaacagagaagagtgagatttttctaaaacagggtacaagaaaagaaactagtctgcatcaagaaaaaattgtacgcaagcaacaatcgtattgcctactggagccatggcaacagaaatgatttcttgacgcgtcgatctatccccttcttgcaaagatggtgacaccacagagatattggttccccaaccttaacaggagcaagagaggacgattcaaaacacacaggaaaaaaaccatataccatcgatccatgaaaaaaaaaatcaaattgaacatgtagaaggcaacatgaaaacacagaccagaaagaaaagataaaccgcggcgccccgcaggtcatccaacgcggccgccagtagcttagaccgcctcgagatggacgcgaacgaggcgcgcaggaatggcgcgggtgtgtcgacggcggacaggtcgcgtgccaggcggtgcagcgaccggagcagctccctgtaggacggccgctcgcacgcctgccgccgccgcccgcccgctcgctgcagagctcgtccgctgcgcgctcgcggccgctgccgctctgctcgctagcccgccgctgccgctccgctcgctcgcccgccactgccgctctgctcagcccgccgcgcactcgctcgctgccgctcccctcccctccgtcggccgccgcgtgctcatccgcctcctcgggtcgtctccatcgacctcctacgtcatgtcccggcgcaggcggaggcagcgccgccatcaccgccgccgcgtcgcccgtcgccggccgccgacgccctcctctcccgccggcgtcctccccacccgctgaccagcttgcgcagagtggtgagagagagaaggaagggagagaagaggggtgctgacgtggacaccctgacatgcggggccatatgagttccacgctgactaaataaccacgtcggataaaaccagtgttaaaaccacctaaaatgtaaaataaacggttttgtaagctgagagatgttggttttgtgggttgagggatgattttataactctcgcggcgatggcggcgcgtctggattcatgcccagaaactctgcttcgacgacgatcggcaatcgagatggaggaggttagccaacttcggtggtttcgtggactgggcgttcgcacaacgcggcgatgccgacatacaatccgtcatcatcttcatgtcccgcctcgacagcgcgaggccggagcaggtcaacgagtggctccgctacgccgtgcggcgcgtcgtcaaaactttctggttcaatgcctgcgattcgacgccgatcggtgcgtggtgggcaccgccaccgcgtgaccatggccaccagctgccaaccgtcgagttgcccagctatgggaggacggcgtccatcaacctcaacctgtcgtcctaccccttccggctcaaactcccggcgtccccagcggcaaggtacgaagcgctgacagatctgagcctcagctcggcgtggttcggcgaggacgaggccgtcgccggccgccgcaccctcggcgacttcatctcgtcctgctgccctcgcctgcgtaagctggagatcatcgatccgatgcggttgccccagctggtgcttcgtgccgaggcgctcgaggagcttatcgttgcatccacgcgagatacgcagacgatggacgtgacggcgcccaacctgcgcatcttcgaactccactacttcaacagcatgacatcagtgacgagctatggggaaagcatcgacttggtggtcagaatcacggcaccgagactggaggaaatcgccataaacaactccaccctggagatcgaggacaacctggacctgcggatacatggcctggcaagcgttcgccgtctcaaaaacctcactctagcgatgcatgggcataactgctgcaacaccgactacggttgagacttcgatacgagatgctcgccactcatgaggtcgatgatctgacggacaatggagcacctcgactttacaaagctaggagcatggtcatcgacgcatgtggattggatcaatatttggtcacaagtgtgtggtcgttgctactgatgtgccctgatctaatatcacttcgcatctgtttgagagggtgggggtgagctcatttcacttctagtaatttatttaattagcacaatataacagctctatatatgcaaactgcacccctcaaacacaccggtaaggcgtcgatctgttctgacgttttctttacttgtatttactctccatctacagagatcgatcatccaaggaccaagatacacggacggacaatcgtaatatatcgttggaatttctggaagaggtaagattaactagcttcacaggaacagatgaggaaatggacctcgtgagattgttgttcggaagctcgagttcaatcaagagcatgactataagtacccctgaaaaggaggtagctgataactgttcgggagactttttgctagattctgacgacgactatccttattatcaccgactgctgaaaattgctccactaagtcacctcagtcgttggcattacaagagatttgaatatacttggacgcgatatgcaacagaggacgcacgagcggtggacgctgaagccaattctcccagtccaagaacagtgagggctgtgaatattggaaaaggaaagaaaaatcaaagctagctagggtcattcttctgattttgattgtttaagtttgaatccaaaatgaatatttaggacattcaaaatattaaataaaatttgagttttcaaattgtcagggttacggataaggtataccctctacccttagatgtatgctatacggcaatacggtatatcggtgcatatacggacgttctctgaacacgctaaggaaatccatcacgaagtctaccaatggaaaggttcctacccgtataggactgggtcgttactatatcgtgcaggctccaatgtctccgagtcctacttggggaccgcctgacctgcgatataaaagggaccccccgggagacctaaggcatcgaatctcatagccgacacaacgaccacagcctacgaagccggagactacaggagccaagtcgccgagtgatctagtcgaatcaactcgactacgatctcgtcggtactaccgagttctacttttccctttgtaatatatggttctttccatataatcccatatcaactggattagggctattacctgctaagaggtctgaaccagtataatctttgtctcttgtttccttaatgtcgtattacgtagatcctcgtaccagcgtaccccaataccctctatatccggtctacgggtacccaccgtcgacacaaatattccttatgtcttcacggtgtatttctttagtgctatagatgttggttcatttttttctaggaatttggttaaagttaaaaaaagtttgatttagcataaaactaaaatgacttgtacaatatgaaacgagagtatccaacaaagaatgaaataaaacacaccatatgaccgcaaaatacccagtaaacaaaaaaagttcactgcttggctattagctgagatttcaaattctccctacttaattatctagttgatattcaggaaattcctttttttaagtggaagtgtggagtatgcatttcatgtgagatagcagtccacggaaataaatgggtcttccaatgcgaagtactaggtactaggttttgtttggtggattggcccatgaaactctcctccctcgcatttcgccatttctcgcatcaacaatctgagggtcacgccgtcgccctgcccgcctcattatcctgtcttttcccaaaaccctcgcatccgtcggtctagcaaaccttagctagaatgaagctcgttgcttgttacccacaagaggagccaatagaagatgggtgccgaaaacactagttcacgaatgtgcgtgaactagacatctcgcgatcagttttccaaccatgtagtgacgagagctggggtagggttaggttttcggggatggggagggggaggggggaggtggtgctgggggagggtaaagtaggggatcggatttaaagggatcgcctgagaggtggtgcactggtggtgggttgtcacaccccaatctggcaccgccgtacaacggcaactgacaggagcgtatcgtaggaataacggcgcgaaccgcttcctacgaaaccgcaatctcagtactagtcccaggacatagtgctggtacccatggtgacaaatatgaatcattgcaaatccttaaaataaatagaggatttatttaccttaacttaggttgcagctcagaaaagcccgagaatgcaaccgacgacacggacgaggaaacaccaacaacagcagcagcagcggaaccaacggactaacacccatctccacaggcgacggctgggagccaggacgaaaccctaatcttcacttcacttcatcttctcttcagggcggaggaactatatatatttatttatatagagcaagggtgagtactttcgtactcagcaagtcacgggaatttaggtgtttaatgcaagcttggaagagaggcgaggttgttttacaattcctttgtttgaaatcatttttgaaatcactaagtgctttatttctttttaactttgggtcgaaaggagacttgcgtctcgattcgacttaagagatgcttttcaacaactcaaatggtaatgtaccgacctcccgggtcagatcattacttctcaactcccggagccatttcacttgattaaccggctcccatagcctttttcattttctcggactcccagagtctagttgcccagcagcacaacaatccgcttccactcgggaagcctagtctatgatgtccgcagacatcccgaatcacacatattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcgcggctgttcgaccagttagttaacctctacagaggggtacattttacccacaagatacgaacttattccgaacacccgtcggtatcggaggttcgcaacaaagcctttcccaagccgacccatggatacctcatgccacatagaaggatcaaatcctcacataagtataggccattttagttttcacaaatcaaattccaaccacctcgatcggtaattcagcaagcttctcttccttgcttaccaggaacctggtttggctccaaccgaccctgttcccaactattggcatgcgaggtttccctgaaccgactagttacttagccagggtgtcccattccaccttgtggttgcactttgattatgctcgataagtttcccacaggaatcggtccttatatgcgaatacgggacagcgccacgtaggcacaacccccgcatcgcgagttttcacaattcattttattttcaaacacaccgacaccacatgtcgggttttcaaggcttctcaaactcatttcccaaattatcgacaatcgatggtgtctgtggagtagttggtatacgtgctcagagagcacggataccgaagtaccacaagggtggagcgacaaggaataagggtagtacaacctacaggaattagtgtgactaatgggtaggtccgtcggtttggcacgcaaaccgaggccaagcaagttaagtgtgtgattctaatgctgcaggttgcacacaaaataataatgattttccaattataggagcaattggtcaaagggtgacttgccttgctcaaggtgaagatgaagcttcacgattcttcgagaaaacccgtgatcgacgaaaatccggtaaccgcgactatacgtaaacaatcgaaaacctaaacaaaagaccaaaagaaacaccctatttagactaattaatagtgccattagatagatctcaattttacggaattattggaagtggaacggagtcaatcggagttacggatcgagagatatgaattttggaagtttaattggaatatctggaataggagaaatggtttatggattttatagaaataatattctcaataatattattggtagtcattgatatgtgggaccaaaggaaatgattcatggaataaagaattgatttatggaacgagggaaaaggatttaataatccctttggaaaagaaaaggaaggagggatgataatcagacttccttgggcggctcgcggcgcggcccgaggggcttgcgcagctcggccgagcctaatgggccggcacggccgcgaggagggcggcccaatggggcgcgggagggggaggagaccgaccgggtggaccgcggtccaccacgcggggtcccgggatggggcccacatgtcggcggcttggctcacggtgggggaggcgcatgcgggtagcggcgctagggttcggtggggttggtttggggttggtgcaccgggtggacggagaggaggtgggcccacgtgctgccgcacgccttgtcgtggaccgcgagcacggaagggaaaacggagggaggggccgaccggatcggcgtgaccgggtcaagccgacgtggctgccacgttggcaagcgggaggaagacgaaggctgtgcccgagatggacggcggcggcattcaccggagcaaggcgcgacctcaacggaaaaaggaagcacaccgggaggagggatgggacgagaggaagcgattcaacggctcggatgcgacggaggaggtccgacggcggcggattgcggcggcgaccgtcggcggcggaaaaagaggggaatcgccggtggtcaacgagggttcgattagaggcggcgggagcatctccggggctcggggagctcattcctggggtcggatgggacggaggagtcccgagtgaggccggcgacgagcggcggctccccggaacgggcggcaatcgcgacgagaccatgccgggcggcggcggggcttggggcttcgtctacgcgcgttcgggagggctaccgagctaccgcgcgagccaaaagagggagagggcgagcgagaagggagaacggagagagacactaccgagtcgagacgggcgctgtgatgggcgaccgacggcgcggggcgagctctccggactcgggccggggaaggggaaggagagggtgcccgtagtcccgcgtcacgtgtcgtcgcacacaccagcttcaccagcacgtgcgacggcggagggaggcgaggtcggcgagcggcagagatggtccggcggcaatggcgcggtggaggttgggcaaggaaacgaggaggaaagggaggggctcgagttgggttttataggcggtggtgatgtcggtttggggaggaaaccgacctaggcggtcaaggagaggagctggcggtcacgggcggtgtcgggcaaagtggaaaaaggagggggaaaagggagcgcggttccttcccgatttgagcgagcagagggaggaggaaaacgcgcgtgagggagagagaggcgctgcctccgcgtcttggacgcgagcgcacggaggtggggcgagcggcagggcggcatgggcggctgcgcggcgcaggcggccagggttgacgcggcggcgaccgggcggtcggccacgcgcgagcgcgcgcgtgcgaacgcgagggcgcggccggatttcgaacggcggcggcggcaaagcggccccggggagagagagagagagagagagagagagagagagagagagagaatcgagcgagagaggaaggagacggcgacgctctctcctgctcctgaacacgcgcgacacacgtgcgagagagagacggaccgagagggagagatggaccggaaagagaaaaacggcccagttgaccaagagggaggcaaaatagacttttaccgagagaactgatttggagggtttggagcttggggtttgaatttcaaatggggatttggttatttttggagtcggggcaaatatttggcaaggattcaaaggtagttagatagatcaatagataaatagacagttggatacgtagatcgataggtagagggatagatggatagataggttagataagtggatagatcgatcaatggatagggagggattcaaggtgagggttcaatattttcttggaatcggtaaagtttttggcgagggttcaggggaatagattggatgtttgagtttgattttgggaacttaaatttggaagaggaattctgaggaggcgatttttttgacggcgacgagagggatcaaggacggatttgaattaagatccacggcacgacttagactctcacacagagaatggaattttcgcatataggatttttgccgaattagtttttaacgcctcacaaaaagcggagcgttacatgggtggcgaacaagggtggacgagaggcgacagcgaagccatgggacggtgggccagtattggtaacgggggtaaagcgagggaaagaggatagtgaggaggccgggtggcggcaccgtaagtggaaagaaatagcagcgtgcgcaggaagaatcaaatcttcaacttgcaatacacatgtgcgcgagctatcacctcatttcattttcttatatatacaattttacataccggttatagtgttacgtgtagttcaaactagctgggtggcccgcgcaattgtgcggctagcacccaaacaaaattatatattttttatgattttactaaaaaaattattaaatagctatctcattgtcttaagagtttgaaagaccaaaccttatcatccccatgtttctaattatatagttttttaaaagtcacaccagatactaccccttatgtcatctccttctttatttgcttgctcgatctaccactatttctattcattctccttagaacctttaaacattggatcttataggttttagagtttattttcacgttgagtttcgtttttataatttctagatgtcccgtcaaacgttgccattatactcctctatgacccgtttactgtctcttctctttattgtcattgagattttagaaatcgaacataattatcgtttgggttcatttttactttctagaagtcccgctaaaccgtcattgactttgccattgtacttctctatggctcgcccgctgcctcccttctttattgtcattgagattttaaaatcgaatatgactatcattgtttttttttactttttagaagttccgaaccttcaaaaattgaaccttgtagtttttagagtttattgtcttgttgggtttcgtttttttataatttttagaagtcttgtcaaacgatgctactatgctcctctacggcccgtccgccgcctactctttattgtcattgggattctaaaaatcgaacataactatcgttggaattcattttttattttctagaagtcccgtcaaccatcggcagctctgcaactatactcctatacaccccgctcgctgcttctcctttttattgtcattgagattttaaaaatcgaatatgattatcaatggggtttattttttttactttctagaagtcccggcaatcgccttgatcgtttgctttacggcctccctatcgcccctccttttaatcgtcattaggattctatttggtgtttcattaacaattttttttatgtcgtatcaaccaccaccactactcctttatatgcctgttacttaatttatctcgtcatgtgttttagatggtcttttctatcaatagtctttatttttatcacaaattttagttatttataaattgtattcctaattggaaccttatttttcttttttctaatttcagatttttttaaaaaaaattaattaatatcgaattgtgttcttttaatatttttattttttattttcaatttcagttgtttcaaaattgtattcctacttgaaatctcttttactttatctaattttggatattattttatttttattctgaattttaattaatctcgtatcgggttcttatatggattcttctttcaatattgcttatttttaattctgaatttcagctaattttaaattgtattcctacttgagctcttcttttattattttttttgctaatttcggattttatttttatttttattcccaattttagttaatctcgtattaggttcttatacggactcttcttttaatattccttatttttaattctgaatttcaactattttaaaattgtattcctacttggactatccttttttttttctaattttggattttattttatttttatttcgaattttgattaatctcgtattgggttcttatatgaaaacttttttcaatattccttatttttaattccgaatttcagctatttttaaattgtatttctacttggactctctttttttttctaattttggattttattttatttttatttcgaatattaattaatctcgtattgggttcttatatggaaacttccttcaatattgcttatttttaattctgaatttcagctatttttagattgtatttctacttggactcttcttttctttttttctttttctctgattaatgtgggaatttctagcccccacatcgaacgtggtgcctcctttcaaagctgttttaataatataatagatacaaatacaccataattacatttagaagtttttaactcagagcaattgtttaatttgatgtcaaaattaaccttaccaaaatttggtattgtcaaaagttggcgcatttttatagtaccaaatgttgatagcgttagaagcgtttagtttgtagccttatcaaaatttagtaatgctagtatgagagaacgtttatggaaataccaaattttagtaaggtgtcaataacaatagaatgttcggtttgttccttaattttaataatttgaccctttgagaaaacttatcaaaattttagtaaggtgtcaaaaaccaattttaaaaataggccggcaaacttgaacctttgcttagaggcttactggcacttgctccaagcaacgatgggccatccgtgccgagcccaacgagctggaccacaaagcccattgtcgtacggtcttttctccttttcggtaaggccggccgggctgcgacccatcgctaccagccacccgtgggcaccactggacagttggggtaaatgttcttattcttccctttttttctgaaccaaaggagcaaaaaaaatgtttcctgtaatcccgtgtactgcagcatggcacactccgtttgcatcgctgcatgcgggggcagaaacagccaagggcgattggatcttcacttgacgcgctgcatgatttgcgtcgtcgtttgcttcctggccattgcgatcaatgcctatctgtatctgaccatctgccattccgcgtagctttccgacttcagagcacccgctcttccatatatcgtggatactctcttcaacagagccatgatgttggtgcgtgcgagtggtacgtggaaaaacgggcgaaagaaacggagtatcagctgaggcggagtactacgtggatctcaaaatctccacatttcggtggcttcagaatccatatgatggtattaaaatattttcgatttgtttagatcgaattacaggtgcgagcgtcacgcgcgcctagcctttccactggccagcacgtgtgtaccattgcaaagcacgccaagacgcaagacgcaagacgcgtgccatgctggcggctggcttgctctatctcccatgccagtatcctgcaagagacgttgacatgtacgcagacacagtgcacactcaccctctcgagaaagcttgtaaaaatacaggcagtcgctctgcttgttcggatcgcgtattctggatttacggttgaaattgtgtgcgaagagtgctaaacgagtaatgggagccggggagaagtttctctgattcgcaccggcttgggaggatttggggactgtttggttggttgtccaacactacctaagccagccaaatatttgtggttaagttgttaaagctgtgatcaagaagccacaccttaacctttttaccatatattattatgtctatgatccaaatgtgggatcaagttcaaggaaagtttgatatgactaactcgtagttagaaccaaacactgcactaaactcagtaaaacatccttatcatacttgtggtaaattgaggcaaactttggtaagcaaccaaacaccctcttcatgctggattttccacaatttgaactttttgaaaaacttatttcgcaaatagacccttgaaaaaacttatcccgaaaatggtcattttggggcgtcaaagtagctggcgcagtcctcctaccaccgtggcggggcggcgctgaggtggcagggggagcgcgccaatgtagctggcgccccccttttttatttattatatatttttttcacacttaggagcacataagaaccaaccataaaaaaaataaactcaaatagacgaagtatgtgacctatagaatttttcaaagctctaccgaaaagcttctcgcctcgaaaacataatcttgcaagtggaatttggaggttttaatttcctcgaacccagcaaagcgggggagaatcggatgtaactttttttttaagatatccgtggatatattatttgcctgattccaagtccgtatgagaaagttacgactgtttcaagaaatgacacccgaatgtaacaaaaagaaacacgaaccctaactttttttattgtttataggatgtgaaaaatgtaaaaaagtctaagagtgttcgaaatttaatctactttctttggggactacaggaaaaaccaaaacaacgaaaagcagggagaacgcgggggagggggggtcttttcggtatagctttagaaaattttataagtcacatatttcatctatttgagtttaatttttgtatggttggttattgtgtgcttctaagtgtgaaaataataataataataagttgtacatatctctcctctacactagagagaggaaaaaatggggggagggaggggcgccaaccacattggcgcgctccccccacctcagcgctgccccgccacggtggcaggaggactggcgccgtcgtattctggcgtcttaaaaaggattatttttcggataagttttttcatgggtttatttatgaaataagattttttaaaaggactaaattgtgaaaaatccagctcttcatgcgtcgcacgcgccagatccgttagcagggcaatgtgagcattcaatccatcgtgcacacgccagtagtgcaaaaaataagcagtcctagtacaagagaagatcgcgtctagcactctccgatcacgatgtcacgcgaggtcacgttgctgtgtggcccgtggcatgttgcaaattgtcaaaactcaaaacctaaccaccaggagatagctagcactctctcgctggcttcagggatcacactctaatcacggtcattaatcccactcatttccatggtcataagatacgtgcagtactctgttgttgttgttcctaccaactgcagcactgaaagtagcttttcagacccttgcagcacacagttttacagccgcgccgattttgttcgttccgtttctaggagtagcatgactcagcgagcaatccgttgccttccacgtgttaacctatatttcggactctgtccagaactccagatgcgaaggcgaaggcggaggatttcggctagcttggtgatgctgccgttcgcgagcattttaaatacggtgtgggggcgttcctcctaatggcgaccctactacttattgcttgcctccccacccggcgcccccatctctctttgcgccaaaggtaatccatccatcgaatcctgcatcttttttgcttgtgccttgtgttgcaaagcagtcttggattccttctgttcgcattgccctgagagttctagttcgatccccaactaagagcgttttgttttcgtttttcttctgttcgttcgttctttcgatctgcagatcctacaaactcgccccccgaataaccatggcgtcgtcttcgtcgtcgtcgccgccgtcgtctgacccgtccttggagacggtagcgccgcacgcggctgttacgggggagcggaagctcaaccccaacctgcaggagcagcttcccaagccatgtaagcgattctatttctaccatgcagggatcgaaaaaaaaactgttctttctttctatctttctttttctttctcgatcgtctttgatgtctttggtcagtggtcactgaacactgataacctgataagagagtgagaggccggagttggctgcaaagcacgcggttgtgcgtgacggcagctcgacgtacatcagttgagacttgagagatcatatggtttaagtaccaacagaaagaatgtgtaattttaccatttaatttctctagatactacgtatttcgatgtactaaaatttttaagtattataaaatcttgatatctcaatgtactttgtcaagtaacgtaaaatttctgaaatttctcagaaagtatacatgagagcagtagcaccgctagtgctttactggtactgcatcatctgttacagtgcagaaaaattactaccgctccagtaactgatcctaaacctgatgtcgtaaccgtagccagctaactgctgctgtttttttttctttctgggttcgcgtgcgcgcagatctcgcgagggctctcgcggcggtggacccgagccacccgcaggggacccgtgggcgcgacgcccgcggcatgagcgtgctccagcagcacgccgcgttcttcgaccgcaacggcgacggcatcatctacccctgggagaccttccaaggtgagtgagtgagcgagcgagtgagtgatccgcccgtgtgtcttgctgtggatgaactctccacgtcgcgatcagtccatctctctctgctgctgctatatctgtgtcccgtttcggacaggcaaacagtttgccttctaaggttgtaattaagcttgacgcaacagaagagattaagagattttagggtcgcgtgttaagtcagaattatgcttccaaatcaacgattgcttgtgcagtgcagatgtagtatgagactttgagtatatggtatgttttgttttttgtttttcacagggctgagagcgataggttgcgggtatcccgtgtcgattgctggtgccatactcatcaacctcgtcctcagctatcctactcaaccggtaaagtttgccctctgtactccacgtgctccttattttcaatactttttaccaacatatatgccgtgccttttgctgtattgccaaactgtgtgatcatatctggactaatcttacgtcaaaaaaaaaatctggactaatcttctcgattatgatgtaaagaaattgtataatgttttttagggcgttctgaattttatatgttggtctgaatgttacaccaccttcttttgtaaatgtgaagaggtgtcactaggctagtgaaaattgaattgtagtgacttttgtaagtgggaagacatatctatcttcacttcaggctttggatttgatgtgtttttttatggaggggccaacatgtacagatgaacttatgtttactttctttcaaatgcaggggtggatgccttctcctctgttttccatccatataaagaacattcacaagggtaagcatgggagtgactctgaagcatatgatactgaagggaggtatgtaactttgtatacataattgttaagttcctctctttgcctagaaacgattacaatttctatctcgtttcaaatttctcactaatttatatgcttttactaggtttgatccatcgaaatttgatgctatattcagcaagtatggcagaactcatccaaatgctttgacaaaagatgagctgaactcgatgattaaagcaaaccgcaatatgtatgatttcattggctggtaagcggatggttgaattagcagtaccgttcgccatcatttttttttttcagttacaactttgctaattggttcttcctgcaaaccatcacaggattactagcgctggtgaatggatgctactgtacagcgtggccaaggataaagaagggctgttgcaacgagaaactgttagaggcgccttcgatggcagcctgtttgagcgacttcaggacagcaagaaatctgcttgaatatagcaatgagctgtgctgctcgaagaaagcgttgacagtaaagaatctaataagattagaaaaaaaaagggtctttgctttgtgtaattcaaatgaaaaatgttaattaccccatgacagtatttatgatgtttgcaatgatcaccacctcatgatatagtcttgttctttctttttgtatgtgcatgttccaaatttaccctcatttatttttaaaatcaaggtgaagttacgcttgttgattcgtgttgcgcttatttaagcgtcatattaacgtatttgttccggaagtttaaacatataattctccccccaaaaaattgagctatatctgataaactgagaagggaccataaaaaataatttataggttaaatttaaaataactccaaaataattttaaaatttttagtgttattagaggtttaaaagccaatgttaaaaaataaactacaataaaataattataaaacaagctgtataactaaaatttaaatttaaattttggttgtagttaataaatcaataaggagactatagatgatgatgggaggcatgcacaattgtttcaaaatagtaaactccaaattatgtattgtaatgcacataagcactcctcccatcccaagtctcaactatatagattttgctaaattgagttcgaatttgatgcgtccaaaatgtgttatccggcaactcatatttgagatttcttttgctgtataatatttttttattaagaaggaaaatccatcgaaggacttgttcaatttgttgcccaaataaagtataccaaattttggtaatgctaaatgacacattttagcattattaaatttggtaaattttaagagagagcttctgaaaatacctaaattcgattatggagggcatgctgtgtgttgtcgttaaatgaacagttatttttttagtttttgttttggtgtatcggagctttccagaattctagtcacgtgacatctctatattaatgaaaaatggaggggcgtcgcccttttgattaaagaaattctaaaatttgatactcccagtcaaactatgttaaatttaattaagttttaaaaaatacggtaattttcaacccaaaatagcatttatgtgataaatattgataaatttgtctttaaacttagtaaatctaaataagtttgacttagaaaaaaaatcaaaacaacttgtaacgtgagacggagaaagtactaggtagtaatggctaaagtaagtttagtttattatctaattttgataatattaaaattcggtaaagtcgaaagtgataacaaaagttgccgatcatccgagccgttgcgagcttcaactgaacggtcaagcgtgttcggttcgtctggtttagctcccctcactggaacacctctccgtcgtgaaaaccaactgccggcggcgtggaagtcgccggcgagttcatggccgccgcgctcatcgtccccgcaaacccaaaccctactccaaaccccacctcctccctccgtcccccatcgcgtgccgcctccagtgtgctccgcttcccccgccgcgaccgcgctcgaacccatctcactgccgcgtttgggaggggatcacccgcggcggcggccgagcgcggcgggaaggactactacgctacgctgaacctccgccgcgacgccaccctgcaggaggtcaagacggcctaccgtaccctagcgcgcaaggtgctgcacctgcactccccccccttcactctccgatgtcatgtcccctcgaagtgttagattgtgtgatactgctagttttagtgtatgcgcagttcaatttatctggaattgaaccggtagcgtgatatagttgcgattgagttgggccacttgcattatctgcttgttccaacctgggtaattatcgtcttctgcatcccctgcacaatcctggttacagtatatgttaaaatgagtaaaatgactatgtaattcttggtaatgtggatcatggaaatcgcacggtatcattgcaattttgagcattttcactgagatgatctacaaattgtgtactctgtctgacttggctatactacgtgtttactgtatgcaaaaaagatgaagaagttttggcgactacctggactgtattccacagcaaagctccatgaatccacgatatgttctgcttccccatttatttttttgctgttgtaccatattttaattcctccattttttaaaaaataaagaaaaggctgaagatagataatgatttttagctccatcactgagtttgcgtatttgggcctctgcgcgttggaagattattcttcaaataagcaatacatgattacacgggacccttctgtttatggagtaaaccacaaatgtatcagttttggatgttcagtgatatccaacttatactttatcatgtgctgtattactttgttaatatgcttcttaaattccaccgatgtttgcttcaagatggagctacaaatcttgaacatacttcattggttttctttcaattcagtaccatcctgatatgaacaaggaccctggggcagaagaaaagtttaaggagataagtgccgcatacgaggtatttactgatatagactggttgattttcgacgcatcttccttgtataacgtgcggttgacctaagttctggttctgctttatgtacctttatctgcaatagttgaaattccatgaaaatagggaatatgctacatttgatgttttacaatgtttacaatgtaatttctcatagattctatcagatgaagaaaaaagatctctgtatgaccgctttggagaagcagggctcactggagattatggaggtggagatattggctccaatggggtagtcattctgttcaatacctaagttacatttttttgcttctgatctgtccaaatttaggaactgaaatttcttgtctacctgatatttttctagttaattatattatccaacctttgacaattggtgtctaaatttcatatcgtgtttaccaatttttcttgtttcccatttcaccctcagcaaatgggttcatctcattttcccaactcctgactaagcctgtgatttccattgagttctgagaaacctgcagataactagaaaacatgctgcattatattggtatgccaattgccaaatattagaatccagagagaaaatttaatctgataaagttatttaaatttgttcttcaacagattgatccatatgaactcttcaatgcattctttggtggccctgataagctttttagagacagcatgggtgctgggagattccattatggtacaaaagtcacagacaacaggggacttgatattcggtaaacaattttaacctgacactgaagcaaggaactgatacttggatgtttgtttactattttaatctctcttttgtatataacagatatgatcttctcctttcttttgaagaatcaataattggaggcaaacgagaagtcagcatttttcgttatgaaacctgtggcacttgccatggaactggtgctaaatctagcaatgacataacagaatgtactcaatgcagaggtcaaggcaggttaatgaaaacacagaggacaccttttggtatagtatctcaggtgaactatttattgtaccgtatgtattcattctcagtatttgttcaccactacaaataatctgataatatcttgtggtttctttcttcttccctggatctactacaaaccagttagtagattaagtaaaagaaaaatttgctgatgaatgatgttgtgcaattataattttcttcttctgctgagtaaatagagtataagacggcttgtggagttttcatattcattgggacaggggatgaagattcattatgcaggaagccattgtatatgaaatattactagctaaatactcatgttttgctatggataaatatgagttatacgcataaatatgaattaattgtgaggtttttagaacaactcatccatgtagatgtctttgcataataaacttgtaatttagagatgaaataacaggcttgttcggctgagatttatgctgcagcaacagcaccaccacacaagagaaagcatgaccgctgcagcggctgcgctgtacagctatgcggaacaaggccaacatagatacaatatgtaccaggactattttgtaatgtgaaagtacaccaagaagtagtaggtaaaaaaaggagtaggttgggtatcggattcactgccaacaccattgtcttctttcaggagagtaaagtatatatatattctaaatgttctcacccttgacgtgcaaaagttcagctgtagtatattcagtggaatttcaatgtcatcattagctgcatatacctcataaagtaatctgttcttcaatgtttactatttgctcagggtctcctactctttgtttcatgaaccacaacataaacacgctttaggtaatatctgtgttgatatattctgcagatatctacttgcttaaattgtgatggcaaagggaaggtaattactgaaaattgcactagctgctgtgggtcaggcaaaatccaagttgaacgcaatatcagggtagacatacctggaggtattcatgatggttctgccattcgaattaccagaggaggtagcgttgataatcaaaggcaagcactgggaaaataatacataaccatgtaattcatgcaatctttgttgaattttgtatgtttgatttaatcatacagcattcaaaactatcctacatttttctttttgtttattgtcggagtgctcagaataaaaatgagtaaaactgcatgtgtagaaggtacttccatcccagtcagttaattcatcatagaacactaaatctcttataaacattcctctcaggaacttatatatttatgatgtattaaaatatattatttgatgttatccatttcatcttattgtgcaggcgcgcaactggtgacctatacatatttgttcatgttaataaaaaagaaggcatccacagagaaggcctcgatctgttctcagatgtcacaatagattatactgatgcaattttaggaaccacagtgaaggtgagctgttaaatgtggctccgttcatattatgcattacatagcaatgacatatatttatgtaatgctagcaggtagcagcagaactctggctccagctttacctagaaagagtgtttcttatttcaggttgaaacaatagagggattcaaggatctttatattcctcctggcactcagcctggggagcggctgaaatttgctcaactgggagctccagacattaagaatcctaccattagaggagatcataattttgtgataaatgtgaagatcccgaagagtatcaggtttgagttgcgagtattgttgtactttgtgat

SEQ ID NO: 80968 - DNA, 23811 bp, Oryza sativa
attcctgcagcccccctgtccatggcatcttcttcctgcaaatatttttatgggtcagaaactcagaatggcaacttttagcaccaataataaatgtcctaattaagtctagcctagttagatatagtccaccattagtggtaatcacgtacatcctcttcctcagcctcttcagcatgctcaaagaaacttctgatactttcaccctttgtaattgtcacaaaaccattccctaccaccagtctgtggtgtacgcacgattggccctttaaggcatgtgctttaacgcacagctctgtgtaggtcccatcaagcttccaagctctcaaagttatgaaatagtcttcaaactgatcaagattaataccatctctgtggacttgtacattcatcccaacatcttcaaagccgaaaacatcagattgcccttcatctgtcccaatggcccattcaaaatgatgataagatccatctgcctctgataaagtttggcgccaatcaattatgacagcatcctcaaacacctagaaaatagagaagccacatgtaacttgaatataactcagaagctattgaattgaagttagaatagtgaagtgggcatcgaggaggcaccctgacctcacactggaaatcagtgtctgcaacacagaaccaactggtgcagcgaggttcccttcgcatgcgtttcagttccttcagttccttgaattcacggataacattccttcggcaatctcgacagaatctcttgctctcaaacctattgacatttgtattaagaaaaaataaaatcaatcctacactgatcaattgtcagttgctggataaatacaaacaaatagatgcattattggcaaaaaaaaaaatccctacatatctaggtagatcatagatagctatcagtatatgaaaaagaaaatagcaggcccttattgtatttgcatcagatagctatgatcgttaatagaattcactgaatatctgcaagtcagttatgaactcactagttcaactatgttactaataatgtccatgagctgaatgcctattcaggtcaaaacaacttgttatcactaatttaaatttgcatgatatggaggtcaacttcattatgctcacctacgcataagtctttccatgaaatcctcctccttcatccgcagaagagataatctagtttcttcactcaatgctgaccagaaatccaccagtgtatcacatgaaaggcgagcagtatgcagagcacatgtttctcttgttccataccccctgctataactagctaggcgttggctaatccatcctctgccactgccaccacatgcatcaggataaagcatctctctttccctttctcttgcccgtgcattatcaaatacctgattaaaccaatgttgaatgcattaaggtataagctaatcaagtaaacctatcctgtactagcattgaaacttctaggttaacttaactccacaaacatgacttggaggttgcttaagaaaaagtaacagaagggatcaatataaaaatcagagcaaattagttattaattgtacaatcgccaatgaactacacaaaaagagacatgaatcccaagttgaaaacttacattctgaagcacccgcaatgattttgcatttacaaagcagtcaagaagcgtaaggatgccatcttttgttgctacaaggcctccccaaggatgaactgatgggtcttcttgttccccttgcctaatccttgtttctccagttgtgttcagacgattaatatccgaggcatcacgctgcagtgtcttcccatacatgactatttgcatgaaactttccagaagcaatccattgcaccttgaacaatacaaattcttgcgtgcttgctcaatgagggtttgcttatccaatttgagaagctcctgtcgcgcttgaggaggcaagccattccagaactgaaacaagtttaatccacaaccatgacatgctcagttccctttgcaacatggctatcacaaaaacctccataacactaagacacacttaaataagctatttggtttgctttccagcacaaagggaagtgctactttaaagtcataaaaacaataaaatccagtataatctactgttcaacgataaaatgagatagctctgcagtagtttaatgacagtatcaatcaaccacaactctaatcaagactattggagcatcacattttaagcatcagaggtggtgcatcattggagatgcttcaacagagctgcaaacaaaatatctgtgtgccaaaatggggaaagaagttcaaatatcgttatgtcttatttagcagttactcttcaatcaaattatatttacaactatactagtttatcagcttgctccaatggaagaaaataaataacaggatgagcaattgaacaaatatgcaaggcatgaaatttatgattgaagagtgtgtacaatatgcatagtttgttgataaggtcagaaactcgtaaaaacttaatagagttagaaagaaaaaaaacattctacacgagccaatggcttgctttcctaaaattattctgacagaattttattttcctaacaagaacattttcatacatcagatttcatcagcataacagcacttacaggctactcaaataatcatgaacgacctaaaaccagtccccaacttttttacttcatttcaaatcaagtgccccatgctcttgcaaaacgaggaatgactgattcaattccaaaattcatacaggaagtaatcggtaacactattttgccccccacgtttatataccaaaccaggcgtacaaatctacctgccaccatagcttagagcaatgtaccgccagaatcagctcaaagccagtacaatcgagcctatcagaagtcaaaattaggatatatgcccatgaccaagtgcaacccgattgaatctaagcatgaaaattcaccactcaaatggactcacaagcttagataaaacaaaaacagatcaaccaaacaacctagctttccccgacgccatttgcagacaactcttctgcgaattacgcacaaacaaaaaacgctaatccaacccacacgcaagcaactgtctcagtccgatcctcggataacaccaccatcgattcaccccgaattcccaccgctcacatcaaacccagccccccgaccagaccaaagtcgttgcccacgcgagcctaccttctggaggcgatccaacgtgatctcgtcccgccgccgcgaccagatccccgatcccgacgccgacgccaccgccgtctccgccgccacacccggcatcacgcccctcaagcctcccgcagacgccctcaacacaacgacgagctcgcccccgatccaccgcccatccaagtggccgccgccagcgacgacgcagccggaggtgacccgccgcttcgccgcagcttggccccgggtccgatcggccgccgccggtggctagccgagtgggttttggctcagacggcgagcgagatgggaggaggggagcggagcgccgaggcgagacgaggcgaggcgaggcgaggtgtgggggtaaaaggcgaggagaaggggaggagaaggggagggatgaaatgggggagggaacgcgacgacgccgtacgctttttaaccgccacggttaggccccgcggtgcgagctgcgatgtctggaacatgggtttctagctgtttcgggatttttagcgggattttccgctgtaaaaatcagtttaaccgaggcggcggttcgctaatttggtgtcaaatgctgtcgcgtgacgttttcctcgggtggctgtctttgttttcttctttttttttattttagttttatttatttccttttgtgggatgatttctttttggtatttggtatggtgtgtgcgagtagctagtactatcttgactatatatcggagctatttttcttgtatgtttttaattaaaccgtatggttggtatgtctagttggtctaatatataaatgagatgagttactatattgttttcatttctattttaagcatgtcgctttgaggatgagatggtgatgatgaaacaacactctattcaaattcggtcattcagagttgaatttaagattaaatcaccctttagttgccttctgcaaaataaacaattcactcccaaaatcctaaaactcattaaaaactaaacaacggtttttcgtctattcatggggaagacaccaactgaaaataaccagatttactgaaaagacaccaaccaaaatagccaagcagagcccaaaaactttctgctctggactttttcaggcaattacataaaaaagcagaaggatggaaaggactgagaaaagatccacgaaaaactcaaaagggaaagctaaggacagcagatcgatgccagagggcaagcaaaaggcgaagctttctggatcgcgtgctgccgatggggtgcgcaaagccccggcgctcactgccctcgggccccacctggcagttttctactactcgcgttggacggcgaaaatgaaaaattccaatcgggcacacagaactacagcaaaaacgtatggttgctaaaaatgcgatgaacttgcgagctgtacacacaaacgatcatcgatttgtcccttcctcggcatgtacgtacaagctaagcaattaaagtatacttttccacgattcgacactaactcacgaccacatccacatgccagatacattgggtccggaaaacagcagccctgagcaccgaaaacaaaagcagataagaagagagaaaaaaaaaaagaagaactgttccaagagacgcaagaaaatcgttgagccatcacccatcatgccacgggagcggtcgccgctcggtgcgcgcgatgcatcgcacctggcggaccagcgatgggccggtggatgcaccgtgggcgcatgccaccagcgcaccgtgcgcgtgcgcggaagctgtgcacgacggagaggggggcagtggatggggtggggtggggaatgccatcgtgtcgtcatcgcctcgccgtgggagggcgacgttatgtccccatgtgcgagatccggggaccgggggggacatatggagacgacgatgatgacaccgtttcataagcagcgcgacacgatgtgtgtgcagcgcagccggtgatggatggattgatggcctgatgctatactgtacgcctgtccggtcgtgcaagtgctgcttaatcggagaacaggaaaccagtgacgtacgtgggtaccgtatccactgttgctgcaaacccaaagaggatataattttgtcacgtgttgatctgaccttgtgaagatgataaatagggactactaagctgtgtttagtttcaaaatatttattcaaacttctatttttttcatcatatcaaaactttcctacgcacataaacttacaacttttccgtcacattgtcccaatttcaatcaatcttccaactttagcgtgatctaaacacagtctactccctccgtcgtgtccaactttgactgtccgtcttatatgaaatttttttataatttgtattttcattattgttagatgataaagcatgattaatattttatgcttgacttatctttttaattttttttcataatttttttaaacaagacggacggtcaaatattgaagacggaaactagggtttgtccttttttttacggtgtgagtagtcgttaatcttagaacttcctttgaaattattggccgttgatgtaaatccttaaagttacaccatgcagtttactggaaaactctagatttcattattcctactataaaactgtgaattgtgactcactgtgtttctatataactgtgaatttgtgactcgctaatgatgtaaaggagctttcatgtaaagccacaacagtacgaacatgtggcggttagttttgcgtctacgaaagtcaccacatatactttcgaagattgaaccaatatatcttagttttgataaaattgtcttgaagactggattagtatatcttaagagagattgacgatatcatcacaagtgcattcgaagactgttccgatatatcttgagattaacatagtaaccataaacatcccgctgtctatgccacctataaataaaaatataattagcattaactctgagcacttatgttaagttaagaactttcaaaatgacaggttacatcataaaaaatctaactgactaagctacgatgagtttgtacatgggtgtcagatttttcccaaactagctaaatacctgtgcttggctacaaataaaaatgaattatacatgtgctattgtttggaacaagttaattgtaaagtttatggaacaatttcgtccctgattcatgtagatgtctttccatgatgataattgataaactgaaattgtagagatgaaataaaatattaacaatatgtagaaggaccgttttgtaaaattaaaatactggaagatgttgtttgttatattgagttgggaactcacttcctccatacggaaaacggagcaacgcattttcttatgattaattaagtatttacttttttttggggaaaaattgattaatatgaatttttaaagcaactttcatatataaacctttttgcaaaaaaaacgtaccgtttagtagttcgaaaaatgtgcgcgcgagacagagggaagagaagttgggaattcagagcaaagaacacagccgtagtatacaacagagttagtgggtgatagattcactgtcaccactattaccttttttaaaggagtaaagatgttcttagatagtactagtaggagtgtagccccgtgctgctaggtgctaaacctattaaaccaggcccggtcctgtcaatttaatggcttggagcggtgctaaaaagataggcctttaatacaactctgataatataatgatgtttctaacaaatgtaatgtataaaaaaaaattcttatcaaacaagctatatatctttcctctcgtgggcttcctagatcttaagttcctatggcctataggctcctatttccatagcatatatatatatatatggggttgggtcctttgacttcgagggctcattacgatggcacagctcgacccccctaggccaggcctgattaagaccgtcccatgcttaactatttttttctacattagagtcagaactaactaatgtgattcttcggtattattgatttctactcctccgccaaaaaaatgaatttaggattggatatgacatattctagtacaacgaatctggatagaggtatgtccagattcatagtactaggatgtgtcacatccagtactagattggttttttataaacgaatgaatttctaaaacatttatcaataaaaaaatgtctaagaaatcaaatgtatcttgctactttttttttcaagtacatacttcctccgtttcataatgtaagttattctatcattgtccacattcatatagatgttaatgaatttagacacacatatatgtttagattcatcaatatctatatgaatatggacaatgctagaaagtcttacattataaaacggagggagtatttatttttttatgaataagctagtaaaaggtaaatatgtataaaaatgtgtttaatgagaatttcatacgtttgttttttcttgcgaaacaatgttgattatattatatatataagagacgattgttacataaacaaagacattaaaccaaaccaaacttctccacatcttaaaacgtcgcaactgatacgagcatacgatgtagaacatccatcgcgccaagccagcctcccgccgctggtcgtgcctcctcgcaccaagccggcctccaccgccacccggtcgcacctcctcgtgtcgtgccggcctccactgccactagacgtgcctctacgcgccgaacctcgacgctgcacaaaagcagcagaacactttttagctcacgtcgccctccccatgggcgacacgagaggtgatgccaccactgacttcctccttccctcctccttctctgcctcgccactgcctgagcgggtgccggcaaagccacgcggccgcaaggacgacgacggcagggctttgcccagcgtacgctcggacaacccggggagctggccgggctgcggcgttggcaatctgcgccgttccggctagatccggcgggacgacggttggcggcagggcagagtggtggcggcgccgtctagcgatgggtggtgaaggcgttcgttgttgacggcggaaacccctgcccagatccacgggttgagtgatcgtgatggcggcggcgggacctcctggcgcgtgcggccgggagcgggtacggagccgaaccggcgcggaggacgacgacgacgtcagcggcacgacgcgggccgccccccgcagcgagcccggcgcgttggcaggcggtggtgggtgtgggcgacggcagggaggccctcgcccggaagccggcgcagacgatggctgaaggccgtcgtggtgagcccaacaacggcagtggtccgccggtgagttgcacgacgcggtggtttgttggacggccacgggcggctagtcgggggggggggggcatggcagacggccacatttggctggtgcggcagcggggggaggagtgctcggaggccagcacgtcatttgtcatcgtccagatatcaagtggtaccaactttacgacgtaggtgaggcatgaagtggtactttcccttttactcacatgtatcatcagatacctacatgtatagcagcccccttcacttaaacatgtcatctttcatgtaattattaatggtgaagttgagggaatcgggccgaattctccgaaactttcatacatgtccggaacttcaatccatggtacatggagtatatcagagggtgtcaacgtcttcacggggaggtgagtagatcagattggattcgacgcactagcacacaaaatatcacctaacatggcattactccagacagatctgatcgactgaataataattatactaccaggtataggccagtgcgcgattccatctactaaaattcagcatttcagccaataatgcgtggcttacagacagtcccacggccgtactacggactgcaatggtacaaccactagtgacaaagggtacaactgcagaagaatcatcctacaatcctaatagaagtacttgcactgtgaagaaatttcaaaagaatttcaaattcaataaatgaaaatatccggtctatcgaagaggctttacgttgtaaatttttactgcttgttgtttgctggatgtttgccgggtgcattgctttgcatccagtttacacctactgggccagttctgttttcctttctcaatttggaaagagtgctgggcctgatgttgggctgaaaaaggcaaaaccacatttgttaaaatgagtttcttttagcacatacaccttgaccttcccagcaatgtagggcacttacacaccattgttaagcaaaccagacaatatttacaactgacctgaatttcagaacaaaaaaattgcttgagatcatccagaacgtgatttcccctttgtgctgaactttcctcacaacaaaactcttaaacagagggatgcacaagttcagtccacataatctctaatataggtacttaactaatacagtattctcttaggcctactttcagaaatgatggccagacaatctcatttgtcttcagccgtttcatatagcataatgcggcacgtactgtagcacatcctgcatggcaagcgaacaagccagctaattcgtttcacggtggaattcaagttggtggtcatggttggctgctaggcaacttgctgagaatgttgtgctctggcttgtggtcacactcgaaatcaaggtgaacaaatgcccgctcgacttctgggagctcctcgatctttatttgaagtgattctccaatagcatgtgcctccttaaggggcaattcctctggcagctcaatgtcaacctgccagtccgttgatcaaattagctgggaagagcatatatatttacctaaaagggaaaaaaacagcaaggcaacagaaaaactgaggtaccaacctcaacaaagtaaagaaccccaaaggtgtatgctcgaactgtatcgacacgcttgatttgaggatgatgtctgatggccaaatatgtcaacttctgcagcatttctggcggagctgattcacccactagtgacactgcatcaaggatagcaataagcatcattaattcagtatacgactatctgccagttaatctagtaagtaactttcagaacacataaggaattgtgcaggaattacacttatatggtgagtcaatttatatattttttttcggaaaaacatgttccctacaatcctgcttcttgcatgggtttagttcatcagatttccatgtccattaggcctatcaaagcaattgatcctaacaagagttctggtatgaaactttttactacgacaacagataatggatgtgggaggggggtaggccaattataaacgaatgcaacagatgctggagtactgcaaacctgcattttcccacaccgttccagaccagtttgtaattgtgtacactgcaagggcaattgcaccaactgggtcaatccaccagtagaacatatcaccaaggacagcagcagccaaacccacaacattcgtgacgacgtcaaaataatgatcctgtgaataccaacccaacaaactttgggaaactgcactcatttgcctttcaaagcatctattgaaattaaaacatggagaaagatctaaaccttagcataggcacggactatcttgttaccagatgttctgcagtagagccagagggctagcttaactactgttgcaaaaatcatgatagaatatagccatgtgagctgcactggagtcaatttatctggagtctcgttcactatcagcttttccacagcttgaacaaatacttggaatcctggaaatgcaaataaaaagcacattgctgtgttaatgcataattttggcacaaagaccatactaagttgagtaataaattttgtagtttgaagacaacaatactgttgcatatacaaagaaagcaagtaaagacatgaattgattgtccattcttgtcctggcaaagttgcaagcatacctaatgtagccattacagcagcaaagatgatgattccaacaggctgcaccctcagtttaccaataggatacttgtagacgttgatgctcttcatcgagagatgtgtgaaccaaaggataccaccagccatgagatcaagcagcgagtccaatgtcgaggcagctatagcaattgatccacttttaattgtagcatatatctaatgatggtgtggaagtataataaagtcagcctagatgaatgttaaaaaagggattaaaatgaatcgggaaagtacaaccttcaacgccaaaagaatcatgtttgcatagtttgatatcttcatggcaaactcactctgcttttgctccgcaatatcatcttcttcactcattacattggattcttctattgaatcaacttcctcaaaggatctcaaggtggcaaattgtttctcatagtattctttctctcctatattagcccaaaaggtaaccatatcacatgaaggaaagcagtgtcttttgagcatataaaaagagagaatttaattggtgttacccttcatatggatcatggggagtttgtccagggttatgaaatattaggaataagccgtataacacattgggcacaccttatcttaacagttatattaagagtttgtagtgaaaaaattattaataagaacaaactctaaaaaatgatgtgaatataggaacaataaaaactagtttattatagtccaggatttgcaaatcttatctctatacttaatgtcagtacaagaaagatatgtggtgattcatacaactgagaacttactgcataagaaatactaaagagtaaacaccacattatacttctatatttctctccctgatacaaagagtattacttatttcgtaatatttgcattaagtgttttcatcccaccatttttaacacagtttgtagtcgtttatgaaaagtaaaggtgtatgtttttccacttagcgacaattgacagtctcacaatcctgatacagctaggcagggttacatcaaatcgtggattaaaaataaataaaatacatcccacccacctcacttattttaaagaaagagacagggaacaaaatggcaatacaataattaaatgtacaaccaatgaaatctcgtaaccaaatttttagtacatgctattggtagagaagtcaaaaatttccactggtagatgcagaacatccttacaaatatattggtattaacagccaacgccggctggtttttgtataatctacatatcacctcggtttgacaaactgtaatttagtcttgacgtgttttagtatctaagctacaatttcaaaagacataaagaccaaagttggaaagggaagtatatagtgctaaaatgaattgaacggcaggcaggcagaattaaaaaaggcacagctaaaatttcaggtaaacaaaggccggtatacccatgttttgtattacgttgaccaggaccggagaaaaagtactgttctggtggaggaaatagactgtggaacagtggaagtcctggttctcctggacaaagaagaaatgcagaggagacagaaagatcaaacggagatgttctccttgatgtgtaattcctttaacttcgacaacagtttcctttctagcaatttagattttttttttaaaaaaaagaactctagatgggctgcgagatagccctccccctacccaagctaccgccttttctttatattggttgtatctcttgaactatgtactcttcttccccctttggctaaaaaaaaaagagcatgtccgttagagagagcatcagagcaagaaagaaataacattgtcctgaaagatttttcgtacacaattgatagctgcttagcattttttaaagaacatataacgaatgacctttgcctaggagcatgcatgaaaacattatagtcgggataaatcgccacctgttattctttagaaccagaaggagatctgcgtgtcattctattaggagtcattcaatatgttacaatcgctaaaaccatatgaaaagaccgtaaaaatgcgaaccaaaagatagtaaacccacgaacttgatccgtcaccgtcaaacggtataccaaaggacgacacacaactaccaagcacgcgcaagtggatggtgaatcaagaatagaaggcgatttccatccatacaacaacatcgaccgcgcgatcaccagcaagaacggcattatccaccgtaattctgaaaagctactacagccaaaccccaaagacaaactcaccaacacccaagtgatgactaacaaaaaggagagcctaaaaagaatcacaactttcatgcaacgttgccacagccaaacctaaaaggacaaaggacagatcgaaaacgggggaaagatcagaacgcgctttacaaagaagtaatgcggggagggctgtccagcgtggtaccttcgcggaggcccttggagcgggagaagtcgacgtgggacggcctctcggggtcgacggcgtcgagcaccttcttgggcagccgcgacacgaactccccgcgcatcgacccgaccgagttgcgccgccgctccgccaggagcggcgcccgcgcgtcattctcccccttcgcctccatcgaatcacctctctcctttctctccccctccctccctcccggccgcgagtggggagcagtcgagctcgagccggcgagccgcctctctcctccgctctctctctctctctctctctcttctctccctgtctcctctccctgcgattcgcgatcgggtcgtggtttgtttgttatttttggcgttcgggcggaaggccgggtgtcgcgctaccgtggcgtgctgcggacgtgcggactgcggtgcggctgggacgccctcttaaaagggattttgtaataataagataagaaaaaggggaaaatagaaggggactatttcgcatgtgagagtggtgtgcacagagggctagaccaccgatcatgagatgtgcggttcagatcatagtgctggcgcgagaactgagctttggtaagatgtggctgtgtaccccacccatcaaattggaattatcagctattgcctactcccccgcttcatgtcctaataagacgttttggttattgtcaaagtcaaactgttttaagtttgagtaaatttataaataaatatataatatttataatattaaattagtttcatcaaatcaataattaaatatattttcataataaatttgtcttggattaaaaatgttactacttttctttataaacttgatcaaagttaaaacaatttaattttaaccaaagtcaaaacgttttataacatgaaacagatagagtagtatacatggttagtaactaaggacttctttagaacgtaggattatacgtaagattttaaaaatatagaaatagaaaaaaaaagggtatgaatcatatgccgagtattgataaaccctacatagaaatccacaggaattagcaaaacaagttaattttttaaaagaatggtattttttttactcggtctatatatccaaccggatatgtgcagtctgcaaaacatgttgtttggtaacaccgtatgaaagaatgtaggaattctacgactcaaacaagagaaaccatcctccaacatttctatgaaatgatccatttcatagaattttcaaagaaatttgaaagagccattccttgatccaaagaaccatatgataattatttccaaggaattcgatcctccaaatttgctatactttttctttactccaaaggagaccaatcatgtacagtttgcctctcagcatatactcacccagttccaaattatagtacataggaagaaactttaacataataattatacccaatctatgctttttttcgtctagaatcttttgttgggatacgcgtagactacgatagcataaaacaaaattttctatcgcgtaaacgaggaaccatgcaagtattagattatagatcgttaccactcgacgcgctgtgcagcggaagaagacgctgagaagtcgaaggaactctcgcgaagtagcgcgcgtcgatatagaggaagtagtcgatcgcaccggctcgaccttctcctcctcgtgtgttctcctcgccgtactctcacgccgatcaacaccgcaaatcagcggcgcctctaccggtatccacacgtacagggacggaacgccacgcgcagatgtgctagcacccgcgcgcggttagggttttgcttggggagggaagtgatggctagggtttctcacgtgatgctatgcctccgccggtcacacccctcatgaatatataggatccatcactcgggcctccaaggcccgtaggactcctattcggtctctatccgaattaagctcatattggatctctatccaatccccttattccggcccattaaacgtgcgaccctgtaggttcatatatactcggctataacctgaaaactcattttcggtccacgcgtcaacagcggccccctagcagaacgtattgacccaccgggcatacataaagatcatatcggctgaacctctagtgtatacttgtatgaacccctttgcctcacgatatcgattaagcttaaggctagatatgtgccatcctctaatagctcaatcattcactcgaacctgttgatagattatataacttgtgattgactcctcaatcacctttggcatggccatgcacttccataatctacaacatcgaggggcccagagatatctctcaattggaggggcaaatcctatcttgattatttatatcccactacatgtttcatagcatacccgaaaactacttttataactacccaattacggagtagtgtttagcagtccctaagtaagctactacacatgttgagaaccatgataatctcagatctaaggattcaacaccaacactcaatgagatcactgatgacacaacacatatggctcttgcagtgtctcatgttgggtctatccaacaacatattcaccaacatgtgtccacattattaatttggtatctctataccatgatccatgagacatgattatcaattaatacatgtgctgatcatataaacatatttgttccatatatgatatttgatcagggatcctttagaaatagtaacaaacaacataaagagtcttatgaaagaatcacatattcattaactaataaagagttatctatttcaaggaacaatgtcggataaatatgtaaacatagtatgtgatacaatcatttctatgattgcctctagagcatatcactaacatctttaacaaaattgaacattgggcacaatttaaaacacttgaatttcacaataattagttaataattgctttgatttccactgggcgaattctcttgttcaaatacagcatgttgcattaggtatttaggtaactccttcctgatatgaatacgtagtattagataatatcccatctaattttttttgttgttatatcatattttaagacgaagctagaggagtatgtattttttttaagatgcatttgccgtcttgcacactccatgcacagatctagacgatcattacgtcaatttctaaaatacaaataaaaaatcatcacgtatacaaagatgaatttacgaagtgaacttaactcaatcggctagctttcttacggtggaactaaaacacccgaatttaagccatagacttaatacagatacttgcatttgcaattatcttagtgttaggcaatgtacccatcaacaacgagacgttggtgttgacttcgtcatcttaagatatgtcagcccggtctgttagagatgctcatagcgatatattgtgcgtgtaaaataaatttcagaagacaggaagcattttattgaacacactcagtgcacatttatggtggtctacattttttcttgtttgcttatgacttgcgatatttgcaatgtacattcatgaaatttggctgtgtctgtacgtacatatcgaatgagcagtttttgtacactttagcttgtccctatttatggggagcagtcaccttaatttcttaatgtgttcggcccttttcattattttatgaacttatgcgaccggcgacttacctttgctgtactattgggtactccctctgtctcattttttgcatacatgatttttcgtgcccaatttagaccatccgtcttatttaattttttttaaaaaagttaaaacataagtcacgtataaagcactatttatgttttatcatctcataattataaaaatactaattataaaaaatttaaataagacagacgatcaaaattttagtatagaaactaatggttgcttttaaaataggacggagggagtattgtttagttcgtttgatttacatttgtcttgcctagcttttggacaagtaactctgtttgtttgaatgaagcttcacaagaatgcaaagaagatactccattttgtagtacatctatagctcataggcccagtttaattcttgacctcaaatttttcacgtttattatgcaaacgaacgacctacattttgcgttatgtgttggtgtgggttgttcatggtcatgtgcccgtcaaaattctttaagatcacgtggcgccccaatcaaacatagaaaaaaatttgttcaggtcaatccctcctttttgttagaattttgttcaggtcgatcaaggtcaagtccattcttcaatcgcacgacggcatcaccaaaattcaatttctggaataagaactccgaagtctccgatcattttatgcacaattggtgtggatcgaccaggacccgttcagatccacgaaattagcaaggtgtgtttcacattgaatttgtatggattaccagttgtcacctctggattgcagttgacccagttttggatatactacctctgtcccaaaataagtgcagccgtggaaattcgtgtccaacgtttgaccgtccgtcttatttaaaaaatttatgattttctttaaaaaaattagcccacataaagtattatacatgttttatcatctaataacaataaaaatagtaattataaaaaaattcaaataagacgaacggtcaaacgttggagataaatagtaaaaaactgcacttattttggaacggagggagtataatacaatcgtcagctattgttgacaggaaccaaatctgggacagtgaccttaaattgggcctcatttctgcatcatatagcaggcattaaaagagaagcacactttgcagacttgcaggtaagcatataattttctagccccactatggcatgagccggcgaaccgcaattaggattttgctagtaaataatgtaagatccaagagaagttcaggcatcttactacaaggaataaaaaatcagaatttggccacttgacatttagttttcttgagcttgctcaaaatttatttatatactagtacttccatttattaccattagggcattatcgcattgtcacagatttttctcgatgaacagagtatgagtgggatctacgctaggtcaggacggcacctcacatgcctctcactgtgctatgctgcaactggcacggcattgctgctgatggctgctgcccatcccttcggtggtgtttagatgcagggacttaactttagtccctgtctttagacactaatttagagtattaaatatagactacttacaaaattaattacataaataaaagctaattcacgagacaaattttttaagcctaattaatctataattagagaatgtttactgtagcatcacataggctaatcatggattaattaggctcattagattcgtctcgcaaattagtccaagattatagatgggttttattaatagtctacgtttaatatttataattaattttcaaacatccgatgtgatagggacttaaaagttttagtcccatctaaacagggctacatgctgcctgtatgcatggcgacaaggatgaaacattgaatatgcttagggctccgacgacctagcgtacccgatgtcccgatgaaaatgatgcaattcttttttctgtatactgatccgtgaactatggaaatgtcacttgtaaattgctatgggtagaagctttccttgccaaaaagatcattctttctttgtgaaagcaacagggaatcagatcgacgccatgatgaaacaaatgcaaaacaagaattccagatgcgggctgcaccgatcagattctgcacgccacatgatcctcggctaagtggttcgtcttctcttgtccatttcctgccgctctcttcgacgctgaaagctttccttgcaaaacagaaagggggagaaggagatgaaagagatcagttgaaaacgagtaggatcatcatcccgaacgggtggatgaatgggctctcatcctctcaccgcgattgtgcgtcgtaaccgctattatcagcaagaggtatcgccgcttgccgcgaagtacagcaacgtacagttacacctcttgttgcttctttctcttcgttttgttctgacgccaaaaggaaattaggaaattctgaaagggacatgtgagtttgctgtgtgacaaactgacaatatgaggtgcagcttttcagcgtgctctgggcctcttaaactatgaatttctgagcactgaaatgaagtgagcaatacaaacaggaaaccatgtggtccttacgccagaaggtgtcaattgtgatatgatattcgttgtttctttgtaaaattgtgctgttagcctgttgctgttacagtgtgatcattttgcacttcaatcagcttgttttgggagtgtagggagtactggtgaacttcatttttgcaagtctgttgctactgactttctgccagaccttatccaagaattactagcagccacaccatcttgaaccgcagtgtttgcagcttactatttgttcttacaggacaaggtatttagttatctgagaggaataaatattcaacagtgaagtaagcgtcctgattcttgttaagtccagtatactaatatgatattctgattatctccctgaaaaccactgtttcgacagttgaggcgatcttttccacaacaataacatcaactcatcaagtgctcacattcactgatatgtgataagaccgatcatattcagtgaccattactgacgctgaaatgaaaatatcatctgttcatagtgagaaagttataactactaacccataacagctgacagcgtaatgcgaacaatcaagccacagtcatcacaaactgcagctacactgagatattgtctctattaatgtttctctctttgataaggaggcctcctattttctctacagtccttcggttgtcagtttgtctcccatcggtgtgatgtcaataaatgtcttaagataagaacacgacgtagcttgcagtcatgcagtggaatggacccttacgtacctacagaacgggacagcgaaattgcaaaaatatctactgatctgaaacctaaacaaaggtaaggactgaaggaacaatggagaatcacagccaatgacctgaaactctgtgagcccttggacccttttagcagtttgattgatttgtgagtagtacatggtacaatcaccagctgtttaacaagtctcagcatccaagaagaacagagcacataatgtgttttggatgctaagttggtttgatgcatgggctggtgttagtatgcatgtgctgctagggccctcctgctccggctggcttgctgagaagtggctgcagcgccttcaccacgatggtcatgttcggccggaaatctgactcgtattgcacgcacaacgccgctaccgccgccatctgaaaacacacacaatgcacgacaagatagcatctcagatcgttcctgcaaacttgcaagaaactgatggtcttgtattaccttggcaactgcttttggaggatagtcatccccgagtttcggatccacgcactgcctcaccttgtcctcgctcaaccttggcgtcgcctagtccatttcaccagtagaaaatgttcagaaattcagcattgtccaaaaaaaaaaaaccagaattcagacaaccacaagagcatatggctcttggaacacatgaaaagctccaacaagatgtgcaagaacatggcctactacactacccaggttacaagactctgctgtctcttcggcatggtatggtccactggcttcctgccggtcagtaactccagtaggatgactccgaaactgtacacatcgctcttctgattaagctgtcccgtcatcgcgtaccttcagaaagcgaaagagagaatccatttgcccggtcaaaaattaaccttgacctttcttaccgaaagtcaattaatctactaatcttctgatcatgtttttctccaatcaaacacagtgtggattcagacagagaatgtattactcgggcgcgtggtagccgaaggttccgaggacgcgggtggagtgcaaccgcgcggcgccgtcgggaggctgggtggtgaggttgaagtcggcgagcttggactcgtagccgtcgaagaggagaacgttgctcgaccgcacgtcgcggtggacgatgggcggctgggccttctcgtggaggtactcgagccctctcgcggcgccgtacgccaccttcacccgctggctccagttcagcgccggccccggcgccgcgtccctcacgcccttcttccctgcagttttttttttttttggtttccggatcgaccaacacgtcgtgtcaggtttcatgtgccaagaagaattcgctgtaaacctgtggtcattaatgcatgtagatcatcagaatggaggaagaatttgtataccgtgtaggatgtcatgcagggagccgtgcgtggcaaactggtagaccaggattcttcggtttgcatccaggtagtagcccatcagccggatgaaatactcgttcttgagcctcgaaaccattgacagctgcatgtccacggaaccagatggttttaatcagcaacgtagatttgcagcacaaaagtttgatgttgaacacgaatccgttgtgtaattgttttactgatcgttaacctgagcagagaagtctgcttcagagtcgcttgacacgctgggatcaagcttttttatggcaaccggctccccggaggtcagcaccgccctgtagattcgaccgtacgaaccttctcctatcaaggcactctgtccaaagtgtccggtgatgttgttcagctcgcccatggagatggctggcacgtcgatggagagcaccttcggtggcgggccgccgctcctgggtgcatttggtcctcttggcttacgagggcctgatacacaaccaaaaacaggagatttgcacaattttcagtcttcagattcagcataaggattgtggcatactccgtgctaaactctctgtattgatgacataagttgatgtggccttgttgaagaatcttgtactagtaagctctaaaatgagatgctgcgaaggcaacacaagttggtcgattgaactacgaccttctcctactgatgtttggtatagtgagtaacttgagcattaaatctgaatgtgcagatgggtatccaattagaacagagaatatggatggtagtcataacgaattacagcttcttattttccctcaaaaaattacagctgcttatctatacaatttttctttctgaaagttcagattaaaattgcctctgaaactaagaaagacagagctggcagtgcggtatttaatctgaactttctgccaattcaattatcatcacgatgcaacattatacagttgagcaccttggcctctgtttcagctaaccacctgcagaaccggaggaggaaacggcgggatttcacctgcattgtactgcgtcgcaggtgtcgggcgcctgctgcgactgcgactggctgcacggggagcgtacgtctcctcctcctcgccgccgcagcaaatcatcctcctggctccggaaatcaagtgcaaggaccgtggcaatttgcagtttgtgctcccgctccgatccgatccaccggatcggccgggagcctcctgaatgacgaacactgcaaaactgaaattgtcacgagcgtcagatagagaaaaaccgcgcatggatagaacacggaatggaaaaggtgttgctggccgcaacaaatcaatagaaaacgttgcttctttttttttccttttcacgagatgcatgtcaacttttaaggccttgttcgtcggacaggacaatgaaaaacaaccacgcttttaatggattaaaaaaaataaatactgtacaagatatgccatgaagaagtacgtacgattaagattgcaagccagccgtaaatgtttgctcctcctcgccgacgccgacgccgacgccgacgaggtaagagttctcgcgatggacggtgttcgccgtcggagaagaaggagaaggcggcaaatgggaacacaaatgggagcctaatataggtaggaaagaaacacgcatcggtagaccaccgcgtttcgcgggggcgcgaacggagagaggagaggagacggtggcgattggcatgtccacaaatcacgtacactgcccgatcgaactcatgggctcacggctagttcgcaagca

SEQ ID NO: 80969 - DNA, 3237 bp, Oryza sativa
aaatttagtaagcccctaagagaattatcacgtcgccaatagccggattcctgctatattcggttaaggaaattaatatgttaaaaggaatcttatctacaagtgatcgagttcaaggaggatgcggcatggcagtttatctattaattaggcagtatttgttagtttcgttttatctttaggaaagtgtgtttagtgtcctataaggactttatgttctcatttttatcttttaggaaagtttatttcttatcctacgaggactagtatctccacatgggtataaatatgtatatccgtggtcattgtaaaatatatccacgatcaatacaattcggcgcatcgccaccttttaccttttctacctttttatttatcatccggcgggacttagcacctgacgcggggctgcatcggcgttcgatctccggcgaaggggtaagtccaatgttccgttggtccaagcaattgtctcatctacgtcggcatcgttcagggctacatcagtacattcgacctcttggattgctccgatttggatgatatatgtgtctgcctatttatcatatgtcttagttaatttagtcttagtatctcaatttagctctatcggttgtctctcgctttagggtttctaccggtatcggctaaattgttttactagattagattagccaaggcatctaccaccctaaaaatcagtcaacggcttgattctctagatattgtgtttctttttatacttagtgccgcatcaattaagtttgatctactaagttgtgtttagaccataatccctagcctgctttctgacagccaataagggtttcatcggggtttcagctaatgaggtatctagacgttgcattggcttacaaggattgcatataagttggatttagccgatggtaacaaagatttcaccgtttaatctaatatgtggattttatgacatcggacctccagccgatgtattctttaaccttcagatcaatacttgttctatcatatcattgttagccgattggtttctacttgattatattgctattttattacatcagtatcagccgagcgattgcctctatattgttatttacatcatgtcagaatctacattggatgtatagccgatagctcaaaaccctatcgatatcggctggactacttcatcggcttgtcagtcgatcggctcgatcagctcactggtcttgtcagttgtaggatcaaactgactggcacgcccgcacctcaccaagatttggacctgcactggagctaagcagatctcccaggccagtgtgtatttttcgcatcaacagctcgttaacacgaaatcaatccacggcgatctctgtgtttattgccgtccgttataaaacgagcgagagatagatagatagatagatagatagatagatagatagagagagagagagcagccgccgcctgccttgcctcgccctcatcggctcggctcgcgcgcgcatgtggctatccgctcaccatctcaaccggttaatagagattctccactatctccatatttaagttgaaacctcttcacttagaattccaagatagtattattacccatagcactaatgtgggccaatgaaatttattaggatttgattgggcctagcccattaatgtaacaatccccatcaaatttcatggctcacaggaaatgctcttgattctgatcctgtttgttataccagtgtttcggtggagacagttaagttgaacttccacctaggagaaattctgatcatgtttgttataccagtgaagaagcagtagcagcgcaggaatagaggagtaggaggaacccgaagtgaaagagtctacgggaagaactgatgaactgccatccctctgcagagtttgtatgcgagcaagtgcaagagtctacggcggagtttgtatgcgtgcaagtgcaagagtctacgggaataactgatgaactgccatccctctgcggagttacaaaacaagagagagccgccgccttgccacgccaagtcggcccggctcggcgcgctcgcgcgcgcttatggctgatcgcccaccatctcaaccggtcaacagagactctccactagctccatatttaagttgagacatcttcccttagaattccaaaatggtattagtacccatagcatttaatatgtgctaatggaatttattaggattattgggcctagcccattaatctaacagtctcctcctcccgagtcagagtggcagcggcggttggttctctcggtctctccatcggcggtaggcggggccgtagcgcgcaccacgcgtggtgcagcgctggctaagggtagcgcacaactcgtggctagctctggagcgccgctcatccgttcaggagacagctcggttgcgggagggtttgagcgcgcgcgctatggcgagccctggagcgacgcgccaatggagagacacgtggatgtttgtttctttctcggcgcagatccgtggaatgcctaatgttgagccacctatcaagccatcatgcagttcatgatggattgcaagttatggtctagactcatgaccaggccggtgaggtactttgtataaagtttaatcaggaatctaaagaactgatttccaacaactagatcaaaagacgtttacacgacgctatattcatatttctaaaaaaccttgagagtcatgatatattatggtctcctttgaaatgcatgaaaatttattgcattttcatagggaatagtttaaatcccttgcgatgttcctccgctgcaaaggtgatcaggattaagcgttcaattatgctatttcaaggcataagacttgactccgacatagttatgttgtgcctccattctattatggatgactttattcaatttggaacctaataatgattgagtagtgttttgctgttagccatggttctgtccaagcacttctggttgagatatcaaagagagaaacgatatgcaaataatgtgaaaagttttcgatctacggatgtttgcttagggatgttgcaccatgcgtgtgaagcacataaagccaaaggtattgttatattgagatatatataaggttctctctctttttctggttgacagtcatttaataaatatattggttacaacttcaatattgtgtgcattatattccatatctctttatttccttctctataggttttaaccattacatcttgcatggttggctacaatc

SEQ ID NO: 80970 - DNA, 25118 bp, Oryza sativa
  unsure (1)..(25118): unsure at all n locations
tcacaaatagaacttttatcatgattgcttcttagttcttacaatttccgcaacaacgcacgaggtatcatttagtcatcttgatattaaggatccataattttattgggcagatagacgaaaacttttactggcatgtgatacttaataaataattagcatgtgattaattgagtattaattatgataaatttagaaataaattatttgtaaagaaactttatatattttatcagaaaatacattgtttaatggtacagaaaatatgatctaccactctaaaagactccaatggtggtggtggaccaccactcactatcacatgggtccttgttgcagtgtaccaatcgtatgttcaaaattcaaacaactttagagtgatcaatacccaatatacttatgcataacttctaaattttacatgattctccaagatagcaagtgaccgtcccctccgtaaggaatgaggtctcttaaaaaggtaaatgggttattttttagataaaataaagttttccaactataatatctatattgattaggcacatagtcgaattaaaactgatgtatgtatcaactaacaactctaacatgtcctagtcaaaactcctacgatttagtctataagaagacacatatattttttcttatagctttgctgggtaaaattttgcacttagtcagcatagattttcaaaatatttccaaatatctgaaatttccaaatctcattgtcctcacaaaagaaaagaaagaaacaaagaaaaccaaccaagccaaggatcagccacagaagtgcaaattaacaggcgcgttggcgagagaccagacagaggctagaggggataacggtcgccgaactatcctccatccacgtggcactcacctattggtccacgaatcggcaccgctcatccattctctctctctcacctcttcgctcgccgccggccaccgtcatggccgccgccgccgcagcagcagcagcagccggaggcctcctgcacctgggggcttctcgcgtgccgtcgcggcggccctccgctggcgctgcgcctcgccttcgtggggcctcgtgcgcgcggggccgccagcctcggcggcgggcgccgccgccgctcgcggtggcggccgcggaggaggcgtacacgggcgccgaaacggagctcctcgatgctctcgccggggtccagggccgcgggcgaggcgtcgcgccgcgccagctcgaggcaagcatggagcgcactaggtgcttgttgaaatgcttgtgcggtgttgctgacatttcgagttgttacgtgtgcgcaggaggtggagagcgctgttcaggctctggaagcactgggaggtttgcccgatccggtgggtgcacggtgccttttcttttcatttgtattgtctgaattatactagtatttaactaggtaattgttgggtggctagagaatatagcagtagttaatattgaattaacgattttataaggcgaagattttaggtgaggtgcatgcatctcaatagttaacgatctgaatttaattgagaaacaagctgttttgcatcttgatcagtgcaaggtaagcttgagtttcttgctgaaataagttgaagctaaacagagaacttctggagtttgaatcgtaagattatatgataaatatgttacaagtgaagcttgccagttgccattgaagtgattcatagagcatagtagaaagtactttctgctgaacgagctagatggcatcttggacttacggtcagaaactccataaatgtgatgatgttagggtgttacttttacttactatgggaaagtatgttcttatcaaagtttgatatgattggcttatctacaaaattgaacatagctagtgctcccattatcatacatgtatttgacgtagctggaaagtttctatgcaacaaaggctgtcgtcttatctttcatggttcatatgcagaccaactcaagtctaattgaaggtagttggcagctcatatttactacaagaccagggtcggcatcccccattcaggtaaaataccagcagtatgccccactgaaaataatgttcagtctcccatttatctctattattttttggattttcaggccgaccgcatatagataaatgactgattttattcttcattcacattgcctgcagagaacatttgttggagttgactctttcaagatctttcaggaagtataccttagaacagatgatcccagggtgattaatgtagtgaagttttcagaatcaattggtgaactgaaagtagaggtattgattagcctacagtaaacttgcaagagatacactactaggaatgattgaatcaatagtatgacaaaaagagacacatgattagcaaacagaaattctgttgaccactcctgtttgttaatgttgtgcccatggattaacctagccagcacacagcgccagcaactcatcagattgtgccatgactggtctggaacaaagctattggcatgaaccgtgcatgaacagagtccaattcaataataaagtcctcttagtctacatttagcatgactcgtgcagtgcctctggttgtctcgttggttgttcaagtgtggatatgtttgcaggtagagtcttagttgcattacttggggcttgtttgtttgctaccttcaatctgcctgaggattgttttggttggtaccctgagatcctccctgaccaggcaacttcatctaacttccatgaagatcctccgttgcatcacctccatggacaagaaaaacctcacccaatttcagattctcgcaagagcactgctatctcactggtcttcttcgccagcactgaccacacattgctaccctgtcccgaagcacctccacctcagccatctttactgggaagttcgacaggtcacactgatccctgttcaccctttccttgatacctgccaatgagttgtctctgtcaccagtgttctgtctcagccgctgcgtgtaaccagtgaagtgtcaccatgcacctctgggagaagaccatcacactacaggatgcccaacatactgttgcatcctataggaatctgcctacatttgcgaaagggcatgtagcctaatggttgcagtgacctaagtagcaccccaagatcctgggttcaaatatccataggagtgaatttcagattgagttgtttgcggggctaagttcccaatttaaatggctgcatatatccggatggatgtagaggctaggtaaaatattacccttctctaaaaaaaataaaaaaaaaacatactgttgcattcctcttgttagggatacacttagataaatagagtgggtcatcatcagtaacaagttcttccaactagatatctatagcacactctctatttctctagtgatcctctaattgcctattgcttccccattttatagtgtgccctcctccagctccatttcttctcaagccatttaatttatcatctaataaatagtagttatcttgtcgggaacaaaaatcctgacgaccttaagactgatagttctggagggctgggcattatattgaagaacaatatattgtacattgctccgactacttggtaaagccgaaatcagaaacatcattggcatttttatcttttgggagacttcattgtttaattaatccattccatagtaaacatggaataagttggtaagagcagtctcttacactcctaaagagagttgacagaacagtgtgcttattctgtatgaagggggataaatacttctactagtcaactaacttcgattactgctagttgctaaatttatagtgcttttacaatgttctacatgactttatgatgagatttatttaaaatataccaggcagaagcaactattgaagacggaaagcgcattctttttcgttttgaccgagcagcattcaacttcaagtttttgccatttaaggttccatacccagtgccattcaagcttcttggagatgaggcaaagggttggcttgacactacgtacttgtctcaaactgggaatatacgtatttcaaggggaaacaaggtacatgctacatagtcttgatgttattttactgcctaacttgcagtaaggttttcacaactgaaaccatgcagcaacgcatttaaaattttgaattgtataattgattttctctttttttatgaatctacagtacagaaaattgtaatatctttatagtttgtagaaatctttgctttttcccaaacctgtttgtacttcattagcttttcaaaacaatctgtagtgcagggaaccacatttgttctccagaaaagtgcagaccaacggcaattgctgttgtcagctatatctgcaggaacaggagtaaaagaggtatgttattatagcttgaattgtccattgtggcagtactttgagtatttgacaaagtggtatttacaacatatttgcttgctaaaaaggctatagatgatctcacttcaagcagacaaggaattgaagctgatctgaacactctagcgggagaatggcagctattatggtcctcaaaggttagcatttacattttcataaacaactccaagcaatatttcatatttctaatgtctatgcatcatttggcaatattgtttttgagcaatggttggttatattgtgaaatatttgacgtgcgaatcaaccacatggcagtactagatcagacctgcgcaactaaccatgttttatgtatatttgttcttctttccctgtaatttatcttgcacaagttctgatgccaaccacctgggctttaatcgttcaggcaggcatctcacagttctatattttgcttagtattatttatattaggtttactatcaactgttttatataaaatctgactgggagaagtatttctctatggaaaggaaattaggactcttggcagcatcaaacaaaacagatccttttctggtttgtgaaaggacttgacagctgctgcaaatgtaatgagaaatggttattcctgcatacaccttcaagcgttactaaaatagaataccacagcgtgccacgaagatgaaatttttcatccaattcctatagcagaaacgaacgggacctataaccaaatttgtatgcgcagactgaagatgaaagctggtcatttgttgcatctgctggtctgaagggtgtccaggttagtttcagaaccacctctgaaggatttgtctgaagactgagcaaaaagatgaaatgtcactctggttttttacttgcacacgatatggcttacaaatgatatgggcttttcaatcagatcataaaagaagatgggcaattgaagaatttggtaagaccctttccaggtgtcagcctcaatgcaagtggcaacatatggtaagctcgaagagctgtatgaatgctgtacttcctgtttgggagagtttacagctttgaagaccttttttttttttttttgaggaaacaagaccatatatattagaacacagtttgttaccacctacttatctacatataaaaatccacattacactcttgaaattgtaaattttgatcatataccctctccttggattgaacttgaggattcaccctcctgacccacatgtgaccttaaatgaccccacatgtcattggctcaagagggtaaatcctcaatttccaatctaaatttaacttccttgaaatttcctattggatcttgattgttatctttattacaatactactacaactaccaaattgactgttcatgtggtgttttgttcaataccgagcttgcgagctaagtattttctttattaaacttgcagtaaaaatgaggatggcaataactttaacttgtccataaataaaggagctattcaagctggtgggttacagtttcccttggatgctcgaggagaatttgccatggaaatattgtaagtttgggttcacattccaacaactgaaacagaattgatgcttgtctgatatttgtgaaatttcatgcaggtatattgacaataagataaggatatctaatattaaccaacacaagcttgtccatgtacgcattgcaaatagaacataaaactaaaatgtagggatctatgaagaaatcgcttgacttcatcactgagaatctttggagacttcatcactgagaatctttggattcaatgatcagatgatgtacacgttgtagttgaccgctaccagtacaatagtaagattcctgtaattatagattcgcatgaggtttgcagatgctcaatccttttctccaatgatacaacattacacatgttttggtgatagaccatgataatacatattataagaataaggttctgcatttctgattttggaaacctttgcttgcaattggcttggacgttcactcagttctttatataaatatcaactgatttaattaagaatttgataagggtagcagctgcctgtgctcattaatcagtcaacaaaaaccatgaggaaactgttgagaatgcttatatcgtaacaagagattgttcagaacctacaagcaaattaagttcatgtgtacacaggagtgcattcaggcataagaaaacgtccacagtatacaaatatacaggtggatgcgtgacaagaaaatcgcagattccagattgaccaaaaaagcttgattacttctgcatcagcaacaatgattgtagtgtactcaactaatattaatattccaaataaactaactgaattgggtggtacaaatagtttcttcctagctctaaaaatacaacaatgaccctgtgtaaaaaatgttacatggtacagtttcctccattattgatcaacttttggttctatcgttttgttcaagaacaaagcagttcttggtagcaagttgagtttggaggcagatgttgatcggcgggtgacaaaacgtccagggaatttgccagtataaagttaatctgtggatgaacgagaccacagtagcaaggattttatcacaattgtttatgcagaggccaaactatcacataatgtttggtatgctgcactgcagtgcttgaatttctcctctgcagtagcctgtccatttaaggaaaatcatgagttacataaacaaataggtgtaacagtataagtgattctggtagttttaagatataagctcaaaacatcaaaaaagacaatattccattgccaagaactgcatctgttcgttcaaacaataatttcataccatgccttctattgaatcagatacaggtacgttcagagaaagaaaaaaaaaaagaaaggaagatggtggaaactggtaaacttgtctctgtgtgagctaataaccaatccttcatatgaaggttggagatgcaaatgaaatactgaagatataggggattttggtccgcaatttccattccagcaatttatataatcatatccaattatcttgtgtgaactcgagatacttgtggcaagactatctaaacaagtgtattattcaccgaacagcctggcatacaaaaaacatgcaaagagaaaaatagaataaagtcagatgtgacaagttcaccttcgttgagccattgtgacgatctgggtgccatctaagtgcacatgtccggtatctagtatgaaaacaaacaaaaataaataaaggataaaataatcttgaaaaggaaaataagtgaaatctactaaggttcatggcttcatggtctaatatcacaaaaaaacacataaatcttggaaaatgttgaaagcttgaaagatcttacgcgcttttaacatcttcgagtttcagtggaccagaagtactcaatccaagtgcctgccgtgccaaagatacctccgtctgtgcgggtgtttcatcctcatcatctgtctcataactccaacgtctggaactttctgaatgagaacgtctgtgatttctctgacaaaaatcatcagaatcaaaagaccaataaaatgtctgttgcccacggaaagcattgcgaaacaccgtttccggttcatcttcatcacttgtgcaaaactcaaatccacctgttctcgaaacaagaaacaacaaaattctataaggttcaccttatgcattatgcatgtgtcatatccagctaaaatatttcttgtaactgaaatatttataacataagcagactacattaaaaatatgtgaattctgaaaatagaagtgctaaacaggacaataatttgctaataagatagagaaaatgaatgaagtaatgtacccctgcttctgaagtttccaaaataaaaatcatgtgggcggaaaccattattctttggattcctgacccaacggtgtcccctgaaccaagaaggtccacttgattcatcatttttgtcatcttcatcccgccaactctgaaaattaatataaataaatttgtggtcaagagcattctacatcagcatttaattatgggaatcaattggattaaaaaactgtaaccaacattacagtaagaacaaagtgaaaaggaaaattgcattaaaggctgaagaaaaaggtctattttacagcaaaacaaaagaccaaaggtagtggagacttgtactaaatgggctgccatgacagctgaaaatatgtgttgtctgttaatgtggcaaaaacaactagcagctatggatgagaaatgatggttttataacagtttaatgtaataaaatgcttttgtagttcagactttgcaatagttaaatgttgtaaggtagacttttccaaagctgaaatggtgcgacttatggtgacagaaccacagaaaaatacaagtaaccaattcagttcttataatccttaattccttccaaaatgccaagggaagaaaaacagaagttctataccattatctgattttttttttcaatcctgcgtgccacgactgtgtttttaatggcaccaatcctagagttgcgacagtcttgcaagtgatagaaaattagggtaatctttggtgtattgcaggagctttttcccttcaaaagctccttagtgggacggcaaacctgggcagctaagctctccgggtggtcttgggtgtgtgggtctcggtaggagggctcgggtcctcctactttgtaaatatctttgtttttgttttttcttccccttaatgaaatgaaatgcagctctcctgcattttcgagaaaaaaaaatcctgcgtgccacataaagcttagtctaaactgtagagtgttaacataaaaaccttatccactgtaatcttcttcataacatccaaacaatattgcagggtttcacatggcacttatattgttcttatgctttccagaaccatttctttagactttagctttgtttctgtattacgtaagatggaattaaaaaatcagataatggtaataatggtataggacttctgataacaaaggatagtaataatgtgttgatccaaatttagtaaccacaagaccagtagatttagaggatttgtgatggctaaaagtcctcatctatttacttcagttacaccgaaaagaaaattcaaagctaaaagatgtgtcaaaattttaattatattgacctggaagaggtactcagcatattcagacatattccgtagcatggtcctttttgattctctatttctcctgcgcttctcataataactgaacctctgtgggggagcaaaagaaaaaaatgttagctctattcatcacatgaactactttgcaacaaaaaacaataatcccttgtcaattgttgctactttaaacatcgaacataacaaagggatagaggatagtaaaacttaaagcatgattacgtgatgaccagacaaactgaaacaagcaaactaaaaatagaatcaaggaaaaccaatcattttaataagcacaacagaaaattaaccacgctcgagcctctgcaatcaagtacaattagctaacaaagtcagcaaattactacctccgtttcatattataagactttctagcattgtccgcattcatatatatgttaatgaatctagacatatatgtgtgcctagattcattagcatctatatgaatatgggcaatgctagaaagtcttataacctgaaacggagggagtatcatattacaaaatgtacaaagtgcagatcgcaatatcaatgttctaaaaggtagtgcgatgttttgtttcaggcattccactttatagcgctcatgcggtaccttaggggtggtactaggtcaggacaaccgttccttcaatctatgcaaccttgtagaccatttttctaagaacactgagcaatacacaaaacagcctaacaatttacccatgggaacacacacgagcactgacaataaattcctcaattttcgcatgcattatcccctgcatgtcagttataacgagaatcaaattcaaacgccaatcagttccacatccaaaacccatcccagcagatgaaacgcaggagctacacagcgcgagctcacagatctcctcgcgcaaaaattcatcacgagcgcacgagaaataaaacgactgaattcgcaaggcttcccccacccccccaatacacacaggcgtttcatcgaacaccttaccgaccaacccaacccacaccttccggcagatcaaaacaaaaaagggagcaatctttttttcctcaacggagacgaggatccgctaacaaacacaacagagagaggggagggaggaaagaaggcggattacgtggtgccactgcgtcttgcgcttccgctggaggggaggggtggagtggaacgaggcggcggcggcggcggaggcggcgaggtggtgcgggccgcggtggccggagaggagagccgatttgacgtgggtgatcatcgcggcgggccggcggacggcgtcggcggcggcggcggcggcggcggtggcggcgagcggcgtttacctcctcatggggcaaaaggccgccggcgatggcgggggacctcgcgaggtgttgtggtggtggcgctccgtgagaggaggaacgtgcatgcttggaatggtcgctggtaactgggcccccagcccaaacgagccctacggcagggtaaggcccagtttgatttgcatcactgagcaaattattaccaaggattatctactctattataataaattaaaaggtaaatattagtttggagtaccctttaatgaatgttttttttacttttgaaccgggtaaatttaactttgtggtactttataccacatttaactattttatccatatgcatcaactcgttatatgttaagtcaattgtttaagtatagctgtgggagttcatcgatgagtaggagccgatctacttgaaattgtttatatgcttgataaaagagtcaggtagtccaaagtggaacaaaggtgagattattcgattctaaataaaaacaatggttaaagggttgatccaaagtaaaacactagtaataaaaggtgatccaaagtgaaatttactttaaatatttatctaagagataatttgttttattccacaaagtatatacacgcacacaccattacacgcgtaacatcacattcacgcacccacagatatgcccctaacacacgctcgaagagatggaaaccaacggtatattcttggtcttattaaaattctgttgaaagttccatatacatatgtgtgattaatttgaacggagagagtatataaacttaattttgtaaaaggatagacctttgtagcaccatatctttaaaaagggacgatatattatgtcatgttcgtttcatctagctgcggccagcggccgcggccgctagttagcagacacaatactcacaaggctcaaatgactcagagagaagtaacgcaagggcacacaagtttgcaataggaataatagccctctcaaggggagaggtgaggctatttatagccacagcacaaattctgtccgttagagcacaataaaagtgattttcagaactttcgaaaatcattttcggaactttcaaaaatttcagatctgagaaaaacagagtcaatgcaatttttcggaacttccgaaaagtactttcagatatttctgaaaatatccaaaacccaaaataccttatatagatttttggaacttccgaaaaatattttcagaagcttccgaaaatttccaggagcatatttggctcgcagacattttcgggaacttccgaaaatttcctgaaggttgaaatttattctgtgtatttttggaatttccaaaaatgcttttcgggacatccgaaaatttacagaacacaccaaacaaagaaatgcttccaagaaaaatagattttgagcacacgcatcactccttatatgtctatgcatcatccccctaatagtatggctttcctataacacaatgcaaggtaaaatatgcaatataccatttgatcattgtcgtattacgtcctgatatcgcattcaatggggtatgcatcacattacaacacgtcgaggacatatctaccttcacatttacttgaatagaaaagttagtcctccctaatcgaattgtaattaatcatcaaaatcatttggtgcctatatgcactttcaatctcacccttttttgtgctttatagcaatacaattagattacaagagagaatgaatataatagatgattttggtgcaaaggtttagtgaaagctctccctagaagtgtgcattaaagaaagtggagagctccccctaaatctttgcatccacatttaagctcaagagatacaaatcatttcatagcacatacatctcatttcatgactcattcatcacatgcacaatataagaaggaaataagaacatttgcaccatatgaatataacacataattgtcattacatctcacacatccataattaaacaataaagtcttataatatggcaataacttaaaatccacacatagtctcataaaaaaagccaaccatgttcgactaagatagctaaagctaaataagatagataggtattctctccctttggcatcgaagcaccaaaaaggaaggatgacgagacaaagactcaagcgaagggcgcctgaggaggatcctctagaggaggatagccatagccatggccaaaaccaaagaaatcatagtctgaaggtatcccagcaaaaggatcctcgatctcttcctctcaggctcatcgggctcggcctcaaagcccggtggggagggagggacatccacgtgaaaatgctcattgagttgtgcctgtatgttcttgatgcgccgagctgtcttcttgatcccattccgcattctgcggttctttttggcctctgcggcgcaaaggtcaaagagacttcgcagaatgcggaataagggagacggctcacgacgagccataggagagggacgctcacgagtgggaggaggctgagtggaaccccgaggaacacgtgccacctgagggccggtctcctcttccccttccccggaccaagcatggtccgagtcctccgcggaggatggagaaggagtgggagaccgatcccgagcgcgttcggacttgtgagtgagggacttgcgtgcaggcatcctaagtcaagaaaaagaatgacaataagaataaggagactaatgagatgaaatacaagcaatttgagacaagaatcatgcgaaaccaaggttggagggttcagacatgaattttcggaacttccgaaaataattccgaaaattttcggaagtttccgaaaatgcctagccgaacactacaactcagatcccgcacaaatcctccaacaaaaagttgtgaaattgaatctacaagtcttatggcactagaggaacaactccaccgaaggaaatcacaagatttaactcgaggggatttgattttgagatagatacctcaagaacacgaagaacacgtgaagagctcggtgaagaacgacaatctagcctccaagaagtgccccaaacttgctcccacgaggatggagtgaagaggagcgccagggagccaccagagaggagttggtcgctggagaggagcggagtcgcagaggaatctgtaggaaaaggagtgaaaagagagagaaaaagaacccacggattggaagaagattttatacccccgagatttttcggaagtatccgaaaattttcggatgtaccgttttcaacctctaaaaaaagaaaaacgttttggcattctctgtactttggctgtcacgcacgcacgcgtgggcgcgtagcaaagcaaagcagcgaatccggcttcactagtcttcttcccccccgccgccgcatcgatcccccttcccctcgtcttccttccctttcccccaatcagattgcttccagaagcctccttccccgcgaagcaaccaaccccttccggatcccgactccatccaaacccccatcccctcccctctcccctacgctcgaaaccctagggagatccatccacatgccgccccgatgaggtcgctccgccgcgtcctcctccagctcgtgctcctcgccggcgtcgccttccgcggggtccgcttcgacgacgccgccgacgccgccgccgccgcccaggggtcgtcagacctcttcgagctcccttcgccgtccccgactctcgcgctccccggcggcggggatgagggggcctcgacggagatcatcgccgcgccgtggccggggcgccacggcctgttcacgccgccgcggagcacgtcccagccggcgagagcggtggtccagccggccgccgacttcgggtgagcttcttggtccccctccctccgtcttcttccagttgcgatgctgttcaggaggaggctatggagtctataggaggtggatcgattggcttgtgcagcgggacagggtggggggggggggggctttgcctcctgttcttatccttggcttttggaggagcgaaatggattcccatcccgccaagtgttaaagagggtttcttgtagttagggaggcttgctatgttcctttgtcactttcttgctttcgtgctgcaatggagtggggaaatgcggggaaaagagagctctctagctgcttaggtcatgcatgatccatggttggaacagcatcttcttgctgctttggtagttctcactagcattagtaatgacatgactttgcttgattgcattgcacttcaattttagtattagttacgaattaatttatggaaatgagcagcttttgcacttactattcctagtataagaggtgctacttatgattcaaattgagctgtttggttcatttcttatgtgtgtactttccattttgtcccgccatttgaaattgcaacttatttgcttgtttttattgtgaacagctcccaactccagttttacgacaatggtacaattcaactagtggaccttctatcaaaattgcctcggtggcagttctccaccggaccccctctttcgaagcatatcactacttcgaaacctgatttgaactatgtcatataccttgatgggtcagaaacatcggaccttatagaagttcataatggcagtggtgtggtatgctttgcacaattgcgttagttctcaacatcctgtctagttttgctttgtttctcacctatcactggcttattcctgtagagacttccctggaaactggaggagtttattgctgagactccatatatacgggattcttttgttacgattggatcaaaggtttcaactacttttgtggtcaatgctgatagcggtgagatcatttacaagcatagcttgccagtggccttgaacgaggtaggtggccccctggttgaggaaattccatccaagttagatgctgctagaagtggtacaagtgctaatatcatagtggttgtgagaactgattattctatcagtgcatcggatcttggggaacatttgttcaactggacaagaacttccttcactgcaaattactatgcgaggtatggccaccaagacatgcttgcccaatcgtcctgtctgcgaggaaatattccatgcattaggactgagggtccaccaattaaactttatttacctgattcaagttcagataatgcaattgtcttgagacctgtgaacgaagtttctgctgtggatgctctggaaccacttctacctccaaagaagttaccacaacctgctggcgagtctaatgtggccttggatagtgctcaaaaccagactgctgacattgccctaggtcattttgtgcctgctgacactgaattgaccaacagtgtcactaaattttcttacagatggctattccccacgtttctcatgttgttgatcatggcttgtctagtgaaattggccgatgcaagcaaatattgcaggcaatttgtgattcgatttttgaagccatttatgcgtgatgagaaattgatggacccaagaggcaaatcagagggaacatcaaaaagaaggaaggcgcggaagaaagatggacttatcaatagcactcagatcttttcagcatctgataaagaggggaatggaactggtggatcaactgaggcacaaagtaataaagcacatgattcaacaaatgtggaactccctaatggcctcaatgggcgtcagattggtaagctttgtgtttacagtaaagaaattggtaaagggagcaatggtacagttgtctttgaaggctcctatggtggtcgggaagttgctgtgaaacgtctgctgcgctctcacaatgatatagcctcgaaagagattgagaatctgattgcatctgatcaggatcctaatattgttcgaatgtatggttttgagcaggacaatgattttgtttatatctcccttgagaggtgtcgctgcagcttggctgatctaatccaactgcactcggtaccaccattttcaaatactaagggaacagacattgaactttggaggcaggatggacttccttcggcacaacttctaaagctgatgaggtatgtgacaactggtcactggtgccctttcatgttgcacaccatgtttatcagtatatgcatgtgttgtttactttgagattaattgactaaggtcacgcttatgcatagcttaacttgatgcccttttgctaagaacactttgccaacaaccaacatccaccatttgctattacaaagttccttaatggctgatattatttgcctgcctattcttggtattgttgctagcgtgtccaccagaccaccactgatgttgcccttgtgaattttcatgtgcagagatgttgttgctggtattgtgcatttgcatagtttgggaattatacatcgtgatttgaagcctcagaatgttttgataagcaaggaaggacctctcagagcaaaactttcagatatgggtatcagtaagcgtttgcaggaggatatgacttctgttagtcatcatggcactggtaaggttcaaagttgcttgcgaatatgcaatatgagaaattactttctgtatcttttttatggtcaaggtcaactttcttaagtgcattttttagtcattgcgatgctctctctctctctctctaactagccatttcatccctgtcaacttactgcaggatttggaagctctggttggcaagcacctgaacagcttcgtcatggtcgtcagactcgagccatagatttatttagtttgggctgccttatattctattgcattactaaaggcaagcatccgtttggtgagtactatgaacgggacatgaaaatcataaacaatcaatttgatctcttcatagtggatcacataccagaagcagtgcatcttatttctcaactgttagatccagatccagagaagaggtaagaataatttggtattttgacatcgttaatgccctgaacatttaaaaaggcttcctgattttctgaatgcatttttttattaatgttaacagaccaacggccgtgtatgtgatgcatcatcctttcttttggagccctgagttgtgcctttcatttctacgagataccagtgacagaattgagaaaaccagtgaaactgatctcatagatgctttggaaggcataaatgttgaagcatttggtaaaaattggggagagaaattagatgctgccctgcttgcagacatgggacgttatagaaaatatagttttgagtccactcgtgaccttctaagattgatcagaaacaaatcaggacattacagagaattttcagatgatctcaaggtctgttgctgcatttcttgttttgtttgctttgttttagttttcctgcatacagctaaactatgggtcaaacaagaggtggtgctgtagtatgcatgaatgctgttgtgtgttcaatggatgttcatattagttgctgtgcatgaatgtagtatataggaaaagtagttagttgcagtcatgaatgttatattagttgcttctgtattatcttagatagtttcttagtttacttcttttatgtaaggttcaactaaactatgtagtgtgctagtttgtgatgattttgattctacagtcttatcttcctcacaagggtgggcactactgctgacctcctcctaggagttaggatatatctctgccttttcggttttctggagaatattaaaagtttgagatactattttatacattttcagttttctgaagaatattatcaagtttgagatactacttacagattgtgaccatgcaatcatcatcccagacgctaacatattcatgttaataaaattccaggagctacttgggtcgctgccggagggatttgttcagtatttctcaagccgattcccaaagctgctaattaaagtctacgaggtcatgtccgagcattgcaaggacgaagaagctttcagcaaatatttccttggaagctcggcgtagctgtaacctgcaggaggggtgaaggccctgccctgcctagtgtgtacactaacactcttctagcaaaaatgtatgtacatgtgatttgtaccatatatcatagggtaaagaaagttcagcctgtacattgtattccacagaattgtgtattacttatagtaaatcaaatcttttacctgactatatggactgcattatcaaggtttttttttttttcaattttgtttcgtcttgtgattgtgtgctgttagtccccttgagttgttccagaagatgaattcatcctattcatgtacggagtacatttgcaagatttgattccgttgttagattcgtttagacaggtgagttcggcttgttaaaaatcatgagttggtctatgtcagattgtcagcatgcaacatctctagaactggtgtaattagaacaactggtgtcatatctttttgttttctcgttctccttccgtatgttccatcatgtgcgggtaaccatagtatctgtcacgtcctgataaattcatcctgaaataaaaatcattccctaaaaggaataatagaattaattaaaattcgaaaagaaattggcaaacattaaaatgcgtacaagaaaattttgaatgtggtccagagaatttttgttaaattctctttggtctaaaaggagccctcaaattttacttgaattttcagagcaccggaaataattattaagcaacaacaaccttgatcaatgtttattaaaaagaaaaagctaaaaataaatcctccttcctcctttgggccaagcccagcccaaagtctccctctcctccctctctttccttcctcctcccggcccacctcttccctccccctcccagcccagctccctcccctcccctctctctcccgggcctgcctctccctcctctcctcctaggccgcctccgggcccaagccgagcggtgccctcccgcccgtgccgcgcatgtgcgtgcgctgaccgcgcgcctggccgcgtgggtcccacacgccgggtcgtcgtcctcctcccgcccagcctccttcctctctctctctctcccgtgcaaaccctagcgccaaacctccccaaaatccaagcgattcaaaccggggtttccaaaattgattaggggttttaatccccattgattcctctctctttcccccatattttccccttgattcatggccccaatcgtcgggaacgcccgcgccaaccccgggcaccttccatggccgccggccacgaattccgccgccgttccccgtctctcccgtggccggctccctcccctctcctataaaacggaatctcctcgctccgttctatcgttttagccccttctcgagctcccccacggccacaccacctctccccgccttcccttctctctctccggcgccggccgatctccagccgcccctgccgccgcgtcggcacgccggccggccgtgccgtcacctctcccggcgtcgcagctgcctcctcttccccggcttcgcccccgtttcgcggggaaatcatcggagacacgtcctcgccggcaaaacagtggcgttgccgccactgtacctccttcagtcgcctcggtcgccgcgccagagcgtcggccgacgtcgccgtctccttcgtcgacgtcgcagcatcgtcctctcctccggctgctcctctgtttcgctagaacaccgccgtgccacgccggcctctccatccgcctcgccggaatttccccggtcggcccttcctccacccgtgcgccgtcggccgcgccaccaccacctccggcatcgcagcagcaaggtcgccctcggcctcgcctccccttcgaccgaaccccgccggtgttcgtcgtcgtcgtcatcgttcctcctcgccggctcgtcgtctcgcggcgccgcctccgtcgtcggattcgcagcggcgtgttccacaccgtcctcgtctccgtgcagccgctgccggctgccctcgttgcctcctcgccggtcccggtcgtcgtcctcatcgtcgtggcgttcgtccctccgtcaagccgttctcgtccgtcgtccgcgtccgtcaagtgtgccgctgcagccccgtcgtcgtcttcgtcctcgcctccgcgtcgccaagcgttgcgtcggccgcgtctcgccttcgtccaaggatcgccgctgaagtcgtcccctcgcctttcgtctccatcgttcctggccgtctccgccgcgcccgttcgtcgttgtcgttccctcgcctcgtcgcgtggtggtaaggatctctccttcgctgccccgtcctcgtcctttcggtgtcgcccgtgcccgttgtgcggttgtcgaccccggtactcgtgtaccagtgtcggtagtcgttcgcttgtgcgtgtggtgaccgtgttagtgtgcccgctcggtagccgcgtggtttccacgtgtgcaggccgtgtggtgtctagtggagtccgtttgtcggccactcgcctcggttgagacacggggtccgcttccgtcgacctgtggaccgtctctgtgtacccggtctgccgtggtcccttaggttgacatgtggggtccgcatgtcaacagcgcagccttcctgtcttttccaggctagcgcttacacatgttttataattgcaaaacctaatcacaataattcataaatctccatgtaacagcattaaacttcagatgatcatatcttggtcatacgaactctgaatcgacccgttcaagtctcctaatgtttgttataacctaaagaaccatgtgctttcatttttatgtattgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttgtaaaattattttgatttaaattaatgcattatcgctttatttaaattcccgcgttatcactgttttatttagccatgcctatttatctttgttatgaacttatcattgttgttattgttattattaccttgttcaccctaggataaacaaaaccccaactagtgagtactctatttatggttccactagtacgaacttaggtagatgcttcgctggttaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcgtacctcgggttctataaggattaagctcgggcctctgttgcaaagcactactgtacttgcacatgtctagtgggtaaggcttagtttgtggctcagtctagttataaacaaaggtacacggatggagatggacgaagtcgggggtcgatggacatctctaggacaaatgaaggctacacgagctgtggcccggtagtcgagatgtcatggcacagggctggtgtcctgctgctagggactcaatcctgcctgcctgtcccggaggttccggccgtaggcggggctgggtcgatactcttgtttatggctaggatgggttggaactatgtcacgtcttccgtccgtatgccgtggtggtatgtggcacgtggttacacgtgaggaagatgtgtcttgtgggtaaagatgtacacctctgatcagagtaaatctattcgaatagccgcgccctcggttatgggcaagcctagcaatgtacccaatttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtcagggttcacggctttgattaataacactatgtagctctaggatcgtctttacaaagtagctttgggcaactaagtgacttttaaatgctgtttactgcaaaacttaacccctatattattaccccttgtacctccttgcattaatcatgtatctgccagtgtggcttgctgagtactgtggttgtactcattcttgcttaatctttccccccttcaataagagaagctttggagaagaagtattaggtggagtcctggcttataccccagttgagcgctgtcacaccccgaagttctcctcccaagcctaaaatttaatttataagagaccctaagaaaataccggtgcaaagcaagagtaaacccttttaaatcaatgcaaataataatcggagtgggcatgtggaatttttcttgagttctacatgtcgaaattcactaacaggatttttagtggaattttcagagcgctcgaaataattttacccaattaaaattgagcaagcaatattttaattccagggaaaattcttttctcctttttctttttctttttcccttccttttccgaatgggccgctggcccattctctcctttcctccccctcctccctgctgggccggccacaggccgaggcccagctaggccgccccgccgccctcctctcccagggtctccgacaagtggggcccacctgtcgggtccttccccaacctcccgtcgctcccgccgcgccgccgcgcccgcaaccgcagccgcgcccacgtctccgcctcctccgggccacgtcgaccacgcccgcgcgtgcgccgcgttccccgcgcccactcccctctctctctcgctcgcgcccgcgcccgagatggccgggattcgattttcgaatcccgtctctctctcctcccccacttcccccacgttggccggcgaaatcctgcctctcccggccacgtccggccccctctctccctatttaagctctgccatcgccccttctcgctttttccccatttcgccgaactctcccgagctccccatcgctcccgcgccgtgcaaccacccgccgccgccgtttccgctactccggccgccgctagccgccgctaggctcgccgccgcaccgcgccgtcgccgccgtcgggtttgcgtggccgagatccaccccgtccaaccctccttcgccgaggtccgccgccggagcgccattcccatcgtgcgacggtgagggttgccatgtccgccgcctttggccggcattcccgtctcatatggcccctctcttcctctctaatctatttcttttcgttctntaggtcgtcccggtcgccgtccgccgcgtgtcgacctccctccgtcgctcctcgtcgccggtcgccgccgtccccttcggtgaggactccctcccctttcttttccttccccgattccccgtgcgtcgccgccgcccgcgctcgccgtcgccttcggtcgttgccgccgtccgctgccgccgctttcgcgtcgcttttgcgccgtcgcctccgccgccggatgccattgccggcaacgcgttcgcgcgcgcgtgccgtcgccgctagccctggccggccggtcggctttgatgccgagccgagcctggcggccgcctctatcgcggcccgtccgatcggcccgaggacgatctgggccgtcggtcccgtggaccggcggtggaccacctgcgtggtcccggtccacggtgaaccgccccccctgagccgctgaccagtgggcctcgcttgccggcgccgcaccctctccgtgctgacgtcagccctgggaattattgcgcaataaatgatttaaggtttttttatagtaataaacacaatgaatcttctaaaattcataactaattcatccgagctccgtttaagcccattcaagtctcagtaaatcaagaaaaatgtgtagaatccattaaaaacggttttgttccctgtttcagtagtcttatagcctgtttgcaatgtttgccttgtatgtcgctagattccggttcctccgacgctccggtgtactttgaaatagtcgccgaggttcctccagcagcagagcaaggcaagtcatgcttgtcacttgaacatgttgatcctatattgcaaatgctctattgttttccttcaaatactgcatcgttttataatgttactaaggggtgtttacctattgtcatagccatgctattgttgtaccatgtccctttgtcagcttggggttataacatgactagagattggactagggattgcttagccatgcttag

SEQ ID NO: 80971 - DNA, 14416 bp, Oryza sativa
tcatatctctgaggaaagctcaggtgaattgcatattgttttccagtattcttctaatatgccagtgacctttttaggtcttactagtaccatccgcgttcacaaaagtaactggggaggcgcactgggaaattcttctccgagctcgtgccattgagacacaatgctatgtatgcaaatcctaactcttataagtctttcacttttgcagacacatcaggctgtttcatatggttgggagtgtgatcaataatataaaatccaccatatatgcattacatatttgttattgttaaattttcaagatttgcaataggttattgcagcagctcaagctggaaaacacaatgagaaaagagagagctatggtgattctataattattgacccatggggaacagttatagctcgacttccaggtatatctcttcattttgttactgtcttctatcagaaatcttctgttgatattttgaaggttttcttgaattttatcagcaccttgtaccttgacaaccaccaagattttattgatcttctgttgaactcctcaacaatatttgctagcactgaagtttgaacttgtcctggaaaatattgtagtctgccattaccatactgcatttatcgtgtttgtatttgttcaaatacaatattctgaaattatgtggaacgagtgtgtcacagtatgcccgttaaatatcgttctgaggaattaatcatcaaactttggctacagaccggctgtccactgggtttgctgtcgcagatgtagacttgtcaaaagttgaggctgtgcgaactaaaatgccaatctctgaggtaatactctcatggagatgctgtttgcttctgtccaagaaacaccatttagttgtgttcttcaataacagtttatcatcttattttgtagcaccggaagtttgacagcgtctggaaaacctcatcactgtaatagtatagaggtcttgcacgcctcctttctctttcttttttctttagagaacagtcgacctattattttgtgtatcaaatatcaattgcaaggcacacatgatgatccaatggtttgatcggcggtaaacttcaattgcgaagccatggttgctgtgaggtttcttggtttgaagaattcctggttcagtggaacttcaagatcccaaatccccaattaggctaggaatgatttgtcagaccaaatagtccataaataatagtgttggcttgaacgcgacgccaccaacctaggacatttcaaataagtgattgccattgaatctaatgtaaatttgttatggtacatttgttgataaatcaaagcttggattttttttttggttactgcagaattgtttataaatatagtccacacatacacttgaccacatcaggaaactcttctaatgtatacatgacttataagggcacccgcaatggttatctataggctctctacaagagatccatgtcagcatatttttctacttggaagagattaaatgaagaaagagagagagcaaagttatctactaacctggaaatagtctatagaaaaaaacgaggcaatggattagagagctatagatacccatgtaggtatatcattgaagtggtttactattaatctagtctattactgagatgtacatgttttatagataacaccttactttaccattgcaggtgctctaaatgatgaaacaaaaaaaaatgacagattggctgtgaatagtttctgaagtatctttaagttttaaaaaaatgcacatgaactatctccaaccaaatatgctcttttatccttgtgtggtggagttcagtcttgattttttgtgaaataatatatatcacttattgttaaaatttttagaaattctattagtatttttgttgcagctaaggaggagaacaaatgagtaagaatatctccttgaggtattatattctagtaattcagaccatgcccacagagtaagcatagctctctcacgtgttattgtaaatagtatactctaatcatccaccgtactccaaaactttaataagcaaaatttttaaactttgatcattcataacttctggtatgcttagctttttatttagaaaaaagaatggtacgcatggaattgcttaggcaaaatactatcataatatagcataaatttattatattttataattttgttataatataaaattgatgatcaaattttcaaaagttgaccgaatcttcttctaaacatcaaacgtttataaatagagggagaataaaaaaattttaaaagtgaaaactgaaaaagaaatgtttgcatttaactcagctgcaacttctctaacaacggggattgcctgctactgctagtgctaatgtttgctgccggcctgcaccagcagtactgcagaggatctgcactcctctaatgctatccctaatgtaaatgctgagagagagagagggagagagaatataggaggatattatttgtttttctttcatgttaacatggtgttgagtgatgttggagtgtaggtgtggttgcataaattaatttgttaaggttcaaattcaggtaaccaaactaggtagtttttttttcttttgaggtttatggatttttccctaatgtctctttgttgtgttaaaagtggcgtattcgtagatatatatagcgcgctgtgcatcctacatttgtattaaaaaaatgatattatttagtcctaatatggattttggtgtaggtccattatttagcaaatgctttaagcattttaattgcatgcaactaattgagacttcctttgaaatggggtgtttcaaagaaattgagctgattcgttttaaaattcctataaaattcttgcgtttaagcaccaatcctttgagggatatgatctttttcgtcaagaaccaattctttgctaagaggaaatattttgaagaatattttcaagaaaaagataatctctctaatattttttgaataagccttttgtcagagtgctagctttactgccaatcaacaacgtgatggctggcgtatcagtagccatgtcatatgtgtaaagtgtttggatttaaagattttatggaatgccaaattttgtttaaaaggtaaaaatttctccttcgccaatatacgaagggcctcattgtttggctgatgcttatgcttataagctaaaatttaaattttagaacttgattttgaatttatttttttttcgtttttcatcgtagtttattttacaacatctgtttttatttagtcgctaaagagaagtgcataaaacatttaccgacaaatattttttattggttaataaccgatccgaataagcatacgaataagggaaacaatattcgaaattagtacgaaagagaaaacaaattacaaacggattttattacaaacccgtttctacctctttttttttccctcttattacagagaggttagattagagttaggctcgccattaaacaacactcatctccccctcccccttgaaaccctagctccgcttcgccgtcgtcctcctcctcctccccggcggcggcggcggcggccatggcgtccgcggcggcgccgaagcggtgctactacgaggtcctgggcgtcccccgcgactgctccccggccgacatcaagctcgccttccgccgcctcgcgctctccctccaccccgacaagcagccccccggctccgacgtcgccgccgccaccgccgccttccaggagctccagcacgcgcactccgtcctctccgacccccacgagcgctcctactacgactcccaccgctcccagatcctcttctccgaccaccacccctcctccggccccggccgcggcggcggcgtcgcctccgcctccgcgtcccccgtccccgacctcttcgccttcttctcctcctccgccttctccggcttctccgactccggccgcggcttctacaaggtctacggcgacgtcttcgaccgggtcttcgcgcaggagctcgcctacgcccgccgcatgggcatgcccgccgacgccgtccccacgccgccggtgatcgggaacctcgattccccccacgcgcaggtcgccgcgttctacagctactggctcgggttcggcaccgcgatggacttcgggtgggcggccgagtgggacgccgcgcggggggagagccgccgggtgaggcggctcatggaggaggacaacaagaaggcgacgcgcaaggcgcggcgggagtacaacgacgccgtgagagggctcgccgcgttctgcaagaagagggacaagcgggtggtggacatggcgctgaagaagaaggtggaggaggagaagaggaaggcggaggaggcggcgaggaagaaggaggaggagaggaggaggaaggagcgagcgatggcgtaccaggagcccgagtgggcgagggtggacgaggatgaggcggcggtgtttgaggacgacgaggaggaggagacgagggcgaagaggaaggaggagctgtactgcgtggcgtgtaataagaagttcaagtccgacaagcagtggaagaaccatgagcagtcaaagaagcatagagataaggtgtccgagctgaggatggtgtttgaagaagaggaagaagctttgaaggatgctgaagaagaggagccagaagaagttgatgtggggtttgattttcagcctgcacaggaatcagaggagagtgaattttcagatgctgctgaagagttggctgacgagttgagcgagggattggaggtgcgtgatgaagaagagaagggtgataagcacttgggtaatggggaacaaaaggttggttcatatgatgaaaccagtgtgttagaggaaatgctatcgaggtctaggcgcaagaataggaagagtggttttgtcgctcctcaggaggaagcttcaccagctggtgccatggatgatgatgacgatgaggatacaagctatgagattaataatgtcaaaaagaaaggacgccggagacgggcagcaaagaagggaggtacttatgctgataatgggcaaggtaggaagagtgagaatcagcctgaggaatccaggcataataatgatgaaaatggtgctgatgataagatggaaggtccatcttctaatgaagacagtgctgcagcaagtaaagaagatcagcagaaaggaaaaaccggtaatactaaaaagaacaagaaaggcacagaaaagaacacaactatatcttctgaacaaaagggtacatcgaagggaaagaagcaaaaggtacattcacattattttctcctgttaacttcttcatatttctttttcatgtatagttggcaggaaacttgttatgaatttgtgactaaaacccatgtattctgtttctctgtttaagtcaaagagcaaaaacttttagcctcatcagtactatgtgaatcacatatgcagatacctagccgtgtaggtgcttcaagaaccacctaactaagccacttattagaaatgcttacgtaaaagctgtgctactttatagaggaaataaccaatgttttgaattttgtggaatacatgattagagttgcttcctttgtgagaaaagaaacttgtcctgaaaatcttatgatttttgcgggtatcaacactcacatgttggattgctgttgttttatgattttttttccttatgcaaaaccctaaatctgtctttgtgcagcacagtagcagtgatcttgctcttgcttttcacattttggaaagaaacctagaggatgattttgcataggttgaaatgatatttgatagcactgattaacatagtggataatgaatattatgcttttgtgaaatacttgttggagacagcctttcttggttttgtgaaatacttgctggagacagcctttcttggttttgtgaaatacttgctggagacagcattttgtgaaatatttgatagcactgattttgtgaaatacttgttggagacaagcctttttttggtttcatgtcaattagtatattatgccttttcctgtgatgtctgttaacagtttaacttgttgatctataattggcgtatcagtttagctttctgtgtatttgttctaaatttgtgggtgtgtacacagttgcaaacagagttaaagaatcttggaagcccccctggtttcactgttatcacgattttcttatcttgttttgattaaaaagtagattagtgccacctagagcaaagagcccttccgtttgttctgtatcatgtagatgtctagtgcaaaatactttgttggagaacatacaacttgaagctgcaaatgtggaaaagttttatacgtactaattcactgtctactgttagtgcaacccgatgagcttaaaaccaaaattcggccatgccttgagtacccatgacatgttttggatatattttgtgtggataatattgtgctatgcattgtctatagattcataaaattctatatatatttctgtaagtagttataacactttgaagctaccttcttgtaccaggaggtttcaaaggcacccagtaatgactgtgaaacgtgtggatcaacgtttgactcaaggtatgtacttgaagttcagctttccttttcctctccttccctttcatttgcactttcccatcatatgttgctatcttacaatgaaattggaaacgcagttatggtttgtctcaaatacttcttgttgcaggaacaagttgttttctcacttggaagaaacaggtcatgcaatgctgaagacacgacagaaaaatcgctgaagaggacaagaaagtagttttcttttaccgtttgtcccagttgatgctgatagattagcacatcgacaaaaaggccatatatctggtttatagcccaattttgatatgtgtagtagagccgttttctttcttcctggatttgtttcattggtttgtggtacagaatgacaagaactaattattattattcaatcgaaatacacaccatcttgtaatttttctcccttttggtgcattgtcttgttcaagaatgaaccattttgtacgcgtttgagcctactgttgctggtgctcagcttctttggaatttcaccaataacagggacattattaaaacaactcgtatgtcatgtaccatttcaaattttaagcactgaacatcagcatcgaaaccaaaacagttactatctttcttatcattcaggtgaactccaaatttccctatgctatctgcaaatgggtcttttagaattcagagaaagggataacattacatttatataatctgacacaaacttaaaatcacaaatccacaaactatcttagtttgttccttttttccccttatgtacagctccatccaaatggaaatttcatgaatggagtttcattccatgttggcatgatctgcttcctggagacctggactgaagtccccccctgcattgctgcctgaacttctttgttttctgacagcaagagtggtttgcgcttgcaaacaccaaattaaggcaagagatgaaaggatttgaatcaatcacttggtgctcctgtgacctgatgaagccatgagcaccgcgaccgcgacgatgaacatgaacagcatgaacccgagcaggatatacgtctttcgcgacgatttccggtactccccaaacaggagtattccccagaatgtgctcacaagtggcaatgcctgatgaaacagcaatgctgaagcagttagaatcatagtccagaaaagttgtacttctctgaagatagtgtgaactgctaaacctgaagaatttgcctggaagatctagtatgatgttcagtatctgaatttatctaaagatctagaataataagttgcagttatctgaagattgtctgaattgctaaacttgaagagaatttgtctgaaagatctagaatctcgccacagccatcgcgaacacgatgaatttctcttctgatgtgaagaaatgataagatttggagattggactaacctggacagcatcagcagcagcatagccagcagcctgaccacccatgaactgaaacccattgccaaagccacataggaagccagccaggagagcccactgcctgccttcccagtcattcaggtaagccttgaaggatgatttcggcacaccggccattggacggtagaggaacaggatgttcaggccgatgccgatgacgaagcacgagatcgagaagtagaagaaggcggtgtacaccaccaggtgtggtacaccttgtttcagggtgtgccattggtcattggtggcgaggttgaatgccggggagaagagtgagaagcagactcctgagaagaacactatcccaagccctatgaaggtgcttgatccgaacacctgcgcaacggagaggttcatcagatcaatctagttcattggtacaagttttcatccataattttggtattgattcaacaagcatgataaaggatgattagaatggcagtgaccgaattaccttgatcgaacgccgttcttcgagctcaatcaagtattccgcagttcctgcttcagctttggcaacatatttggttgcagaagctccattctccaagtccttgggagcatctgaaattggcagagttaagaactaggatctgatctgcaagaaatcaacattactagtacttacaacattaaagtcagttttttttttaaagaaaaggttatggcatacctttttctatgacttctttgtttggttccacacttccattttccctggaaattacaggttattaagatcataggggtcagtaaattaaaagacgcagaatctttaaatagattggaacctaaggcataatatattttctaacagaggtatccagataggctaaccagtgtgtaatgtgttttatgtatcttgatgtgaaatatcttgatgtgttgaaaaatgtgaaatatcttacccaagtttatagatatttgtggagccatttagtttttcttcattatcagctgcattggaggcatgtacagcagagccaagaatgactgcaacaaggaagcaggccactccagggaaaagaatctctgctctgttgatgcggttgtccaggaaataattcagtgttgtgcctgaagatccaacatgtgagttttctgatctactgaataattaggacaataataatggatacagcaattagtttgctgtagctactgaataaagtaaactggagatattgatctgaatatatgttcttttcaggagtaggaccaactataatgtattcatactattactaacctaattattcagtttcttcgactaacataaatatagataggttgtgatgagctgtacttcacatgtatcaccaagaatcaataattttccctcaattttctttacttaaaaaaaaatcaaacaataatatatgttgcagtgttgtaaaagagaagttttacctacctattacaacaaccatacttgagctgatgacctcagtcactgagagacctacatatgcccatgcatactgagtagagaggttccctatactgagcacaacaccccctgccattgcaaacagcactgaaggccaattatccttcattgcaaacaaaaaaaaatcactgtcagcaaaatttcagactaactaacaatcagaaatgtattaattcagggatatactatttcagatgcttaagagaaggtggctaacctgactgagctgggtgaagaaattgggcatgttgggcttgctatcgccgagctgaccgaaggtgagcgcgatgaggaccgcagcgaggaggttcgtgatcgagtagtcgaggtaggtgtgctgcgggagccggcctcggcgctcgaggagggtgaggaccgcaggccatgtccccaggaagaagagggaggccagcatgagggcaatggcaccccctttgtcctctatgatgtacatcttgaggcctccttgtctgatggacaacagggaattcacaagggggccttcaaaaacctgacaaaaaataaaataaaacacattttttcatcatgtaagagggttgagctgctactcatttggattgaatcatcaagaagtttcaagatcttgcagttgttatccacaaaatcttgtaaaatcagaaagtgttttgcatttaatactgtcctcaaatctccatctcttcattcttgcttgttacagcaagcaataatatcattacaagaaacacaagaaaaaaaaggaaggaaaagaaatcaggaaatcaaattcattccaacagccatagggaagatcccaaattgtggataagctatccttatcacttatcagcatgaaagactcccagttcttggaaccctaaatccccaattcttcaaagatcagattctgctgaggatgagaagagatccaaactcccaattaaacacataaacacacaaggaaggggaagaagaacatcaagcaagtagagcagagtaccttttggcatgaaaccaaagaagtggcacaaccaaggacatggtccatggatactacttatagtgccaagcactggttaccaaaacaaaagctaatggtatctttcaaacgcaaaaagtccaacttgatctgcacaagtttgactcatgcagcaatttgcgaattcgcggcgtcttctcatgcgcagatcacccaatggaattggagctttatggaggaggaggagggagaaatggagagaaaagaggtggagaaaaagacaactatacactcgtcatttgctgaaaataatggaatggggtgatagtgacatctagggatactctcctccaccaatcaataaccttgaaatgaaatgatttttagctgaaatatcacttattgcagactccacaagtttatgaacatatggcaattgacaccattatgtctaatgaattacatatcaaggcttttttttttcttggatacagatatctaactaggtattatctgcaatttgggcactgaatttgtccaagaatgcaaagagtgaaaaataatggaagtagagaactgtactctttagctagatataatcatataaacaactatccatttctttcagtgacgtcttatctaagaaaaaggcgcattaaaagagaatttttttttgatgattccaacaagaaaatgatgcgtctactgaatctttcctttcctcctttaagcaacaaactaaacaaaaatatttctcaatagaacaagagattcataaactgacatggatccaagaactcaaaaccaacaaaaaagagagacccatgccgatgattttcaaccaagaacatcatcttctccccaaaatatcattttttttaaaaaaaagaggaagcaaacaaccaatcaacatcgacttccactcacgaatacaaagaacacaaaacgaaacagataacaaagcagacatgccggacataaaccattcatcaccacaagctaattaatgacaaatcaaagatcaaaagacaggaacacattacctaaagtcagaaggagagaaagggatgaactgctcctcctccagagaactcaagaactgaactctcaagtctcaacagcctttgtcactgcatagaattcttcaggttaaatagataggcagctggggtttgttggactctctctactactactcactcctccagctgacacgcaagaagggaaggaattaaccatcaagagattcttgttcttctctcaagagggccaacaaaaaaaagggaagaagattcttgtggcacctaaaaatgaatattttttttgggaaaaaaagaaatgtaaaaatagaaataaaaattcaatccattgactccggatctggagagatcctcaagattccccaggcaattcggcagtatttgttgctatcttccctcgctttgaccgccttgtgtggttgtcgttgtttcgcgtgccaggagcgatttgtttggagaagagtaggtgatttaatctctttttaatttaataaaaaattggaaataggtgaattatatatgcagctgtttgacaatttgacatattattatttctgctgtaacgtacagatcagtccagcctaggcgggaacacgtctggatgaataattcataattgttttattacacggtgggaaggtttctcctaacacacgccaaaagaaaaaaaaagtactagactaatagtaataactaggcattaaaaaaaaactcatgttaaaacacattcaaattttagataatgaaataaaatcacggcctttgtttacagagctatatccaattattaaaaaatgttccaaacataatcacacctcaaaagaagacattaagacataagggacaatccaaactgatagaggcgcacactgacacaaacactaataaaaagataaagcacaaacttattgaattttatttgtgaacctcccttcaagattggtgaaaagttacataactccagtttgtaacatgcaacttttataaacttaatgtcttcgtcacatttttgtagaagagcccataatcggagccaatatgttgtcttgaaaatcatatgcaaaaaacacattcatatatatatatatatatatatatattcaatattaatatttgtaggcatcatgatctgaacctataattttttagtacacatagaatttctcttaacaaacgttgtaagagacgcacgagaccgtgactaatttctagcgataaataactagcttcattaaggccctgtttacttcctacacaaaaattttacaccctgtcacatcgaacttttgaacacctgcataaaatattaaatatagactaaaaatataactaattgcatagattgcgactaatttatgagacgaatattttaaacctaattgctcaatgatttgacaatgtggtgctacagtaaatatttgctaataacggattaataaggcttaataaattcgtctcgcagtttactgacagattctataattagtttttttattagtgcccgaacaccccatgagacaccctatataatatccaatgtgacacaccaaaactttacacccctggatctaaacaccccctaaattcctattaaaaccatgcacatatgtactggcactaatatagatcttgtttggtataactctaaatccaagattttataagctggatattcctaactctacataaccacagatctggatctgctattacgttataacatttagataaattattttattttcattttagataaagatataacattttactagaaattttaaggctgtgagatctggatcagggcctaagatctcaactctacgtgtgaagatttttttttttgtttttgagaaaattggcatgattggctttgttttcggtgtcagcctggctgttgggtgcgacgactttggaagctattaacatgtgctttcttacattaggtgtcgtggttgtacaattagaatataaccttgatttatttgtttattgaaaaaaacatattcgtgcattatatacatatatattttcttgacatgcatttcattttcatctttatcccttgataaattttattgctgcactaccaaatgtacaatagtaaaatacaacctagaagcataaaattcactttcttttcgacgacatatatggacctttaaagagtaattttacaaaaggctaccttaattctgtgatgaaagtttcaggggccctcaattagttagcttatcctagctaatcttgcatgtggcaggatactatgcacgacaattttctatgtccatgttcgaaatcttttgatgacaggttaagtagaacttgctaatggatggattaataaatatataaatatttctaccaaataaagcatggcagctagcctagagcgcaagtgtcaaagcaagtgaatagttttgttagaaaaacgtggctcgtgacttcgtgaggaggttccatatgcatgatagatatcataaattagtaccctccagttttttaatagatgacgacactcacttttaaacacaattgatcatttgttttattcaaaaattttatgcaaatgtataagatataaatcaagcttaaaataatttaagtgataaaacaactcataacaaaatatattatatttacgtaaatttttttaataagatacatagtcaaacgtgtgataaaaggttaacagtatcatctattaaaaaacgaacccagcaacaaatttagattatcaaagtgacaggcattgagtgaagatcacggtaggtacgaatatgaataatcaagtggccctgaagatttgccaaagtcctacgctgcatttcgtattgcagtgaattagtaacaatattttttgtgacggtttttaatatttcattatttggtaaatagtttctatttagatttaattatgcaaactataatataa

SEQ ID NO: 80972 - DNA, 12117 bp, Oryza sativa
acacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggaggttcctagcaatgcaggggatgttgttggaccatcgatgcaaaatgagaaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggctactgattgggcaaatgaggacttctctggtcttgttatatcagagggtgatcatgtaccctgggagtataaggagaacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagacgaggtatggcacatttgaagcttcttatgataatttgcctcgtttgttagccaccattgcccagaggaataataatacttactatgacctacatacatttacatcggttgaagatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtgaccgagactacttcgtggcggtacgtccaatttgtattacttccaacaattatgtcatttatcttgcataatataggacaactactgaattttttatttccatcttgcataggctgatgcggcgcgggatatcagtgccgatatcaccgcagtccaggtgaggttgaacagaggtttgcacttgactgacgttgagcagagggcgaccttcgaccggatgcaggagaagatgcgtgcggtcatgcgcgtcttctcctgtcgcagcgccgtggacgtcgtacctccagctggtccggtacacccacggcctcgcgcgcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcactatgttttaactgcacgtttcctcatcgcaggacctcgtctgcattcgagcgcgttcgcaggcacgaccggcgcttccgcgagctccgcaggggcgttcgccacctcttcgggcgcgttcgccagctcttcctcccacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcatttatatggtgctagaacaacttatgctcacgacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattgctaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaataataaaattgtattttaccagtcttggagattttaatcttgtatagttttcaatataaaaagatttgataactattgatatttatataaaaaaaatatagagcacagtacaaaatcgccctagcggagggcggcaagggggccgcctgcaaaattccatgccccctcgccacccatttgcaggcggccccccgcacagtgcaaaatcgccctagcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcctaattgagagctatgactgacttatatccaacaacattagtcaacaaaagcaaacactcttgtttggggctttatgtccactttctaaccaccttgagaaaaatggatctgaatcatatacatcaaagccatatgctctctctcagtttcacattttttttgtgtatttactagggatatttggatatatcataatatttttctatgtagtcaattgagttgccacatttcttccctaattccttatatctcaagctggcaaggttgatgctcgctgattgattgagatgatgcacaattatacgttgacacgtgtccctctttctctcccccaagaggctaagagtgtggctggacaagtatttagaaaaacaaaatactaaaaatctagagaactcttcccacacaattaactctagtatcttcgagtctggtctcatttcaaatgatttaggagtaaataagacaatattgtagtcaaactaatcgaggaaaaaagtttcaaaaacaacatttatatgggtcgcattcacctgattaaatcaaagaaggagctaacaatcgaaagaagaattgagccaagcaataagatcgaacatgagcaatggtggtggtagtgactgcaatactggatcgaacaagtgatggtgctcgcactaaatggctcttccatgaacaatgcagtgctaccgaagacttgttgatcaattggactttgccattgcagtgaacgacatgcttgtcgggctcacaccacgtaccgccaccctctcgctggtcagacgtgccccgttttcagctatgccggaacttccatgccaccacatttacatggctgacgctggagttcagatagccgtcttcgaatccatcgatcttgcatcttggcacccccggaatcaatgccccaagagtagccatctgatcgagttggtaggagcacaactgccaccagatcagatgtgtcctctgtctctacatccctctttccacatggatctgacatctgccaacacggccaacatcagatcgggcaacctaaggtaccaagtaccataagcctcctggcgagatgggaggggaaggagagggcatcatcgtagccgtcgctggtgaggacagagaaggaaaaaggtgccatcggcgagatgcagaagaaaaagtctgagagagggagaaagaggcgacacggcagactgattgaggcaccaagcgtccgacgagacaacttgaaagtttcactcgattagggcaaacaagcccgcttgaatgtatctcttttagaaatgttacaaaaattatgttactttttaaaaaatatatcttataaaataaatatcttttaaagagcgtacatgtttaaagcagtagatgtaccaactgtcacgtctattttctagttatgcaaaaagggctaagggcaaccacaatatgcatgaaaacccaccttaagaaataaagtagtatttttttacctttatacatagggagatgatttatgaagagaatagtgttatgggtaaccttaagcttaagggtagaccataagaattttaaaaaatatatcatagctttgcaacatgcatgtacacttttaatcttgagtaaatatgtgtttttttccttagtgagtcccaccttaagatcaaaaagagaccatatacttcctccgtctcataaaaaaaacagtacatgatgacatttcatctgtcatcccgggtactaggttggttttttatgggacgaaggtattacattgtattatgtagtatggacaaacacaaggacgtcccgtcttatgactacattgattttaaacattgaggatgctctaatgcctttgtttgatttatattatttggcagattataatcatggatcatctacttagttatagggataaattaaatatttcagaagtaaacttaacaataaaagattaaaaattgatacaaacaatacaataaaagtaattcttttttgcaaaaaatatattcttcaaagcatgaaacaaataatcccttttaattgtccgatgaagtgaaaagaaagcttccgtaagtaagttattgtaccgttccaaacttccgtatggaccgtatggtgccctgcacaagaaaggtgttgaaaaaaatactaaacaaaaaaaaagacagaaattctgaacatagaataagaacatcaaaaagttcctaaacaaaccagaaatatcaacatgaatacattagtgataaaagatcaagtacacaaaagtccctaataatattttttttcaaaaaaagtagagacattatttttactttctaccttaaaaaaaaaagaaaaagaaaaggggcgcgtgcctggccgcgaagatggtcactggtcagcatgggacactgatctccttcccttttctttggggaaagtgaaatcatccctcgaggaaatcccctcgtttcgtacatgtcacctaaataatcataaaaaaatataaaaaaaattggcaacatagattaatatgaaacatatcactctacaaacatgcaagtttaaattcaatttctccaagttgtaacaaaaataacaaatatagttacgaatatgcgataactattttcagtttaatttgttatttttgctgcaatttatagaagttgaatttggtcttgtatgtttgtggagtgatatatttcgtattaatctatgttgtcaattttttttaaattttttaataactatttagatgacatgcaaacaacgaggggatatcccctcgagggatgaaagtccacatccttttctttgctagcttcagtggagccacatgccagcttagccattaaccacacttcactcactccacttctccaagaaacccacacgaacgacgatggcagcaagatcgtcgctgccatccttctgcctccaccagatcaggtcagacagccgccgcggcgcgccgccgtcgatacgcgcctcctccaccggcgctgccaatgatggtggccgcaacgacgacgtcgacggcaaggaggaggaggagaagagcgaggtggggaggaaggtgatggtggtggccgacggcggcagcgacgaggcgcggacggcgctgcagtgggcgctctcgcactccgtccgcccctgcgacaccgtcgtcctcctcgacgtcgtcaagagcggcggcgacggcggcggcaagaacggtgagcattgtagctatggcttaattaatgatcttccttcgtttcatactgtaaatcgtttaactttttctaatcatttttatgtttaataaaatttattgaaaaaattagtagtatctattttattaaatgggagtattaaatatatctaaatatattatcataatatgtttttttagaaatgttactaatatttttctataaatttggttaaacttaaaaaattaattaacttataatatggaacggagacagtagcacatttctaattagatatattcttgttttttaatatgtgttgagaagcttaaggtgcacgtatgcaaagtaattaaatgatattgatagttctatatatcttgcatggttggtgatgaactttgctgattgattaattgattaattgattaggggatgatccaagcagagggtgccaacatctggagacaatgaggagtatttgccaggctaaaagaccagaggtatacaactactaaaaaattgtggtttttctactcttgtagctgcaaaaggaacttaattagaaattgtttttttatcaattaacaataaaatgagggtgatttttactgttttgtattacgtcgtttagatccctctttcttctcccaaatgcaatttgagctgtcataatatttttttggttcctgtaaacagtgaattttccctgcttcaaacagagcactttaaggaactctagaaggcatgccagttttcataaggttttcactgaaaaagttggttctgttatttcatatatcctaatggagcatgggggccatatattatgactatcctcataaaggggttatcatgatggagctatggttcccattatcttaaaaaatgatggagctatggctttagcatatcatatataatacacagagcttgcccattttgatctcattatattctggttttatatgaacaaaaatttgcaatatccagaatatccattcaatctacttacgatcgaaccatatatgtaaattccaatacaacattgatataatccacaaagcattatggaatactctgacttgcaacatcatgattaagattgatcctgcaagctagaacttctacacagttacttattattgttcagtgatagctatgaaacagatgcttctattgataaatagcaccttctgtttggtggtacatattttctttcaagcaacagatcaatctgcattggaacttatactcccattttttacagtctctaaaccaaaccgaaaatatatataaacacaaagcaccctaaccctgtaaaacccatatgttggtagtaacaaatgagagaaatttatcagaaagctggagatgattcttgcaatccatcaattaatatctgcaagcctgtccctttaattaccttctggcatttgaagtgacatcatgtatttcagatcaacctgctaactaatcagtaaatcctctttgccgacaacccagatgatcagtaaataccctgtggcagatcttacccttttgtgatctggaaatatagacagctagtactacatataaaccagttcattggtaaattaattgaatgaatgctttccctgagacaatgcattctatgtcaaacagtgttaataatatagagggtcccattcactgtcaaatcatgaaaatgattggtgaacagcctccacagagatgcatgtgctgagcatcatctcaaggggtgcatatgcagttgcatcccagacaggatcatggattcatggcccttgattatgtttctcatactgcaccttttcaatcctagtttgacattcatgccttttgcacctgccatagcatacgagaattaattaagaagttaatcaatggcatccagaattccatgatctagaaacttctgatctgaagctaagctaggtgcagcaaccgggttttatgagttatagatttactaaaagaattataacatcagaaaattacctctccatattcaaacaattgcagttttgattgtttcaatcttgactacttactatggacaaattaaaaggttttacacttatatttgagatgcagtactagtacacttcaataatatgacatttttttaaagtatttgtagctcctttttttttcacgaaagaccggtgctcagtgtttgaagatcagtggtatatatatatatatatatatatatatatatatcaaatgacagtcaggggcaaagccaggatttatggctagggggtgtaggcagggcgaacaagtcataagtcagggtaagcaataccgacgataaaaaagcttgaatttagctttttagttgtatcattggatgtttgacaatttgagacttgaaacatcatgctcgataacgagacgcaatgggaggacagagagacgtgtgaagccgaagcaatgatgacgaggagttgatttgcgtcgtctctccatctcttccttattaattaattttctataccatgtttattaataatggactaattaacatgctaatgcgctagttagtacaacagggatgggtgtcggataggggggtgttggcccccttcggcaccccctgtagctacgcccctgaattgacagttatatttttaaaacaaaacgggtacatgagtatatgtcacatggcacaagtaatgagatattgattttttttaacaaaaaatgcatggtagtttaggagaaatgaagcatgattgtggaggcaagcctagggcttaacaagttgcccaagttacctggacttgtctccgcccctaattggaacttacagtttttataatatttcacaagctagaattttgtggaaatattgaattgagaaaactcttgcattaataaaaaaaaataacatgtccttactcgcgtcttgattcgatctatatataggtacgcgtcgagctttccttggtggaagggaaggagagggggccggcgattgtggaggcggcgaggaagcaaggcgtgtcgctcctcgtcatgggccagaagaagaggtcgatcacatggcggctgctggtgatgtggatgaccggcggtaaaggcggcggcggaaggggcaccgccgagtactgcgtgcagaacgcggcgtgcatggcgctcgccgtccggcggaagagccggcgagggggagggtatctcatcaccacgaggcgccagagagatttctggctcctggcttgatcgaggtgtcccaagagcttacagtattgcatgtgtgtgacctaactatggcgtgttgtaggtgtctgttaccggagaggttaagttaattatagtggaataggcattcatgatatgagaaataatgcacaagatgagtgatggtgtttggcgttggattggtcgtttctctttcgctcaatttcaactctcttacaattcacacaaaaagattgagaatatatatagcttggtgaccattggaattttgtgctctcggattgtgcaaacacgttaattgattgagaaacatttatattttggacgtgactacacagctaccactccacctataagagactttatccacctatacttcaaataaaattttcttttaaactactcatccgatctacgatccgattacatcactgtgttcgtaacaattaaatctttataacaagatctcacatgattatattttgatgaaaaattataaattacttttataataaatctaaattacttttagatttcactaaattacttcttcgacatataaaagtaaattcaataaagcttaaaagtaatttacatatattatagaagtaacttataacaaaaagaaagtaactttaatgaatttacttctaatgttatgacaaagttacttccgttttgttttaagatacttttataatacatgtaaataccttttagactttattgaatttacttttatatgtttaagaagtaacttagtcaaatctaaaagtaacttatatatatgataaaagtaacttacgtatataataaaagtaatttacaaatataaatattttttcatcgtaatataatcatgcatgtaagatcttattgtgaagatttaattgtaacgaacacaatggtgcaatcggattgtagatcggataaataatttgagagaaaactttataagaaggaagaaaaagacatgcatgtctaagaggaaaaacaagcatgcacgtcagaacttgtagcagtacttcttctcacaattcgttcgtcgctggttaacactaaaccgagaagccttttgccttatattttgtctgcttgactgaacaggctgctgtccagtctccatccaccctgtctttctttcctttttaaaaaaaatgaaaaaaaactcaatcaaaggtaactattttctcacttattatgatcagaatccttgcaaaattcagttatttctcctttgggccattctcccggcccatttcttcgtcatttatttttcaataaatctattttgcttccctcaactcttgctcttgattgaatcgcctcccttaacagctataccaggtataacatcttcatcttcaaaaaccggagcaaatcaagtccctcgtctgttttaatcacggttttgtcctcctacgtaaagctcatggaaccacgtgtcagtgaaaaaaaaatagaaaaatacgcatgtcaggcctttctttttcctcacccctttctcacatctctcttccccattctctcgccaagcggcggtagcggccggagagctcctccctgtgcgccctgcggccggtgactcctcccgttctgtctcgccgccgccgccgcatcgatcgatatgtagccagccggtctgttcctccacgttggcgacggcgcttgttgctttccgccgacgtacggtgttggcatcgttagataatcctgaagctttgttcagcaaattcagttactctgtatcctgtagcgtgtctagctattttcgttcttcagctgttctgttttttcagttagcttattagctggttttttaggatctgagccggcacttccctgcgtggttgcgtgttcgtgcgcgccgtggagtcgtgtgtagcgagagggacgtgttggatggcacacgttgcaaaccgatcatggcgcgctcgttgaggttcatggcgagaagcgcggccgcgtctgttcttatatatttctcagtcgcaaattcagaaaagctgcagcgagttaacgcccgcagcaccagatcctctgctcccactgtgttttcgcgttgagtatttgcaaattccactgtgatcctgtgagctagataacataacggtacgtcgttgctgctcacattgatcgatgtagccggcatacggtacggtacgtctttgctgctatatatccatgttgaagtaggagtatatatctagagaatggagtagagagatctcactgggaaaagaggtcttctatattaattcgtccccgatcgagaggacctgaccgtgtcgccgtcgttgatgacgcctgtaggagaggagagctctcctcacagtttccctcgtggcagccgatcgacagagcagagcacgctcagctaagctatccaaacagccgagggactttgatttgatctggttttcgaagatggaggaggcattatacctaatcaggggcaagagttga

SEQ ID NO: 80973 - DNA, 45441 bp, Oryza sativa
ctacaagtttaaaaaaataataaatttaactgcaaataaacgtatagtaatttgagctttgtttgttatttttattacaatttatataagttgattttttaacttgcatggttgtggagtgatatattacatattgatttatcttgtcaattttacacggttttaatagttgaaggggtcgatatatccggttttgtgattgagatatacgaataagatctgaccaccactacccaactctatccttatccacaaccgaccgacacatcccgttctctcaacggcgcctcctcttccaccaccgtaccgctcttcctgttccgctattgcgccgacgccgcccctcttccgccgcagtggcgctgctccccctgctgcccatcaccggtacacttctcttccacctccggtcttttcccctcgttttatctgctagcggtgatggtggaagggcccagcatcacctctccccccttcctttactgcgagtggcgacggcggatccccacaacgacatcgaatctggccgctggcctctcccttcccaccctctttttgtggtcgaggggctcacgagcttgccagatccatcaacctcgttggggaatggcgatgcgaccacaacagtggcgagcggtagatttggctgtgagttcgctggatccgacgattggcgaccacaacggccgcggtgagagcgcgatgatgaccacggcaagccctcctcgacctctcctttttccccaagcacatcaagaggctccggttctccccaatgcgtggccctaaacagtggtttcacacctcaagagccgaagcgtgccgaggcaaccatgacctctacaagcacgacaagggcttatggaacaacggttctaatggggaggattgaaaccactattcacagtggtgtattgtatatggccttataactaaaaaaaactagaggatgccttgcgcgttgctgcggaatttggttaacatcaatttgttagataagagatatgatctcaagaagaaacagaataaacagatagctttcttagagaaattttttttagcagacctatcaataatttgtagataatttaggtagcacatgtcaactgaaggagcgttcaaccataaagatcttttatacggttagacgggttggatacatgtagatgtgtgtagagatgggccaatgtgttcatgtgggctacatttagcactgaagaggcgaaaagactcacccgatgactgatgggttgggctctatcctgtattgcatcaaacgtcttagaagcaatctaatacattcatccaacggttcagaatttgatgatgacgtggaagcacaagatttgagcttttggccttaattttatataaaaaaaaaggattacgatcatttgtgctgtgtcctctctattctctccctctctcactcttggactattggtcctcccagcgtcggcgaagcgaggcggcgagcgaaacaatactcccaccaaagccccacaattgttttgccctttttttattcttttcagagcgaagaaaaagaaaagaaaattataaatgagagaaacacacagcccgcttggacttggagacgagacgacggaaggcatccgtgtggtggtgtgtgccttgtgcttgtggggtcaaaaaagtcaaagcgctgatgctaaccgctcgcctatctaggcaaacaccagtcaaaaagctgacccacccacgccaccaccacgctgctccgctccgactcctcccacctccacccccaccacccgtcatcaaacgagtaggagtatcaattatcaaacattcaaacccatcaccgcatccccaactcgccaccaaccaccaccaccgccgcacgaacccccgagcgcccgaatcccacaccgcaccacgcgccgcgccgctgcggccccgtccccgcgtcccctgttccgccccccggctccggatccgcttcaccttcacgtggcgcaggcgtccccggtttaccccaccgccgtcgcccgggtcccgccgcacgcaggcgcccgcgtgtgtgcgtgtcctgcggcccctctccctctcgtcgtcgtcggtgaaaaaggaaaagaaaaacagagaggaggaggcgtttttaaccgcggtgctcagcggggtggtgaaaaaatctccgacccgggtccaaatccaggtgacggccgttgaccgcgaccgtgggggcagtgaagtggtggccgggagcgagcgggaggaggaaggagacatcgaggggaggagtgacccggaagcaagcggagggcgagcagccaagccagcagcggatgggggagtgggggcggtggtagccatctcgcgcacgcctttccccgtacaagctgctcctctctttccttatctctccccccctgattactacccagcagctgcagcccccgccctcctcggcggatcggaggggcagttgatttccgggcggcggcggcggcgccatgaagcggcagaggtcgtacggagatgacatggacgacgaccggaggaggttctacgaccgaggacccccgccgccgccgccggcttcgcggcggcggccgggggactacgacggcgatgggttcgaccgccggaaggggttcggcggcggcggcggcggtggcggtggtttctacgaccaccggtacagggagtccccatctccgcgagggtacggcggggaccgggcgatgcaccggtccgagagcttctcaggcttccggcgggagttccccaaggggttccgctcggagcgcgaccggtctcggcgggacggtggcggcagctcggcgtggaggcggcagagcggcgggtggagggattcggaaggtttggacgggtacagggcggcgcccaggcggtccggggcgtcgccgccgacgccgccactgcggttgcccagtgagtctagcaggaggtttgatggtgcgagggtggagaagtccaggaagcagagctttggcatcagcgagatggaggaaggggaggttgcgccagatcccgagaccaaggcccgcgctgctgcggtggatcaccggaagcagatcgagttttctgggcatgccaaggagaaaggaccggagcgcggtgaggtgaaaaaagtggaatccggtgtgagaggggatttaggagctcatggtaaaggagtggctggttcatctgctgctcgcaatgcagggagggaagaagggaagatcaaggatagtatgattgcagaagcaggaacggtaactcatacaaggcatgaaaaatccacctcagatgccgcagtatcaacggggagaggacatgaggtgcaagggcaagatgaggctgccaatgctctcaatcaagttggacagtgcgtttcatccagtggaagtcacaaggtgccacaggaggaaacgatgatacgggatgaggctgccaacgttgttgatgcgattgggcagagcacttcgtctgatatccagcaggaagctgtttgtgagaaggcggctgtacgagatgaaactgctaatgctgctgaggaagctgggcagagaacttcatctagtgtacatgaggaggctattcatgaacaggcaactatacggaatgaaactgctagtgatgttgatgaagctgggcagagcacttcatctaacatccggaaggatgctattcagcaaaaggcgactatacgagatgaaactaccaatgctgttgatgaagctgggaatggcacttcatctagcaaccaggaggcggctattcaggaaaaggtgcctgtacaagatgaaacaaccaacgctgttgatgaatctgggctgggcacttcatccagcatacatcaaggacttcaggaggaagcgatggcattagatgaagctgttgatgctgctgatgtggttaggaaggtcagtttgtgcggtatgcatcaagaagctcttctggggaaaacgagagatcaaactgccaatgatgttgacagggttgaatgtagtacttcatctggtcttctgcaggtgacaccacaggaaggaatggcatcaatagatggaactgccaatgctgttgagccagagaagattgattctgatatgttgaaggaaacgattgaaggagagctggtgctagatggaactgctgatgtggtgggagagggaaattcacctagcactgtaaaggaagcaatgcatggaaaaataactgcagaagacggttgtcccagtagtgctcttgaaatagctaaaaagtgcaagcagtcggctattacagaggaactggtacatgaaaaggtggcgacctctccaagccaaggggccccagaaatgaaaaaaaatgaaaaaggtactatatccagcaagaagatgagtgaatcatttgaacctgatgcgtctcaacatgtggaagaggcactcccgagggatggccgtgaaaatatagttgcattaagtgatactgaagtcccagaacaagaggcagctgctgagaacaaaactatcgagaaggaagtaaaaggtttttgtttggaagcaaactcagtaggtgctaatgtgttccttcaaccaagcaaggaatgtaatggggataggaaggaagagggtacagctttaaatttaattatggggaaacctagtgctgaagataaaggaaagggtatagcatttgatgtccttagtaaagaagaagacataggggtaggaagttcagtaggaagatcatttgacttagcactgcaacctgacattgaccgaacagaggtgctaaaatctagtgggactgtttctgtaaagcaggaagatgacacacctaagatagggaggcttgacctttcacttagcttatcaggttgtttacagaatcctgaattcaaatgctcagttcccagatctgaatctctagaccttgcaacatgctcccaaatgttgccatcatcatcgttccgcacaaattcagaagggttcacaggttctgtatcattgaccaattctcaaacatttgttcacaatcctagttgctcacttacccaacagtcattagacaactatgagcattcagtcggcagtaaacctttatttaagggtgttgataagttgagcgacagcacaagatggcaagctcagttgtcgaatgaatctactaagaagagggaacctaccgcagttcttcagaatacagtaaaatatggtaatctgccagacaagacctttcttggtgtgaatgtgcagaacaatgggatttccaaggacattcacaggcgcgcagggatctcaggtgttttgtcgccaactcatagtcgggattctcatgattcaggatttgaacaaagtagacatagaaggcagctcacaagagagagaagcagcagcagtcttacaaggggtgagcggcaggatgggcaacaacttgtccttaatggtgctggtgtcatcgaaaggattatttccaagatagtatcagaacctttgcatcatacaggaaggatgcttgacgagatgacaagcaattctgtaacatacttgagggaggccatttctgatatcatagctgatgcggataaaagagggcaggtggtagcattgcaggaggcacttaaaaaaaggtctgacttgaatagtgaaatgctgcaaaggtgtccacgcgtattgctggagatactcgttgctataagaactggtcttccagattttatgaagaaaagtaatagcattggtacatgtgatttggttgacatttttctgtatttgaaatgccgcaatctctcatgcaagagcattctaccagtagatgattgtgattgtaaagtttgccaacggaagactggtttctgtagttcttgcatgtgcattgtctgctcaaattttgacatggcatctaatacatgtagttgggttggttgtgacgtatgtcttcactggtgccatactgattgtggcctgcgccactctcttattcggaaggggggaagtggctcgagggcatatagtactaatgagctgcagtttcattgcgctgcttgtgggcatccatcagagatgtttggttttgtgaaggaagtcttccgaacatgtgctatgcaatggaggatggagactctggttagggagcttcagtacgtagaaagaattttttcttcaagtgatgatgcaaggggaaagagagtcagggactttgtaaaacagatgataattaaactggaaaacagggcctatcatcctgaagtagtgaaatatatcatggcgttcttttctggtaagctactaatcatagttcataataaaaaaaataatagttatcattttcatgcttgataaagatgtttgttttttgttttgttgtcctgtaagatattttatatttctggaaatagaaataagatttctatattttacacaatgctatagcagaagtatcagctatattggcaaaaagattatgtgatccatgttctgatatcatgttgttatattagagatgctaatggtcttttggcaataaaaccaggctaatgctcgattttccctgttctagatgacaattctaacgctggtagtggtacatcagtaccactgaagggcattccatgcaacattgctgaaagaatagatgggattcctagttcaagtcgaaaggcaccatcatggctaccatcggtgaccctggagggagttccatttttagaaaaacaaggagtaatttcaaccaccgggagcccattaacgcttagaaaatttggcggaactgacttccagacagttgataataagcctactgttgatgaactggatgccctaatcaggttaaagcaggctgaagcaaatatgtaccagcaacgtgccaatgatgcacgcaaagaagctgagactctgaaacacgtcaccatggttaaacatgcacaaatagaggaacattatgctactcaaataggtgaactccacataaatgagttacaagagcaacgcaaaagaaagattgaagaactgcaagtcattgaaaggacacaccatcgatttctcagcatgaaaacaaggatggaaggtagtattagggaattattgttgaagatggaagcaacaaaacaaaattttagcacatgagccaagataacagctctgggttgaagataccaggatttactcaacttgcctaatgaaggttccatgtgatgtaagttctaagacttactgcacgattatcaattttctagtattttgatatagtttatgtttctgttgttttatttaacaatctgttattgagttttgatgatgtgcaataaactttagctgttacagtatatacttcacttttatttactgatctgctgttataagtctgtgtggagttaactgtttttgtggctttagacttaacagtcaagactgaagacaatgacctatgacttattgtgcgccaatttggcactggctttgttcttttgcatacttatctttaggtgcaccgcatcacatcccttaattgaaaataaggggaaatagtgacgttttggagtttatcttgtttacaggagggcagttcttatcatcgtggcgtgccttactacatatctggacagttcttatggaagggtgctagactgcaaatctgcaactttaagcatcacaatgaagatgagcatgaatgttctcttatgagaacaggcgagtggatcataatcgttgcaaaacctgtttggtcaaatacaattctgaatccagtatggattgttgttgcaagggagaacacaaactgaagcacagtaatcaggcctgcaaggtcctcgaagcagaatttcagaacgtagctagacagcatctaaattatgaattgatgttggcaatagtataggtaggcatgaattatttctcgtatgtaaattatgataaggtttatggttctgatcttcagtgagaagatgcattaccagtttcctttttttttttatctaaattatgcagcgtttgtacgtcggccacgtacgtgcatgggaatgcgccggcatggaatgagtgtgaaatgcaatccggaaatgtgtcgccagccgctcctgctgggatcacattgctgatatacagtattgaactgtaccctcaccgtcaccgactatatgcataaaaccgtcgaatttcagagctccagaattaaaatttggcaaaaaaaggtgcagatatatggcattctgttctgcaagttacactgaggcgccaactcgtgtcaggcttgctcggagaaacataaaaggatacaactcatacaacaaactacaaactcaagaagcactccgaattgaaatactcgccattgcttgcagtacgtacagagccgaaattgctacactacccttaagtttgcatgccgtcgctagctgcttatcgatcaatctcacatggccacgcatgagctgatacatagcatcggtgtagtttctcaaccgtgatttgatcagtgagacagtgacatatatatagaacagttcagcgactaaattaaacggtggcgccgttgctcttcccgccattggggacgacgtggtgtttgtcggcgtcgtccatgaagcgcttccagaaccagtgctgcttccacaccctctcggtcatctcctcgatggggatgttcttggtctcgggcaggaagaagagcacgaagagcgacatgacgacgacccacgcggagaagaaggcgaagatggcgtacttgaggtggcagagcatggagaggaacgcctgcgcgatgacgaaggtgaagagcaggttgacgcacacggtgacgctctgccccgccgaccgcgtctccagcgggaacgtctcgctggggatgagccacccgagcgggccccacgaccacgcgaaggaggacacgaacgtgcacaccatcaccaccaccatgatcgcccacccgtggccgaggttgtccgaccggtccgtcaccttgatccccagcacgacggcgatggccacctgcgacaggaacatctgcacgccggcctccagcagcagcatccgcctccccaccctgtccaccgagtagacggacaccagcgtggacagcacgttcacggcccccgtgatcaccgcggagtagagcgacgcgtcggtcttgaacccgagcgtgttgaacagcacgggcgcgtagaacatgatggcgttgatgcccgtgaactgctggaatatctgcagcagcacggcgatcaccagctgcggccggttccggcgctggagcaggttgcggaacgggtgcttcacctcctgcgccacgcggctcgcctccacgatctcgttgaactccggctccacgttgtccgtcccccggatcttcctcagcaccgccttcccttcctccagcctcccgcgctcgatcaggctgttgggcgtgtccaccacgaacagcgcgcccagcgtcagcagcgccgccgggatgccggccagcgacagcgacagccgccatccccacgggtggatcctgcatgcgtacgtaaaatgatgcagctcatgtcagttcatcatcatacgtacaatgcattgcatttgtatctgaatgtgtgtgtatgatgatgtgtgacgtacttggcggtgccgtagttgacgaggttggcgaagaggatgccgatggtgacgttgagctggaagaggatgttgagcccgccgcggatcctcgtcggcgcgatctccgacaggaacaatggaacggcctgcacgtattcacctctgttattaaattcagatgggcttgacgaggcccattaggcccaaagtgacacttgattcgcctttgtttagcgtgcagatacctagctcatcattcaatagtaataataaacttacaaaggcaccaactctgccaataaattccccgtgcgtatttctgagtataataacaacccaagctaggttaggcgttgaacctaatacctaatcacatggcaatacggcatgacccttgaattatgtagatagttttgttattcagagaagatagtttttgttatcttaaccataatcaagggggctgatcggtagaggtggaattaacaaaccgtagtagttgtacatatggtagtattagactactactacgagtacgatagtgtctgctgactgctgctaccactctaatgtttgttgaacctaggcctccatcaaagtcttgttaggtggtgactgaataactgatcacatgaactctgtcctgtactaaacctcttgcatatttagtttattgtcttggcagcttcataattgagtctagacgtcccatatgttggcgagtgtgcgtaatatgtaaactactgtttcatctattagacacgaataaattcagaagaagccaagcaaattaagtactactcctactctcctaccaatcaagcacactagcagccaactagtactttgcagcccaaaactcagtgaaccaaaccaaaggtctacatattgcgacccgtgtggcatatgcgtggacagccatagcagcctctgcttaaaaatcaaaccagagcaagccaaagctgcaacagcatgtgtgtattccaagctgcatccattgaggacttgacagttgtggctgtaactagctagaagttgctgtaaagatcagtcaacaaagctgaccaatctccaacaaacgtgacaaacacaagtctgttgctacactacacaggtcgattcctccgttgataacaactgcgacggccagatagcaggcagccacacgcaaaactaccggctgtaaaatcatgcacacctatcgcctcttggttggctgcaacttcttcagacgtctcgactacaaacttggacaacaaaaaatgggtaatttagccaggttcagtaaggattaattaagaagcgtggctaatcctaaactaggagagtcacgaggacatcggaatcttggaacttaaaaagtttatcacacgcatgctgctgccaatggaagatgtcaacgtagacgaacacaagtcatgcacgatcaagactctctcggcaccggccgaggtgtccataaatccatgtatatatatgcccatacttctacgcgtttgaccccaaaattacggcaattacgaagggccccgtgtttaagtacagtactaactaccccagtatccgacgccataagaaatacgtataaaaatataatttttagtaatgtatatgctcgactcgagtataaaaattctaatcaggacggtggttcatataggagtattaggcaggcaggaacgcacgtcgttttcatggaagcagaaaattcggcttgcttgtgatgcaaattctcaaaccagccaccgctttatatgtttgacttaaactctgtgctaagacttttggactcaagtgagtagtatcagtttatattagtactagtcaataatatatggaatcaaagaagatgatgttgcgaagaaagtacaggacgaaaaaaggaacatggaaatatccgtgcaaattatgagtgaaaacaatagtataaggcgtaatgactttgtttaactccatagcttattatatgaaatgatataatgctgtaagcctgtaacgataagattattggaaagttgcttgcctggttggcaaagccgacgccacagccgagcaggatcctgccgactatgagcatggcgaggttctgggcggcgccgttgaagatgacgccgacgatgaagaagacgccggcgatgagcatggtgaggcggcggccgagccggcgagtggtgtaggaggcgaagaaggtggccgtgaggccggcgaggtacagcgacgaggtgaacagctgcaggccctggttgtcatacttgcagtagttgctctccttgtcctcgtgcttcttcttcagcaccgtcgggaagaactcgcgcaggaagtcatccatcgatgtcactccgcctaaccaagaaaaagaaattcacaagattttcaacggatattatttagtttcataagtcgtaaagttcgtcatctattgtggcaaaaatggcatgtataagtatgaacttggaatgttttaaaatgttgtgttagtgcgccatggaaaaggttgaatcagagagtggataagattttttttccgttttaattggaatttattgtcttagatgtaaaaagggaacatggccacacaaaattaggaaagaaagctgagagagttgcaagaaacgtgatccgtggataaacaaatgcattgacttaccagcctgtcaaagcaggtggctagctcataacactcgattccttctctaaaataacatctaaaaattttaatgctttgggatcctcaagaaaatcatactactagctggactgtaggagcactacaagccggaaactaatgaaaaaggataaaattgcaccaaatggactcaataaaatggcaagatcttttttgatcctctgtaaatggtaggtatttaatgacaaggataaaatcatccgtttcgctttaatctttgcgcttatatgtgcttatccatagcaagataacacaaatatgtagacagatcaaaccgataacacacacgtgcaagaggaatctcactcaatttcaagcaggagacaccaatatgaataatcgagatgaaccaactaatcaacagaaggacatcaaagccggccatggccatgttcggacatcgccggcggccggccgtgcgtagatatatacctgagataccgacgtcgtagccgaacatgaggccgccggtggccgccatgatgcaggagatgatgacgatcggcgtgatcttcgcctcgaactccaccccggaccccgacacagagaaccctcccgccatcttgccccctctctctctctctcgtcgtctctctcctctccggcgatctccactagctagctaccaagagcaagcaggagatggagacgatgaactcacagggctccaagccgctcgctatatatagagagggagtgggagcccgatcacacggggggagacatttcaaacgcatcggagaggcaggatgcggccacgtggcataggtgggacccaccgccgggtcgcctcccgggctggctagccggccggtcagcgacggctttcccggcggcccacgggccggaggctggccgtgccgcaagtctgcgactgttgcataagcagcacaagactttcaaatcccactttaattttttttgcttatccaaattaaaacctttttttaaagctttttgagctccttttggaaaagagggagagagcaagtaggagcagcagtttggaaatttggatatatagttggatatattgaagtttgaacgccggcctttttgacgctggatgtacggtactacagtattgattcctggcgttaggcgggcccgcatgtcagtgccttgacgctggttgctgtcttggtactgtacggtgatgctcacttgaatctttggcgagctgatcatgtgaatggaggaccttgacttgaatatttgctaaggaaaattaagcaacatgtgcgatggacatggtggagtagtagtgtagtactattacttgggaaattgtggttctgtggaaaatgcgagctaaagaaaatgacttctagttcggctagtcggcttacctagcttgtaatattttccttctagtaaacgtggtatcatagggcacaccccaaaattttacaccatatcacatgaaacgtttaaacacttgcataaagtactaaatatagaaaaaaaataactaattgcatagatttcgactactttgcgagacagatcttttaaacctaattgtttcatggtttgacaatatggtgctacagtaaacatgtgctaatgactgatcaattagtcttagtaaattcgtctcgcagtttactaacggatactgtaattagtttttttattagtgatcgaacaccccatataacaccctatataatacccgatacgacacgctaaaactttacacttctgcatctaaacattcccatagtactatattagtagtagctagtgtagatgacggcgtttaatcagaacacaagcagtggtgattagccgccgctattcttgcccaagagctgctagtttagtcatctttgtattgttattggatttgatctactcgtgattctcattaagatatgattgtataagatatacgtacgtagtaccggacacagttgctagtaataattaataggtatccgttaatcagccatgtgtagttcatgagaaagaacaaaaaaaaaaaaccgtgaacacgaattaacaaacgtgtggtctaacggccagtcactctccaaataacctccgtacctatgtctacacaaatttaattttgcttcgttcttctctgcatatcaacgaattgaacatcgaaaaatattcgcacgctctcactcttgttgagttcatacaaccgtatcatagtcaagtggtcatgtcagatcgatcaactaatatttggcaccgttttgcaacttacaatctgcacgtacgtactctccgtgcctatgggaattttcacgtaagccgatcgaactgggtgaactccttgtcgtcggaatcgtgctgtgatacgatgtttgacgcttaccggatggaactactccacttgatcgaccatgaactgattgtgtacacaccgacaaatgtactcaagcctcacgaattaacatggtgaaaatttccatggaatttctttcgctgacgcttgacgcgtgcacgattgatcacagctcgatccttgggcgctgcatacacgagttgccaccgtaaggtacgtgacgatttcgcgagaaatccttcgcgtggagcagtactattccccggacttggaacactcgaataccagccactcgaataccagccgtatgcagtccaagtccgcgcgcgcacgtaatcggtgtcggtttcatgcacgtagatcacggtgacaccgccgttttttatcccgtggtaaattttcccaacgatctctgcatttgagattgttcgtgtgttacaatttctaaaataaacacccgtcgcgatcggggcttgagcggcagatggcagggaggcaggcgcgatacgtgcacgtgtccaggttgggcatgactccgatcccccgtgcgtggcaagtggtgacgtacacgcgctttgccccttgacacgtccgttaatttcatcctgcttagttgacttctaatactgctttggacttttggtaatttcggagttgtaactactagtaccatccaccgcacagctgtacgcgcaggaactggccgactggtttttgtgtgtgtgtatgtgtgtttggatttcaccgtacttgcagtcaactgttgctggcatgcaatatatttttttaagttgttgttttgttgctacagtgccattgcaagtttgcattctgcttataagaatgacgtgaaggagccataggacgtgtcgagtagtgtccgtctcattgtttcacttatacttatgttatttatgttcgtacggtttactaataaaagattatggataaaaattttcacatatgtgcccttattgatttgattgaaaagcaaatgcaataaaataaattacaaatggaaacactatcaaatcaaatatctctattattataaaaattgaagatgttttttgccggtactttggtacgtcatccgtgtatgggtcgatttttaaattttttcgcttttagaaatacagatcacatttgaatcgtgttttaaaattgtttgatattagaaatatataaggagtcgcataaaaatctcttttaaaaaactcgcttttctagaaaaatatatatatctaagtgaattcccacaatgaattttatcttaactaaaccgtataacaataataagattaaaaataaccttcacccgtttacaacgcacaaattttttttagtaaaattaaaaattaaaaattaaaactttgattataagtataagtgaaaatgacgaggctgtgtattagggttgcatgcactggagcaacacgaaaccgggggagttgaccccggagacgaggcaggcgtaagcaatggaactctctgattgtttggctgctacggcgtctagtaatgcctattggtcaaaaatatatgcggccaacctgaagcagataattgttgattcacacggcaacatgttggtgcagagggcaagcaggaaaaggggtcattagattctcgaaattagttgtggtgatcgatgcttgcacccagcatacatcgatgcattagcccatgatctatacgtgcacgttttagcccgttctgtgatgccaattcgccctccggatgtcgcagccgttacatatcaccaacccaccagagcttccttctcgcatgaccggtagaaagacctggacgaatttgtgcaggtgcatgacacatcacaccgcctgtcgtcctaaggacgatgtgagttgtgacagagagagacagtacgccggcccgccactggccattactgagagcatgcttagggagcttttaactactactttctctcagaatcagaaactcatttaaacagttcagcttttgattcagattctgaggagttatagttgtaaaatttagaaaataaactagaagctggacaatcgagtttttctatattgtcaaaaactgactatcaatcagttgtttctcagttttttaagcttctcaaaacaagcaatgaggctaaacaagcatgttgattggtgaaccgagaacgatgggccgtgtatacaggaccacgatttgcactgggttagtcaggtagaaagactctcctgggtctggtggttagcagtacaggtggtggacctatcaaggaatttctggttagatttgcatgaatatcctttatatttggaacaaaggtagtaataaaggggtgttaaattacatgtcacatcaggtattatatacggtgtcgtatgtggtgttcgagtactaataaaaaaactaattacagaatctgtcagtaaatcgcgagatgaatttattaagactaattaatctgtcattaataaatgtttactgtagcaacatattgtcaaattatgtggcaattaggcttaaaaaatttgtctcgcaaattagttgcaatctgtgcaattagttatttttagcatatatttaatacttcatgtagatgttcaaacgttcgatgtaacatgatgaaaaattttggagtgggatctaaataaaccctaacgctgagttcttatctctatttatccaactcacctccctcgtttttcgcgtgcacacttttcaaatggctaaacagtgtgttttttgcaaaaactttatatacgaaagttattttttaaaaaatcatattaatccattttttaaatttattttagctaatacttaattaatcatgcgctacacgttgctctgttttacgtgttagggagggagggtttgttttttgcaaaaactttatatatgaaagttactttaaaaatcatattaatccatttttaaaatttattttagctaatactcccccatctacttttgatagtcatattttatcttggcataagtaattttacttatcatctatttaaacatgctattagtcattccttgtaaataagcgattcattaatatgtaaatttctcgatacccatgtagtcaatcttgtgaagaagaatggagagtcacacattaaatccgagaaagctattaagatgatatgttgttggattgaaatatacctatcaaaaataatttttttagatttgaaaatattcctatcaaaagtagatggagggagtacttaattaatcatgcgctacatgttgctccgttttgcatgctagggaagtgagggttcccaaacacacccttaaagtatctttagagttctttttcctttctactctttgcattttctctcctagagtctcttacgagggataacttatcctctctctcctaattacttcttttctccatctcatcatctaagtttatatactactcccttcgtcccataatataagggattttaaatttttgcttgcactgtttgaccactcgtcttattcaaaaaaaatttggaatttttttgacttactttattatccaaagtactttaagcacaatttttcattttttatatttgcacaaattttttttaataagacgagtgattaaacagtgcaagcaaaagctaaaaatcccttatattatgggacggagggagtaccattttaggatttgtgcttagaagcttatgttatattagtacttttgtaacaaatatgatgaacacttacgtttgtcactcgccgttgctactacatctgaatgtaacaaatatgatgaacagagaactcagggaaggatataaaggaaagcgatcaacactgggtttaagccaggtagaaccttttggagctagggccggttcaatttaatgccattttcaaccttaccaagttttgataaagttgctaaaaaaatagctatatttagtttgctgccaaaatttgataactatataagaaatcttgccaaaattttgacaagttaccaaaattttagcaactatgccaaaattttggcaatgctaaaatttgataaaattttttttagcattaaagtaaacaggcccttatatttcacaagcaacggattagacacctttagttttctactctagtgttatacaaagtggaatactcgagttccgaacagccggtaacattgatttattctatacacgcgacacacattttttgtacagagatgacattggcactctttatgtttacatgtaaaaagtccggcaaacaagctactgaaccaagtaaccatcatgacacggtcgaaccacatatgcacgaactacggcaccggatgatacgagtcatacaactacattttttttagataatggagtcatacaactacatgcgacgatatgcaatttctcaaggatgcagcttcttcgggatagtagccaggtcaagcgtactgccatacatcttggcgagagcctgtccgcaccagccatggccatcgtctagcgttggcatcctcacctcaatgaacggtggaacagcctggccctgaggcttgacgacgccggcgaataccctgaggacattgccagcgtcgatgtccatgcagacattgatttcgacggtgccctttgctgctgctggaataccggtgatcttgaagtatcccaatagatggttgtcttcagcctgattcccttcgccttcatagacggcaatgagagcttcggtctgattgtcgtgggttgtggtaaagagcatgtcccttctcgcaggaacagcagtgttccttggaatgattgcggcgaagttaccgccgtcagcacgaattccaaggttcattggagttgcctgaattgtcaacagatccaggctccctgaagggtcagatactcctgaggcaatggctccttccaaagcagcccctgaaactgcagcttcaagtgggtctataccactgtaagagtcgtccttcttgcataagccaaggacaacgcttctgattttaggaattctggaacatcctccaaccaatatcacatcattgatgtcctctggtgttaactttgcatcagccaggcattgcttgatgatcccttcacatttctcaaaaatagactgattcaccttttcaaattctccacggtccaagatctttgacactttgtggccagcccccaaatctacattgatctccacatgctcctgcgtagccagtttgtgaattgcatcctgagttgccatccggagtaagccaattgacttgattctgtccattgtttgaccagcatatagactatcaaaatcaggcatgagatggcgcatgacattctgaaggatatcctctccaccaacagtgcttcctgaaagtgctcttatctgagaaacacctccagcagtggcagccacagcagcatcacagtagccagcacccatgttaaatatcagagcaattttctcaatgccacttcccatattgtcatgtagcaattgctgctgctgttgggcatacaaaagtgcgatagcggtcggctctggcatgagccgtaacacatgcagcccagccatcgcacatgctctctcaatcctggtctgttgaaaccgactgaatgcaactggaatggtaagaacagcattcctcaccggatgtttgagatgcatctctaccaaggccttcaattcaaggagaaagatggcaagaacttcttcaggagtggtagaccgccacatattgttcaccagtgctgcaatgaatggtctcaccccaatacccaatgtctgcacaagaaaaggaaggctcttgctagcttgaaccacttcatctgtgtccattctcccaatcaaacgtttcatgttaaatatggcacttcctgacaaaatatctctttcctcatgtccatgttcccgggttgctcctcctgtaactcctgctgaaaggctgtcatctttgaacatcacatatgacctcatccctttctggttgcgagtgtttttgaggagttcaacctgatggccagtccaaacggcaacactacaatttgaggtcccaatgtcgattccaatagcaacatcaggaaacgacatctgcgacttatcttccccagtggtttcactgtcagatgccacagtgtataattgttcagtcatcctgcaaacaatgcagcgtcagtattgtgtacctaacattcttcttgttctaaaaagggaaaaagatctggttaatccaaactatgcccgccatttgaattagtagttttaaggccaagggtttatgatagtactattttattgcatttgcaaaatgtaacataaaagtgtaagccaatacataaggcaaaaaaacaagcaagaaaacagaattccaatgacactcgatgaaacggtgtgaaatcctagcaaaccaaacatgtccatgactcagaaatgacctattcgagccatttaaaggagctacccatgaaactatttcaaaataagcaatccattcaagtgatattttctgaatcctaacagtatttccttttcttttttcaggagtcctgacagtacttgtacatttcacatacagataaaaagaaattccttttttttttctggctctgtcctcatccatgcatatcggactcacttgatgcacccgcgaaggcagcttgaattatagataaccaattcgcgtatttgaaacaagtaacttgtcttgcagtacagttgtatatagtggtctcaactcatgtaactagatgacactatcctggatcgaccaaggaataagattgctaaaaaccaatgaaccaagtaatgagttgagttctctgcgacaagacaaacttaggacttagtaggtcacgtacttcgattccactgattatgccaatttcatgccttgccggggttcaggaatttctccaacctctagcactgacaacaacacatccaacatcaacgggataggattaaatgtcgggattttccagtagtaacacctagctactagctagcagacaatcgcatcgcatcgcattaggcttccatcaagagaaagtattcagcgaccacaacaggttcacagatccgggcttacagttacagcactacgacggggaacaaaccgaagcaggtaaagaaaacaaggcaagcgcagggtgtgcggagatacctcgccactcgatcgtgcgacggagatggccacgaaatccgggactctccggggcggcggttgctgggagggagtgcgggcgaagacgaagcttggggaggcgaagggtggtgggagcgagcagctggactggagccttgaagaaggcggaggaagaaagaaagccgcgccggagttttccggagaggacgggaggcggcacgcggcgcgcacgccgacagtgcggagccgggctcccgaagcgtcgggaagcggcgagacgccgctggagaagaagcgtggcttccgtgggcctggaaatgcagcggagatctaggcccagtgcacacggcccggatactagaccaaatttcgtatagaaataggcccatatgttttgggaggtacttggggttgggccgaacccacgaacgctccgggctgtaaaagtccgactagttcagatagcgtgctgggctgtaaaagtactccatctgtcatcgtgctgtgcagatgcacgttcgaaagtgatgctcctgagctattcgatggcagggaaactaatctcgagcgattaacgcaatgatgattaattaaatattagtacatataatatgtaatatgctcggactttggcacatctgaaagcaaagaatggcttaatatttcagaacgttcaaccttcctttcaagcatggagatttttttttgtcaacgaagttcttctgtatatgtgtagaatgaaagatcctttaaagcaaactgtttttaattggttacaaaccttataatcttcctatgtgaccctcgtgtaactctgtaatcttgtaaatattttctttctttataaaattatactgctggacaaaaccctggcagtatttccggtcaaaaaaaaatatgctcggacttggatttaacgtcgttttctgtaatatggcatgttctgtagtttgtgttactccctttgtcctctaatataagggattttgacaatttttctcgcgctgttttatcattcgtcttatttaaaaaaattaaaattattatttattttttttacttactttattatccaaagtattttaagcacaactttttgttttttatatttgcataaattttttgaataggacgagtggtcaaacaatgcaatcaaaatatcaaaatcccttatattatgggacagagacagtagatactattatgtaatagtttagaaatttgttacgtatttgactaggtcttcctttgtaactaaccctacctcccaacctatataaggatataatcataactcgattgtatacatacctagcggattcaatcaccgaaacaggactagagtattacttattatcaagaatggttgaatctgtttagaccttgtcccttttactcatactccttagatctcgtactatacgcttttttttttatcgttgatctagaaaatcgacaacgggtttatttgagtctttttaataaaatcctaccgtcctacatagaactttacttcaaacacacaccttttataagtttaaaaaagtgtgctgatgataatcaagggattagctcatcctaacagaaaaaaaataacggggcctaacctaacgcttacactaacagcatctgggacacattaagctcgtgagaattcttaaggatgttttagtttagtgttgttttggtttgatgtcaaattttgctccactaaactattggtattttaaatagtgatttagaaaggtttggactgctgccaaaagttaccaatacatatataaattgtaaaaaacttatccgagttttagcactataatatattaagtactttgaatagtaatacggtaatatttggttagctgtcaaaatatgccaatcagccatataatatgctaaaatattggttttggtattgttaatattttgatacgatagtaaaccaaaacaatcctacatcatatagtacaacggacaccttgtcaaaataatctagcctaagttgttagcccacaaaatgatgaccacatcttaggcaaaattttactggcaaattttagtaaaattgtgagcaaatatatcgctagtgggtctaagagtgaaaaatccgtggcacattacaattgtgggaacaaacaagcgtttcataaaatgtgacaaagtttcataaactgtcataggctatcaaacaacccagttggacataattaggagggagatggagatgtgccccataataacattttttttgaacgactcgcacgagacggtgcgaagttctattgataaagcaggaaaaaattacaagattaaaaccctgtagggtcgtaatcaggaaaaagaaaaaatataccaccacccacacaccgacatcgccaacacacaagccaaggagaaggctagcaccggaccggccgccgctaagcgtgaccgaccgctactagaccaacaaagggtcccagacaagatcgcctcctaggggatgccaaaacgacgtcttcaagaagagaagcgagggaaaagccgccgccgtccgtccgtcgggactcaaaggagccaagactgggttttcgcccgacaaacacccttgaggggtgagacagcacgacaacgcccttaggagggggaatgaaccatcgttgtcggtccggccaaggccggactgagttttcacccgccgttcaccacctgcaaatccacgactgacgcaccgatgccctaccaccacagaagctctgctgacctgtgggacccctgcaccggcgtcccctgccggccagccttcgagcgccgaagatcgcgccacacccaccggcaactcctcctcacacctaggtcgcctcctccatcgccggccgcgcctctcgtgccaagccggccttctccaccggacgtgcctctcgcgccaatccagcctccctccatctgtcgcgcctcttggccaagccggcctccatctccgccgtccgcgcctctcgcgccgagctgacctccgctgccatcggctgcgcctctctgcgccaagccggtctccgaccctccaccaaacgatgccgcggcggccaaatgtagccgtctcccactccctcggctagccatctgaggccatcatgcctccggtgaccgcaattacggccaccaccaccacagccgctgctgttgaacgcctagccacctcgccgtcgccatcctcaccgcgcacctccacttgctgccaccagcgacccgcatctgccgacatcgccagcgcctccacagtcacagccgccgcaaatcggccgctgtcaccgctgccactgacgccagccactgccagcggccgcttcgctgtcgtcgtccgccacgtcgccgccaagtcctccataggcgtcgtcagccgacgccgtcgccgccaactgccgcgaccaccactgtcgctgccgtcaccagccgtcgcaagtcagccgccgtcgccgacgaccaccgccggccaccctccagatccagccaagaggcgcagatctgagggagaccgccgccgagcaccgcgccgccgctgcgtagggaccaccgcagccgccttcgcgcccgccgcaatcgccatccccgccgcctgcaagcaccaacgaccggcgtctgcgagcaccatcggccggcaccgcacgtgcctgccccataataacattagttatttatcttttcttgactcattaaccgtttgattgttggcagagaccgaaactttaaaccatttctatgaccccaagagggatgttggtaaccaaacaacctctaaacattttgccgatgtttgatgggcagcaatgtttttttccttcctttttttttcggtgatcgatagtagtagtagtacgtagttacctttcaccggcagagaatccccaatacgaacgacgatgactcgaacaagatctaatgataagctcccttagctcgcgactggtgctctgaacaatcatcattcgcagctcaagcttttccacaccaagaaaattcaaacacgcctgctcacagctcatacagaagacgacccggaccgaaaatcgtatcagctaatcaatcatactacccggatacccaaatgacaccacccactgcacccctcctttccctttcaacgccaagctgcgccaacaataattaccacgccgcgaaaaaaaaaatcaccggacgaccgaccgggataccagacaccgcacatacgcgcgcggtacgatctccactcagtacaacacatccagcaggaagtactccctccgtcatataagagattttaattttttgcttgtaacgtttgatcactcgttctattcaaaattttttaaattattatttattttatttgtgacttactttattatctatgttactttaaacacaacttttcgttttttatatttacaaaaataatttgaataaaatgagtggtcaaacgttacaatcaaaaagtcaaaattcaaattccttatactgtgggatggagggagtagcagtggtactgtaccactggtagcatcacccagaaaacacaaaagctagctagcatcattgtaccggctcgagcacggacacggccccatcttttccgcgcttatgccgcgctgtgccgacggccgcggctccctgcgacgcgccgtggcatccgtcgtcgtctatcggcctcgccatgcacgcgcgcgcgcggagcgccgggccagtatcagcgagagggaagaaacgccccctggccacgcgcgtgaaactcgcagagacgatgggtaaaaggaaaacgctgtatcagcgcgcagcaggagccaagttgccaatgccgtcgtctgcatggtagccgcagccgcggcagcgacgcgagacgtggaggatgccagcgagcgtccgcgcttgcgttcgttgcagcttgttcggaaccccctcttcctcgttttccacgcgtacgttttttaaattattaaacggtatattttttaaaaaaatatatatatacgaaagttatttaaaataatcatattgatcttttttttaaaaaaatagcaaacacttaattaatcacgtgctaatgaaatattccgttttctgtgccagagggtagcgttcccaacctcccacgcaaaaacttttcaccctgtcacatcgaatgtttggacaaatacatagagtattaaatattaaaaaaaactaattacacagattacgtgtaaattgcgagacgaatcttttaaacctaattggttcacgatttgacaatatagtgctacagtaaatatttgctaatgacggattaattagacttaataaattcgtctcgtggtttacagacgaaatttgtaatttgttttattattagtctacgtttaatactttaaatgtgtgtccgtatatctgatgtgatacgccaaaatttttcagcctagatgcataagattggtggcatgatgtctcgttcgttggacacacgcagcagcagccatcatgctgttgggtgcagcaagaatgcacaaatttgcacgagaaacagtgaacggataaagattttattgaatgcttacttcgaattcgaaagatatatatatacagaggaagaaattccacgcaaaaggttggaaaaaggggggggcgacaagattctcgcttgctgccgtggactttttacgggccatgcatggaggacgtaaggtggcaagtacgttttttataagaatcaaatttagaacagttatacgtttcaaaaatttgaaaccgagcccccaggatttatcgtggggggccggaatcgcgagtcacgactgctgcctagcttacgatcgaccaatggatggcccaggagtaaaaagggtgagagccgaggctgccagacgcacacatgtattccgttacttgcgttgtccctgcctgcagacattgtcacggccaaacaagtgtccattgcatggggccggccatgaaatggccaagatcgatcgatttggtaaattaaccgaagacacacaagcgcggcacatggcgcaatggtcaaagatgcccgaatccatgcgcgacatgcggcaagcagtgcgccgtgccccgggattcaatcattcaaacatggttgacaaaacgttttcgaactatagttgttaatgactactagcagtattatcatcagacattcgagtagtatatataagaacatgtccatgataataatagagtaatagtggtgcatggtctgaactggttttgctcactcagctatagtaatcagctgtagtgtagagcaaggttgtcaggatcgggatattagacagtatcgttttcctcaaagtaatatcgtatcgtagtatcgggatactataagatttctttttttaaaagtttaattaatatttatattaattatatatagccattatatattaaaaaatgtagtaatgatatatgtcatgcaaatagagacatttatcaagagaaaccacgttggtttgatatatttaactaatttttatataaatttgagcatatttatttacattattttcaaaccatgttattttaaataatattttgtagtatcgtagagatcgtagaatcgggataccacctaagatttcgtaggatcgtgtagtaatgaatagtaggatcgagatactatgaaaattaggatactaggtaggatcggtatcatttcggcttggtaggatcgtagtatcataagatactagaatacgaatcgagatactaacaatcttggtgtggagtgtacctgagctgctcaggtaagtgccccacgagtactggagtactttgtacgtaggagtagttcactacactactacagtgccgctgctgccagcttagaggaggtggattggtgtggaagcagtagtaggtgaagcaaaacgcagacatgtggacccacatccgacattccgcgtgatctccggatggtccacccgtaagcttctgtccccttgtggcaatgtagctaaccttttacctctctctttgacatagcacccattgatcaggcacctatttttctcactgactcgaggggaccactgtctccgaaggtcgtgggcacacctctgataagcagtagcaacagcaggtttatcgaaagaaacttcagcgggaacccttttcgatcgatcgctagcctttgagaaaacaccaaagaattggatgagatacagatactcctagtaacgagcagtaggtactcgatctcttctatactaaccattgtttgatcttacctaaaatgcattcgacaaagaaggaggatgatgcatcgactgtacatcgtatttcaaattaaacttgcgtcttgcttgaatggtggctgaataggcagtggatgctgctgttcgctacttggtcggtagcttttgactgcggtagttccagccttccaggcttacctaacctgaagtcacacctcacatgcatgcatgctcatctccgatttaccccttttctcccctggttaactagtggagctagctagcgcagagtgccattttggacagactgaaaatggctaattattcttccatcatctttagacaaagagaagtgcttcagttttatgcatgcatgcacgctcatttggaccggtacgtaagctggaaattgcggtcaatctacatgacgcccatgtgactagcagtacgaaaactggggaactattctaatccctcgagagatattctctcgtttgcttaaaaaccatctaaacggttatgaaaaattctggaaaaatttgacaacattcatacaacacatatatacaactctacaaaatcttaagtccaaactcaactcacacgtcgagatataaaaaagacaaattcagcgtatgaatagtagcgtatctaaatttgtcttttttgtttctcgatgtgtagatcgaatttgaacataaattttggtggactggtaggtatcattatactctacattgtcaatttttttcagaattttttacaactatttgcatcgaatttgaaagaaaaagttatacgaggggatatcccctcgagggattagaatccacactccgaaaactgatacaccgtactagctggtgatcgacattgttgaataatctcgagatgggaactaaccgtacaaatatcgatctgaacccatcttggtgcagggctgcagagtgcagagtaggattgactagtgccgtcagttttctcatccccatgacggtccgatgggaacaaagcagcactatgacatgcattcctcgtatctcccttaaataaacatcactattgcgtccatcactatgcttttaaggtccgcatcatttcgtttattcaggaaataagccaaacggtatatttctaaatgaaaaataatttataaataaaatttttatatacatgttcttataacgatataaaagtaaaggctgaaaaataaattttgaggaaaaaaactctaaaatcaatctaaatttaaagttaaaaatttaaattttataagtataagcgaaaatacggtgccgtaattatatatatcttgtttatttctaggacactcaacgaggtagtagaagaatggttgcctctgctgtgcaaaccggcagaaacagagcggaaatgtcaaaaggacttttatcctacctgaccttttgtagcgcaattgaattgaaacaaactcagcagagcaagctagtcgtgcagcatcatgtagtactacactaaaaaacaaactaatcacaggcttagaaaagaatgtactacaagtagtaatcatgagatcgaactacacctcacgatttcacagtttcttttttaggtcttgaatcttgattcacagaaatggcacaaagttaagcataagctgctcttttcttactttgccagctggagaagaagtcctactccatatcatgtgtacacgtctctattctctttgaaccggaagtccgaaacagtggaaaccaatcaacccagccagtcgggaaacaagagagaacaaggcgaacacacatcgattccatccgtcaccgtcgatcaatctacgtacagggcctcgcgcgcgcttccaccgccgcgcgcgacatgaccgacggcgacgtacgtggacggcagctagctagccggcccactactactcgatcgatcggcttcccgaaacgctcgagcgcgcgagacgtactacgtacggggcaggcggcactcgccagccagtctcatcgcgcattcgcgcggtgagtgacgcggcctctctctcgctgtccctctccgggattccaccgagcgcaacgcgacgccgcgctcgcctccaacccgcgccttgcttccccatttagtcaacccaacccaccacccgcccatgcatgcatgcacgcacgcacggtggcgctggctgactggctggctcgctagctttttctctcccccttccccaccacggctgcctcggccctcgggaaccggaaataacaacgggtgcatggcggagtacacgctgccgcggccggggtgtgtgtaagccaagcctgccttgctcgctcagacacgcaccgtacgtggccgaccggccgtgggcaggggtcgcatgcatggcatggaggtcgtgcgcactcatctcgtgctacgtacggtgctacccatgttgcggggctctggcacggcgagtgtggtttgtgggtggtaggaagaaggggacgagagttgccgattttgtttcttcctcaagttttcgatgttttcctggggatggctcatggccgggcttcgcgtcgattgcgcggccggcgagcttgttggctttccgtgcggccgcttttacgtacgtacgtggtcgtcagcgaggtggtagcatagtagtacgtagtagtaggtaaaattgcagccttgcagggggctcatagccggatcgatacggtcgttttgttgcatgggccggaccgccggagtagtagtttagcacgctagatgtatggcaattctccggttactttgcactaaactaatgacggacggagtctggattaacggctaggagtacttttttcaccgaaaaagaactgctacttttgttttgttggaggcagccagcataccgaagtgcttagatgattgctattccacctgcgtttcatacggtaagtcatttgtttttttagtaaaatctaattaagatcgaccaaatttatagtaaaatttagtaacatctaaaataccaaactagtttaattaaattaaagtttaatatattttgataatatttttattttgtattgaaaatactaatatatttttttaataaacacatttaaacttgaacaagttcgactagaaaaaaatcaaacaatttataatacaaacggatagggtacttaattgtaaagtgtgtttagggggaggaagggattttaaatgtgaagcgttaagatccacacgacaaacaaaatgctggggtggccatcaccacgtacgccggggcccctgtaagccatgcaaaggagactcacaaggccgtggactcttgctaatgacatcgatggaactgacattttatatcagtatattaccaactaactccctccgtcaaaaaaaaaaagagaaaccccgatttacgcataaagtattaatcatgttttatcatctaataacaaatgaaaatactaattataaaaaaaattcatataagacggacagtcaaacgttggcacgaaaatccagggtttgcttttttttttggaacggagggagtagctagcgccaccatctgaaaaacagtcacttcgtttttattttccaaaataaaatactaggagaaagacgttctactagtactagcgtacaaaacaccgcaaagtatatcttggagctttccattgccaaatacaaacagcaatcatatactaggagtacaacgagacaatataagttcgatcacaaattcacagtcatgaattaatcgtagtactcgctccgtccaaaaaaaaaaaacttaacttataaagtttaaattttatctaaaaaaaccaacttctaccatcctacctaatccctgcacataaaacgagaagttttatttcttaaatactttttacctacctatcaacatttctacgttttccaatacggaaatgctaaataccgggataccgttgctagccttcaatacgagatccttatcctctcctagcctcacgtggctacggataagaatggcgcggagacaaccaagtttcacgacggcgttgcagctgagataacctatttcgtgcgaggttgcgccgtggcatccgtcaccgtcgcgctacgcagctactcgcaccagctgatgacagcggcggcgcgcggggcttggccgtcattgctgaatcgaagagaggtgccacgttgaggagcagtgcgagcttggagtcggagctgatggacgtgggttgtcgcgatggccggggatggagctatcgtcggagttgatagacgcagagaaaggaggacacggccaccggcgacgagctccgatgtggtgtggacaatggaggatgcggccgtcgctgatgagctccggcgtggggcgtagatgacggaggacgcggccgccggcgacgagttctgacgtggcatgtacggcggaggatgcggccatcggcaactagctccaacgtgagacgtggacgacggaggacgcaaccgccggtgacgagctccgacgtgacgtggactatggaggatgcaacagtcgtcgccgccgagctccgacgtggcgtggacggtggaggatgcagccgccgccgacaagctccagcgtgagacgtggacgatgggaccaccagcgacaatgctttggtgcccgactcctgatacctcggaagtatcacctaatacgtggtaggaatcatctgatacctaataagtatcacatgatactttgcaagtatcacctgatacgtggtaggaatcgcctgataccttataggtatcactagatacctcataagtatggcctgataccggttaggtatcaggatcccgtcccaacaggatttcgttgtatagcagctctcttttcaataatgagaggcattttggtcatttttactcttcactaatctctccttagatgctaggaatggactttttgtgggatggagggagtacatgtgatcattgccgtgttcaagattctattggcatgctaaggccttgtttagttgggaaaagttttttggtttggttgtcacatcaaatatatagacacatatttgaagtattaaatgtagtctaataacaaaacaaattacatattccgctaggaaactgcgagacaaatttattaagcctaattaatttgtcattagcaaatgtttactgtagcaccacattgtcaaaccatggcgcaattaggtttaaaagatttatctcacaatttacacgcaatctgtgtaatttgtttttttcttatatttaatacttcatgtatgtgcataaacatttgacgtaacagcgtgaaattttttttgtttaagtaactaaccatgacctaagtttcgaccaaagcaacaatcagcaacaatgattgggcaacattaattaattagttttaggttcgaacatacctatctgtaggtagtaatttatttacaaatactccgatagggaactccatcaaactgacgggatcaagtcttgtccaaattgcccggcctgttttcaaaaaacaaacaaacaaacaaaccttgtccaaacttccgataagatatttttctgtatgcaatctgaaacgtagaagcgattccattcacgtaggcaccaaaacagaaaaactgtgggacacattgtcacgtcaatttcatggccagaacgcgcacacgggcacccactagttacagactaaactcagacgatcgagctgaaggtgaactctgataaattaagacagtgtgatcaatcattgcaaattcagagtaggtgtgaaaaccataatggtcactgtttctgttttttacggactgcattggtatcataattcttcagcggaaatgctaaagggcgatcgctcgtctggagatgggggtagcgatcaattcgccccaccctgcctccccattcctctctctccacctggtttcctattttgacaccgcattactttcttattttagtaaatttatgcacctaaagtttatatatctcaagtttacacatctaaagtttagagaccaaaagtttataagtcaaaagtttatatatccgattcaaatttgaatttgaattcaaatattttttttatatatagtatttctatacatctaaagtttatacacctaaagtttatagacctaaagtttatatatccgattcaaatttgaatttgaattcaaatatttttcatatatagtatttctatacatctaaagtttatacacctaaattttatagacctaaagtttatatacctgattcaaatttgaatttaaattatattcgattcaaatttgaatttgaattcaaatattttctatatatagtatttctatacatttgtgcaaatatgaaaatatttatgtcatgcttaaagaacatttgatgatgaatcaaatcataataaaataaatgttaattacataaattttttgaataaaacgaatggttaaacattaaaaaaaaagtcaacggtgtcatacattaaaaaaatatggagggagtaagacctacccgttttctctaggtaaaaaacactaggaatctaccgagagaccaagtaggttatattcctagttggctagtactcctagttcggttccactcaaccgggagcatgcaggttgagcttattagctggtggaaggtggtgacctacaagctacagctcgactctacgacgtccggatgagaccaacacgaagagaaaaaggcatattaggtggctatacatgtcgctgtgtgtggcgctgctggcgcagcctgcaggccaagctgccaaaaccgcaggacacgatgtgtgggatcgtaatgggaaaggcagcgcatcactctgataatgaccgagatcacaggaatgattgccatccccaacagagcgtctcccgtctttgtcaatgctctcgatgtcatgcatatgccccccccccccccccctctcgagcgatcacaattcacaagctgtgaactgaagccagctgatcgatcgcgagacgacggccgaccggccgtgttgttggcaatggcatgcatgagcgcgaaggcatgcatatacgatcgcatgcatgcgctgcctcacgtacgtctaagcgctagctagcttcatatgcgcaagctctgcagcgagagctactaatccggcacgacaaagcgctaatggacacaccctgatcacaggttacctgttccatggcgtggtggttagcgcactagctaggcgagagtgcggtgacgcatcctgcatccccctctcccacacgtgcgaacagaagccgcatgcatcgtcgtctctcccctgctgccgccgctgccccgtgatgagctcaagttaagcgacgaatgcgacagccgaaccgcagaattactagctaggctgctgctgccacatatatgcgctcatggcgcagtgctgatatatagatagatgcaggcgatattgctgaatgcaccccggtaacagcactggagtatcagagaacatgcatctggttgtgagatggttaagaaaaagataactgtagtaagtgctcctggctgtagctactcatcagacagcctctgaagccgcctgaacctgcgtgccattagacgactgttctctttcagaaaatttgtgcatagataggatgtgcatgcttgggtcagagcccggaggtgtcaaaacggtactatctctgttcatgtcgtggatattagagcaaatttaatagtatagtcaactattagttttaaatcatgtaaattagtttaatagttaattcataacctataaacatattctacactattaatatctggttccacccgtcatacgcatattgtatcttagagtccgtgctgcagcgctagctatagagatatgtggtccgctgctcctctctcttctcttttatctcttcaaaatatgtttatagttggcttatacctactcttaatgtcgcatcttactaatataagaatttaattaactactactccctccgtttcaggttatacctactcttaatgtctagattcattaacatatactctctccatactcgtaaaagaagttgtttaggacaatgtttaagtcaaaccttaggaatataaatcatgaataactctcaagttgttgagtttgaaaatgtaaaaattatatgaatagatttgtcttgaaaaatactttcataaagtatacatatatcacttttcaataaatattttaatagaaacaagaaatcaaaattgtgttttaaagatcgtgtcgctgttctaaacgacttcctttacgagtacggagggagtatataaatgtgggcaatgctaaaatgtcttataatatgaagtgaagagagtactacaaaggcgattagcacacgtacacggtgacacgctaactatacacatgttgtcaacttgtcatttcactcatagccttcatttagaccaggtagaagcagggattctttgcattgtatttttttttcaaaactgatatcttcacgcaaattcgcgtaaaaacagtatactttcgatttttttggggatccatgaaaatgtagttcgaagatgcagcatgtgacactcttaattgcagtgcgacatgccaaccaaacctccggatctttggcactttgtacccataaattgtactccatccctggacatgatttcgccatcaaagaacaacaaatatataaatggttcagacttcagacggctgtttggtgattcagaagacagagcactgatgtctgatggtctcttgatatagttaccagatgtctgatggtcatgataaggtgcaatgggccattgaaaaatcttatctgtattcgctattcagtgaggtcactccaccatttgatatagcatatagagggttggtgaatctcagaatatggaaattgtgtgggggttcagagtccccgtggaaattaagttttcctttggcaaatgtaccatgaaaagatttaccttcgtaggaaatagactacctctagtgttaacaaaaccaattggttttaacgaaaaccgttggattaacgtaaggagttagatcaaatgtcattgtttttaccggctttcgcttggtttccagcaagccaatggagggtggtttttacttctaaaacagaaagaaagttggactgaagagatatggattatacttttcttctcctgtcacttgacggtttatatatattggtatgatttcttccctattttgtttccctgtcttgttcagttagatagatttgtaataagatagcaataattgagatgattctaaatcttttaaaatttctacttttcagaatatatcctggagcactctactttgaccagaggataaaactaaggttgatcgtttggcatgaaaaccatctattgaccctcatatgctaatataagtgggatacccctacttcaaataaaagagagagagagagagagaaataaaagaaaccattgttctttgactgcaaatttctttaacaagccatatgaacgtgcaatatatcgacatatagaataataatatttccacaaccattcatatataatctaaaagtatttctaatagaggcatcgatccatacaaggaaataaggaagccactctagcattgcaggaaacaacttacatatatgcgcgatcaactctaagagaaagccatgcaaaaagattgatatagaccactatttttgctattcatgatttaagcaattcaattatattggtcacaaccaatttgaacggctaaataagtcaacacttacacaatgcattatgtggaccccacttaactaagacgtcagatatgccataaataataaatatacaatagctaacggctataaaattttcaattgtaaaggcgcgtcaatcatatttggcacacttaactttttaaaagctagcgttacaagttaggttttaaccatgccgtcgtatagtagtatttatacgctttgttcaaaacacaacggtaatatgtattattagctactaccttacaaacataaatatagtctcaactatccttatatgacataaataccaacgtttttttttcataaatttttcaacgacttacaatactggaagtgttatactccactattcaatggacaccataggccgccgcagcaacccaggtcattttctagctccctgggactgtatacatgtatgtaggacccatgaattggtgaaaataaggatacgaatcatatgagagccctgaaaacatgaacccaaacaagggaataactatatatgatgatgatgatgatgatcaaataaaagcacaaaagggttgtggttctttaaataaaaccgaacgcaccaacacgggccgttattcgctagggaacgaatcgctagtcgccgaggcgaggcggaagaatacgagcaaaagtcgacgaccaaaccatgggggccagcgcgcgcccaaacgtccgtttcccgtttcgccgtcagcgcgactcggcgagcgagagagcgagcgagcgcctgtgcgcctgtgtggcttgaacggcacacccccgcccgcccacgcttataatactgtcgcttacgcctttattttttcttctctccttcatctgttcgtcctctcctctctcctctctctcgccctctccacactggcacactctctgtgaatctctccttctgttcctggttaattcgctcttcttcctctcgtatctccgccgcgatcgatggccatggagaaggtggacgccaaggagagggagaagatcgaggccgtccgcaagaccctccgcaagcaggctccgctcaccgccaagcaggttcgccctccatggctcgttttcatgcatggcgctcgctcgctcgcggtgctgcgttttcaatcggttttggttaaccttggtggtgcgtgcgtgcgtggatggcgtgggcgagcaggcgatgtactgcaacgacgcgtgcgtggagcggttcctccgggcgagaggggagagcgtgaagaaggcggcgaaacacctgagaaccgtcctgtcctggagggacaccatcggagccggtacgttcaacaatcccagcttccatttttctccattatttccatccatccccacatcgctcctcatttactccactcccctcttttccatgtttctgccaacaaatctgagtttcatcaagcgtgtgtgtctgcatccctgcgattttccggcagcagccgggggccctgattttttttgaaatccgtggggggtttgccacattaatggtggtgcatgcccctgctctgtttcgcttctgttctcttcgcgatacctacggcacagtgtattttagtcaagctactgtgcgcctgaatttattgtgccgtgtgatttgtttccttgcaatattatgcaagcaaagtacagtctgcaacagtgtacactcttgttggtattctgttcttcgtcgggttgggggctaaattggttgattttgtgccctttgttttgtgttgagcagatcacatcatcgccgacgagttctccgccgagctggctgacggcgtcgcctacgtcgccggccacgacgacgaggcccgacctgtcgtggtacgtttccatggcctccgtgccgggtgcaaattgacactcacacgctagatggagaatatgttctgatttgacagggaggtctttttttacaggtctttcgaatcaagcaggactacccaaagttccactcccagaaatcgtaagaacgaacagatgaacacttgcctaatttaatcattaacccggtcttaacaattgattgactcttgcttcttgctggatttaattaggttcgtgcggttactggtgttcacgctggaggtggccgtgtcatgcatgtcccgcttcgtcgaccagttcgtcctcctcttcgatgcaagtaagcagccatttcttcaccatttccaactattcccgtagctgtagtagtggtactagttacatctgtgcgtgtcctttctttctccaaagaagaaagacagcgacagtgagaaaatagcggtcgcgtttctcattgcctcgcacgggcaaggcagaatgggcagtagtggcatgtgtaggtcagagctgtgcgcactgcacattcgtggggatggctcggcgagaccttcgtcgcgcgcggcgcggcgcgcccacctcgctcgcacggacgaacggggccgcatggccgtgtcgtgtcgtgtcgtcgtgtgcggttgccggcgacggcttcgcggcggtcccgcggcatcgcgcacagttaccgctacagtggcaggcacggctgccgcttttgggggcggagaccccggcttcccgccggtgcggtttgaatcgtggcgagaatgattggatcggtgatgatgcgtggaaagcgagagccgtagaatctgcaggaaagtgagaggggttgacgagacgaatcgaatcttttttttaatttttttttcatgtgcaggctttttccggtcggcgtcggctttcctcaacctgctcatgggcacgctcaagatcgtcgccgactactaccccggccgcctccaccgcgccttcgtcatcgacccgccgtccctcttctccgtcctctggaaggtatacgtcacgtttgatttcgtgttcatcgcgatggcgatggcgagtgggagatgaactgaaaaaacgggtgcggtgttgtccagggagtgaggccgttcgtggagctggcgccggcgacggcggtggtgtgctcgctggacttcgaggactcgctggaggacgcgtcgttcacggcgtacccgcggacggcgtcgctgcggttcgagccggcggcggccctgctggcgaccgggacgaagggcatcggcgtcggctccgcctcgtcgcggttctccgtcaccgtgtcgcacgacaacaccctcaagccgtggtacctgtccaccaccacgccgtcgtcggtggggcctcgctccgtggtgccgacctccagcccgtccctcatcggcgcgtcgccgctctcggcgcgctccttctccttcgcctcccccgccgcgcgctccaccacgacgccgcccgtccaccgcggcgcaccgctgacgccgttctcgaccaagggcgggcagaaggcgccggcgccagcgcagcagttcccgcggacgccgcggccgtcgttcctgcagtcgccgtcgatgctgttcgcgttcaagaaggacggccaggccagccgcggcgagcgggagcgcgagtccttcctgccgttcctccgcttctaccgccgcccctacgacgagatatcgtatcgcgccaagatgcggccgccgctgggcgggctcatcgccatcgtcgacgagaagtcgaagcagcacaagacggtgcagccgccgctgcgacggcacgccgggctccaccaccagcagctgttccagctccaccaccaccagaggatctgatctgaactccagatgatctcccgttgctgaagcatgaatccaaccgatgaagctagcgttcttctccatacattttacagcataatccaatgctataattatgctaagttgatcttttgtcgacattttccccccagtatttacctcctaggatattcttcaacccgtgtaaaataacagccctaaaatgtgagtaaaatcgaccccttttgcagcctctcgccgtgactgactgcatgcatgttcatctctgattgttcatggctttaaaaaatgccctgcaaaatgccatgattttcaaaatattttcatattgtacgcctacagtggacacatgctatttcttcatttcaaacataaaaataatagagtaaattgcgttggcggtacaagaacttggcaggtgtgtgcgattagatgtaaaaatttgaaaatcaagcatagcggtacaataacttggctaggtgagtgcgctcatggtgcaaaagtagccatgtaaaaaaaattgccacgttgctattccaccttagcaaaattgccacatcagctttatatgaaagacctatctcattttataaaaaaccccaaatagctttttttttccaatcacatttcctttttaactcgacaaacagaacaaacgtatgcatatctccttccatctttcttgacgtgttcctaattgagaggcggctgcggttgtggcgatggcggcgtagcgacggtggcggcggcagtgacgacggcaacgagggaaaccgttacatcgccgcggcggcgagggcttcgtgtgccacattagttcaagccctaaaccagtaaccaaaccaattcaagccgacaatttgctaccgtcgacatgatcaccgtaagctttgggatggctctgaatcgacgagtttttggagcatctgctcctagcttattatggtaaatcacttgctgatggttgtagatttctatttttcgttcatttgatggatgatttcgaagttaaggtttcattgatctgtacaatggctacatttttttgggttttcacttgaatatcatgttatttgttattacaattcaatgaagtgatctaatggtactagccactagattggttttactgaaattattggtgtttcctgtaattgtatatgatataagagaaacattggcaatgagaaattcttgctagatgtgttgtacccttgtcagcagatataattagttgaataatttgcaaataatcttagtgtattattttccttatgcggtataacacatcaaccaattattttgtattgcaggtcatgaggaagaagaattcacaattgcactgtatcgtggtggattttttttttttttggagttggcagtagcagaatttatttggatgagaagatggactggtttgatcattgtgatacaggaggaaaacagatatatctgaagaagtaattggaatataaaagttattagggacttttctgtaaaatgagatggtcaatgcatgctcatgtggcactttcgctgaggtggaacaatagcgtggcaacttttgcaccatgagcgcacccacctagccaagttattgtaccgctatactcggtttttaagtttttgcacctaatcgcatctacctgtcaagttcttgtaccgctatgcacggttttttcaattttttgcacctaatcgcacctaacttttaagttcttgtactgccaatgcaatttacttaaaataatattaaaaaatcttgcacgcgacagtgtcacgttggtcatgcgacatatcgagccaacacagttggagggagaacacaacaggccagacacggcccgttgaaaattttgaaacgttgagacgaaaaagagagatgacatggagagtcccgacggttttttccttttcgatcttttacagtaaccctgtcggccacttcgtaaaacacacaaaagctagcgtcaccgattaagcagagtccagtatactagtactagtataaacagaagtctacatgtacgcatgtacaccttctgattttctgctaattttttgtcgctctccctctctctctcttctgtgtaagttggttttactttgagatgatgatcaggtttgacgcttttaagctttgtcacaagtgcttacaaaaagcaaagctgatgactgaattgaacatcaatttcttgtggaccaaatcgaagtttaaagtctatactactatgagaccactagtgtgaacagcctcttttttttctcgagttctgggtaaagccaagctagcacagtggacatgcaaatctttcctggcgagctactgctaaaacaaattgaaatgatctcctgcaacaacaatgatccagttcgctttcattgatccagatgcagcgtgatctgcttcgtgtggacctagatcgctttggttttgtcccagaagggaccaaagctggagctccattttgcttaggcgttaattaactcgatgtgcttagcgcagcgactaatcccatctttccacattaatcacttccccttttgagcccagcctgctgggatgttgttgtgtatcgagaggtttgtagtgtagctgagagtgtgacgtgcaatatccacatggaccagtgtgtagaacccatctttccatacagggagctcttacgtgcattccgtctgtttgaataggctctgtgatctgtgaacgtgttcatgattactcatcgatacgtttacttgattgcctactaaggctatcaaaagaagaaaaagataactgaactaaattatgattggattcatcttgaatccaaactcggtaactacagaaatactcttaaagaaggggatggattcaaactgagccacattttcagcctatgcgttcatttgcagtttgtgttttctgtctcgtttgaggttattaactgcacatgtacttctgtagttttgtcacactcagttggaccgaccaagtggttattgtcacaaaccacggatctaatcacagacgacgctacttcactattacgaccgatcgtacagaaaaacaacggacttaatggcagcagcaggaacggtcgctcggtggtgcatcggaggaatcacgctgtgtcaaggcgaaacgacggtgtcgccacggcacacgcgcacgcacacgcaggcgaggcgagcggagccgaggcgcagggacgagacgacacggcccgcacgcgccacgatggatcatctacccccccccccc

SEQ ID NO: 80974 - DNA, 14947 bp, Oryza sativa
tttgtactgtgcggggggccgcctgcaaatgggcggcgaggggacatggaattttgcaggcggcccccttgccgccctgggggagggcgatttttccccccccccctataaagcccagcccctcctctgtgaaatttcattatattcactaaaaatccaaaaaaaaacgaaagagagaggggagggcagcagaagggaagcggcgaagccctgctggttcgctcacttcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgatagccctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtgcaaatggcttttgaacggtcatggcccctcgttatatttgtgtcggtacaagagaaagatatatatgtttcaatgcaaaccgaagatgtagagggtcctatcaatgcaggggatgttgttggaccatcgatgcaaaatgaggaaaatcaaccaaaggaggagcaggccatgggcatggcggatgagggggagagagtcagtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctagcaaaggcctggagagccaaagaaaaaattattgagatgaggtacggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaccaatttggcagaggtgtacaactgggtaatgcgaggagttcgggtacttccattgattgctattggtgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtagatgtacctgcagttgtatgaagccgaagcttcatcaccttctttgctcacacgtccttgctgctgccggtgattgtggcatatctccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgtccgaagaatgcagaagttccaagcggcgcagatgctagtccatctggacaggcaagtgatggtaggcgaccacctggtgaaggaacaacaagcaggcgcgcaaggccaaggcgtcgtctcgcagcaggcgattccatggtgtaacaatgctatcgatttaggaaataaaatgctgttgtgatgtgatgagtgttcggactaaatacttctatcgtgtaatttcaattgaatgttgttgtaatgagtacctccgactattgttgtactagtagtattgcgaactattcggtgttgtatcataatgttatcgtgatgagtgttcggactaagtactcatatcgtgtaactgcagttattgttgtaatcagaaatattccgtatggtgacacttttgtttatttgtactcttgtttaatatgtgttagtaattcgcttattaacatttattacttatgttgaactaattatttatatgtttctgatcaatctatttgatgcaggtatggcgtacgacacaccggcgctgttgaaccgtgggattgacaggaacgaccggcgcttccacgagctccgcaggggcgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactggggcctcttcgtctcacgccggtaggactggtcctactagccagttctacgacgacgacttgcacggtgcacaccaccacgacgtcctaggctcctctcagcttggaggagctccagaggcgcacactcaggagcagccagagatcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcataaggtgcttgaacaacttatgctcacaacaacacactttcggcgcttcacggtagtgccagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaatcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttactagtctccagatttgataactattgatatttatacaaaaaataaagagcacagtacaaaatcgccctcccccagggcggcaagggggccgcctgcaaaattccatgccccctcgccgcccatttgcaggcggcccccccacagtagaaaatcgccctagcggagggcggcaagggggccgcctgcaaaattccatgccccccctcgccgcccatttgcaggcggccccccgcacagtataaaatcgccctagcggagggcggcaagggggccgcctgcaaatttcgttgacggccgtcgcccgagagcgaacggccggctgccacgtcattttcgccgccctctgggaaaaatcgccctcccagagggcggtaggcgactaattccgtcaattttcaaaatggaaaattatttttgtaaaacttttaataaaaaaaattataaataaaaaaaattctacgtctggccaccttcccttccggcctaggcccaccagccgcttagcaccttcccttctccccaaatgaaggttgatcgagcacaattcttggatgcccagcatcttaaaattttctcgcaatcctattttactgttagcagcagagacagccgctaccatcttcactgctaagggagtgtttgagacaagtattggcaagggccctcgcgtcgccctcccccgggcggctcgggaggcgacgcgcgcgccgccgctttcctcctccccccgccccctcctccacctcgccgccgcccgagcggctgccggaaagccgcgcagccgcaaggacggcggcggcggggtctcgcctcgccctccccacgctcggcggctgggggagcagtccggggcggcagtggtggcggccagatccacgccgtttccggccggatctgaagggggggtggtcggcggcggggactgacggtgacggtggcgactgaaggcggcggaccacggcaactgagcgacgttggcggcggaccgcggcgactggcgacgtcgacggcggaccgcggcgcgtccaggccgccacggcagggacctccgccgcaccgtcatggtcgtctcgctccagcctagcgctgagtggcgcgctccgtcccccggacccgcgccaccccagccggatctggatgggcggcggctgctggcggcggccggtgatggtggcggctggtgacggtggcgtggagacgaccggtggaccacggcggctgacggccgtggtggtgatggctggcgacggtggcaccgtgcagcagacggcgcgtgacgccagcggcagcatatgaaggcggggaaggagttgggcggtagggaaggagaccgggagcgggcgtggcgtgggcggcggttgcgtgtggcggcgttgcacggctcgggagggctccggcgagctcggcggctgcgcagagtcgagacgggcttcggcagggttgctcgctggtggtgagcctcctgctcgcgatatgtggatgtggatgcgctgacgtgtttggtcacgtcgaggtatgattgctcgtgagacgtcacggactattccatggtcgtcgacgtggggtgcttgtgtgagtgatgtgaagacgctggcgaaagccttgccgtgcctttggccggttcgacgacgacgacgctcttgggcgccattaaccttcttggaggcgtcgtcatggcgttctttcatattccccacaaatctccgggtgaaaaccttgttccgatttcggacgagcggcggcgacgttacgcgtcgtgtcctccttgggggtgtcgcttcggagaagttcctatgcatcaacgaccatggatggtctttttcggttctaaagctttcataccttgacgtttggcgaggccttcgcctccttgggtccgcttcgttcttgtggtgggcgacatgctcttcggttgcttctgctgatgaagtcgaagctgctcgctgatggggtgcggcgatgcttggcaacgatgacaagttgcagtctcttccaaggagttggtgctggccgtgtgaaggaagtgtctctttggtggtttggctgatgtccattgttggatgtcggagctgcttttcgctctggcgactttcgcggattcagtgtcgctgcggttgtgaagtcggcgctgctgggtcgctttggcggctagctcggcaacgataacacctcttctgtgatgttggagctgtttgggccgcttttgtgttttagcttggcaatgatgttctacatttggactccgccgttgttgatagttgtgtagctagatctcttgctttcttctgtgtggtgggttttagccggtttcccgtaattaaccgtgcagttgtatggttttcgggcccagttttccttataaactgggtcaattctcttcttctaaatataaaagtggaacaaagttccgccttaggtttcaaaaaaagggagtgtttgagaggggagaaaaaaaagattaagaagatgatatacaaaacgagataagccaattagcgcattattaattgagtgttaactatttcaaattttaaaaatggattgatataattttttaaaacaactttcctatataatttttttttcaaaaaacgcactgtttctctcccaatcacccaccaacgatagactatctagaaacaacattggccgctcggtctccgacgctgccatcgtcattgcgaattgtcgtcgacgtatgaaaaaaaaaatcgatttatcatctggaaacaacattagccgcgtcgctcgctctaccatcgctgattgtggaatttattaaaacactgctctgaacttaaaacaacgggttttttttttgtttcagtcacgcgctctagcttgtataaattactccattaattatatagaatctcatcaaacatctaatttgaacttcataaactcatatgaacatgtacatgcacagcacataaaaacagacacacacatacaagatacgtgtaatcataatcggaagatgatttttacgactcaaatatgtatatgcaccttacgtcctaagccatttgatgttttgttgagattcatgttatactaaagaagaacactactaacattattatgtcttattaaaatctactccctcaatcccataatataaggtatggtaaaaattacacggtctccaaaactaatctttaatttataatttctcatatgctataaggtttgtaacaacaaaattataatcatatgaaagtaaatttaaatgtcaatctaacgatataatttttatcaaataaaatttatttcatattacgttaaatgttggtcaaatattttaaagattaaatcttgaaatacgtgcacaccttatattatgggatggtgagagtatattatgccatgtacaacgcgtgaccctagcttgtggtctcaaacctccacgtcggacgcgcgcacccatggcagtggggaccgtagcactgcaggctgatcccgcgcttgcagaagaaccgcccaaagcgccgcgccagggcttgggaagggcgaagcccggtccgaggccacgcgttggcagagccggagacccgtgcgtcgcctcgaccggtccccagatccgccgccaccactgctccccggcgccgacggtcgcgaagaagggaggaggagaggaaccaccgccgttgtggcccccgccgccagatccggcgagcccgccaccgacaagctcgccacgccgtcggcgagctcgtccgcgtcgtcgtggggggaggaggacggcggcgtcgagccatccgccgccaccgctgctcaacgccgccgccagatccgccgacactgctactcaatgccaccgctagatccaccgccgccgccactccccgccgccgctaccgctgctccccaccgccgccagagctcgagcgccgctgatggggagctcgcggcggagaggggaagggagaagccgtctcgcgccgcagaggggaggggagaagctggcgagctcgcgccggagaggggagggatctcgccggcggggtggagtaggcgtcagtggaggtggagaaggggatcggaggagcaacgtcggtggcgtatgagaagggggacaggagagagaagggggagagtaaaaaagaaataggttggaagaggctgacaatgggttcttatgatatttaggggtgcatatgtacttattttggttgctatgggattcaaaatataaaattttaggcctcatttctttcagcttgggattattataatctagattattgagtcagattactataatctagattgttataatctgtagtagaataagcggttagttgtctctttcctaaattattagagcctagattattgggtttgcaagtctaaagagggagtggggtggcatggtgggtaattttttacccaataatctagaaaaagctcacctaaatgagcttatcatattataataagttgggctccagattataataagctacttcaataagttgtctgaatctttcagcttactcccaataatctggattataataatcccaaactgaaagaaacagggccttaataggtttgataatatcatacaacacaagggctgacatataaatagataggggctgaaatgcaaaatatgttttggagtggttaccactgtgggttgtgtgacctttatgtggttctattctacgtggcaacttgagaccactgttgcttgtggcttgcattgtacatacccttacatgggcgaatcttgaagcaaatttgatgacataaaagtgcatgggaatttgcacttgcgttgtgactttcctgcataatcatcgatgtatggatacattatcttcatcctaaaataataaaataatatagtagtatatataagaaaaaaatttgttaatatacttatttttttaataatttacatttatatacatacatcggacggattcgtaaaaatatacatgtcccgcacgatagaaacgcgggactgcgatgatcccgcagctccaaaacgcaggatcatcggtcccgcagaatggtcgtggggccacgacggtccgcaggttcaaaatgcgggagcgaggcagcctgtgattttcaacgtggtttagcactgtgtagcactgtttcgatactgtttgaaactatttggcaccgttcacacgcgcggtaccgcaggttcaccgtgcggaaccggcccctaaacaggccgctaccgtgcaaacagtacccgaaacagtgttgaaccagaaacagtgttgaacagtgccgactcagtaaaataaatcgctggccgactcgctcccgcgttttgaccgtcgcgatcccgcggaccgacgtccggcgttttacaactgcgggactatcatggtcccacgtttctatccaacggaacgggtatatttttatgagtccgtcttatacaggtatataaacataaattattgaaaaaataaatattttcgtaattttcattcgtatatatgacgctagttagtatactctcttagttctttaatatataatgccatctattttttaaatacgtttgatcatacgtgttattttcaaaaatatgtaattatcatttgttttgttataatttgatttatcacatgttacatgacttgtaactttattgatcggtaaaaaataaaaattgaataagtcaaattatcaaatgtatgtcaaaatatcaatgacatcgtgtattaaaaaatgcatattaaaaaaggaggtagtacatgaaaagaaactgaggtagcaatatttaattaagcataattaatccagagaggctgcaggggtgagattattcgtcatcttcctcctctttaaacatggcttgtaattttattgatttgtaaaaataaaaattgaataagtcatatgatcgaatgtatatcaaaatataaaaaaaatcttatattaaaaaaaggaatgagtacatgaaaagaaactaaggaagtaataattaattaagcagaattaatctagagatgataaagtaatacttcctccgtttcgtattataagactttctagcattgcgcacatttatatgtgtctagattcattaacagtagaatgtgaacaatgaaagtattataatatgaaacggcgggagcaattaattaagtagaattaatccagaggcgccgcaggtttacctacgcgagcagattaatcgtcatatccctcctcctcttcttcctcctcctcctcctcttcgtcctcgccgccgccgcctttgcctttgcctttcttcttgcgcccaccgccgccgccgccgcggccgttcttctccagcccgatgaccttctcgacgagcctgatgacgaacgtcttcacccgcttcctccggctgccgctcgcgcgcggcgacgacgccgccaccggcgcctggttgtaggacgatgcccgctggtgctgcgtgtaggccaccggcggcgggtggtggtggtgggggcggcggcatccttggcggtggacggtgaagttgcagagcgggcagcggtagccgaggacgccggcgaggtcgcggaggcagacgttgcaggtgcagaagccggcggggacggcggcgaagctgatggcgacggtggcgcggccgcagaagccgcagctgggagggttggaacaatggccgccgccgctgctctgatgatccattggttaattactagacctaatattgattcgatcctaattctccattgttttagtggctgattttatgtaggcttaaaagaagttggttttttacagtcattttcgaggaaattaaacccaacagctagtttgggattgggtggatagctacggtcccttagatataggatcagtttagtttcacatattttaatatgtttatgtctaaaatctaccactttgactcaatattgtttttactggtacacttggctcaacataatcctaggggacacaggaaatgggagagcgctacgcgttggacgtacggcgcgagacaaaaaataccacatgaacgtgccatgttatccacgcatgtaagaacaataataatgatcattatatataatcataataacaaataaaaagaaagaaaagacaaaaccatatatatttaaaaaaaatcaggctggcattctatcatgactttctgggttattattatttttgtttgttcttattactgtaatatggtatatgtaagggtagaaggatttatttttgtccttatatatgaggattacgtggcatgctcatacggtgttttgttcaagggttacattgagtcaatagatttctaggagataaattgaaacgtaagggattgattctgttttcaagatttccccacacaccccccccccttttttagaaaaaaaaaggttttaaagcttttctggtttgctagctcctgtaatgctgtttaattaagtccctgtattcgttagctataaatagatgagagaatccaggagctaagctgaccatttcttcaactcccggcttatttttatgtatacgtactggatggtacctcagacgttactgcggaacattatggaatagcataggattataattttttttttaaaaaaagaagccaatgaactgaaatgtacatgttgatggggatgtaatatgccacataagcaatctaacagagtcacctatgagagcaggtacaataaaagctgaattagcagtgggtagaattgtccacttcagcaaaatctaggtggaagaaagagaagagaggagagagagagcaaagcggacgctcatgcagccgccaggtgatagcacgagaaaaaaggcagtggcacctacatgcagccgatgcaacagcaatgcttaaaggtcatggtgaaaataagataggtcccaccataccctatgtccatagccacaatgttgaaggcaagaatatatgttaagatggttcacacatctatgtaaacaaattctactttaaagtaggtcccaccataccataatctattctcatcctcatcctctttagtgtgcatgtatgctttatctcatcattttattttttaaggttgagccataaaaaacttatggctatttttagtatttaatgtcttatggctagtgcccataatatatatggttagttaaaaggcctatggctcattcttatggcacattgtggaagcctttatatgtgggattgcatgtccttctgattggttgggagaaaaaaaggttgacgggtgagagaaaaggcaagttaatgtggtggggacccaaattaaaaaaattgaatggtatatttttgtaatttgtgtatagcaatctacctaatagtctgttgttatacacctatctttgatgtagataattttatagacaacaaccggctctcttattaaacttgctctaagtagacagggcatctatattttcagagaataaacggcatggcaggaagtaaaaagagaaaattgtacagtttattttaatcacagactaaacaaaaattttgtagacaatacataggtaaagccataataacttgaattgttcttggataaacagataccaatccatactatatgacttcactagtgagcttcatgagaccaaatggtgatgtctatgcagttgctgaactcaagtttacgtaccagtgagatcatgtaagatgaagcccttcaatatttccaccaatgtaagtctgaagagcaagagactggcttccgtttattccttccatccaattgtctggtgatgagctgagacaattcaagttttagtgttttaccatagaaaaacaacagtgcacatagtagtttgtgacgatggaagtttcaagttacaaattatgtcaagtatcaaagacataagaaatttgcttataaaatctctagctatatgagtatataaaataaaataatgatggacagcattgcaattcatacatacatagggatgacgcccccatgttagatatatctccctcccttgagcccaacggctcaagggggccttgactcgcgccctgatcgggggcgcccagcccaatggctgatgggcccccatcatactgtgccatataaagaggggtggaggacgggacgcacatgacacaaggttcgtcgccgccgccactccaccccaaaaaccctaaggccttgttcggttcgggtgtaaaaggccgggataccagccttttccccggccccttcggggaagcccaccacgaggggatagaatccctgagttgtcaaaaaatgcattcggcttagcccgggaaggtggatttcccggcccaataccccacaaaccctagggatattggtccaccaccctgacccgtggaaactcaccacaccgctgcctcttctcgactggagcggcgcccgcgccgccgctgctcgtccagacgcgcgccgcggtgggccacgcccgcgccgccgctgctcatcccatcgcgtgccggcggtgggccgcgcatctactcgcgccggcgcctgccgtcactttggcctcctcctctcgccggaaacgacgccgcctctcgtcagatctgccggagttcaacaacggtgtggccttctccgttcggtctccaccatccaggacctcgtccccaacaagaacctccaggacctcgtcgtcatcttctaccagcttgtctaggtatgccaaattccatccttctcctgaattgattggtttggtggttgggaaggtgaaatcttgggctagatctgatcgattatgttgcggatagttaatcttgggctaggtaatcttgtgctaattttacttgtgaaatctctaggcataatctgtgcagctctgtataagttgtggctctgtgtattaattcctgatgctcgtgtggataaagcttgagcatctctgttgatccatgatatactcttaatttttgccctaacaaacttgatacggtttgtgtattaattagaattcttcatgatcctgtgaagcacccaaacttgctttgtcaattcctggaattaaaatgggtaatttactatgggagatgatagtaacaaattctagatgtctgacataatgttcattcgaaggaaaatattttcttcctttccttttatgttgatcaagatatattgaaaggagagtaatcaggttttgtccctttatttccgaacagatatttttgtggttcattgctatggatttctg

SEQ ID NO: 80975 - DNA, 3590 bp, Oryza sativa
aattcctgcagccccaacttgaaagttttggtgaaaaaaaactgtcaacgatttcttagcacatccgtttttttaagtgttgcaatccttttttttttctcgttttgttgcactggttgtgtatgagcgtttaactctctttttatttggaccagtaaataactaaatatgccatgcattgcacggccaacactattgggagtgggttagtcgtaaatttgtcatatatcctaaaagcacatgatctttctgaactaaccgtttcttttttttctatttttctccatcaatattttttctttctatttttctccattaatattttttctttaactaatcgtttctatttgagctggggctaagtcttcggactgagatcctctattttaagtcaagtaactttaaagtcactgacatgtacatggatccatagcaaagaaagtccatatcttaagctcagttcgtttcccatggttcccaactcccttctcatttttcgcgtgcacgcttttcaaactactattttggtgtgtttttttgcaaaaagtttctatacgaaagttgtttaaaaaaattatattgttccatttttgaaaaaaaaatgagctaatacttaattaatcacgtgctaatagattgctccgttttccgtgcggaggagtttggttcccaaccatcctaagcgaacacagccttaagtgacttaaagtcagaggatctcgatcccaagtccctctatcttgctagatcaccatagagaataagaaaagaaaggggaggaagaagaccgaagagaatcagagcaaaccctccaaattcaaagttagatctacccctggatatacgttatgggaggaaagaagtacgactccgtttttacagagaatgttatgtttgtgccttataacgagtcagatccatataataatgggttaaatagatccataccattacaaattatttggtttggaaatatgccattactattcacatatttagaaccataccattataatttttagctatttaaaatatgccactacatacccatctgatgcatccaataaacattttagaccaaattacccttttctttttctactgtccatcttcttcctctcctttctttctttttggatttggatctgatactggcagcttatctttctcctcctcatctactcacccattttcgcttgaacctaagcaaggccactcatgtactctcgcacccaaaggaaggtccagcaacgacatcgagccatcatcaacaacttccctgtttatttttttctcgtttttgtttctctagaatttgtactaaagaaaaaggaaacaaggaccacccactccacctttggcccgacgaagatcaagcatgcgtgcatgtgagcaaatatcgctggcggtcatgccttgtgcgactcgcagccgccttgcacaagtacgagagcacctgctgcttcgagagaagaagggacgaaggagagagaagatagaacatgggagagaaagaagaagagaacgaggaagaagataagggatagtttggtcctaaaatttttgcaaatattttgaagaggtagctagtggcatatctctactacttaaaaaataaaagtgcttccattgtccgttaaaaaaaccgggcgaaaaaaccgaatctatctgatccaaaaaaaccgggccaaaaaaaccggaaaaagaaaagaaaaaccaaacgtcaataaaaaccagtcgttaaaaaatgtccgatcaaaaaaaacgggtgaaaaaaaaactgaaaaaagaaaagaaaaccgaatcggttcgatccaaaaaaaaagggcgaaaataagtgaaaagaaaaacgaatccgactctgtcaatgcggtaaaaagagggtgaaaaaaatatgtccgattccaaactctgcattggtgaaaaaaattgatgtgccggattgaagatctttttgcaaaaacggaacatacgtgtcgagagcattccatttttatataatttttatttttagtttgtacttttgcatttaagtccctgtaatttttatatttacatttaagtccctataatcttgcaataagatacttgaggtcgtttttgttaaaaaaataataaaagagagagaacaaaggcagaaaggtgcattaaaagaaaaataaaagctgcacaaaaaagaaaataaagaaaaacaacaacaacaacaaaagtctttttcccctaagtggcgaaaaatactgtagatccgaacggaaaaaaaatctgatttatataaaaggcaaaaaaaaagtggtaaaaaaaatgctagatccgattcctttataaacggaaaaaaagtctgattcctataaaggccaaaaaaattctaaaaaaatatctaaaagagttcggccgattccctaaaaaaatggtgaaacaaaatccaatttctaaccagtatatatctcttctctatctctaatctaatctaactattttaaaagagaaaatgtacgagaaaataaaacggttcaaaaaaaatgtgtgaggcaaaagtcagaaaaaaacaccaaaaaaacatgctaaaaatgttttccatctttaataaaaaaaataaaaaatgcgcgagaaaaattatttctatcgtcggtaaaatattttttaaaaaaacatgcgaggaaaaacctgtctgaaataacgcgtcatttctaaaaaaatggttttaaaaaaccgcacaagaaaaataacaccgtctactaaaaacaaattgctttaaaaaaattgtcagaaaaaagataaattgatggacgcttgaatcgaataggatcattgattttttgccaactactatatggctttatttcgtcatatattctcttgtattggaaaaaagagaaaaaaagcattcgaaaaaaacaagcaaaaacaacatgcaagaaaacaggcaaaaaaacacacgagaaaagaaaagcaaaaaaaggagaaaaatatagttttcttcatcagtaaaaaaaagaaaaaaacatgctaggaaaaaacttttagaaagaaatgcgccatttctgaaaaatggtttgagaaaatcgcgcaaggaaaaaaatacactgtttataaaaaacaagccgcttattaaaatagaaacattgtcattgacatgattatgcatgaaaaacatatattatcattagaatttttttacccgttacaatgcacaaacatttttgctagtaacaaataagtgtgaaattataatggtataaattcaaatagctgaatagtaatgatatatttcaaaaccgtaaaaattatagtggcataacccatacaaaatacttgctgtactagttgctatggttgtacagctatgtttggtttcgaaactactaatgataatcagaattttcaaagtttaactaaatcttatccaaatatcgaatatttataactgtagagtacttcatatataacacatattagagttatcaaaaaaaattcaaggtggaaattacagtagcagagtagagccaacaacaaaataattcagcttggacaattagtagtagtgactagtgggctttacacagccaaataattcagagggctgcaggaat

SEQ ID NO: 80976 - DNA, 13331 bp, Oryza sativa
  unsure (1)..(13331): unsure at all n locations
aactccccgtccgcgccctccccctcctcatgcctgggccgctccgtcctcatcgccgacttcccccacgccggcgggtaaaaacccctccctctccctctccacccaaaccctaatctgcctgtgttcaccgccttttgcgcttcctcgcgccgtttggtttcccacctcaggaggggcttggcggcggcgcgggacctccggcgcggcgagctggtgctgcgggcgccgcgcgccgccctgctcaccagcggccgcgtcatggacgatgaccccaggatcgcctcctccgtcgccagccacctcccccgcctctcctccgtccaggtaatttcatatgcctatgtcaggctgtcttcgaattgacttgagttgttggatggtttcgatttggagtgcattgctctcgttgtttccgcaacagtggagtgcgttgctcatggtggtggtaggttaataccatattaaatctttggatgcaccggagaattcgcaaaatgtgccggcacgataaaggcatcatgaatactggagttggaataaccatatgcttctcacaataaatcttgtgaaataaatttgtgcgaagaggcacggccttggctttgagaagaccagaaacaagtctggccttaagcgcaccgcagttgcaggaaccaaatgctgcagacagttggtgtgctaagagcaggtacaatagcaggctataagccagctgcaaacatattttaaggagataaatcaggagagagaagagcagcgggctacagatttgtagccagctgtagcacggactccaagacgcagtgtgtctatgacagttggggctaggtattaatagtgtagcatgtaactattgtataaatgagctattagattggctatagatgagttggagttagtagttggctaaactattgaacttgctctaatccattagattggctctacatatgttgaattggtttcactattatgtttcagtttggacaaaaagattggatggatttggcaattttggggagggtaaaaagatcacactaacacatactagtaatttactagataaaatgaaaatgaaaatcttcgacacaaataactctatcgtgatgtcttgatgattctattttttatttgacttcgaaagtgtcaactcaatcttggcctttctatgccccttttgatcttgtaagggcaatgaaagaaactttcatgcttggtctccttatcacatcttttcaattgcttcaatgctttcactgatattccctttgtatctgagcagaccctgatcatatgtttgttgtctgaagtgggaaaagggaagagttcaaattggtatctatatttgtctcagctgccctcctactacactatcttggctaccttcaatgattttgaaactgaagctctccaagtacaactcggtagttctgtctacaaaattttagttttccatttcgattgcttcatgttacattcagcttacttcttttcaggttgatgaggctatttgggttgctcaaaaggctcttcgtggaataagatcagactgggaagaagcaacaccactgatgaaagggttgggatttaaacctaagcttttgatgtttaaatcatggatctgggcttttgcaacggtatagttttttgaattttagctcagtttataccagttctctttgttgtttgacataccagctttgctgtctagttttttgtaagggagtttgtcgtctagtttagttactgcatagaatgaaagtaatggaactcaccttaccttttgttttttaacatggctctgagttttgtaacgttacatttatatattccttgcacggggatagcctttctctttcatatttgacatgctagctttgtagccactacaatgaatctctgctgactcaagaattttataagtttgttagtcttaatttctgttctatattttcatggtggaaaggtatgaggtttctgaagtttcttttgacaacttgaaggtatcttcaagaacattgcatatagcatgggatgatgctggttgtctatgtcctattggtgatttgttcaattatgctgctcctaatgatgacaattcatcaccggatgaagatagagatgatatgatgcatcaggagacaaataagatgttggaccagacagattttgattcatctgagaagttgacagatgggggatatgaagatgttaatgaataccgtctgtatgctcggaaaagatatagaaaaggagagcaggtttcttctgatatttgcctaaaatatatgcccttttttgtctataggatgctcatgttctcccgtatcacattatctgccttcttgttgttctgtacttttgaattaaactttgtcctttcgtacaggtacttctggcttatggaacgtatacaaacttggaacttcttgagcattatggttttcttttgggtgagaaccctaatgagaaaatctacattccattagatttggatttatgcatgatcggttcttggccaagagattccttgtatattctgccaaatggacatccctcatttgcattgctgtgtgcattaaggctttggacaactcccagaaatcgtcggaaagccttaagtcatcagatctactctggatcattgttatctgttgaaaatgagctggagattctgaaatggttggtcaagaagtgcaaggaaactttgcagcaattacctacgactatagaatttgatgataatttgctcgtccttttatgcaagctacagaacagcactagctgcataacagaaatgaaccggtcaatctttgagcaagaatttgctccattcttcagatttcatggcttcaagctggattgttctatacacagtaaactcccagttcgtcttctacgatccctggaaagatggggattagctgtccagtggagatgcaactacaaaagaaccctaaccaagtgtattgtgcactgtaaaagtttagttcacgagctttcgttgcaacaaaatcaacaatagctcaaagattcaagctaactatgttctttagaatgcagaagttcttgatacaacaaaaatcaacaatagctcaaagattcaagctaattatgtttttttaatgcagaagttcttgatacatttttgcttaacagcatgtcaaattgtcaacactcgatagcagggcgaggtgctttcatagttccatgcatcacactttttggggttgcatagtttaagcataacaagcgttctgtggaatgccttctgtggaatgccgctgagatactgataattgattatcaggcatgcatatgatcttgtcaattacctcattcaaagtgtttttatggcgtgcttattttgttttctttcactgcttaaacagttatttttatgatgttgcaagctttttaaaacacaatactgtatgtaattgggagtttattttttgaagtgaactttggatattgcacatacaaacaaaaacttatgtattttagaaattatttaattttcatctaaaaagagagaagttatttaatagcatgctttacgattaataacaaataaaaatctaagaggctctacattttgctatcgacaagtgtccggttttacgaaatgttatcgatgaaatcaagttatacacaatggtatggtacaaacgtctttatcttgtttttgccaccatcaggtttctgtcactttgacattagtttgtttttgtgattgtggacacgcctgacctgaggcccgatgtcctagcgctagcaggcacagttggatttattttctgcatacgagtacccgagggattttagcccattcttacatcttgccctatttgatccatgatagtagccatatgtccatatatatgctattgtgattggaaccctagctggagcccctcctaatccccctccctccctacttggtcccatttgtagtctccctcccacagcgacggccattgcagcggcgcagatgggccatggacgtcgccacgtcgggccatggatgcatagatgaatatcttaagatcatttgagtttgataaatgtattatgtcaaatatgtggccggtacccatcggtttctaggagcttgacgggcacaagcgtagttctatgttgtgccatcagaggtgtcaggtttgggccgggcacaagtacagatatattcgtgtttgacctgagcctaacccaactctttgccatctctaatcctggcactattgaacaaacctaaacgttttggatgacctcaccataaagaccaacatttaaaaaggtaagtggggaccacttcaggacccttgattcttcccctcccagctataaataccaccctagtctaggactccatggtgcaaaactctaagccacagagctagcgacagatagaacgcctgcaaggccaggagcggaggtgctctttgaccagttcgaccgcacgctctcccttaggcttcaggccaaggtgacaatacgctcacctcaaaccccatgtttccatcgttccctttctttttcctacctaattttttgattcttcatgttctttttatgtggatccatgttgttgttcttggatgatgcatttttgcatcagaagtggattcctctcgtttagtttgatatgattttctcgattatactttagaagggttggactgattagggttttttttgttttgtatgatggaaacaagttcttttttttcctcttgtttttcatagtcctcgttggttcctatggtggtttttcaatcgtctaatatatatttgggaatcttgaatttggtacatagtttgtttgtgtcgattggtttttttatagatctatttatctctttttttttggaagtaaaactcgagaggaaggacatggtttgtattgagatgaatagatctatgtattgttacggttgtttgtatgttggttatgtcgtagaaatgatagcttggcttgactcttaggtgaacgagattatgggatatgtgagatagttatattttcacggtattagattgaacaaggatgcaccaaacggttttaaccaaagatgttggaaatttggagggcaacgacagccatgcatggtagatgaggccatcataatatgtggtgatggtggtagcaaaggtgaatgtaatttaggaggagaaaacttgcggtaatagaatatggatatatgggatgaggaaattaattgttgaaaaatatggtgacggccacggtggtggcggcggcggcagtggaggtggaggcgatgatgaagagattaggaaggggtggggattttaaggttatggaggggtcttgttgggccgggcctaatatccatgcctaaaacggtaggttcacattggtcttgggttatgaagggttacaaatctcaaaggatgatcaaatggatcaaaatacactcgaacaaaaattgaaggcccttcatttatagaaaattataaacaaaggactcctgatatatgacagtagcctaaaatatactccttcatttatcaaatgagctagatggattagattgtgggatatgtgaggttgtaataaattcaccatatgttgtagttaaggtgtagggcagatggagcaacaccaaacatgtactccattgatcgaaggagttacgcaaattaaattatcattatattagaaaataatattttactgtctagttataataagttaaaaggtgacacaaccaatagttttggtacaaggatggtgcaaaattagagacaaacaccatgaataacagatagaggagactaggaatgtagggagatggtcttttgtgggttgagcctaactttttactcctcgtaatagtgatctttactagagttgtcgtgttagggggtcatgatgtatgcaaacatcgtttcattccgctatagtctcgtacaccctatgtcacatagtttaatcactaataaacacatgcataaaactatttattaggaatatataactgaccacataaatcccaagtccccaactaagcgctgccatataccaaacatgccatacatccaggaaggcgaagaggtttgacttcacatattgacttccttcccttcatttttcttttcctagttaattaattaattagttcctcaaccaagatgagaaagaacaagaagaaagacaccaacataaatttgatgttgacgtagtcgtgccaaccgtgcacacatgacgtctttagatttggaaattactggaaggccttttcttcctcttctttttttttttgaaagaaacttatttggaacttggaaggtcttttcgctctttaggaaagcgcgcccgcttccatcccagaaaaatttccacgaaggccacgacccgcgtcgcgcgcgcccgtttccatcccagaaaattttcctgtataaataaataagacccacacgaagtccacgaaccgcgtcgcgtgggacccttccagaagcagagcccttcctgtagtcgtcgtcgtcgtcgtcgtctcctcttcgcgttgggtttgattcctcttcttctcgtctcccgcagcggcggccgtcgatcggaatggcgagccgaggagaggccagcaccagcgccaccagcagcagcagcagcagcccggcgggtacggacgcggcggcggcggcggccgcgggcgcggccgggacggggcgccgtactcgggtggtcgtgggcgcggtcaggacggatcgtaccctggcggccgcggtgggggctatggcggtggtggtggtggaggtgggccgccgtactatggcggaggaggtggtggtggtggaggaggaggaggccaagggcgtgggtactatgatgatggcggcgatggccgcgggtaccagcggggcatggagggaggcggaggccgtggaggttatcgcggggacggcgatggtggctacggacgaggcggtggcggttatcacggggacggtgagcgtggctacggccgaggcggtggcggtggcggtggaggcggcggcggctatcgtggggatgacgagggtcgtagcagctacggccgagcccgtggcggtggcggtggcggtggcggctatcatggggacggcgaggctggatacggccgtggacgcggcggcagggactacgatggcggccgcggcggcggaggaagaagaggaggacgcggcggcggtggttcgagctaccaccagcagccgccccccgatctgccccaagctccggagccgcgcctcgccgcgcaatacgcccgcgagatcgacattgccgcgctccgggcgcagttcaaggggctgaccaccaccacccccggcgccgcgtcgtcgcagttcccggcgcggcctgggttcggcgccgccggagaggagtgcctcgtgaaggtcaaccacttcttcgtcggcctcaagaacgacaacttccaccactacgacgtaagcatccacactactacagtccacagcatctccattcccatctcctcgtcgatcacctcatcaccgtttgttttgcaggtggcgatcgcgccggatccggtgctgaagggcttgttccgcacgatcatctcgaagctggtgacggagcggcggcacaccgacttcggcggccgcctccccgtctacgacggccgcgccaacctctacaccgccggcgagctcccgttcaggagcagggagctcgaggtggagctgtccggcagcaggaagttcaaggtggccatccggcacgtcgcgccggtcagcctgcaggacctgcggatggtcatggccggctgccccgccggcatcccgtcgcaggcgctgcagctgctcgacatcgtgctgcgcgacatggtgctcgccgagcgcaacgacatggggtagaaagaactcgatcagctgcctcgattgagatctcttgaggatttcgtaaactgggaattgatgaattcgtgtaatcgttttcgttttgaatgtgcaggtacgttgcgtttggtcggtcttacttctcaccggggctcggatcgagggaactcgacaagggcatctttgcgtggaaggggttctaccagagttgccgggtcacgcagcagggcctttctctgaacataggtcagatttgtgtttcagtttgtttctgaacttgtacttgatcgagtttacctgcaattcatgagaatgattaggtgatggcatttttttttgcagacatgtcttcgactgctttcattgaacctggtcgggtgctgaattttgtagaaaaagctattggacgtcgaatcactaatgctattactgtgggatattttttgaacaattatgggaatgaagtgtgtaatccaaatgctttcccccatgatttgtttgcgtggagttgatcttgacttgtttttccgtgcttcgtgaatttgcagttgatgaggacccttaagggtgttaaggttgaagtcactcaccgaggaaatctacgcaagaagtaccgcattgctggcttcaccgagcagtctgcagatgttcagacgtaaggagcctagcttaccttctccctgatcttaacagtttctgtgtaatgttgctatttgaattctcttgcatagcttaaatcttaccaattattttgttggatcccaaaactattaaggttcacatcatctgatggtatcaagactgtcaaggagtatttcaacaaaaaatacaatctgaagttagcttttggttatcttccatgcctgcaagttggcagcaaggagagaccgaattacctgcccatggaggttcgtgcatatacttcacatttaactgaaatgttcgattcttttctacatcctctgcctttacacatgctaattctttgtgttgaaatttgatttggatttcagctttgcaatatagttcctggacaacgatacaagaaccggctcagtccgacacaggtttccaatctgattaacataaccaacgatcgtccttgtgaccgtgagagctccattcgtcaggttcctgcttatgcttattttctgtgatattttgtcaggtttttactgtgtgggtaaatacgttttttatttctctctaacccatctttcctttttcttagactgttagcagcaaccagtataacagtacggaacgcgcagatgagtttggcatagaagttgactcttatcctactactttaaaggctagagttttgaaagctccaatggtaatcctacttatttttttctcatcagtatctccttttgtttttcagtttttccgtacttctgtccttacatttgtgagtaatgttgtagctgaagtaccatgattctggaagggtgagagtatgcacgccagaggatggggcgtggaacatgaaagacaaggtacatcatgttgaactgaaacatttcttaaactttttctataatgttttgtaaatttattactatatcacagaaaatggttagttttagtgatggggttattgttcttcatctctctagttttcaaataaaagtattgatgactattactgttccattttgacacctaacaactcttaaattattaaactgatgaactaccgaagtttcatgcctatatgtctaagatacaatacacttcgataatactactatagcataagttttcttttttctaaaagagatgagtggtctcgatgacaactatttacaaatggatggagtacctgtttattgtctatagttgagtgttgatatgttgccagacaagctacagttggttcagagtcttggttccctcaaacttcttatttgcttaaacaaaatctgtagagctcttgtggattgttcccaaaaagagaaactggttggaagatcctggtctaccaaccctgtgcaatattttgaagtttgcgcaaatagttttaggaactgatttctttttaggttgtatactctgtctattccatttacccccttctatattcttgtcttctctccacactgtttgaacaattcttttgatgcgcagaaagtagttaacggtgctacaattaaaagctgggcatgtgtcaacttgtgcgagggtttggataatcgtgttgttgaagcattctgccttcaattggtcagaacgtccaaaataactggactggtaatttagcttttcatcatcctctttttgctgttttgatcattttatttgatgtactcttagctaattttttactttgatttcaggactttgcgaatgtgagccttccaatattgaaagctgatcctcataatgttaaaactgatcttcctatgcgctatcaggaagcatgcagctggtcgagggataacaagattgacctcctacttgttgtaatgacagatgataaaaataatgccagcttatatggtaactagcatccaaattcgctctaatgtgtggaataatattattcattaatgtctctttataggttagagttatattggctattcaatatagtatcttcttctaccatgcatctactctgttataattttagccccaacaaagttcttaaaatctctctgattaaattgatgttttttttttgctttttttaaaggaatatgcaagcccagtttaacaaaattagaattcgaatagcaaatatatatttcttgtcttgaagaaaattctcacttgtgccatgcctgatgacacttataaccacaggtgacgttaaaagaatctgtgaaacagaaatcggtgtattgtcacagtgttgtcgagcgaagcaagtctacaaggagaggaatgttcagtactgcgcaaatgttgctcttaagatcaatgccaaggtaaacttgatcacctcccagaatctttgtttcgcaaagcttattgaaccacaagattcaagatgtaatatatattcaccatgtctgcaggctggaggaaggaactcggtatttcttaatgtagaagcaagtttaccggttgtttcaaagagcccaactattatatttggtgctgatgttacccatcctgggtcctttgatgaaagtaccccttccattgcttcggtaagatatatatatttctttctatcagaaaatataattgcatctattactgtaacagctttcatctgacggggttccatttaggttgttgcttccgcagactggcctgaggtgaccaagtataattctgttgttcgtatgcaagcttctcgtaaggagattatacaagatcttgatagcattgttaggtgagatcttcatgctgctcagctaaattctagaattgcatgccagtgtgccaccatttggcagttctttaatttctaaaatataaaattgcagggaacttctcaatgcattcaaaagggactccaagatggagccgaagcagctcattttctacaggttcatattctccatgtttgtttttttttcttaattgtacgtgctcctttgttgatcataccgagacactgataattgtcctgtttcatcatcagggacggcgtaagcgagggtcagttccagcaagttgtagagagcgaaataccggagatagaaaaggtataagcaatttttttcttttcctggttacgactctccatggttgtaatcttgtatttttttcctgctctatcaatagaacttcgcaccgtctcgtgcgagtcgttcaaaaaatttgatgactgaacagtgcaaaacgttttaaccatctggttaaaaaatatttgttatcgtaattcactgtttcttcaggcttggaagtctctgtatgctggcaagccacgaattaccttcatagtggtgcagaagaggcatcatacaaggctgttccccaacaattacaatgatccacgcggcatggatgggactggaaatgttcgtccaggttgaaaatcgatggcctctcccgtaaacgttgtttaattaccctgtttggtcaattgcctaactcgtttttcttcttctgtaaataaattccaggcacagtagttgatacagtgatctgtcaccctcgagagtttgatttcttcctgtgcagccaagccgggatcaaagtaagatgcctattgcctatagcacgctgcagagtacaaatgagtgaactgtcctctagtctaattacttaatacaagagggtgccctaacgatgtttaaattgtaaaattgcaggggacaagccgtcctagccattaccatgtgctgcgcgacgacaacaacttcaccgcagatcagcttcagtctgtcacaaacaacctgtgctacttgtaattgtgctctgctcttctttgccgtgattgctgatgtctgcattttgcactcgcgcggttgaatgatgacttctttttttttgctgtttactcgacagatatacaagctgcactcgctcggtgtctattcgtaagtcacttctctcttagctatgagctctgttttatcacagaagagtattcaaataagcttttctcctaaaaaaccatgaatgtctgcatttttgattcttttctcctaaatgtccattgtgctgcaaagaacttgaagtttttgtacagtcataagtcgagtgaaattctatcaaactcaagggtagttaaataaatgatagaactattgggctttccaaagaacatgaagagggatttaggaatgcatgaatggaactagagttttttttttaagatagtcgataaagtccggcctttactactgctacaactatctcaatttgtcatgctgttctgtcttaacattgtcttgtttgctgttgcagcacctcctgtttactacgctcataagctcgcattccgcgctcgtttctacctcacccaagttcccgtcgccggtggagatccaggtgctgctaagttccagtgggtacttccagagattaaggaagaggtgaaaaagtccatgttcttttgctagtcgtccttgtgcccccctgaaactgaagcctggagccagccggcaagctctggaaatgctctgaataatcaaacttggaagaataagcacctgcncaggttgccattcgtttccatgtggcatggaggatggcatcctgaaaaggatattgtcatgtttgtgtggtttttaaacgacattgaagtttatctccggtgttactatctcagcactttggatgttttattttgttatgtctgaagatatagacacaaaacttcatttttgtttctgtttctggtgattctgcttgccgtttatttttctggatatgcaagctaatttatgcgtaccacaaaattgttttttaaaaaatataaaacctcaatttgtatttaaccatctaaccttggcacctcgattgtgtttagtataaataatttctaaaatttaaattcttta

SEQ ID NO: 80977 - DNA, 27128 bp, Oryza sativa
caaaattttaaattatttttaaaatttatttgaatataaggaggttaccgtggtttttcttttaccgtaccctttcagtaagcgcggtaaccatgcggttaccaatggtttgggaaacaggatgaattttctagctggttaatttgatattgatttgtcttcgaaagtgatatgtgtttaacttgaaatccattttagaaatttgattctgtttgagatgaaaggagttttgagcaccactgtaccatggcacaatttctgtaactgaaactctgccggcagaggtcattacattcaaggtctaattatctatcggtaaaggcttcccccgaccattgtccgacagaacttgtggggtcatggtgtcatgtagtactcctcatggttagggcatgcagcttgaaataagtgctaagtacggtcgatcgatcgattaatgcagttgcataaatcaggacatacacatccacgaaggctctacatattgagtgttatgtttggtgtacacaaaaatgtcattgtaccgtggaaactgtattacgataaaaccttttcttttaaaaaaattcataacatacagacagggcacatgggtactgttcttttgttttaccgtaaggttatagttttcagataaagtgatacttatctaaagttatagcaaattagtatcctatggtttgaaggctatctcatgtttacttaattatatggacgaggcgtggttgttacaataaaatgaccaaatctctcttcgtaatcgatatactataccttgaacgtaaatctaatttgtttactttggacatacaatataatattgcaaatcatgaaagggtctgtagcctagtagttacaggaggttccgtagcacctgaggtcctgggttcgactccctataggagcgaatttttcaggatttaacggcgttgcgctttcaatgatttttcaggattttaatggcgttgcgctttcaatggtagggcgaggcgcgagtcttcgaagatgttcataggggtgagtgcgcgtgcgttgtgagtttctgtattgtactgtgtaattctaaaaaaaggtataatattgcaaatcgaagtgttttctttcatactagtatgtaaaaaaccaaatcctagctatgtgtgtccagatttctagctaggattttttttttacggagagtacttctttaactagacaaatcattttgtattgggagttgtacctgtcactagtgctggtaaaattctatccattgaatccttaaaattcacaaatcccagttatgtgtgtccagatttttagttaggatttgatttttttttacggagagtacttctttaggcagacaaatcattttgtattgggagttgtacctgtcactagtgctggtaaaattctatccattgaatccttaaaattcgtatattagagatacttgccgcgtccttgaatagatatcatttcagagtgcatatatatgtagtgaaatttaaaatctttgccccgctccccctaacacgtttcgaattagtacactaaattcaaatgtgcatactaatgaaagatgacaaagagacactttcctggaccacatcacactactacatgattgattttcttgaacgccccccataagtgaaattacacggaaaaatagagggaccgacaccagtttatcacccgcacaggaaaatcaattttcgtgtacgggccacttaacagacccacacgcaaaaataatatgtgcaggtctgctaagtgacatgcacacgaaaatagcccaccccacaaaaataaagtggctccctccacccggctcctcccacagacccacacttatcctcatccctcccacacttctccctctcctcctcccctcctcccatcgcgctctccctctcgtcctcggcgacggcggtgccctcggctagggtggcggaggcggcggcatcgactacggctcctcccccctcccatcgccctctccctctccctattgtcctcggcgacggcggcgccctcggctagagcggcggaagcggcggcactacggcaacggcatcggctacggctcccccctcctcccatcgccctctccctctccctctcatcctcggcgacagctatggctaaggcggcggcggctgcatcggctaaggcggtggcagagcgtatccgtggcagaccaccgcggggaggccggatccgtggcctgccaccgcggggacgacggcgacgggcttcgggaaggcggcgacgatgacggcaggcttcgggaaggcggcgatgacgttgacgatgttgattttttattagggttcgtgggtggattttgattcttttcccttttttattattccgtgcggttggtataacatgaccgcacgggataatcgattatcccgtgcggtcagcccgcccgcacgcaaaaatggcgatttttccagacgaccggctgcaaacgggccggacccccgcacgggataatccaaacacccgcatggaaaaatgggtattgtagtagtgtcaaccaaaaaggagatacattcttcatccaaaattgacgaagattttcatgaccgttctaaacttcaagcatgcaaaaatgtatgaatttcttgtcgttatcacaccttaatttgttatatgagtatattatttagataatggataatccgacgtttacttcaaatgaagatatagccactcttattacaaagttcttagataaaccaaaagcaaaagttcaacccaatcaagttgacgagaagatatacttaattaaccacaatcaaccacacaaggagacaatttgttcaggaaaacaatcctattattatatttatgaatatatatactgagattggagagtgagataaagtgatatatgtgagtgcatcaccactacagattctatttttcaatgcagccaaaatcgattttttaggcgagtgggtggcccggtgtctgtgaaaaatcatagttttgcatgtgggtagagacgattttcgcatgaggtcacttatagcgaccacacgaaaaaataattttggtgaaacaaaaataagattccaaaacaaaaaaaaatcagtcgaaaccctagcctaccgccagcagaaaccctagcttccaaggcgtcgtcatcatcctcgacgcaacaacagtcaacgagggctggtgccaccagattcgccgcccctcgccgttgtcgttgtcatcgtacttatcctcgtcgctcgaagtaatcgacggatcctcgcgtgaggcagggtggagtagtggcggcgagatccatgcgggagggggagggggcgccggatccgccctggcgtcgctgccactggcagatccacacgcgtaggggccagagaggtggcagaatgctggaatccacgcgggagttggaggggccctagattcgtccctcccattgccgttgccagcggatccgcttgaggggggggggggggtagagcggcagccgaatccaggtgggaactaaagggggtgggatccctctcatagtcgaccgccaccgttgctgccgccgccattgccctagcccgcctcgctcgagcctacgaggagagggggaggtgcatgggggagaggtggagtggaggagaggagagggatggttgtgagtagtggggagagtgaagtagtgaggtggatgagagaacttactgggagagagaggagaggagaggagaaaaaaagaatgggaagagagaggagtattttcgtatgcaggccacttaagaggcccgcatgtgaagataaacttattttcgcatgcaagcctcttaaaaggctcacttgcaaaatttgattttcatgcgatctttaatctctacacgggagattgagttttgcaggtgggaacaattatgatccacatgcaacctaaaggggttcgttcagaaaaattgattctgtaatactgcattgtcagatggggaaggtcaatgtggaatcttcaatttataccttccatatattggtgttatcaatcaggcaaggtatggcagaggggttgttgcgttgttgtcacaagttcttccacatttatagttagagaaaaaagatgagtagttttcctaaaagaaaaatactcaactaccgtatctgaatggagcaattatatatctgatgtgtcagtttttttcttgggttgttacacaaagcacagtttttcttattaattagcaatcaaaaaggaacatatatatatatatacatataatgtacacctcacccacactagaagcttgaacctattattgatgttcatgaatcttacggaaggcatatactcttctctccacagctttccttcaaattgttaatggtcatgcaaaaagaggaactctaatccaatttgttcttttaaaaattcctactttttaaagacatggtaagttgatgattaatatcgatgaaacgtactaatgggctatgtaaacaacaagtaaaacttgctctttgggttcatttttgtatgcacctggtaccaaagattaaaaaaaaacttgagtctttttgtgcgcatccttactaccaattattgttttttacaatttaaaaagttaaagttcactcttccgtatggtaaggggtcttgtccttgtcataaaatgagggcatttggattatagaggggtaccctttagaacaagagaaaatccataaaatgccattgacaaacactctaatcccaaaaatgccattgacaagtgcaacttccttaaaataccatcgtacaaacgtttttctcccagagatgccatcacagccatactgctgttaactcctccccgttaagtggtatgaaaagacaatcttacctctgggtaatccttttgctcaaacaacatcattttgtattgtttgctcacacaatattattttgaattgatgcctatttaaattcacagacgtgtattatttagatatcaatcaaaatatttcaaaattaaatatcttgaattcacatacgtgaatattttgaattgatgcatattcaaaattcacagacgcgccgccgctgggagcgccacatcgccgtcgagggctgccacaccgccgcctgggaaccccgtgccgctgcctgagggccacgcgccgctgccgccgggggacctccgcgccgccgcccgggagcatcgcctcgccgcctgcgagtgctgccgcgccgccacccgggagcatcgcctcgccgcctgcgagcaccaccgcgccgccgcccgagagcgccgcctcgctgccgcctgcgagcgccgccgcctgggggcaccgcatcgccgccgccgtcgcccgatgttaggtttagggttcttttttcccccaatttcttttcttttaccacctctggatagtaaaaattggagcgagggtaatctagtcattttggtaaaaaaaatttctaacggtgtggactaaacggtaagttggctgtgatggcatttcggggagaaaagcgcttgtacaatggcattttgaggaagttgcgcttgtcaatggcatttctgggattagagtgcttgtcaatggcatttcatggattttctcttagaacaaacgaaaaatatggaatgctagctagtgcctagtagatgatttaaatagtatgaaaatatattccttttgagatagccctttaaaacaaagaatttattcctaaaaattcctttgaaatcttatagaatgagctatattataaggatctcagccaaacaattttgaggatttatgagtttctaaataatgggacatgtcattctattcctacgtgtttcatatgttactatgttccgatgatcttcccgttccaaaggagccacttttagagccacagcatcatggagttggagttgagaagatgagttataattgacaagtttttcatctctatataaaatattagaacccgagcgccaaacatgcatcggcccaggcccaccccaccccacatcccatcatcccactcctaccgttgtcggagtaaacgatttactcctatcgcgcggctctaccacccacctttatttgagtaaacaatttactttgataataaaaacaatttccctgcttccgatcccaccccacgtcccgcatcatgctccgactgttatcggagtaaatgatttacttcgataaaaacaacttctttgtttccggtatatattctatttttcctgttcccaaccaaccactcttgcccccacttcatttttttcttttctagtttgattacatgtgagtaattttatcgcttgtgtgtgattgagcctgtaattttttcattcatatgactattttgtgatacagatcaacaatactcttagtatcagtttttactcttatactgtatattgaactcatcagtaaacatattactacatggtggctatgagatgatggctatatcgagaggaatgtggtaattgttttactcgcagaccaggaaatctcaattttttctcaaatactgtgtattgaacacatcagtaaacatattactacacgatggctacgagattatgggatatatcgagaggaaggcagtaattgttttactcacagaccatgaaatctaaataatatttataatattggtaaaacaattactagcgttgtaagctggtagtaattattttacgaccatctaggtatggcgtcatacgatgtgaaggcattcatgcgagtaaatttgttacttttgaatgagcagatgtgggaggctgggagtaatgaaaaactccacagagtaaattcattacttttaaatgtggcgagataccagaaaaatgaaaaactcggaaagaaaaactagacggtaaatattttactaaaacacaaaaatagaataactacagagaaagaatgaaaaacagaaaaatctggatggttaatattttaccgggcctattgatgaagcacggatgagatgtaaaagagaaaaaagaaacatggaagaaaaacagaaaaatctggattgttaatattttacccggcctattgatgaagcgcagatgagatgtaaaagataaaaaagaaacacgaaagatggggagataaaataaaaaaaaacgaaccaagaaaaggtgggatgcaaaggaaaggtaggtggtaaaaaacgggaaaaccggacagagagggggttgtgcggcgctcgaactaatattccgtgctgtagcgcgtggattagcgctaccgataaaatattactaatatatgtaatattagtgcgtacgtacaggtgaatatatgtagcaaattaacttttccatatgcaattaacgaggcacacttgacattctctgatgtgtaggaacttgcatgcgtcgattaaatatatgtgcacatccacatcatttagacatttacttttctaaattttctcatattaatcctttttttattacttgcatcaaatggctctttgtgtggtctttgggaatcaggctatattctcaaagttaaaatttcaatttaaacaagtcaaaatttgaggacaacaatgtgttttttatgccaaacttttaacttcatacatatgaaatgaaatattttccggtgttataattttaatatatagaactaaacaaataaccacaataatagcttcaaacaaacatagttgctatttttctcttcataaagttagtgcatgacttgacgtgaaagaatgattcaacgttggaatagaatgttattcttcgcaagaagtgattggtgcaataactttgtttccttacgaacaaggagctaacaataaacagagggtattaattccatctcttgatatatatatgacgatggccagcacataagaattcctacaaagtttaatagaaaaatattagctatatatgacaagtggtaaaaggctcaaaggtatgcacatgtcttagttaaacgatatgcatgctatagaaggcttcttttctcatatcacaagatttgctagtttgtggttagctagccataacctagcttttccattatcaagaaaagtcataacctagctaattaattaactgtggcctgaagaacaccctaccattggattgcctccagaacccatcatagccatctgatctttagtttttcctaaataatatttagttttatatatgattgttatgtttttattaagtagccattgacggtcctaaaacttgtgcataggtgtcatgcatctacatctatagacttgaaaaatgcatcttaagcccctaaagatgcgaaatatattcatgcttccaaagttcgacttggaatgacacaaatgttaacatgaagccttcatcaacccaacgctgctgacaagtagggccagccattttttctttctttttctcttctccctcctcaatctcttcttccatggctaaaggcagctggcggacctgggctagtggcttgtgggaacaaaaagagtatctcaagttggtgaacccgtgggcacgtgagtggcctctccgccgctcggattccgcggcggtgcccctctcccgccctccgcccccggatgcggcggcaccgcccctcttccaccctcccctgcgcgacggcggcaacaacaacgacgacgagatggccaggatccggcggcacgcgcctctccgcctctccccacggcgcagcgcctctccgccactcggatccggtggcggcgcccatctcccgccctctgctgtccggatccagcggcggctcccctctcccgctctcccctgcacgatgacgacgacgatgaggtggccgggatctggcggcgaggcacctcttcgcttctccccgtgtcgcgatggtgacaacgacgagatatggcgacggtgacaacgagacgagctgtggtggcggcgacggctacgatgacgacgaacggcggtagcagctagggtttcgattatttttatttttattttttttggatttttattttcgcgtgcgggcgacataaccaccccacacgcgaaaatgcgattttcgcgtgcgggtgcgctatccgtacgcaaaaatcatgatttttttgcagaccttgggtgcgtgcgggccgccatcggcacgtgaaaacctgttttcaccgcgcaggtaaatccttttcctagtagtgacaggagcacatgcatgaggttagagactagtcaagatggctgttaatatttcttaaggatattactaaaaatataattcccagcaatgatactaaaatattcttggcatattatgatttacagatataatccgcaagcgtatgaatatactattgtagtatttcacccgaaagtattccaaggtatcgtatttatttaatcccaagggaagattgataagagagaactatgctaataatttatatgttacttgtataaatcagagtctatgcaatggttaattaattcaaaggggtaggatgacacgaagaaagaagaactaagatactctcaataaataaagtctaggctaggtgaagaaagaataagaaaagaatttattcctatacttctaatatacatgtatctttagtttacactcattagtatataatcatgtagccaataccccctaactatgctctcctggtattcctgattgccgagttccttgcgacaatccatcatggccatccaaccggaaatatatggaggactactcataccaaaaaagtgccttaggactatatatatactaacgtggaggaatacccgtactgagctgtcaccatcagcagtccacctctactgtcccgcaacatataaccccaaataatgatatctaataatctaagcaccatgctcacattattaaatactactctatacctcccggcaagacatagggcaatcattcacatgaacattaaacctacaccaatgcgtatctctgttaagctagctacataattatatgggcataagtatgaagtaaagtcgtaaaatatggaagctgaataaagaagaatattctattaattctataagtcttacaaaaagagagagaaactactagagtcatacctgtattctcctgaagactcgaggactatgaaaactattctaattctattccactagcattagcactagaacactaactaaacttgagagagagctcttgttcttattccttgagtgtgtgagggaaagagtgaggtaaaccctttatatagcctcccaatgacggttaaaacggttggaattgtcggaaatgcccaacaaccgctattgggagtgcatctagagcattgacctaacaccatggcatgtctggtacatgctcatgccgggctcctaatggccatattcatgaagatagcaataacaagataacaataaaagatgaggaggaaaaagaaaaataggacaaggaaataataaaaaagaaattttgtaagtgaatcccacttgtcagctgatttagggttagtgtgatatcacgtaagcgtccttgtcgtatgtcacattggattttggacgggtgttgacacattcagtaagtctaggatttaaagatgcattatttaagcttatggatcttgatgacaagtacacattatttaaggactgttggcatattttactcgtttttagtttctatccgacctttggtttttcacaactgagggcccctttgaaacataggattgtcaaaactcggaataggaaaaacgtaggaatagaatgtcatgtttattggattcctacgtgatttgaaaacacatgaaagtttccaaactaccgcttgatagtcacacaggaaaaccgtaggaatttaagacacgggaagaagaaaacataaggtaagacttcgtgctaatgttccttcaaaattcctctacaatagttcattccataggaatttcaaagaaattgatatgaaccaatcaatcctttctttcaaaggatttcataggattatttcccataggatataaatcttttggaatttctatgttttttctttgtttcaaaagggccctgaacttttcatttatctagatctttttactagcgatggttaccttttcttttcttttctttttagttattgttttcaaggttttgctgccacctgtaggcatgggacttgggaaggtgggggggtgggggggttagacagctacagagacaacgacctaaccctaattatggctagggaccttagtttcatcccaacaaggttaggaacttgcaaagtacgttttcatgttgtttgcagtacagttttccgattattatctttccagttagtggtatgtgctaagtgcactctcagttcatcaatcttatcaacaaagtgactcagataatccaaatatataagtaactagctagctaaattaaatgcatagcttctccttagtggtggttgactttgttaattacttagctagcatgcatgcttgcgcatgatattgcagataagtcacattgacaagtcaactaattaatgacagtctctagctgtcgatcatgtagtgctatacagaggcggttaagttttgacacatcgaattgacccctcaattagtgagacttgaaggaggagactaattaatataaaagcttttagcttttaattaatcaaccacagtggtgtaccgtacatagttgcaaggtaggaatgcgatgccatgcacgctgcattatcatctaggaaaagtacaccatatgaatgggctgacatggcacaatattatactgccgttctttcttttatataccaccaaagtaggattatgttgggtatgagtgcctgttgtaatattaatttaggacagaattaaattagggaggaagaaaggttgtggctaaaaagttcatcaacatttgtttaacaaaaaaaaaaagcaaatggtagagtgagattgatatccttctcacaaacattccttttggttacggaatgtctttcgtatacctaattaaaggtgtttgtataattaatttctcactctcttgtaccagaggattttgaggtctattacggtgttttttttttcttgctggaggggtatattactgttactagatatagagacttttaactaggaaaattaatttaaatctgaagtatgtcaattaatattataaccttgtatgacttaccattgaaaatctcagttgcacatagagtgtttgttttccactctaccaagaaaatttgggcacttctttcacacgatgaatattgaaatgtctgatgaagaagcaaaattaaacatgataccaaagctagagagcatatgtaacaattaaagtgcaagctcatagcgacaggtgagtattgttgtagataactaggacctccggattaataattgaggggaaagaattaattggcgtgagacggtggttaacgatgagcggaaagagatcaaattttaggggtgtttagatccatggcgtaaagttttggagtgtcacatcagacacacatttaaagtattaaccatagactaataacaaaacaaattatagattccgcatgtaaactgcgggatgaatttattaggtctaattaatccgccattagtaaatgtttactgtaacaccacatagtcaaatcataaagcaattaggcttaaaagattcgcctcgcaatttacacacaatctgtgtaattagttttttcgtttatatttaatactctatgcatatgtccaaacattcgatgtgacagggtgaaagattttgccaggggatctaaacaggcccttaggggaagagaggccagagaggagaggaaactaaaagttagacttgcaaagtgatcatctgctcaccaaaagaaaagctcaagctatagatagtggagaaagatgtcacacggctaaggttgaggctggggtaatgtggtgtggggagccaccactccccatatcacaaccaccaaccacatatctatatagctctggtctcaagtaaaatgccaagctttcagcaagagtgtgaggaagcttatgtgatggtccaattaaaggaatgcactggttaattaattaaactaattgaagtgaactcctagaaagcatatggaagtctatcactttttggagaggggctcattgcaagtaatccatattcaattctagtgtgttgacaaaattgtcatgattatcagtgttgctagatgtgtatagttatatgagtggtgttttgagcttgcctatcacttctgtgcaaactaaccactatgattggagcaaaaggaatgttctctatggctaggagaagaacaatttgtcaatgtgggatggaaacaaaaagtcatgtcatcaacctccccatgatctgagtccagatcccatagagaactcattactaaaggtaataacaacacaaagtagatttactggtcaattcacaatcaagtgcaagcatgcaaagaaccatatataggttaattagatagttagggaactagtctaaacatgccccacatctttatttcagcttaattggaggcagtttcaatacgaaacctaactacgagctttatcgcctgttctccaaaattgtccatgcatgcagaagttaattaatggcagacggcttgcctacatggcagttgatggagtcaagatcagggcatatatcatcgatgggggcctactggtgccatttgcacatggcagatagccgcttggatgcaatccatcttttaagttgggatccagcaatgatgctgcactaaaggagttgttttggacaatcggttatatatgacagtatctccagtagcaggacccaaaacaggttgtgttgggactagctatacacatctgtcgaaaaatttgtcaggtttaaatataattcaatcatagtatagttgcattgtaatctgtatgtaactataatacaatttatatatagctttaaaaaattccacggtaacagcgaaggttacgagactgaatctcctaacatgtgtccatactatgatttttcttctttccaactcgcacgaattttgaagtaaatataacggtttgaaattatgtgataggtatatataagttacgctgtagttacatataagttataatgtaattatactacaattatattatatttatatttaacaaattttatcaacaaatatatagcaatatcaataccaaatagtttttaggttgagggcccaaaactatagccccaatccgcagttatggtggcggtggtgggaggacatttccactagcccccgcccatcctccctaatgtgcaggcactagcgcaccgttaatcctactccagcggtttcaaaccgactgttgccttccttgtcctccctgcataaccaacgtgcctcttgagctcgactgatgacgttccaccatcctaatgccacgctaggagctcaggtggatgtgcttctaggaatcatccccaagcacctccacctcccaagctccaagccaatcagccatgcatgtcaccgcccttaccacactactacaaaattgatttttttttccgattgagactccctctagattacagttggaccataacagcccccatatgcaaaaatcactccccaaggatggttcaaggacatatgacaaaatcaattttcgtatacgggcgtctgaacatgtagcgcccgttccgtcgtggcgcctagcgggaaaattatctcttaaaaaccctagttgcgaaatttgtttccttgcttgttgtctagtgtccgtgccatctcagatctcaatccccgatctatcgtcgagtccaattccgaatccaaatccttccaaatcaatccctccgcaaaagtctattttgcctcccccggggtcgatgggccgaatctctctcggcccacctccccctccctcccggcgctctctctctctctcttcctccccctccgctccgccagcgcgccgcgcgcgcgtgcgcgagcgtcgcgccgagcgccctccgctccgccgcgccctgcccgcgcgcgtgcgcgtgagctggccgcgccgagccgagtcctcctttccgcttcctcgctgccgctccccgcgcgtcgttcgcgcgcacgcccgcgtggtcgtcgcccgcgtcgcgtctgcgccgtccgcgcagccgcccgatcccgctagccagcgcgcgtgcccgagccgcgccgctcaaaccaccgtgccgcccgttgtttccgcgcgcgcgtgccgtggtggccaaccgcctggtcgctgccgccgtcagccccctgccgcgcctgtcgctcgtgtcgccgctccgctccacaccgccccgccgtcatcgccgtcgtcatcgcctcggccccgcctctccgcgcgcaagccgctaagggacggaggcagagctccccctccctctgccgcgtcgcccccgctcccctcctccttttcccaaagaggcaagggacaagccccctttccctcccctttttttttctctttttccctctcgccggcgtcaccttctgtcgccgttttggccgctaaccggagcaccagctcgccggcttgaccgtccaatgtcggttcccctctcccaaaccgacattgccgcccatttaaacccaagcccctccccctccaatctccctcgttttcgtctctcgccgccactatcgcccctgttcgccgtcgccgtttgtcgtcgcgtgcgtgccggaggagccggtgcgcactaggatgcggaaggggactccgggcgcgccctcttcttcctcttcctcggcccgaggccggagagtttactcccgcgccgtcggcctctcgtcactgcgccccgtccgcatggtagtgcctccctccgttcttcctcctcgctccatctctcccctttagttttcggtagtagcacgagtagcctccccgtagctagccagcgccgccccggccgttgccaccgctcgccgtgtgcttgccgccgtcgccgcccgagctcggaagcgccgctcgtcgccggcctcgctcggcgtagcttcgcccaatccgacgctagcaacggattcccatagccgcgtagatgctctcgccgccgggaattggcccctcgtgacctcgtcgccgttttccccttttctctccgccggttgccgccgccgcaatccgccgccgacggactccctcctgcgaatccgagccgttggctcgtctcccctcatcctgagcaaccacccggtgtactcgctttcaccggtatcaccgtggttcgctccgccgctcgccgctatcgtccgccgtccgttccggccggcgacggcccgcgtggcggccacgtaggcgccacgtcggcgccagctcgccgagatcggatcgggccgatcccggtcagtccctcccgtgcgcgcgttccaccgcgagccgtgaggctgcgcgtgggcccgccgtatccgcgtccaccgcgaaccgcgcgcgtgcaccgcgtccctcccccaccctagcgccgcgccgcgtgctccctccgcacggtgagccgagccgctgacaagcgggtcccacccgggaccacgcgtggtgagcccggtccaccggccctctctctcctcccctcccgcgcgcgcgcgcttgggccgccttgggccggccggcccatttagctcggccggaccgccccatctctctcgggccgcgccctagccgcccgaggaaaagtctattttccctccctcttttcctttcttttcttttctttttcaaaaaggatttaattaaatccttttcctttagaccaaaaatccaataatcttagaaattcaatatcttcccaaccgtaaatccgtttgactccgttcaacttccaaaatttctcaaatctcgagatctatctaatggcacgcttagaggtcattaatagggctttattttcgccgtttgttgagttgtcccgtttcgcgtgtagtttcggagcccgaagacccgcagcgcgaggatttcgaggatcaagctccagatctcgagcaaggcaagccacctttgaacatcttgagcctatatttgaaatttaattatgttgtttgaaaatattatgcattgataggatcgcacttaacctgttgtcccgtctgcaaggcagattggcggacctacctaatttgttgcatttaatccttcctttgttaattgtgataccatgtccccttgtaaccatctagttgcgcctcgatattcgtgcactctatgcaagtatcgacggtcgccttcaaacttaaaatctgagtaacaacttgggtaaaacttgggttttacaaaagacttggaaaacccgacacctgggtcggtgcttgcgaactaaatgaatttccgaaaccgcggaccggagaacgtaccgggtgtatggttttccgctcttgcacttaaggattgtttccttggaatttcatccaaacataagacaagtacgaccacatgggtggaatgggacacccctggctgagtaactagcttatcaggggagccttgatgccgagagacatgtggattcgccggggtggtgtcggggaggacccctgagcttcctggcacagtatggtctgggacctaacctattgttggtctgggacccctctcgtcggcatatggtaaacctgtgtcggctttggaaatgccttgtcatgaaagcttggaggtctcccgatgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggaaaggggttcgatgtttgtaaaatctgcagctgatgggatcagctaggcccgggtggccgtttgaaagttgttggcccgggtggccgtttgaaaagctgttggccgggtgccaaccttgttttcaaattttaaagactgatacattgcacatactccgactggacgagacgcactgtctcaaccgtgtcgtttgagaagcactcacttagttgtttttagaaaagagttcaaataaaatcaactgcaaaaacaacagcctttccttgaagcctgcattaaacacttatttcccttggcttgctgagtatacccgtactcacccttgctctatataaataatccccccagttgctgaaaaagatgaagcggatcctgctgatgatgagttcttccaggagcaagccggctacgatgagttttagggtttcggcctagttcccaagtcgcgcctgtgttggttggtcctagtcctggtttccgtttcccttttgtaatgcagttgtgagctcgggatctgtccgtagcccaacatgactgtatctctactctataataaagagaccactgttgctgtgatattctgtctccctgtgataccagcactgtttcctgggacttgtatcgatcaacaggttaatttggagcgtcacgggctagttccggtcgggattagttcggggcgtgacagaacagggctattttcacatgcgggcttcttaagacacatcaatgcgaaattacccctctctctctcccactcccacttcaagtccactcctctcttctccccactcctgccactccctctccctacctctctccctctcccaacaacggtgggcagcggtctcaagcgatggcaggcggcagcgttgccattaaaggatagacttctctctagtctctaccctcctctctgtctactcctcggcttctcctctcctgatggtcaatgggcatgggatccacaaccaccaactgaggagtggtgggcagcagggtggagggtgaccatgacgacgtaccagatacgtcggctacaggctctgccggcgcggatccagcagcgatgggaggtgatagatcctgtcgggacgaatccaacggtggcagatccaacgaccgcagctcctgctagggtgggtccaacagcaccggtactgggaggcggcggatccgtcagccgcagtcctggccaaggtggatcccttctgcccctaccactcttcatctcctcgacggggacgacatctatgaccacgacctccttctcacgacgacaacgggcggcggcgtgggcctatcctgagtggatccagcgggctttgggcagcgatcgagtggcggagaatctggctagggcttcgattttagaattatttttatttttgcagggatttttttctttttgcatacgggcggcttaactgaccatccacgaaaatacaatttctgcatgcggctaatctaaacgtatgctaaaatactgattttcgcagacacttgggtgtaggtgggccacccacctatctacgaaaattgattttgacagcaaggaaaaatcgattcagtagcagtgtcatagtaatccccacctccaccatcgcactgccgaccacctcctggtgcctctccttaagctatagccatgccgctactctccctaccctagtatttgccatctaaatttatgaaaaaaattgttgtggttttgaaatttcgaatttgaatatgcatggttgaatcctaagcgttagatattcatatttgaattggtgtggttgaattgccacatactgattaccttggccaacgcaaccgcatacaaagcgaagaaattaaaaaggacaacgatcgatatatgtatatatacaccctaattaattttaatcaacttaactattgttccattagtttgatctggctaactaaagacgaagacgatagtcaagcaactgtagtatcgtaaaatgtctctcacccaaaaactaactaacgagatgatgggcttccctgcttattatatattaggtatcttgcccttcactagtaaaaaacgattttcctggacgaagagctatttagattacagatggaccgttttcacatctgcacgtaaaaatcggcctcccattttcgcttgcggacccttaagaggcccgcacgcaaaatagcgatttttacagacacttcgttgcagatggttagaagatccgcacgcgaaaatcacttccaaccacacggagaaatcgttgctgtactagtgcttccacaatcaatcaatatgagactattcaacagcaactagggccgatatatgtagcgctaagctatagctagcacaagacataaatttatatatggtgtggtcgtctcgtgtggccggccgggggcggtaggcgcgtagaaaaagacgggcgtgaaaagacggcgggtggtcgcgcgtgctccgggccgccacccaccagacatgtcctctcaacccaacccctctctccatcttctcttcttctattcgatcgttatttgttagttttcccggtcgccaccacctactagctgctgctgctgctgctgctttcaaacgccgatcgaatgcatccaaggaaataatcctgggctatagctagagcgaattcgtcgtcagtattccgtggaccatgcagcagcggcagcatgcatccacatccgtttcatgcactagcgtttgtttcccgccctccccacgctagcgcggtcaattctcgcctggccatcatcatgccacaccaaatgtttatcttatagtatatatgctatatacatacaaattaagttgtatatactcacgtatatctctactattataaaaattgatgttatttttaccggtattttaatacgtcatctgtttatgagtcagtttttaattttgttcatttttggaaacgcatatttgtatgtgagttggtttctaagttcgttcatttttagaaatacagaaaggagttctaattgcagctcataattttctatatatatatatatatatccaacggaatttttacagttaatttcatcttactaaaccatatataataataagactaaaatagccttcacccgttgtaatgcacgggcattttttatagtatataaacatatataccttgtgtatattgtttgaattggaacgaaaccgaattcatttatatgggtacacaagtacttcaatttacattagtatctccctttatgataaaaaaccattaaggcaaattttgctacaggacatcacgactttgtggttttagctgtaggacaccgcgtgaaatgacttttaggggaaaacaatatgtaagtgtagttatttgccacgagacaccgtatccattaaattagtatttttgtgctgacaaggctagaaaggggccacttttttacacatcatgatcgaattgcccctcttcctcttcctctctctccctcctttctctcttctctcttctccggcgaggtgagtggcagtgcgaccaccagagccgcagcagcacagggaaccactcctcacggtgccacccaaacgtgaactgtaggtacgccgcgagcagcagccatgccactgcgtgcaccgcctcgacaacggcctccagtagtatgttcccggcggcgaggaacaccgcgatgtcgctgagctcgacgcggaggtacaagaacgagtcaccggtggaggggatctcgtggtgagcagaggtcgacgcggagcatcgggggcaccagatctagcgcctcggctaagctcgaaccaaggagagaggggggcaggtgacgacggcgaagacacaactgccgctgaagaggccacagagctccctgccgccgctgaggaagatgaagatgacaatgacaacaccgcatcgatgagcaacaaccgaaggcggcgagcagcatgctggcctccgccgcctccgacgagcggctcccgaggcggtcaaccagccgtggcacggtggccgtgagcgcgccgtcataggaccaccagctcacgaacgacggctccaggaagggctcgcgagcggcgatagtaaaggagatagagagagaagagagataggagagctaacatgtgggcccaagggtatttttgatatttcatgtgatttctctctcctcttcaaccggaaattattattttaatgagcgcggtgtccaccagcaaatatccaacttttgagagtgtcttcccctaaaagtcactttgcacggtgtcctacagctaaaaacacgaagtcgtgatgtcttgtagcaaaattaaccaaacaattaatactgtctatgtgaatataagcttgtacagtatcatgcattctagtttttatgatcgttgagaggtaccaaaaggtcccaaacattttagagtaaaatctctcttgagtgatataagtcattttagaggtggagttggagctggagctggagctgtgccaaacaggccctaagtcatgataactcttggcaccttttgataaaatccctcttgggtgatataatggattgatataattaatgtgtagtgttcccttttaaataataataaaaaacttaaggtttatgaaattttgagcttctacgaagactaaggttatgtatgttatactatggattatatatggcatactttctaaatttctgaagggcacgatctattgcaaaaacattcttcagcaacattacttcgaaaactctttttaaatccacttttcatatttttctaatatataacttattcgtttctatactctcgaataactgtcataattaaccattcagcactttacactctatagaaaactctctagacgtcgagaatcaattggggcctgccgacgatcgaactgcatgcaagcgaagttgaagaaccctagctagctgagctccaaaccagcactacctaacactaacagccacacgtgcgcgcggctcgcattcagccagggttggtccaaattaaagccaaacagtgccgagagggaaaatgactgtgcctagattccattacgatccatacgatttgctgctgctgctgtggtaggcgattttgacactggccaccagcagagcatgcagctgcttggccggccacgggcgcaggtgcatgggtggtccttcttccatcccaatattcctcaagcgatctgcagatggtgatgctactgatggcgatcgatgtactccatcacaccgaagaaaacaaaattttacagcgcacattcagctagctcagggtcagagtcaggggcatatgcttatatgcatattgcagctgcaaacaaaacaatgctctatcgcactactggtgtgtactgctgcaaggacattcagtagggtgcgtgggggctcaaacgccggtcgtttatatatgggtcccatatgtctgcaggctgcaggtgtttataattcagctggggctttacctccatggtattcatagttggtagtactccctctgtttctaaataacatatttcaggttgtttagcaaatattaaagatattataaaaaaagattccctttcgacatgtcctagtgataaaattttgaattttgaattattgcttatattctccttccaatcatcttgttggttaaatttgcagagggtacactgtgaaaacaatatgatgattgatatatcacactgaacttagtaacaattaataggcatcaattttcatatattcatagggcgagcatgtacatgtagaagacaaaatacccaaagaccactagcgaagctagaaatgttcttctgatccagagatctgcttatcttacaagagtgattttggctcacaaaaatgggcagattaagcaattcctgctaccttctctcataaaaacctaaaaactaggatagattaaaattttcaacagtagggatggattaaattagccctagttgactctgaagagtatgtaagtgggtttgtagaaaagaaaaaacaacaccctttttcctgtcatagtgaggtcaaaattagttgtgtgccgcgtgttcattccatggtctcagatttttcttctctccctggggaatctgattaacctgcctttttggcgcctgcatatccatgaagtggcgatcgacatgagtatgcgtaaagactaatcttggatgttagcgtataaggtcagagatcagttaaaaggaatttcagctttgccgcaagattcaatgcaagcccacacacactactgatgactactgcatgcagagctagctacacactctactagcggctactagcttcttcagtgtgctgagctgcatgtggtcgctttcatgggcacattgtttgctcctttgacattcttctgtggtctttgctgcacaatacctcacctttagtccaaatcacatccatatcactcggcccttttcttttttttttcctttttttttctttgcaaagatgtgatacaccaacaccacatcttgcacacacacaataagtggcatctccctctcagagatgaaattaactaatgcctttgtatagtacaatattgacttttcatatatagctggtaaatatcaatgctaactatatatgtcaaccacaccaacctcctcgatcgttcaagactgagagtcagagagtgtgtgctagcttctaaagaaattgtggatatggaattaacacatgcacaaaatatatacttttggaagtaatattgcttataaatcaaatttgtaataaataaaaattgattcttaaactaagtttaggaaaggaaaaccgtaaagagttgacatataagatgcctcgttgcaaccttttacctagctatagtaaaactagctaggtgcttttataatgtcaatactttttttaaagaacatatatgtatgtagcgagactacagtcgctatttactttagaattttggctggttggagtacggattatatctgagttgacacactaagggcctatttagttcacgaaaagaaaattttttgtgtcacatcggatgtttgaccggatatcggaaggggttttcgggcacgaatgaaaaaaactaatttcataactcgcctggaaaccacgagacgaatcttttgagcctaattaatccgtcattagcacaggtgggttactgtagcacttatggctaatcatggactaattagactcaaaagattcgtctaacgatttcccccttaactgtgcaattagtttttttaatctatatgtaatactctatgcatgtgtttaaagattcgatgtgatgttttggggaaaaaattttggagaactaaaccgatgtaagcgggcgacaaacaaatgcgcgaggggaaggaggatgtggggctttacaaggcttactcgaaaacgcgtctgaaattattggagagcatgatgacaagcaatagatggcaatgttgaaaaaatcttgctaaggttgaagtctccacttgagccactaccacaacaagctagcatgcttcagctcacttacctttcttttttccactgcgcctttcggattccactacatatgagttgagcccaacgacagagaggtaggtcaaaaacttaggtaaagattcaaaaatttcaaataaaagcacttccgaaatcggagtaaatccaaatccaaatgcctatcatgccttgtgatgtggaccaccactaattgttttgttttgacatgctaaagggaaactgaaaaagatagatatgctgactagctgctgaaggagatatttacatgggtggaccaaagttaactctcattctggctatgattggctccatgaccaacttgtgatcaattgcagagaactttgtttttgcctgaaatgcatcacacgactctaaacttggcatgtagcacagctttgtttgtgttctgttacttaggttttagtccctttttctgctgtaacatagggtgcatgcatgcatgtaacaaattagttgtggcatggaatcgttaaaagattgtgtcctggttaatttggttggcatggcttccctcaacagaaattcccatgatcgatcatgagaagcatgtacagctggaaggacaccaccaaggagggcagaatcaatggtgatttctcttgtagttgcaataatgttccttcctttatccttgtatgtgtgcgtgtggtatgtgcgactgcgagaagtaagactaaaggtcgtatgccgacaatttcaagattctgggggtgctttctttgttaaaaaaagttatatgtgtatagtacatgataaggacaatacttggagtatttccttgcttagtccaaaaaaatgttgattttgacttggcttctggacctccaaattgaaattgtattttgcaattaatcttcgccatttcatgcatggtaagcaagatttatagaactgtactatattaacaaagtatttttcagattttggtggcctttatgttgtccttttacttaggattagttcttttctcgccctagggtctgtgggcatgtgcgccatgcctttgtctttttttgttttactagctaaatacatgtactttactacgggtaaaaagggaaaaaatcataatattgtctaaaataaatgaaagcatatttttcaggaaatatgttggccacatttttactatagagaatacttaccttagtttaattatatatataagctatccattcactagtggagaaatcgtttttagtcctgattcgtaaccccctatagtcccggttttcacaccggaactacgaatccaggactaaagatccctatctttagtcccggttggtgttaccaactgggactaaagatgggagtgggcaatagttttttttttcatttacttactatttaatctctaatttattttctcccaaattaggtgagatgcgtaccatcccaaatacacaaatcaatcatatacactacagattatacatcccaaatcaaaccccaaatcaaagaaacatcccaaatatacaaatcatacacaaatcatgtacatctcagatccatacaatgagattccaaaaaaaaattatacatctcaatccatacaatgaaccatagattcttcatctcaatctacacgtggatcacaaattctttgaaaaaaaaaagaaaaagaaacgaagcaaagccgccggccagctgagccggctgccgcctcccctcctccctggccgccgccgcgttgccctccaccggccgggccgcccaccccctcctgctgcgcacactggatcgagttggaaggggagttgggaagggataagaagaaaaagagataaggaggaagggaagagataagattaaacatggaggga

SEQ ID NO: 80978 - DNA, 7369 bp, Oryza sativa
acagtcgtgttgctgctgctgttcgtaaccgcttgccgctagctgctgtctggccgctgtgctatgccgggccattgctgctataccgggtcgcagctgtgcgtcgcttaaacctagccgtcgctttaacccgttgctcggtagttgagttgtctaggtgtaggtgcatccctaaattcctgtcggcctatcgtttgccgtaccggggctttaccgtgaattgtgtctagctcaccggtttagttgcagccgttgctgagtcgttcgctcgttcgttcgaacgaggtgttccccgtgcttcgttcgttcgtccgtgttgactcctcctttagttcagagctaccggttccgttcgccggtttcggttgatcatttgggtgatcccgtgtcacgtagagttgactcgttgagtcggtatctcgtgaggctcgcttgccagatcaatctaagccatccgatcttggtcgactctttgagtcggttgatctcagccgcccaaaatcaatataaatcctttccactctttccaatggcatattaattctttttatcatatgtcatctaccaaatataatctaatctttttccgaaggttgttttaatctttcatctccgttataaatcatttgtaaatggtttaattaatgtggaatagtctttttctttaataggtttaattgtaattaaatcttgtaaaaatcataattaattcatacgaaatcggaatgagaccgttcaagtctctaaatttatctaaaatcaagatctacatgtttgtttacttttatgtactgtttatttggtttttattagtctttttcctcgttttgcgtgttagcttgtcgtttccgtcgtttcgaaggattcgtgaggcgttggaagtattcaagaagactaactgaagaccgaatattgcaaggcaagtcacacagatcccaaacacaattcctttgagcatgttgatcctatatttaaatttcctatttatttcaactgtgcatttattttcgaatgtcaccgggtggtgagcctttcccatttaattatggccaaagatgactttattttcctatgggttataatttgattagctagaaccttatatattggtttggttcagctagatgcttataatagatgcttagccatgcttagaaacaatagctcactaatgggataaatcatgcttcactatcacttatggatatttaatggaagctcacgatggttgatcgtgattggttaattaattaatttgccaactaaaacttgataatggtgggttgtgagcatatggttttgatggtcgtgctcatgataattaaggaccgattcacgagtttcggttgtgaaacattaaccatgccaaccacaagccagcgtgggcaacggctttaccttttgtatagcatggttcattgcggagcaccagactgagaagtggcagagataagcccacgagggtcgctggggagtccatgccttgtttataagggggtgattatgatccaggaacggtgcgctgtggtggattgtgttgtgcgaggggtactgtcacagctcctttctgaggtactgtggtggtattgaggcgcatggtgacatgttgtggggctgtgtcttgtgggtacagtggtacacctctggccagagtaaaactattcgaatagccgtgcccgcggttatgggcgggtctaacaatgtctttcgtgattagtctcacacttctcaccataataaatgatgctataattggtaataatttgattagctcctggtttggaatggtatattcctggtttggagatagatctgtacagccgggtatggttgttcaggatggttgggcctgagcagcatgggtatgctgtttagtgttgattaaaattgatgattaattactctactgttttataattctcaaatgtttgctaaatgctgcttttgcaaatgagccctatattatgccattctttggtatccttgtgcacttgcatatttgctgtgtggcttgttgagtatgtcatatgctcaccttgcaataatcaatcaaacctcagttgaagacaagttgtggaggagaaaacgtttggcttataccccagttgagctgcctgtgggagtggagccggagcttcgctagaccgtaattccgctgctgtttttcttttcttttgtaagtatttacgttattattatgatgaatctatatattaaattgtcagtttgtgtacctcggctgattactggacgaggatttaatgcacaaataagttcggaaattactagtgaatttctgggcgtgacagctttacggaataaattgttgtctaccgtcattattgctttccttcgagagtcccctttccccgtagtctccgtccatggtgtgattcaggtaccccgattgggcgaaggtcttcgataaattctacgcagaattcaatgacctcctctgttccataccccttggcgatgcttgcctctggacgagcacggttaagaacatacttcttcagaacgcccatgtacctctcgaaaggaaacatgttgtataggtacacaggaccgagaataccgatctctttgacaaggtgacaaagcagatgcgtcattatattgaaaaatgaaggtggaaatatgaactcaaagctgacaagacattgcaccacatcattctgcagggcttctaatctatccggatcgatgaccttctgcgaaattgcgttcatgaaagcacatagctttgttattgttgcccggacattgtctgggaggataccccttattacaactggtagcagctgtgtcatcaacacgtgacagtcatgagactttaggtttgtgaacttcttctccttcgtgcttattattcgctttatattcatggagtatccagacggtaccttgatgctctccaagcattcaaacatactttccttctctgccttgctaagagtgtaattggctagactcaagtaatggcttcctttctcctttggttctgggtcaaggtcgccgcgttgttccatatgcttcagattattacgtacttccagtgtatctttcgacttttcatatacacctaggaagccaagaagatttacgcaaaggttcttagtgaggtgcatcatgtcgattgcatggcagacgtccaagaattcccaatagggtaactctcaaaatatagagttctttttccacatcgccgcgtgaacatcttcgctttctataggctggctgccaggcccctttccaaacactactttaagatctttagccatagcaaacattgttttcctgctgcgatgtttaggcttcgtacggtggtccgccttatgttcaaagtgcttgcctttcttctgtaccgggtggtttgctgcatggaatcgacgatgacccatgtaaacaaccttcatccatacagtgagtgcaagccttgtaccccttgttggactgcccggataggttgctaagtgcaggccaattgttgatggttacgaacagcagcgctcgtaggttaaactcctcctgtttgtcctcatcccacacggggacaccttccttcttccacaacagtttaagatcttcgaccagtggtcttaggtacacatcgatgtcgttaccaggttgcttggggccttgaataataatcggcatcattatgtacttcctctttatgcatagccaaggggggaggttgtagatacacatcgtaacgggccaagtgctatggccgctgctcatctctctaaaaggattcatgccatccatacttaaaccaaaccgtgtgtttcgtgcgtcctttccaaagtctttaaattttctatcgatgtttcgccactgcgaaccatcggcggggtgtctcagcatcccgtcctgttgacgctcttcagcgtgccaccgcatcattctagcatttcccttgttcctgaacaaacgccttagctgtggtattatagggaaataccacatcaccatagcaggaattctcttcttcgttagctgcccgtcaacttctcctggatcatctcgtctaatcttgtatcgtagtgctttgcaaacagggcatgcttctaggttctcgtactcctcaccgcgatataggatacaatcattcagacatgcgtgaatcttttgaacttccagtcctagagggcagactatcttcttagcctcgtacgttgtctcgggcaatttgtttccctccggaagaatgttcttgacgagtttcaataaatcgtcaaatgccttgtcactaacactattttttgccttccactgcaagaactccagagtggtatccaactttttgtgcccctactcgcaacctgggtacaacgacgttgtgtggtcctctaacatcttgtccaatttatgggcccccttttcactttcgcattcctccttggcgtcctgcaacatctgaccaagatcatccgcaacgtcgttaccatgagcatctctttcctcctcgcccgtttgatttccttcaaatccagcgtatagagcaaagtccggaatattgtcgtcttccacttcatattcttccatttcaacaccttgctctccgtgtgatgtccaacaattatagcttggcatgaaccccgactcaaacaagtggaaatgaatagtcctggatgcagaatactccttctgattcttacacttattgcatggacaacaaataaaacccttttgcctgttagcttcggccactctcaaaaaataatgcacgccgtcaataaactctgtggaccgccggtcagcgtacatccattgtcgatccatctacatgaaatgaaaaaaaattgtacacaaataattattcgtacaataatgacagtcatataataattataaaataattacaaactctttcaacagtcatacaataatgacatatcattattcatacaaaaattatgaaatattacaccaaataattattatttactatttctaaagttttaaactaatattaatgtgttgtacttcttttaattttcattttagtttgttttctattatttaagattaactttcactatattttccttctcaactattttataaaaccttctttagcaaataaactaaatttctatatattctttcttccccacacaaattttctctatcatcaacttacaacaaaattttggagacaaaaaagtgtgcaaaacatagctccaaatgtaatatgacaaaaaaacattggaggatgaagttactaaccttttaggcacctccgatttgtatataatcaccataataaatttactagaaattttggcatgacctcccctcttttttgaagaaattttgaagcttgctcgggctggagaaggaagaagacatatatataggggttggactttagtcccggttggtgttatgaaccgggactaaagatccaggggggcctgacaagccctgacagcatttgaaccgggactaaagattaccaaccgggactaaagatcaaatatgcccgttaccctttttaaccgggactaaagatcatctttagtcccggtttttgttgcaaccgggactattgtgcaattaggccaaccgacgaaagatggtttctccaccagtgatcatattttatataaaacttctttttattaattatgatgacgatatacggaaatataaacatggtttatagtatagtagtttaagttaggctcacccaggcttcacggaaatcctcgctctgccactagcctcacattgggtgcttgagtaataattgaagaaagaatcttgctatacgtacgaccaagccgtacgatttgtgtccgaccgagtcatgcaaccaatcactgaacttatttactactatgtgggctcagacaaacagcatatatgcttatacttacactagtcagatggatgggtcggacgtataggtcggacgtatagcaatttcgttgaagaaatcaatagactcataaacgattgttttctgtttaaatttttgcagaaatcaatagactcataattgcagaaatcaatatgttcgtggtagtcgtggaagcaactttcaagtactaaggaagacgaaagttgttcctgtagcagtgtagctacacccatttcaatcaatgtgcagacttcaaaaggaactggaagaagaaaatattatagactcataaacgattgttttctgtttaaattttcgcctttcctctgtttttaacagaccgcaaaaagttagtaattggagatactgccctgtacatcatgatgctcaaatgagatcaatatagcatgaccagggaaggtttttttttttttttggccagaaaggttaaaacacttcgctattttcagttgctacacattagtattacaaggaaaaaaaaggatggccataactacaccactgatgtctgcatgattgtgatgtgacacaaaatataatcaaatcacacttcttggttttgctgaaatctatctatggaattgcaaattctgcctacaaattaaaatgttcatgcgagcacatacagtacagggaaaaaaacatccatcatgcatatgccctgaattttgcagacgtataaggaatcctccattggttgttgtatgcagaacattttagccaccatctccatttcagcgtttctcaacctttagatctccagcttctgactgtcatgcggcaagatgaaaaagctaaaatctgagcattatatttggcttccaccatgcatcatgctcaatgcatacataaataacaatttcgaagctacacacaaggagatgtctttgatttcgtgtacatttcgaatttgtgttacaaattactcagtccatcccttcgtatcgatcaatggctgctgcaggatttgggctctataaaatcaagtagttgacttagattttgtgtgatgaaaacattggtagttggcgatatttcaagtgtgaaagattggtttcttgtgataattggttttgtgaagtgatgttgctattgacccctggcggtcagaccggctggatgccacctacatgtgttttatgatcccgacggtctaaccgctggcaaggcggcagtctgactggcgggagtgtggcggtctaaccacaggtgtataggtggtctgtgtaggatcgaacatgagtaaccaagcctaccagagggggtgaatggtagggaaaatcaaaaacccaaaaacttttagcggaaataaaagttaccctcaaatcgaagaagatcttgacgttgtccaatcgccgctggtcacaccgctcctaagccgccggtctgaccgccgtagcctgcccggtcagactgctgagttgtctttggttagaccgttgtactcccaccggttagtctgccgccttactg

SEQ ID NO: 80979 - DNA, 11479 bp, Oryza sativa
ctttagccattggcaccagcctttgtggggcctccttgtctgcctcttttctcctcaaactatgttcactccatactccatgtatgcatcagcaactggttggtgccaatggcttaggtcatgaacttttaaccgttgcagtgggggttcggtgttaatcataaggctaacccttcggttgttactcggtatttatagttcagcatgcctgggtgattgtcatgtgcccttgtcagcactcagcaccctgtgccgagtgtgcgagagagtccggtcagtctctcctttgactggttggtgacggttgttttcccgggaccacctggcagtgtcactgctagtattaatggagtcacgtctcctagcttgtgcggcccagctggttgtcgcattggaggttttgccttgcctgcgcagaggcagcagcagagggcggtgcagcgtgcaggactggactgaactgtgcttcgctcgctgtggccatccgcatgaaaagcccgggattttgcgctgcgtcgtggtggtggtggctcctgtttccaacgtatttcccccgtaccaagttgccttgtgctttacagctagcttggtgtactcccaacatcccccatgcccatttttctgtagggaaatcgatgtgctgctgtatttgtccaactgttctttttcttgttgctactagtagttgtacgagttagggggtgtttgggagagagagggtaaactttagcccctctctcaacaacttacttcctgcgttccaaaaattcctccgttcttaaaaaaaaaccctgtgtccagattcaaattcaggagtggtttttttcggaggaataagtctctcggggagggactgtttttgagagaggtaacccctctctcccaaacacccccttagtgatcagttactaatcctccatttacatttgcatgtgatccttgtttgtcctcaatgatttgtcggagttttgaactgtgccgtatttctctttattcgtcatgttcggtacggagtaaatgaaaaataaacttgacatgagctacgttaacgttgtttatcttacatttttggcgtgcaggggcgtacatcggcgtcaacattggcacggccatgacgtcggtaccggcgccgacacagatcacgacgctgctccgctcgcagaacatccgccacgtgcggctgtacgacgccgacccggcgatgctcgcggcgctcgccaacaccggcatccgcgtcatcgtctccgtgccgaacgagcagctcctcgccatcggcaactccaacgccacggcggccaactgggtggcgcgcaacgtggccgcgcactacccttccgtgaacatcacggccatcgcggtcggctccgaggtgctctccacgctgcccaacgcggcgccgctcctcatgccggccatccgctacctccagaacgcgctggtggccgcggcgctcgaccggtacatcaagatctcgacgccgcactcctcgtccatcatcctcgactcgttcccgccgtcgcaggccttcttcaaccgctccctggacccggtgctggtgccgctgctcaagttcttgcagtccacgggctcgccgctgatgctcaacgtgtacccgtactacgactacatgcgctccaacggcgtcatcccgctggactacgcgctgttccggccgctgccgccgaacaaggaggcggtggacgccaacaccctgctgcactacaccaacgtgttcgacgcggtcgtggacgctgcctacttcgccatggcgtacctcaacgtcaccaacgtgccggtgatggtgacggagaccgggtggccgcacaagggcgacccgtccaacgagcccgacgccaccttcgacaacgccgacacctacaacagtaacctcatccggcacgtgatgaacaccaccggcacgccgaagcaccccggcgtcgccgtgccgacgtacatctacgagctctacgacgaggacacccgccccggctcgacgtcggagaagtactggggcctgttcgacatgaacggcatcccggcgtacaccctgcacctgacaggctccggcgtgctgctcgccaacgacacgacgaaccagacctactgcgtggcgcgggagggcgctgacgagaagatgctgcaggcggcgctcgactgggcttgcggcccgggcaaggtggactgctccgcgctgatgcaggggcagccgtgctacgacccggacaacgtcgaggcgcacgccacctacgccttcaacgcctactaccatggcatgggcatgggctccgggacgtgctacttcagcggtgtcgccgtgatcaccaccaccgatcccagtaagttcacaaaaccataagagattcctgctttccaaacatttggatttgagcttatttcgttctctctgttttcttcaggccacgggtcttgcgtttacgctggaaggtacgctctttttttcccctccccataacgtctttacattctcgcgatgtttgaaacagaattcaagtgcgtttcgctcaaatctgtcatttatttttggacgtgcagtggtgggaagaacgggacgtcgttgctgaacggcacatcgctggcgccgtcgtcgaactccacggcgggggactccggcgcgcaccgggcgatcggggacgtctcgtcgttcgtccgcgccgtcgtcgcggcgctgctgttgagcgtcgtcctcctgttgtaggcagtgagacgagagtggttagtttagtaggcaaggcagcagagtccgtaggaattcatggggggattctttttttggtgtcgagtgggattggcctcggtgttatgggtgggtggtgatcattgagaacgaacaagatgatgtgcctgtgttcatctgttgctctaagatgttgtctgggaacttggtattgggtggtacgttgcctggaaaaggaaattggtactaggttgtatttgcagaaggtgtcagtgtttgtgcgctgaccacaatcaaaatcttcttctgagccaactgcttcactcgtttcctttgttctgaatcgttgatcgattcatggatttttgcggctttccgcttccttcgatcgcgacgaacgcgcggacttgcattggttgggccgaaagggatagccacttacaagaggcccatatagtttgggccggaacggtgtaatgccacagctatgtgcggcccatagataccggcctccaccctaatcgtggtaatcgaggcctataaaacccagcgcctctgcgtctcctccatatcctcgcgcgccgccggatcccgcagccttggctccctccctgttccttcccttccatcaaagatccaatctgaatctgtttcttttctcgtttgcgcttcgaagaacagatctgttttctcgtcttctgattgcgtttcgatgtgatttgctctttttttcgaagcactcttctcgtttacaactcgatcgctgctgattcgaagcttgcgtttctgaagggctgccaaatcatactcgaggatctatggacatgcagcttctggtaatagattcccgcattttctcgtaggtccaacatatttttttttcaatgaaatctatatctatacctaataaaaaaatacgtaaggattccgatatttcttcgtccgtcatcccacgcgccactaaaatctgttttaatccgagtcgggtcggtcggttttcattgtattgcaaaaccgcagttgatatagtatatgtatcttccatgtaatcacataacacaagtggtaatttgcttgcttggttaatgtggaaaatcttcactccggcctctcctgtaataagtctactttcgctccctcgtgtaatgtgtctataggacctccttgcctaacgggtcgggccggcgcacgttgttttggcccttattttttcgcccaaaaatcattaaatgtttacataaaaaaattaatcactttgaaccatcattttaagatataaaattgctgtaaattttacatgtgcgttttaatttatttctaactaaatagaacccacgtgaagaacaaaaaaaaaagtaagtcttcgggtaaagtttttttttcatcgtccatcacacgcggaatcaccttcgtatatttcggcaataatttgtttttttataacgagggtttgtttagattgtagtcaaaataaaccttatcaaattttggcaggattttttatgtatttattagagtttgataaaaaaactaaatggatgcacatatttggtaactttactaaaatttgataagctttatttaagctacaatctgaacaggccctgacatcagtttcctaatctgcaaaagcgatataaaatttcaagatttggaagacatgtacaaatttgaaattttgtacacatgtatcatacaagtacacatgcaatattagcaatccatatttgtttgatattcacccgttacaacgcacgggcatatttgctagtcctatatataaattggttgtgtgatctccatgaaacaaaatcatcctctttggatttttttgtttgttcgtttctgttttgtttcatctgtttgcgatctggtcaaccggtttatggctcgatgatgactactcttgctttaaccacaccgaatacgaaggcttgacgaagcgtgctttgcccccaccgctacgttgtgctcttctgtctcgtcgattcctcgtgaaatctcctcgtgtcgaagaattagactgattttttcttctttgatgagagattgagatggatggattcggcgagattggtgagcatggtagtatggacgccaatgcctctttcgatggctcttcacatgtggaaaaactttggcctttactgagagcctaacaatcatcagtttattcacaagtctttggtgattctttttccagttttgaaactgctcgaggactttaccgagctagaattcgtatataattaggatgaaaataatttgtacgacaacatagcagatgcaacagcagccgcaatatgttttccaaacgaaaactgcagaaatctgaatagaacagcaaatgagacgtttgtcggcattgtcattgcaatctgattacgacaacagcaaattagaagttgttgacttgataagcatttacgtcatccgtcttaccaaacctgacttgctacaactaaaattatccagttacacgcacagggaccggacaggaagggtatgaacaccttcgtcgtcatttttttcaacggatgctactgctagttgaacgagttaagaagtggtcttttgcagtagatagtatagcagataaatagataaatatcattatcccagtatcaatcaagtgatcaacgaatcctgcgaccatttctgacgaaatgatttctggtaggatttctgactaaatgatttttgctaggatcagcgttgctcccagtcgtcaactggtgcaatgcgctgtgcgcatcaccgcagaaatatcccggtgagatacaaaagaaatcaacgacttgctcaaagtaaaaccaaagcgaatgacaggacaaacaaattgacagcgctcaccattgtcaagtgccaacgacgcgcagctgccaacaaaccttcattaactagggggtggccactccctctgctttcctacgtactccagcgacgagttctgttcaggccgccggttgctttcatccgaggacactagggccgagcagcagagtaactggagtactggacaatctatgcgatgacacttcagtagttcacagcatccaaaatctggcaaactgccctactaattatggtcccataaacctccaataccagcgaaattgcaataacgatcatggtccaagaactagcggctaccggtcggagatgggaccttagctagttattgcccgtaaagatataaatttatttaaaacatttaaaacttagatttaaatttagaaatttatgatataatcttttgattccattctgaaccgtgcgagcaattaaaaaaatgttcgattttgacccggacccatggtgcggtgcaatacaacatcgctcttgcagtttgattgctgctctcgttggttaattaacgtgggggcatatccatccatttctaagggataaagcctcgatgcgtaaccaagaaattactaactttcataaatgcgggctatgcatatgcctatatatcgggggtgctgcatcgctactgaacgggcttcacagcgacatgagaccaactagtgatagacctaaagctaaagcgatgataaagacggatggcttcctgctgaagcaggcagatcaaagaaaatttcagacctgattcacatcaacacgcgagagagaaaggatggaaatgagcatcaggtctttatatagagataaaagttcgtcttctttaaaatctgagaaatcttgttgactagcacttccgaaaaacttgaaacagacattattgtcacgctgaaacttactgccaccaaaaacttattgtcacactgattggatacaagtcgcggtttgtatatcgtctaaaatccaaataaactgtaaaaaagtagtccattggcacgtaaacatcgttgaagaagccaatgctgcatcatgccatgaccggctgacggctaatacataacttgtggattcatgatggccaaacaaagcttggcccttcaatcaatgccatgacagatacctatgagtactatataggaggccaacaaacaagttaatcactcttcgctaagtaagtaagaattgtggttgccactcggcactcgccaccatgctcctcgtcggcgtcctcctgctgctcttcttcaacctacatctccccacggccgccattgacaccctcacgctaggccagtctctgctgtggaaccagacgctggtctccaatggcggcaacttcgagctcggcctcttctcgccgggaaagtccaacaagcactaccttggcatctggtacaagaagatctccaagaagacggttgtttgggttgccaaccgtgagcgcccgattcttgagccgtcgagctgccacctcgagctgagcgtccacggcgatctgcggctgttctcgacggcgccgtcgaacaccttgctgtggtcgtcgaacgcgtccgcgtcttcctcgccgtcgcccccgcgcaccaccgtcgccacgctccaggacgacggcaacctcgtggtgaacagcaacgcgacgcggtcgcggtcgcgatcgccgtcgtcgactacgacgacgcacgtggcgtggcagagctttgatcacccgaccgacacatggctccccggagccaggctcggctacgacaggggccgcggcgtccacagcttcctcacgtcgtggacggactccgagaacccggcgcccggcgcgttctccatggtgatcgacgcgcgcgggctggccaagttcgacctcctcgccggcggcgagcaccggtactggacgaccggcctctgggacggcgagatcttcgcgaacgtgccggagatgcggtccggctacttcaccggcgtcccctacgcgccgaacgccagcgtcaacttcttcagctaccgcgaccggctgccgggcgccgtcggcaacttcatgctggacgtgaacgggcagatgcggcggcggcagtggagcgagacggcggggaagtggatcctcttctgctcgttgccccacgacgcgtgcgacgtgtacggctcgtgcgggccctttggagtctgcagcaacgccaccaacccggagtgccggtgccccgccggcttcgagccgcggtcgtcggaggagtggaggctggagaacgccgccggaggctgcgtgaggcggcaccctctcgagtgtcacggagacgggttcctggcgctgccgtacaccgtgcggctcccgaatggctccgtggaggcgccggccggagctgggaacgacaaggcgtgcgcgcacacctgcctggtcgactgctcctgcacggcctacgttcacgacggagcgaagtgcctcgtgtggaacggcgagctcgtcaacatgaaagcctacgcggctaatgagaatggccaaggcgatcctggcctcgccggagcggtgcttcacctccgtgtcgcccactcggaggttccggcgtcgtcgacggagcactcgtggaagaaatcgatggtaatccttggaagcgtcgttgcggcggtggtgctgctcttggcgagcctcgtcaccgtggtggcggtggcggcggtgttgcggatgcggcgtaggaggggcaaggtgacggcggtgcaggggtcgctgctgctgctcgactaccatgccgtgaagaccgcgacgagggacttctcggagaagctcgggagcgggagcttcggcacggtgttcaaaggcgcgctgccggacgggacgcccgtggccgtcaagaagctcgacggtctccggcaaggcgagaagcaattcagaacggaggtggtgacgctcggcatgatccagcacgtcaacctcgtccgactccgtggcttctgctgcgagggaaacaagagggcgctcgtgtacgactacatggccaatggctcgctggactcgcacctgttcgtcatgagcggctccagctccggccccgactccaagcaggtgaccctgacttggagccaacggtacaacgtcgcggttggtgtggcacggggcttggcttacctgcacgagaagtgcagggagtgcatcatacactgcgacgtcaagccggagaacatcctcctcgatcaggagatggcggcgaggctcgcggacttcggcatggccaagctcgtcggccgcgacttcagcagcgtcctgaccaccatgcggggcacggtgggatacctcgcgccggagtggctagccggcacgccggtcaccgcaaaagccgacgtgtacagcttcgggctcctgctcttcgagctcgtctcgggccggcggaacagcaccgcgccgtcgtcgtcgtcggagggcggccctgggatttacttcccggttcatgccgtggtcaagctaaacgaaggcgacgtggccgggctggtcgacgagagggtggccaaggatgccgacccgaaggaggttgagagactctgcaaggtcgcgggctggtgcattcaagacgaggaaggcgaccggccgaccatggggctcgtcgtgcagcagctcgaaggcatcgccaacgtaatgttgccgccgatcccttctcggcttcatatcctggcgattgagaacgaatgggtcagaggtgttccagaggatgagcgctgctcaaagagcggtagtaaaccagaaacagaagcaatagaagaaatgtagaactgaaaagaatctgggagcaccctacagctgaagtgaagatgcagcgtcagatatgaaaatgtagttgtaatgtcagcatagttgatatttcccgtgtggatgtatagccagtactgtactgcaactgttctgtaaattccttaaattccggaaacaggatcagacaagtaccttctctcgttttgttcccatctaattctggtccatccttgctgacagctgcacctttattgaagaaatccattagtgctacccagaagtccttaactaattgttgaaaacaacttgttgacaaaattgcagatccactcctccacactcactataattctgttatgtacaatttttagatgggaaaattttctgataactacaaagggcataagaagcatatatctacacgggcaactagtaacaacctatacagattaagaactaaatacaaccccaaagaatgaacgaatatcactatgtaactacaagaaccaacatatcaagatgtacactttacaggtaaagatgaagatgatgatacagagtaaagagctttaagtaaagaaatgaacttcacaactgtttcttcagagaaccacttgagtttccatgtatgcactgtgtaaatttcatctggttgcttgctctgtgaatttgtaatgctaccgttactgcaaaatcttccttcatgtgcatggttgtccaaaactaatgtcaaacatctcttgtcacagtgatccacaacctgaatacatgaagagagaatattgaatgagtgatatcaactttcaatctgacagaacagctaagcttacttacaatgatatcacagcttattttggtaggacacaacttcactagctaaaggaataaagtcagatgcaatcatgattcatatacttgatcgattgatattaaattaaagatggctgttcgtgttcaacaataggcaagcagcgctttgtttggattgtggaataggaggggtaggatacggattgagttaagatacaggaataggggaaaaatggatggtcaagcaaggggctattgctctaagctctgtatgtatgctattcctttcagacatggcattacctaacatcttaaaatgcaaccaaaatctaaaatgggtacgtatgcttactgctccctgtttttctgtttttctgtttttcatttacatcacaaatatttacagccaaggaagaaacagagtactaagggtgagtgttagtgacctacttaacatcaaggtgggaaggaattatcttttggagctgttggagcaaatcatgacaaataactagcaagggaaatgtcaaaagtaaaccatggcttaccacttcttgaatatcgttgataaaacaacaagcatccagagaaaaatatggagtatccggatcatcagggagggaaccaaactgatgtatgttctcgatacacacaaataatgacccttcagtaacagcgagggatctaataacaaaggatccttctgcaaaatagaatggacactatttcagcaagttccagttgacagcagacaaataatgaattaaggtaactggaacaatcctcatagttttcatatgccaaaattggaatatgacgtcagtggtaaaaatgcagataaaaaatctgtggtaaactattatagttttcataatgacctccctccctacttagcttatacaatagtcatgcatactcctacctcctttacccacctttttccaaagaatcccactctataaggcttcaaggaaaatctcagacacacccaaacataatttagaaccatcaaacataagataacgcagggaccgatctgttcttagtccagccacagaatagtgtgctgtttcatcaaccaaataatgcttaccttcagtatcattcttccaaaacatcaacaacgagtagagaaatattcccatttccaaacttggatggatacaattctcaagcaatttaagttggaccttctcccagctgccatttaaatacagaactaagtataatcaacaacataaaccgaaagtcgcaataaaaaaaagtttccttttaagcaaaaaagaacagtgttttgctcacagggaaagtaaaaggctaaacaaaccaaacctttgcaaagatatactactagttaattgtggaaaattagacgcggttaagag

SEQ ID NO: 80980 - DNA, 3386 bp, Oryza sativa
actctagccttagtatcccgcatgatatctgaccaccacggacatcgtcttaccaccaagccgactcctggtccatcaccgcaaatactctctcgaggcatcgagtcacctacacatgaaacaaacaaagaaaccatattccgagaccaagctatctccaacttgactcattgttagcaaacaacagtattacatacgtatagtatccatctagaagccataaccatgaaacaatcacggatatccaaagaaacaacccgaaaccgaaaccaactcagcgtcggccggtcagaccgcggacctggccggtctgaccgcacacatagcaccggtctgaccggcaacctccgcccggtcggaccggacacataaaataacagtgaatccgatcatcacctgaaaattgattatctccaaaattgattatctccaaaaccacttcaatgataatctcaaaatatcaaaaccaataatcacagatgccaattgttcatcacagaataagaatcaaaacacacgttgatcttacaccttgtatatattaacattctaccccagttgtttgcttccaaagtgtctaattaatctaaaatcaatgttagtcaccttcatttaacaaatatcacatgtgcaagaaatcgggttaatatggataatctctttatgactcaacccactcaagtctgaggatcaatctatttatttagttagtttaagaggtccttgcaagtactgcatgagcaatgttttccgaaacaatagttcgatgtgcagagcaattgtatcgtaagtgataaagagcaaatcaaaattcagagcaacgatgctaccttttcagctcataggtttatattaaaaatgcaaataggcacgaagcttcactcagctatcaacttacttagcttaaacttctgacaaaacaacttccttccaagtacattcagggccagtggtcttaattagaaagtataagattacatagaagccttcccctgttctatcataattaaataagtgacaatccgaccacagctcttttccagatatattcaagtcgaggccgggtttatgttcatttcctaagataaatattcaagtggcagctaggtttcatattgaccatagatcactcaaatcagtttatatttgaattagatatataacgtgcagaacataaacaggagagtaacttaagcacatcaatggttgagatgttgctgccaattatcaatagctagagatgactagacacataattgatctggacatggctagtgtgacatcaggagtgcaggtataagctctgtgcattggaattggaggtatcaagaaaacaaagatagcgagggtagcagtgcaatcggaggtatccaggccacaaggcgggcagggagcagtggagaggacccccacatggctctctctcccagccgcacctccacgagcatctcctccccaagctgcattacaaatcgatggcagtgggccgagcttcttccacctgcacgacaatgctactaagctgggaagtagtagtgggaagacgggctgttcggcgcatcccacctttttgcttcctggaacggcctccttgtcctcaaccaccgtggttgcaaccagaacgggtcttcaggcggcgggcggacccgcctccgccggcctcatgacgggcggcgggcggcgcggtcgacggcgggtggcagacggctgcgatggagcatggcggcgcaggctcccctgcgcttcgaaggaggcgacggcggctccctcgcgtggatctgtcgggtggcggccggcaacaacgaagcattgcggcctggatccagcggtgggcgacgggtgtcgttcggatctagcagcagagctaggggttctcttgtgattttttttacagaattttatttttgcatgagggtgacataagcacccatttcgcgtgcgggtgcgtcgcccgcatggaaaaagagcaatttttgcataccttttcgggcatacctgttggagttctgcataaaaaactacttttggcccagctggaaaaaaagttttttctactagtggcaaccccatcactgccgtgatgaacttttgtgttgttggatgttgtgaattcttgggaaaaaaattgctggggaattagggccccttgatgtgaattctgtggaaagtttttctacggagctggggttgaaaaaacttttctctttgcatttttttcaccaaaaatcattttcgcagttagtcgtcttcacgtacctgtatgggaaaattgattttcacataccttttgttctaggcaggcgctccatccgcatgtgaaaagctattttggctaactgtaaggaattaaggatgtgttttgtagcagtgctagttgaggtgtactcgtttgcaagaggatggagagattaattgctactacataattaatgggcaatcggaggacggcacaatcagatgaaaagaacacagagtcagattggatcatatacgagaatgtatatatatttaaggttgagagggtataatctaaacgggtattagcatggcatcctttaaccttgatttaattggtttcttaaatatattaaacattggatcatttaaccttgattcatcacttgtacagttgtacccagccttgaagtggatcaacaaagaagtgtgagctagcctatatatattgcattggctactgagtgagcagggtaaggaacaaaacacatatcagatttccccaaacaccagctactactctttttgttccccactttgcatcaatcctctttctgaatgcattatgcatactgattgctagtgagcacacacaaagaagaaaattttgtgatagccctgaatattggatttcgaggcatcgggaaagtggagatgcctatgaattaatttaagtttatcatcctcaagaacgtatctagcttgcggagatgataatcttggaactggttaaatcagtgtgagttctcatccaagggttgcttgtcaaacatcataggttcagattcaactcactcgggccgcatctttgttgatatacatggcgataataaccatcgccgtgggttacaagataaggggtgcaggtggatggatagatatgatactattctattacaacaagctctatctattcgcatctgtccatctaaccatgcccatgtacatcacatatgcatattacatgtttaacattgccgaccgcaaacattacagggtaccgtttatgctaagtctagggactgcaaaagtcaatttgccatcatgttacgcaatacttcaacacactccgtgaatgcgcttcctaacacgtgcgaaacgcacaatggggctctaaaatgtaaaaaaaattagcataactaaaccataaa

SEQ ID NO: 80981 - DNA, 2119 bp, Oryza sativa
agctaccactccatctataagaggcaccatccacctatacttgaaatacaattttctcttaaactattcatctgatctaagatccgattacaccgttgtgttcgtaacaattaaatctttacaacaagatctcacatgattatattttgataaaaaatcacaaattacttttatgatatgtctaaattacttttaggtttcactaagttacttcttagacatataaaagtaaattcagtaaagcctaaaagtaatttacatatattatagaagtaacttagaacgaatcgaaggtaactttgacatgccatttgaagtaaatctgtcgtagagataaaaacatgactcaatctagaaattaaattaatcagcacaaattatggaattaacttaaaaaataataaaagtaatcacctcagagcattatgaatgtataggaagtattttaatccaatctaaaagcaacttatatatatatatatatatatatatatatatatatatatatatataagataattttttcaatgaaaaaaggcattaattaaagttactttcctttttattataagttacttctataatatatgttacttacttttaggctttactgaatttacttttatatgtctaagaagtaacttagtgaaatctaaaagtaatttgtgatttttcatcaaaatatactcatgtgagatcttgttgtaaagatttaattattacaaacacaacggtgcaatcgaattgtaaatcggatgagtaatttaagagaaaattttatttgaagcatagatgataggaatatttcccctacttgctcaatgaattaatatcaaccaaaactcctgaagtactagcacgtgggtgtctctggatatgactaattggagaggcgcctccaattagatttaccaatatacaaaattttaattcacggtcttatgagatagagggagtagaagtaaatagaagaatgtctttacttagatggaacaataatattaacaatttccattctacaatcaaccatgaaaaccattttcattccacaatcaacatgagtacggtaactatccgtggccattggctagccccctgaatcaccattgatcatagatccattctcactcagttacccttttcttttcctcactaattaattaaccttatcggctcaaccaaattgatattggaaagaaacacatatgtgggggaaagactatttagaaagaacttatgtaataaccatctgatagccctcaaaatttggcgctttatcacactactacaaaaaagcccataaagatcggcactataggtgctggaacagttaaaacatgcacctatagtgattttaccgcgtccattggttgaaaacacataaaaccggcacctttaagcaactataggtgtgtcggttctaaagaaaaaccgacacgtagagtataggtgccggttttttataaaaaaccgacatctatccaaaccgagccgagccgacacctagccaaactggcgacgcattagccttgtcgatccccctatatgagtgagctggccttatcccctctcctatctctctcgtctgtctctctcttgcctccctctctcccggctctctcacatctcagcgcgcggtggcggctggaggggaggcgatgggcaactggtggcggtggcgccctctcctccaccggatccagcgggaggggaggcgcagcaggcggcggcgggcggcgacgggtggcggcgggcaatgggcggcagcggcggtctcccctcctccggatccagcgggaggggaggcgcagcaggcggcggcgggcggcgacgggtggcgacgggcaatgggcggcagcggcggtctcccctccgccggaggcgcggcaggcggcggtgcatcgtggcgcgcgacgagcgacggcctcccctccgccggatctggcgggaggggagatgggcgatgggcggcggcggcggtctcccctccaccggatccggcgggaggggaggcagcgggcggcggtagcgccctcccctttactcctctccccagttgtagatttttttgttgatgtttgtgtgaatttgttgatgaatttgttgttgaatatgtggg

SEQ ID NO: 80982 - DNA, 847 bp, Oryza sativa
ggtggcggagcaagtttccacgccgccggcggcaggcgacggcgcggcggcggcgaccggaacgaaggtgggggtggaggcggggggtggcgaatggtggtggtctcctcccctttttgaagtttgaaggcgtaggcgggatgggggaggaggattgaggaagaagccgagagcgagatggggagggggcttggtgggcccggcccgtcagggacccggaaaagggaaagtggggttttgggcctatatatacggataaggcaacttttgtggccctagaaaggaaggtggcttttttagttgagtacgtacggcccatgtaacatgtttgagcccggtccattttactctcttttttttcaatagatgacgttgttgactacacatatttgaccattcgtcttattcacaatgtttatgcaaatacatgagatataaataatgctttaaatatttttagtgataaaacaactcacaacaaaataaatgataattgcataaattttttgaataagacgaatggtcaaacgtatacccaaaaatcaaaagaggtagtaggtagtagtggacttggctagcgaaaaaacttagaggatagcattattcgcaaccttgcaaaagttttagggcttctttaggaacgcgggaatttttttattaaactttttgtaggatttagttcaattactccattccaagggagtcattcgctgaaaacacaatctatgtgcgaagagataaaaaaagggggtagggctttttcggaacgtagaaacaatctgtttaactgcgaaacttccccattccaaagagacctaaagtgcatttatagtgtgtagaccatgtg

SEQ ID NO: 80983 - DNA, 27766 bp, Oryza sativa
tttgagcaaccgaaagcaaattgaaatttagagatttaacaagagagacattatcaattgacaaatcattggagatagcaattttacctaacccaattacctttcctttgctattgtctccaaatgtcactttctcttgttcattccctcctacttcaaatgtggtgaacatagccctatcaccggtcatgtgttgagtgcatccactatcaagcacccaatggctcccaccggtgcggtagttcacctacaaaagaagatcaagctcttttaggtacccaaacttgtttgggtccttggaggttagagaccaaagctttgggcacccaaatggcattctttttaccaccgagtataggggaacccacatatctagcaacaatgctaccatcataagccttcctaagcatataatgagaatcagacatgcatgtcttaggaggcttaccaccggggcaatcactcaccaaatgcccaacctcacgacacttggagcaatacttaccattgctcttgacaaaacgagtggcacggtgagaaggtttcttacccttctttagaatgaatccaagtccctctttgttaaggatgcactgttgctcactcaaaatcttgtcaagagtgttcttacccttgaagcatctctccaaactcttgttgagcttagccacttgctccttaagctcattgttctcaacaacaagtgaggcatcacaaatagaaacgcaagagctagagctagagttaggcatatccataagatcatcacaagaggtagaaatgctagatgatgcaacatgagcaatatggcaagtagcactatcatcaagcaaatcacaagatatgccaacatcaatgagagctccatgttgagtagtggaaaggaggttgtcatgagcttccttaagcttctcatgagaaatggtaagtctctcatgagaagtctttagctcctcatacaaaacctccaaagaagcatgatccttctttagggtcttgaacttgataatctccttctcactataagcatggagctcctcaaacatactcacaagctcatcataggaaacatcatcacaatcatcatcactctcactatcactaagagatgttaccttagaggggctctttgccatgagacaaagtggagcgaagagtgatggtgcctccttgatggcaacaacggccatcttcttcttcttggagcttgcatcatcaccaccttcttcctcggacccggatgaggcagagctctcctcatttgagtctcattccccgatgaaggcctcaatcttcttctttttcttcttgagcttcttcatgagcttgtagcctccactcttcttcttggatgacttgtctccatcatcatccttggaagggcacttggaagcaaagtgtcccttctcaccacactcaaagcacctcaagttggagagagtcttgttgggtcttctatttcttctcctattggagttggagccccttcctctctcctttctccttcccaagagatcattgaaccttctagcaagaaggacaatctcttcctccaagtccttattgacttcattcaccttgctcttgctcttgtcttcaacttcggcttggagagcaatgcacttcttggaaggtgaggcttcctccatctccttcttcttcaacttgtacatgtcattggtgttgatcttccccaagaggcttgcgggtgtcattcttgacatgtcggagttgatgagcatggtgacaagggtctcatacttctccggtagagccctaagcatcttttgggcaacctcaagattggtgtagtttgccccaagccccttgagatcattcacaatgacattgagcctcccatacatgtcattcacactctcatgaggcaacatggagaatgtctcatattggatcttgaggaaatgaagcttggcatccttgtactcacttgtactctcatggatctccgccaacttgttccaaatctcatatgcggtctcaaggttgctcactctatcgaactcctcttggctcaaagagttgaacaagacattcatggcttgggcattgagtttgaggttgcggtgatcaatctccgtcaagggtgtgccggtgatagcaaagcctacatccacaatactccaaatatggaagctcatagctttgaggtgagtagacattttaattttccaagtggaatagtttgtgccattaaacatgggagccttccctacatggttcacctcgttcgacatcttctctctaggcggtgaagcccaatcaagagagaccaagctttgataccacttgtaggattgagatgtcgactagaggggagggtgaataggcgatttaaaactaaataacacctaatcaaaactaacctaagttgctaggcttggtgagggtgaactctaactaagcaactaagttatgttttgcaaacctagggtgatagtggctcaattatatctctaggaaagtaaatcacactcctatgtcaaagttttgcaatcctagggtgaaatgatctcaagtatgtctctagaaatgtaaattgcacaaatgtaaatgcgacaatcaaatgagacaaggagacaagagatttttcaccgaggtttggaaactcgccggtttcctactccccgttgaggcgagcccaactccaccgctcaaccacgaagccaccgcacgccccctttgtcaaggggtgggcaaggcgggagccggcccacggagaggactacccaagcctcgatcactagggtagttcttccttcactccgaaggtggtgaactccaaaccactcacaaaccggcgccgggccttctccacaatcttctcggagagatcaccgggcaactcctccacaagccgtctaggaggcggcaacctccaagagtaacaagcaatgacccggcatggagatgatcaaatgccacactagctctacaatggaagcaaatgcacttgactcttggctaaacaaccctctaacacactagatggatgaacacaaagctcaagtgagtgtgagagagatgcaaggggtgtatgcaattgaattgggtgccaagagagcccccttgctgctggtgggggagtatttatactcccacccaccaaaactagccgttgggagcgaaatcccccaactctgtgctctgccggtctgaccggaggtatgtggccggtcagaccgtgctactctgcaacggctagaaaactagccgttgtagccctgtcagagggccccatcagcctggtcggtcagaccgacatggggtggccggtcaaaccgccatcggctcggtctgaccgaatacggctccgtcggctctgtatcggccatcccgagcagcaccatcccggcctccagggggccggtctgaccgcgcatgtgccgccggtcagactgtccttatgcgccggtcagaccaccttcttgcggccggtcggaccggccagggcacgccggtcagaccgccactatgtggccggtctgaccgcccctggtcaggccgaacctagtgaagtgtgtgtgtgtgtgtgtgaaatgtgagcacaagtctaaatgcataatgacctaatgtggcaattaaaatcatctctttgctaggtcattacccctcttaatagtacggcgaaactaaaaataaactagcaaatttgatcgccctacacctcgatcaattctaaattaaagcgctagttttatcgtcttctttccctttgctttgcgccgtcaattttaatccatcgataatcatccatgcgcacatatgacgtggacctaacttaaaatgtatagctcaaagacaacggttagtccacaattagcacttgtcattaattatcaaaattaacaccgggggcctagatgcttcaccaccaataaactaaacagttacatgcatatatttatcgattgcatttcttgactcctttcctttcacctaccctttcacctcactatttatatgcctctccacaatggcatgtcttagccatcgtataggatcataacagattctttgtgaaaccagtggatgcaatggctgtgatctcttcaaattactgatggttttcttgatgtcttatgctgtcaatgctatgctacagtcattccttcaaggtttgtggtgtgttcctttcctcggcctacaatttaaattattatttttgttttacttataaatattcacgttagtattttctttctttctcatgtgttctttgtttatctgttttcgctcaccgtgatgatctgaagttcttccctttttctactgcttatatggacattgatcctgttgatgttgctttatggcaatgagcaactaagctccctatacgaccactatttttctatgatattcattcatacagcaatgattcttgaagtttattctcgggtactaactaaaatttacttgctatttcatagcaggcctatatctttgtatgcatcggaatgatgcatgtcagcacaattaagtcaatcttcctttccaacgacctgactcagttgaagcaagcatcagaaaatgcgtaactccaatctttctatttattattgaatttttgtaatttttttaatagttacaaggtgtatttaaatcacaacaatcaagtgtacccgacgcttgaagtaatggataaatttacaatagtgctaatgtaggtatacaactggctagatatatgttgcgtctaaagttttcttttatcatataaaagtgtcgcggtaacgcgcgggttactcactagtttcatacatttgagtgttcggctttgtaattgtaatggagatgccattgatagaacccgaacaactgtctaattagctcaagaggtggctccacacacatagcatggtatttcaatcggcggagttatagatagatagtatgtttttttttcatcaatttcaaaatatggtataatctgtggtaaacttccaaaaccagtttcatcggttagagtgcattttaccaagtgtgttgtgtgtcagctgaactaacacattataacggttgctggtggtgtttgagacggatgaagatgtaaagtaagggcatgcaaaacgagtaaaccattagggcatgattaattggttttaattattgcaaatttgagaaatatatttatttgatattttaaagtaaattttatatagaaatactggaaaatttagaccaatccattgtcgtatagtgcagaacaaataaattgcactgtacacatatgtcacttgtccattgtcgtctagtccggttaggatacctggctttcacccaggcgacccgggttcaaatcccggcaatggaattttttttctattttttctatttgtctatttttctatgtttcttttaggggatctacatgtctttatgataagttagcagacttaactcaaaactatacgggacctgcagaacttcttgacaaatcgcacataactcccaagttagcaaattagctcaaactaatcaacactttatttagtggttttccgtgagcatacgagaactaacttgttactgttagtgtgacaactcacaggtcacaggattcgcagcatgttcacggttcaccaatgaattatatccacattaagtaaacaaactgtccaaagaaaagaaacaaaaaatcaaaccgagcggtgaacacaactacacaaggggacatgatctgatacactaatacactacctgagcaataatacgcacgaggcaggagtgttgtctgtaaaaagtgaggcatcaataggtgtagtataactattttatcacgaaaggtgaaaaagactatctaccggctctacatcattttatatcaggggcagggcgccccgctttagccgctggcaacaatctcgtggatcttgtcactgacttcgggatcatctgacctgacggcaagcttcatcgccacttccttgggcccgctcagtccaaacgatagcctgacaagaaccttggcgtcgccgatgaacacaccagacagcaggcaagtgtgcgatcttgcattctttggtacaacctcagtgccctgccaaacatgcgcaaggatttagcgacatttaaatttctcaaaaaccaaatgaatttaaatttctcaaaaaccaaatgatgtagggccaattacgatgaataggaacagaagtggaaactgacctcacaaggctgcataccaaggatactaatgacagcactcacagcctcagccaagctctctctaacaccaagtccatactcatcgacacgctcactttctgggtccatattttcccaggcattcctgaagttgggagacctgcagaccctcaagcatgctaactcagtccgtaaacaactttccaggatcttccgatgctggctattcatctctctcacagccattccttcatgcaacttaccctctgtagatgtgtcaacctgagaattggcaggattagtcattgttctaagaaaaagaaatagccatggaacaacttaaatagagaatgattaccccagtacaaggtacgtgttgatgcctcaatttaattagaacaaaatggcttataacaatttaaaccatagaacatatttttattactatattcttaatttgatttagaatgccatagttctatgaacaagggagcaagactcttatgaaggatccgaaactcactaaaggtgaaaacatagttttatatgagatcaaaagactttaacaaagatgaaattcactttcagtaccaacaaccataacacgtacgggcatagacagacaatacaaagtatatccaaagcatatgatatagaacagtcatacttgaattagtataacaaaggatattactgtcggtcatatcaggatccaacagcagaaggaaacatttacctctttaacaataaacttcagcacatttgaaaatttcccagtagcaggaacatgttctggcttttcaaaagcaacaaaaatttgcccaggtgaatcataaggcaaacttctaagtggctttgaacaaacttctgaaaattcctcagcatcagtggcatcaacataaacagtcacctacaagaatcaacatacatatatgaaaaaaaatcttcagtgtgagttgacagctgtgcctccaagaacatatttaattgtacttaattgtttgctgcttacattttctagcagttgttcgggtatagtgtttgtacagttgtactgcaacacaacatggctactgtatatgtgcttaaccacattaatcgcatattcagtctccgcctctgtcagctccacaggttctgaggactggggaaaaagagaggggtttagcatgtgtactcaatcaaaatcattaatggtatagaagctacagaccttgaagagccttccaaacccggagaactcaggaatggacgagagaatcttctgataagcatcaacagctggaacaggtgcaggagcaggagcaccagcaggtggcttctttcctggggcctttttctcttgaagtggttgtgatttgacttctctcgacaccaaagaaatatcaaaaggctcctcagagggttccttaagtttgaagatgttagtataccatagggcatggcagttgcttaaaacataaaatgttcattgtaaaacatacataggttttaagacttgcttccaagttggcaagtggcacatcaaatgatccaaataggaactccttaacatccttctcagtgctaccaacagcaacttcaccatcaagagtttggagataaagtgtagcacggtcacgaacctatgacaaagaccaataagacttgttattgcccagagaggagagacaccatacaccaatgttgtttctaaatgccaagttggcatcttacaataggtggccttaaaaataagaattgtaactgataaaaacatacttcaagatatgcatgtcacaaaaaggaaatgataataatcatgtcggtttgctatttacctcatcatcggtgtcaaacaggcaacgacgcaaaagaacaaagatcctaggctgaaaaagaaaaagaaaagcaagatctcaaatgagctaagaatacacaaaagtggtctatataaattagagcacatgatatatgatttatcctaccttcaaggcatcaactaaggcaccaaactttgccaatgtactgacagcactagcacggacagtggcattttccagtatcacacggttgtagatgtagcgtatatatctgcttggatctgatgtccttggtccttcatttcccaaaagatgcaatatctaacaaatagagaggattgattctctgttcaaatgttgaaaaacaagagctaggcaaggaactaccaattggaaaagattgattatgaacattctcaacagttcatatattatactatagaaaggtcgtcagtttgttatgtccccgttctttttttaccattgcatcagcatttttcactatatcaagtaatactacctgataattcataggcagctggaaggatggaagttaaccagttgttacttaatcaacagcaaatagctaatgtaattacctgactggaaagataggtgaactcacagtcttcaatgaactcacagagatacaaaagaccaatttctttagcatctggtatctcactgataagagttactatggaatcaacgatggcctttttgtactcaaagcccccttcttctctcaaactgttactcaagaagttcatcctatagaagaaaaaaaaatgaagagcattggacaccaaatgcaactgatagtcaaaacatacggcactaaaagaatgtaaatgtcatcaacaccgaattaagatttacatacattgaacgatacttcaggggaaacttaaggcatagagatcgtatagcttcaacaacaactatcttgaattcatctgctatgtctgacatgaaattggtaatttgtttcatgaggcggtctacgctagattcattgcctgttttaagaagtgtagtgattgccagggttgctatactcctattctggtccgacatcagactttccaagtccacattgcagtttgtcactgccaaagggcgtgtcatagcaacctgcgagataacaggcaaatcaagatatagacataagctgagaaaatttaaatgtcaaagattaaacatcatgcagggataaccttgttgagtgtccggacagcagcaaatcgaaggacaggtttggatgaactcaaaaataactgtaacacagtaatcgctggtgctaattcacgacttgtcacatccatctctgctattttccgtgcagcctctagaatcaccatttctgatttatgtctcaaacatgattccagataatcaaaaaatgggcgatcactggtttgtgtgttcatgcttgactcgcgtattacctggtaaatcacccttccaatgttcagcaatttacttttgctaggttttaagcttcagtagaggtatatgtagcttacctggctcgtgtaacgaatcagaagacattgtgcaagaggtgagcggacagaccccctagtcaagccagaaaccatcttgctaatagctaaacgatcattctgtctgatctgaaagttgggagacaaaattaacagagcatcaactcatcatgtgtctcaggctaggacaccttataccatactattccttttgcataccaaatgcacaaaaataaatcaatttctacataattacagttattttaagattaagtaaagtggaggtcagtgatatttgaagatgttaacccagcatagcatatgactaaaactagtgcaaaatggactgaagcaactgaaaattggttagtcataccttagttcagaaaagctttactttggtaaaagtgtttgacctaaatagtttcattctgagatatcaagacattgacatctggtgtataagttcatcgtcggcactgataaactaaccatggactattccaaaacagtaaactgcaaagcatatgacctgtggcctgacaatggcctcctgaactgaatccataagctatcaagtgaaacagggcacacaaaatgattcaggtagatattctaactttcaataaagaaagatgtcctcctagaaaatttaaagagtaaactatgaaaagctacaatatattaagtaaaagattgatattccacagttccatcatttagtcaaatgatgaaaaatacttttaacacagatgctcccctgtaccaccaccgatcatccgaatgtctttgagatccatgcacaaaaaatatatagctacgaaaaatccatgcacagatctcaaaatgtgccatgacacaacccaagggcattaagaagtaggatggaatcccattaagtggttaaaatctatctccctcaaatgagatcatgcagccaaagtgttcttcaaagggccaggattaatcagagtttgtcatgcttttcattttttcgtcaaaagctagtaaaacacaacgtgcaacctatattattaggcacagaactgctgccggcttctttggtaatgcccaggtacaactcagaagttctattcaccggatcaacaagatataccataacataggcattataatctatctcaccttcatgttcaatacctgtctttgctttgctattagtctaagtttagttgggcattgatcgatgaaacaaaatacaaacctggtgaagaagagctaggccatgaaattgcacaagtgcaaatcttgattgaacagcttcctgcacttcgttgctccatcttttcacgatttctggatttgcctgcatataataagtacagtttttgacttccgaaaagaattatgttttttttcgtatagaactatagaagtgtacctgaagcagatggatgccactaacaagagcagcactagcaaccacaggattcttatcaactatagcttgtttcaaatatctctcaatttgagtaaggagggtgccatcaattattctacacagaactctgatagcattggcacggtacatatccgtcttgctgttcatatctttcattaatgagcttgtgactatgataacctgttgtgtaaaattcaaacaatttagaatgacaatacaagaaacaagttataattcatggatctaaaaacagtttcctttgacctcatctgatgatggtgaaagctctttgatcattaaatacaccagccgcctaagaccagcatccttggactggaacagctttgttactgcaaagaaaacttctgtggcctcaacctacatcagaagcaaatccatcagggcattgagagcataaggcaagtttggttgcacgagatgtagtatcctacctttgtgaatgtctccccttggttgagtaaatacaatagcttagtgatgacctgagaaattccaagacacatcaaacaaagagcaaagccataataatgaataacaagagggtgaaacatacatctgaacacaatactcagaactgatatgaaaatgagagaggtcatgcaagaaacacttacttgcgagcacttcctggcatcaagctgcggatcatggaaagcccttgcctcctgcagaacggctcccttctcaatcccataaaatggcgagtactcaactgtaaaagcatccatgggttaataaacaggtaataacttgaaagcattttactacactgactgaattcaatctaaaaacaagagataggacactctctataaaagatcaaactgcaatatcaaaatgaaatgctctgacgttaaggtaaacaccgcatgtaaccagcttgcattgagcaccaaaaaccttaccatatttggatcatacaaattggccgaacacccatatagactaagggggtgtttagatccaccggcaaatttttttgccccgtcacatcgaacgtttgaacacatgtacggagtattaaatattgataaaaaaaaaactaattacacagtttgcgtgtaaattgcgagacgaatttttcaagcctaattgcgccatgatctgacaatgtggtgctacagtaaacatttgctaatgatggactaattaggcttaataaattcgtctcgcagtttacatgcggattatgtaatttggtttgttattggtctacgtttaatacttcaaatgtgtgtccatatatccgatgtgacccggcaaatttttttgccagtggaactaaacacagcctaaggaacggatctactcctatatgcaaattagacgtgcgaatctccaatggaaagtgaaacgaaatggttccagcacacgggcgcaactgaatctcatctcactattggatcaccaatgggcctagccgactgataattagaggatgaacataaaaaaaaaacgaagtgcgtcggaaccgaacgcctgtgatgcctcagaggagtgatcgagcgcactccagatccaggtaaacccaagctctcccactccaaattctcagggccaaagcacgccaagtcgcaaaacagaaggccactctgaccagcggagagaatcaaacattcaaacaggaagctcgcacaaccaccaccacaaactctcgggggcggacatgcacacgaggtcgagatccaccgcgagatcccgccagatccggcatctccgccgctgggccagcggctcccagatcgcagcgcggccgggagaaagccaacaggaggagaattaggaggggggagaggggactaaccgtcctcgtcgtcgtcatccttcttcatgtacggctgcgccatctccggatcggtgaggtcgccggcgagggagcgaggcatgcgacgctgtggcaggcggcggcaaccaccgaaccggggagcgtggggtggtaggtttttgagggccgtggggtggtgcgtggagggaagcttttcccccttgtcgcgctccggatcctacgaaacggtggcctggccgtgcggtggtggtggtgggggtggcctggccgtggtgggggagctcgggacggacgggacggggaggagctctctttgctcgcgccctttttgcacttgggtccctcggtcgagtcgagactcgagactccagactgtggaggccggtttgttggggttgccacttgccaggtgttgggccagccctgcctgatggaagggacacggccttttggcccaaactgtccagcaccaacctcgacccttttgggaattttgaaggtaggaaaaaggccactttgactcccttaaaagtatgctgaatctaattcataccccttaactagaaaaccaggtaaaatgactcctctaactattaaaaccggtataatttaactccctcgacggttttggatgccagttttgcttatgtggcgctttgacttggtccaattggctgactcagcgtgtgggacccacatgtcaatgtcacattttccttctctctttctttctctttttcccctctttttctcctgcctccgaatgacgccacaaattgtcgtcattcatggatacttgcaaggacatcgtcgctgcccgtctccccgccgcgggaactcggccggtgacagatgctcatgtgcctgtgcgcgacagtccttctcctcacttcttatcacctgctccatccttctctctctttctcttccctttcctctcccccaaggcgaagcgacaccgtggcctcgaggcggagtggtggctggaggtcctgatgcgcggcatcggcctggcctcaagcggagcgactttctatgggagccgtttttgctttatttgctggattttactattgggtgggtaaaatctttggcagacatatcctgaaactttaggataaatccatttttcgattactttattcagggttaatctgacattttttcccatgcatttcttaggacgtcggcccggcgtagagggggatggcggcgggccggcttggagacggggtggtggcgtggcgcgcccagacgccctgcggccgcctagggaggtcatggaacaggtcccctccaccgtcggcagcggctcggctagctcggaccctggccgacacaggagtagcctcgctgcaccgcctcgctccaacacgaaggtggtcctccccgccatcgctgacgaactgcggcgtgtcgaagttcacggacacgccgtcccgagtggtggcactctgtcacaccccgaagtttttctccctagccaaaatttaatttataaacgaccccaagaaaatgcaggtgcaaatcaagagaaaaccctaagaaagtaatgcaaataataatcggatttgatatgtggaatttttcttgagttctacatgtcgaaattcattaacaggatttttagtggaattttcagagctctagaaataattttaaccaattaaaattgagcaagcaatattttaattccagggaaaatcctttttcctttttctttttttctttttctttttcctccctttttcctcctttttttgaatgggccgccggcccattctcttcttcctccccctcctccctccgaggcccatccaggccgccccgccactctcctctcccggggtcgccgacaggtggggcccacctgtcgggtccttcccccacctcccgccgctctcgctcgcgccgccgcgcccgcaaccgccgccgcgcccacgtctccgcctccttcgggccacgtcgaccacgcccgcgcgtgcgccgcgttccctgcgcccactcccctctctcttccgttcgcgcccgcgcccgagatggccgggattcgattttcgaatcccgcctctctctcttcccccactcccccacgtcggccggcgattcccgcctctcccggccacgtccggtcctctctctctccctatttaagcttccccgtcgctccctctcgctttttccccatttcgccgacctctcccgagctccccattgctcccgcgccgtgcaaccacccgccgctgccgtttccgcaactccggccgccgctagccgccgctaggctcgccgccgcaccgcgccgtcgccgccgttgggttcgtgcggccaaggtccacctcgtccacccctcctccgtcgaggttcgccgccggagccccattcccgtcgtgcgtcggtgagtgacgccatggccgccgccttcggccggcgccctcgtcctctcgcactctcctctctccctctaacccctctccttttgttcgttaggaggttccggagctcgtcccgccgtcgccatcgtcctccgtcgcccgccgtcgtcgaccgttgtcggtgaggcctctcctcctcttttttctctctctcccgcaccgtttcgccgtcgcgcgccatggtcgccgggtcggtttgcgccgtgcccgcgcgcaccggccgcgagctcccgccgccgtccgatctacccttgggtagatcggggccgtcggttcggctgtcgcgtggccgccgcgtggcgcgccgctcctccccggtccgtggacccgatccgccgtggaccgccctccccgagccgctgactggtggggcccgcttgccggcgcccttcctccctctcccgagccgctgaccggtggggcccgcttgccggcgccgcccccctccgcgctgacgtcagccctggaatatattgcgcaataaatgatttaaggtttttcttttatagtaataaacacagtgaatcttctaaaattcataactaattcatccgagctccgtttaagcccattcaagtctcagtaaatcaagaaaaatgtgtagaatccattaaaaatggttgtgttccctgtttcagtagtcttatagcctgtttgcaatgtttgctttgtatgtcgctagattccgacccctccgacgctccggtgtacttcgaaatagtcgccgaggttcctccagcagcagagcaaggcaagtcatgcttgtcacttgaacatgttgatcctatattgcaaatgctccattgttttctttcaaatattgcattgttttataatattactatgggatggttacctattgttacagccatgctttttggataccatgctcctttgttagcttggggttataacatgattagagtttggactaggaattgcttagccatgcttagttcaactagttcacaatggggaaaatcatattaatgcttagactgttggttctaatggttttgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcattcaggcaagggtgggcgtgatagagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccgatatgtcgtggtggcatgtcggcgcacgaaaacgtgtcgcggggctgtgtcttgtgggtacagttgtacacctctgatcagagtaaaactattcgaatagccgtgcccgcggttatgggcggtcaaccagattcaccgtgattagtatcaccctagtgtaatcttttgaatttggttagtttaggtggatggttgggcctgtcgcaacgtgggatagcgttggatagtggatgtttaattaattattacaacggtttaatctttcaacttctgtttataaatgctcgctttatgcaaatgaaccgctctagctcttctttgataattccgtgcatcatacccctattccggtatgacttgctgagtacagtgggtagtactcagtcttgctctacttttcccaaccccagagttcgagttcgggtcagatgaaggtttctccgaggagtaggctttgtccgtgccgtcgaggatgcctgtggagtggtgttcccgctgcagttttagtcaaggcttagctcttgttgtctttcttttcttccgctgcatttatgtaagacttttatgatgtttgtaagacgtggatctgaatgtcaacattgtcgtttgtgtaccccggctggtcctggacggggaatttaatgcacattctgcttgaaattctattcgggaatttctgggcgtgacacgctcggcgtactccaccaatggcagtggcacgggcgcagccgcacagagaagacgcccacgtgctcctctcgccgtcagtcaccgcccactcccagcgccctgaagaaaaagaggtagaaaaagagggggaaaagataaaagaaagagagttgaggaaaatgtgacattggcatgtgggtcccacatgctgagttagccaattggaccaagtcaaagcgccacatcagcaaaaccggcatccaaaaccgccgagggagttaaattatactggttttaatagttaggggagtcgttttacctggttttctggataaggggtataaattagattcgagatacttttaagggggtcaaagtagactttttccttgtgttaacagtgaaatttggtaagcccggagtaatcatcggcttagagtcagcatcgacttcgaagtcctgagattagccgatgagacttatcacgtcgtcagttgccggattcttgctatattcggttaaggaaattgatctactaaaggaagcttatccagaagagaccgagttcaaagagaatgcgacatagcaagttatctattaattaggaataatttgttagtttccttttatctttaggaaagtgtgtttaatgtcctataaggactttatcttttccttttatttgtagtttcattcttgtccgacaaggactagtatctccctatgggtataaatatgtacacccgaggtcattgtaatctatcaatctctcgatcaatactactctcggcgcatcgccaccctctttaccgaggtttttacttatcatccgacggaacttggcacctagttgcattgtgtttagagacgcatcaatttagttggaatgtctcggttaggtccgatcttctgtcttagccaatatatctctacaatcacaaaggtgttctaaatagatttgttatatccatcacattagacagatctatcggctcatcgagtattagattatcatatacaatctcgtgctgcatcggttaggttcgacctattagattgttgttgataatataagtcttgttaagccgataggttcatgctggtgtttatcggggtgctagccgataagttatctggacgttgcatcggcttacaaggattgcatatacatataagtttgacttagccgatcgcaacaaaggtttcactgtttaatctaatcttgtggattttatgacatcggacctacagccgatgtatgttttaaccgtcggatcagtgcttattctatcatatcattgctagctaattagtttctaatggattatgttattgttatactacattatcatcagccgactgcctttatatcattatttaagtcaagtgtcagactctacattggacataaagccgatagctcagaaacctatcgctatcggctggcatcggttatcggctggtatcggcatcggctggaattatttcatcggcttgtcaaccgatcggctatttgatctactctttacatatcttgtcagttgcagaatcaaactgactagcacgcccgcatctcaccaacctttggatctgcattggagctaagcagatctcaggccagtgtgtgtttttcgcatcaacaccttgaaggtattctggaggaggaggaagttcactttaggtcccttagttcgtcgcccaatctatttttcgtccttgatccaaaaaccggatataatacatccctcaacttatataaccatacaaacgaagtccctcggtagtattgactccagttttaactgacatgatgcctttgactaagtcttcgtcccacgtgacattgacatggcgcttacgtggcagtttgacaaaaaaaataaatggaacaaaattaaagactaaaaaaataaaacaaaatatacgggacccacatgtcagccaaacaaaaaaaataggacccacatgtcagtggttcccacttcttccacctcaccctcttcccctcttttccaatcttcttttgggtgtccatcctccatccttccccgctcctatggcagcggcaagagcaagagggagaggagcgcagcaaggacgccgagcgcgacgggcggcgagagaggagcagtgtgcaacaagcggtgagagtggagcggccgctctccgtggggggggggatggccatcggggagaagggcaatgaccggcgggaaggagctaggcgatgggcgcggtgtcaccgagctcgaccgctgtggggaggtctagggacctccgctcccgcctcgccatcaggcctcctaagctcccgccgcggcgaggctaagcaccaaacccacgacaaccacggggatttgggtcccctcccgtcgatgatggatccaagagccagtcaaagttggatcccctctcgtcgcgtctcctaatgccgccatcggatcccctcctgtcgtcgttgagttccccttttgaaggccgacatcaccattccctctctctgcacagctgcttccccacttctcctgcagacaatggtctccattacaacggaagaggagcaagccggcagtgacctcgtctcccatcaagcggtgccagtgaagataccccccttctccctctctatgcatgctcgctagggatgcaagtgggtagtcctactacccgcataaaaacccgcttgctagtctatttttcgcatgatagtacaaaatttagaagaaaaaatgaactagaagtaggataagcaggaaaaaaaagcctgtttgcctgcccggcttgcatccctaatgctcgccagccgacgagggagcttgaggagagaggaaggatggccgggacacggcacaaagaaacacgtgcagtacgttcgacgcttttcaaccgttccattagggcagtcccaacccatattgtccataagcagtgtctatggtgccatgtcaataagacatcacaatagaaactacactctacaacctatggtttcttaaagtgggccattaataaatataaactacactctacaacctatggtttcttaaagtgggccattaataaatacatcatctctcttctctaccaatcatatttattcttcatctattataaagagactattctctccaaatgcaaaacttgatagtgtctagtgcatgggttctcgtgttgaaactgtgtcttgcatgagacccggtttcttcctctattcactctctctctcttaattaatacagtgtcacataagctaaaagtcctacatgacagtagttaatgccatatataccatcttagatggagagttgggaatgcccttagaaacaagctgactaaacttatgtaagttccttcgaatgtatccttaacttcaaacgaaacctctcttcttccttttctcgattcagtgcaaacctcaccagtagatatatgcaagataagcgcaatatcgcattactcatcgatcggatacatcattaaatcacacgataatacagccaacaaagcagtcacgtcaaacgatcggcctgcaatatgcacgacagtatcccaattcccacatacacggtacgccccggttcccatcgatgattcgccatctcgcaacaccacacagtttccactttccacactcacgcaccgaagaaatagtcaagtctagctcgacgcctccgatcatacggctagcgatgctgttgccgccggggtggctcccccgagtcggcgctggagtgggtcccgtactcgctgctgtcctcgatgctgctctcgaaggccaccttcctcaacctgttgatgtcggaagcgtagttgccggagtcgtactccgaccccgtgctgaacatcatgctctgcccgggcttcaccccttcgttcaggtcgtccagcgacgcgtcgccctccagcgcacggacaatctgcaatacacgcaaagaagaaaaaatatcatatattgccaggcaaccaggtgatcgatgatcagtttgatcactgtgagctgtgcggtttcaattacctgcttcatctttgggcggcgcttggcggagtggcggacggcggcggcagcgcatgcggccatgcgctccatctccagccggtcgaacttgttctccaggcgctggtcgatcagctcgtcgaaactgccgtcctccgacaaggcgcgcgccaggaggggcctcgcctgtcacgaccaagcgatcgagtggccggcgtgtcagaaccacgtatgtaagcttaggatgtagtagtggtagtttgcgatggaggcgagggtgacgctcacccagtcaaccaagctgtcctccatgtagttcgttgggtcgaccggtcgccggccggtgatcagctcgagcagcatgacgccgaaggagaagacgtccgatttgtccgtcagcttgccgctcgacgcgtactcgggagccagatacctacacacatgtaactgggactcgtcatccgtgcccgctcgtccgtcatgcatgtcaacgagcgagccacggtctcatgttgcactaacccgaaagtccccatgacgcgcgttgagacatgcgtgttggtgtccgtggttagctttgcaagcccgaaatccgcaacctaatgcaaatgaattcaaacaagtcaggactagctagttcaatcttaaacgcagcttaaacaagctggtgtgttcaccttagcatcgaaattctcgtccaagaggatgttggccgccttgatgtcacggtggatgatcctaggatggccttcgtacgtgacaaccacaatgcaacaaatcagatcgttagaaggacgtacagacaggatttgtccctgcagactgcaaattaaacgaaaagtttattagggaccttacaatcttcgtgaaggtacgcgaggcccttggctgagccgagcgcgatggcgagcctcgtcgtccaggccatcaccggcacgcccttccctgcacgcatccggcacacgcgcgtgtcagaatcgaacaaaaatctcacgtacgaatggcgcgttacgatggctgggaaaagagcaggaaagatatggagaccgtggaggtggtgctcaagggtgtcgttggggacgaactcgtagacgaggaggcgctgggatgagccggcgatgcagtagccgacgagggagacgaggtggcggtggtggacacggctgatgatctccacctcggcctggaactcgcgctcgccctgcccgctcccggccttgagctgcttcaccgccacctccttgccgctgcccgcgaggacgcccctgtacacgtacccgaacccgccctgccccagcaggttcgccgacgagaacccgcccgtcgccagcgccagctcgtcgtacgagaaggagctcttcgagaaccccagcgccatgcccggtgacggcggcggcagcggccccgccccgtgcgacccgctcatctcgctgctcggcggcgcctggcctggcgagtactgcgcgtgccagccgccgccttggtccacgctgttctgccacctgggcatgctgttcgcgtagtacactttccctgcatgcacgcggacgcgggagcgcaccccatgtcaactgcacaagatctctctgcggcatgcgtggcgagcgcaccatgccgtcgcgtcgcgtgtagatgtgtgcttaccgttctcgtcggtgtagtacggcatgtgcatgtggggaggtctcttcttcttcttggagcagcacacgcaggcgacgatggccagcagcagggcgaaggtgaagaacccgatgaccatgccggcgatgatggcagcctctggccccggcctgttgccgttgctttcgctcttgccacggtcactcgagctgcctccctccttggagctcccactgtccgaggaggagccaccgtcgccgctacgcttcggagcgggttgagactggacggcctttggcgctggcggcgagccatgcgatggtggtggggacccgccgccgccggtattcgccggtggcgccgactgcgacggggaaggtggcgacggtgctgagcccgaggaattggtcggtggggccgacggtgtggacggtggcgggctggcaggaggcggcgatgaccccggaggaggtgactgcgacgacggaggggacgacgacgtggagctcggcggtgatcccgtggagctagagctgtccgcgcctgccgatgaatccaatccatttccatcaaacagattatctagcggggaatcgtccatttcccgccggacgtcgagacggatctcgccccggcgatgatcaagacgattccacccctcccacgagaggatgttctggaatggaacggcgcggcgcgcctccccctcctcggctcctcgtcgcgataaacccctgcaaaaatatgggaggaaaaaaatggtgatattatctaaaaggaaaaaaaaaagaaaggatgcataaccatgggagaggatagtgagggatttgaggattttatctgcatttgagggacttgtctcatgtttcatcagacctttggtttagttaacatgtccattcatacagaactacacgctgaaaagcagtccttttttttttgtttatcttacattttagaatcctggaacatcaaggaagatagttcaaaagctactttaccttacatcttagaatctaggatcaagggaataaccacattcactttaagaaaagcaaacatcatgcaaaagaaattggggtttatgaaactggaggtgagatcgaatacaacattcagagtaccaaacaaatagaggaattgaaatgccatgaaattgaagaatcaataatgtaccttcctttttccctgttctttctgaaaaaaacagaaggggttgaagcagaattgggaagggaaaaggaagtaggcttcaaagcgctggtttcgtcacattgtccaacctccaccgcaccgcctcgcgcgcatttctgggatacaatctctttatattttctatttttggtctccatgccaactgggacgttcccaaccattggagctcagctgacaaacatcattatcattggtggtcaagggagcttctgtgtagattcaaaaaaaaaaaaagagcttatgtttttttccactccgcacgagatctagtactcattgccatttgtgctaaaacatgagctaccctatttgcttctctctttatcttgtgcacttgcacttgttggaaacactacatcactcctttaatctcttcaattgtcgtcgcctatttatcttgtgcacttgcacttgttggaaacactacatcactcctttaatctcttcaattgtcgtcgcccaggccgatttcaatggcccctgttgttttatgccatcgacaatttcagcattgtccatctccatcacaattggcatgtggatcaattcaaccgccgatcacagtccttctagacatgctagcgcctccgcctgggccgaagaaccgcattgatgcaaggttttgtggccagcaagaagcaccaaccccttcagtctctgaatataaatccgacgcttgcatccccagactcttctctgtaaccagcgtcaacattcagtttagcgaaatattccggcggcgcacaccatctgtcagcctgtctgttcatacttgtagttggaacttttttattatgttccatatacatagggcccttccctttgtgatcatcttcccgttgtcggatcggctacaattgattttcatagcttaccaggaagctagccgagtcagctattgatgcatttcctttaccatggatcacgtcatttcgcagatgccaggctctccaaagtaaatacatctgccttcgctgaagtactgagactgtccagcagtactaacagccaatcagggcccgtccatgaaaaactccaaaaaaaaaaggagtttatgtatattaccatgcaaatgctttgtgccatgtagatttcttttctttcttttaataaagagccagtaatagaaattaaatgaattttgtatcagtaaaaaaaaacagtgactgaatcttcggtcattaacagtcagcagttgtcaaataacaaataacttatgcccatataagaaaacagcatcgaaactggtgtactgaacactatcgttccatgcatctttgtgtaacgtcagacaggacagggaaatttcatacaagtaaaaacaagagcataaggatagattttgctcaaaagtagccagtatcccattaaataaagagcccgataatacaatgtagcagcagctcaattagaatcgaagcaaataaagtatttcactcacatatctaaaccagaaagaaatggacatccaatgaagaaacgtatgcaaattactcagttccagggttaaccagtgaatgtttggagcattggacaatgcatgcactgtccgtgttcgaaactcatacagaaacaattatagcacatcacccaactatacaagtgactcagataacatactattcaaacaactgttccgaatcagctatttcacttccaggagttcctgccgaagatttaacaaccgtctcttgatcagcataaataaaactctctggcaatttgagtactgctcgatctccatcagattcaccccggtaggccagcccaagagcataccccaaagctcgagcaactggaattgcaaccgcattgccaacctggatatatctacattgaacaagaatacatagcataagaatggaactacacaacactcatctgtcatatactattatatctgtgagtaattcaatccaaaatatggacactaaagtccatattactgattcctgaatccactacaatcgatacaaacatcctataagcacttacttctcctttagtgggccgatcaatctgtaatagtcaggaaaaccttgcaaccttgcattctcgcgaatagtcagaactcggtcttggctaggatgcaaaataatctgcatatgggggagtccgtttatgcacaattacaaccgaagtggcattaagatgggaaaaacgccaaaaaaaaaatgatacctggttgtgaggctcagctctggtaactacagtgggaacagtttcatcccaccacaggcgtccaaacggtctgcattgccagattaattagaattatcaatcaagattgtgtaaaatgaaccattatgctcaacgtacttacttagttgacttccccttgacgaaagatatggcatagtcaggcacctatccagagaagcagtaattaatggcatgcaaaagaggaaacattgacattgcagttgttgaaatatagcaaaatataaaagtaccaaaggcttcccagatgacagtcgttcacgggaaatgtttggatccagccgcacagtattatctgggccaactatgacgccctttagatcacgaaagttcgctccctgaaacagaaaaaaaggtaagcaaccaaggtattgaaagtaactggcatgacaatcttaagccttgctaaccttttttacaggtatccgctgcacacgctcataatcatctttgtttagctttagaggttgatgatcaaacaatttaccttcttcagaaggatcatctccacgaaaagagtaatcctgaatgtctgaaaatgaataacaaaacaaagtaacttggcctagaaattcaatcaagaaactacaagtagcaacacttagaattgcataaaccaacgggcaaggcaattgtcaaacccacacactaatgaaaatttaaatagttagaattccacaaatgcagagggaaagagcataacaaacgaacatagccctccatcccataaaaaaataaacctagtaagggatatggatcatcttaatactacgaatctgaacagactgtttcacatcccatattaggtgtgtttttttatgggacggagggagtagatttcatgaacagtatttatcgatatttgttaattcaattagtaacaaatcatggactacctttacggttgttccggatataccgttgaaattcagttttgggggcaacactatactctattacatctttaggttgatcatttccaacctgtaaatttgtaatatagcacatacaaaaaaagaacaacacaattgtccaatcagcattcaaaagataaagatccatggatatatgaaaataacacaaaccttgggtaaatcagatatggcatctgcaaggagaagagcctttcgtaggcaacgggtgtctacctcattgtatgcagcaacactatgctgcaaatggagcagccaaatattaaggcgatacataatacaataatgaaatcttggcaattatttactcaattctcttaccgaaaatgtagttggtactattccacgcacaacagcatcatgggtaggaagtgggaattttggtaatacctattggtgaatgtaacatcttaatatgcaaaagtgtcacaaaggaataagattaagaaagcatagagagaaaccattgatggaagggctccccagagaaatgcccgcattctgaactgcggtagcccataatatcctgccgccatcatcccaagcctagcttgataattcatagccacaaggcaactcat

SEQ ID NO: 80984 - DNA, 22804 bp, Oryza sativa
gcatcaatgccttgaaaaggttttattttgcaaatggttgacttgagaaaaacgccgttcatcaggaaaactagctagtttgtaagtcctggaaacgaatcctatattttcatagttgagaagcaattgtttgaacattgttatgagtttgttgctacactgttctgaagtaatactacctctatatcaaaatataagcatttttagctatgaatctggacacatagttgccaagattcatagctaaaaaagcttatattttgggacggagggagtacaataataacagtactcaagatttgaatcgaacgctgaaagaaaatgcactctactcatgctttgtactccctttgtcccattgtaagtgtagtgggttttcgtgttcaacgtttgaccgtccgtcttatttgaaaaatttatgataaagttttaaaaattaagtcatgcatgaagtatcattcatgttttatcatctaacaacataaaaacactaatcataaaatcatttcaaataagacgaacggtcaaacgttggacatagaaactcacaactacacttaaaatgagacggatagagtagtttattacggagggtctaatttcgtatgtccttaatttcctcctaactaaatgaaaatcatgatgaatcaaagttaccttgaaagtcacatttcttccgattgtaccatcaactaccatctcactcttatctatacaccatttaatgagatgcaccttattctttctaatcaaatcttcgatatcctaaacaatctagaattacaattattttgacacaaatgtagtaaatcgttagatacgtatataaaattttacctacatattattctttttgttaataagccggcatataattaactctacgccaactgatgaggccgaagatgtggtagatacctatcgaaccctataatcttaataataggagcaccctcacatggcctaggaaaaaccataggacaaaactgcaccacatcctgattagttatgatttgtgaatattatgacatgggtatatttccattaaaataatgaaaaaccggttaatcctgcaaaattgagggaaaaataatatcttgaaaaataaattcatgatttggaggaggccaaactagaatccatgatattacaatatctcgtaacagtgctggagtggtgtttgtgagttcagggagagggagattctctgattttttttctatcttttctaagaatagctaaactagttctaggaaaagaatttgtaataaaatttgtagtactaataggagatgccccctaacgtttcattttgtccaagtatgtcctttgacctgatacaattcttcgacacataaagtgctacgtgggcatgtgtactatttgtggtaggttctaacttgtaaaatgactttatggcctgtggatgcccaagcaaataaaaaaactcagtgacaccatgttaacttggttcttttggtaaaatatctatacttcttctttaaagatcctaaagacggtggtaagtgggtccccagacatatcccttccccaacctcaagccataaaacaagggaattttctaatggtgacaaataatgacttgaagattttataatgaaaataattttaaccacggcatggttcttttttttttaattgccattgcaacgcacaggcgtccaactagtagtaataacatgaatagtgtaagaattgaggtggcttgtctacttgaattcctatggattaataaaatgtaggaatttttgaaaggggaaattcggttcatagcatgggtgggacttcaaattcgaaaaaatcccatgaaaactttcgcacctatgctatctgcatacttaaaaaaaaagagatagatagataaaaaaaatggttcccatgagggccagcctaatgaaagaaatcgttcaaaattcccatgaactaaacagttccatataaattttgtagactaaacagttccatataaattttgtaggatctcaaatgtccattactttgtttcaaagcagcaccaaggaaaattttccatggatcttacaaaaaaaagtccagttcattttccttttgttcgaaggagtgaacatgcatagatgtgatctaaacttgtgaactccatttccacaacatcatgtgtttttttttatcaggaccatattactacattagcgactttgatcatgcatcactgtaattccggacagtgcggtttgagaaagaacaaaaaaagaactctcactgactgagtgcctaactggtaacttgtctagcgttctgcaagacctgatgaaagggtttgccttgtcatcataggtaactaaataccggctaatcccaaagaacagacttatgtctatactccttccgtcctataatataagggattttgatggtaacttgtctagcgttctacaagacctaatgaaatggtttgccttgtcattacaggtaactaaatgccggctaatcggctaatcccaatggacagacttatgtctatactccctccgtcccctaatcccctaatataagggattttgagtttttatgtctatactcccttgagtttttatgtctatactccctccatcccctaatataagggattttgagtttttggttaaactgtttaaccactcgtcttatttaaaaatttgtgcaaatataaaaaacaaaaagttgtgcttaaaatactttagataataaagcaagtaaaaaaaaataaataataattctaaaattttttgaataagacgagtggtcaaacaattcaaacaaacactcaaaatcctttatattaagacggagggaatcctttatattaagacggagggagtaccgtttttaattggagtctattgacaagatagataacacatagcataacacagagaagcagttataaaacgctttgcttcatgtcacatgatatatagagcaaagtcaagatcgaaaacggactaaaatcatggatagtctgggcttgtttcatgccgggtaacggagaagttaccagatgtaaaaaacaaacaaaaataagtcatggatagcgcatccttacgcatgcatagagacatttgagggcaaaataaacagcacgtcaacagttactgtccaacgcaagaagcccagaagcacagcaagcaaaacaaagcagcagcagaagcagcgcatcagcagtttaccttgagtgatttcaaacagagctaatggaataaaaacagacatttaaaacacctccattgtcatctcaacataacataactagaagtagtaccttgagtgatgtttacgttattacaccacatctatgaaaaagaacagaagaaaaagaaaacccagtcattgtgtattgttctggaatttgatgcttgagcaggtgatgaccattcaggtgagccggttcatcactaagagactgcaaactgaggctcgaaggacgtagattaattagccctgcttgttggcatagttgtcaggctcgtcatccttgaagaggtcatccatgagctcatcgttcttgcggcttccaaagctgtcaccaccggcaccggagaaatcaccaccgccagtggaacctccagcatcaccaaagcttccagctgggtttccaccaaaactaccatcaccacctaagttgattccagagaaggcatctgcagatccttctgcaactccataaccacctccaccaccacccctgttgccataccctccattgttgccaccataaccaccgccgcctccttggtagccgccgccgccaccaccaccaccactgtagccaccaccgccatagccaccaccaccactgtagccaccaccaccatagccgccaccgccgccgccatagccaccgcctccatagccaccacccccactacggaagccaccagttctctcattggcagtgttaaccctgatgttacgcccatcgagatcctgaaaccagccaggaagaaaataagctgctggataagattgaacaaaaatgactttggtttaatggaactgttgcatattttttttaactagaaaaccagaggtaaataatcaaagcatcaacaccataatgcatagtaaaataacaaataagaagctcaatcagaacctttgaaatggaacatctccaatttctgtaacaaggaatctagagtaggaatattcatttaagcgatcgtgttgcatacaagctgatcaggcagcatgaaatttgacattctacaaaccatatcttttgcaaaagtatggaaacatggcagtgttgaaaatccacttaaattggtttgcagtggtaaaatccattagagtaatagaaattaagggctccaaaactttagaagcattctaagtgaatttaaccagcataaatcattacaccttaagtttgacagaatacctattaagtctggataaacatatagatgatggggtaaaaaattaaattaaacctaatctgaccctcaccatacagggaccaactcttagaatcctggaacataaacatgatgcccgctaaaattaattccctataagattacctttccatccaaggctgtgattgcagctgaagcctcttcacttgatgcgtaagttatgaagccaaaacctctagacctcccagtttcacggtcattgatgatcttagctggacagaacaaaagtagaccccgttaacaaaacaaaggaccaacaggagtgcagttacaaaaataaggataagataccttcaataacttgaccataattggcaaaagtatctctgaggctctgctcatctgtgccgtacgaaaggcctacaccaataatttgtagccatcagaaaagaacagtacagagagaataattgttttctgaacaaatgatcaaacagataaaatatagtatttgcaaacctccaacaaaaagctttgaggatgacatgcatctgattgattgatagagagctggacttgagctcgtggctctcttgagcagattaccaatcttattagccaacgccattgttccaaactacatgcagtggtgaaacaaaggaagacataaatatagccatctaaataacacaatacagctggagcaagtccttgtagtgtcacaggaagaaacaataacagcaagaagaaacacaaaaacagagtggttgattagaatccgagctcgatgggattgtgcagacaccaatttacagaagaaagcaatgccatacatctaacaactaaatcagacatctcatatagcaattaacttcaatatcattccatctcatatctcaagaacgatggaatggttttaaaaattgcaccacttgcaagtggaaatctcaataggaacatcccaagctggactatctcaacgttactaaaataataacatcagttacatgctgaaatccacatttaaaaaggaaaaagcctaagatattcactattggaggccaaaaaaaaggaagatttaagatagttgactttatggcacatagtgcccagttttacggtttcaaagattcacagaattcatccttgttcaaatcttatatctaataatagaatatctgaaagaatatcaactaacacaaggtttgatattcaatactatttcatggacactttgtaacatgataaatcaagcaaacatgctacaggccatcagaatactaagggttttctgcaacttcaaccataaaacatgtgatttttttttaacaaaacttactcaaagatcaaacctcgcaacatatgagaatctgcaggccctcaaataccgacccaaaaacttccattcatcaccaaccccatggtgacatctactcaccctcctccaccattcaagccccctccatccctccagccaaaaaaaccataaaccccacgagccgagcaacaacagcgcaacactaatagatcgtctatcttacgaaccacggagatctccacgaaccctaacgcaccccgcacaccgccaaccaactaaacaaacgcatccacccacccagccaccaaaaagccccccaaaagaatgggggacagattcgcaccaaatcgctggatcacaccgacgcgcgaagaaccccgcaccaccaccaccccacgcgggatatatattaattaatcaaatcaatcgaagaaaatttcaacgaaattagatggggaattcgcgagctagggtttaagcgtctcacctgacgagggtttacgatggagaaggcggcggcgaggggggaaggaaaaagatgcgcccgtggagccgtatatagggctcgaggagcgatctcagccgtccgatcggaacggggcggcggtggtctccgccgttggatctgggcgttgacttgtcaacgacagatatttcttggggactgggaaaagcgtgggccccgcatgtcagtggaagtgagccctagtttataatttagaatagttcgagggggttaattgcaaaaagtgagggtttgtgagatcggcggcgagagatggcggcgccgagggagaagtccgccgcggcgacctcgtcggcggcggcggcggatgcggcgggggcggggggtggaggggatcggtggggcgcggcggtggggaacctgacggagctgggggcgaacgtggcggcgctgcagaggctgctcgcgaagaaggcggtgttcgtcgacgaggacatcttctccaaggcctccctcgccgccgaccaggcccgcaccatcaaggtgattttgctctgctttgctttgctcgttgctggtgctcctgattcgcccccaatcccttcgccggtatcctcggcgatgctgttttgtcagtaagtggaatgtaggatttgcaattgttgttcgtatcccagatgcgtcgtgaatttgatgtggattctactcaacccagctgaattggtgtcgactccactcaaaatgtgactgggttgattagatcattcatcaatcatcatgtagttatcatcagaatgatgtgtagtgtgaactctccaagaactctcccagtgtaaaagaagaatggtttgatctgatcagatcttgagtgattgcactaggtgaaccgctgagatccttgtttgagtaaaataagaacaatttgattcacatcctcattgatatgacatagtcatttgggatggcatatccgagaaaccagttttatacatgagattaagattattcgttatatctcagtagttaggagcattatttgtgctaatgtgtactctccctaacttagcatttgtgatcaaggtacttggcatatattgttctaatctaggtttagatcactggaaagctatcaagagaaccctgtactatctacaagggactaatactacatgcttagtcaaaatcaactatcaagttttcaaagatagaatctagtatcaaccaattaattttcagcatacaagtagttaagtactaagttaatgattgttgacccccttactaagtcttgtctccaaatctccttcgagaacttattgccagtatgatactaatgaaaagctcatataactcagggataattataatgataagatgtcgaattttgattctggaaatattgaaagtttgtttctcccttacgaagtgcacataatgattaatggaaaaacaacctatgaaactatattgaggaccatgagaaaggagtatgatcacgttctttctgaactcccaaatgccgtaaataataacccatatgagatatagtggtataccatagacaatgaagttcagttatgattattttgtcaccctaactacattatctttgtgtggtgctcttgccaaagtatggactaagattagttattcaatcaagtgggagaatgttagaccatttagtgtgatccatgagtgaattgtgtaattaacccattggttgaagggcaaatgggtaattaagcaattagcctgtcacaaatggttaattcgctgatatgctttgatcgtggggctaaatagaatttatagaaaagggtcaggtccctagtcagattttacactataaattgaggagcatcttgttaccacaaatctaagtgcttcttgtgtgtcagcaagtgactgcctcacaacctcattcccgaactaattaggaagtgcaatttggttggctcaaaggctgatccactccagaggaggtttcgtaggacagatcccctcgattcattgtcactcgttcatggatcatcccgatgaacatcctcaggagtggattgggcttcaagacagcaaattatacttccggattggtttgggaataaactttttggagctcacttactgtgacatgagaagtagttaagttcgcagtagtgggacgcccccttaatttatagcgcataacctgacttgggacctaagcctttctgatagcctaattacttaagactcatgttatcttttaggctaatggaccaattgcatatctaatccattgatcaaactaaatgatctaacacacttgtgcagattggtggatctcgtgagtgattggaacctatattttggggtcacaagttctcacgaaaatcagaacactaaaactgatgacctgtagctaatctagtggacaccatgtagatattaggatcattctgatttttgttcttttgtattccgtcctgtgttggcaacattaaatatggtattgacatcatagtactcacatttctgtgttcatataacatgttggttagatgtcacaaattattaacctttcataacctctccatatctgaaaaaaggttgatatgggatctgctcaatctaccttttcaaaatttgatcttgaaaatatgtcaaagtatatttattggctacatgagaaaatattaaaatttggctcttgcaaaatacttttataatagataagttcaatcattttgctagtataaattatgatagtataccataggcccagtcatacattggagactgcaagaagtaaaaaccgacttatatttaagctggagggatgtatttcatctctctccagaaatacttaataattttgcaagtcaatggctgcaaatgtgaagcagtaaattggcattcatggctttacgccagtacattattattacaaaaaattcaccgagacttatttatgttgtagaagtgtgctgtcattgctgtccatatttactttgctaaaatacaattgttaaattgtatgtatgttgataataagccaccatgtaagattcatggttcttaacatttttatcattacaaatataaaaatatgttgtagtcaatggctgcaaatctgaagcagtaaattggcatttatggctttacgctagtatattattattacaaaaatataaaattcgctaaaacttatatttatgttgtagaagagtgctgacatcactctgatgtatgttggcttttaactaaacattgtcccaaaagaagctatgtaagattcatttgcacttcttgttgcatgttagattcttgaccagagggtgcagtcgctggaacgtgaactagatgctgccatttctgctgctgcccgagctcgtacagagaaacgccaagctgaagctgctcaacgagctgcggagttacgtgcgcaggaagtgaccaaggaattggagaacactgcaagtatgttatgtttcgttgtaaaccattggcatttggtaactgagcgtgtcaaaagctgaatgtcttatctggtttcattttatcatcttgcagaagtgttcaagctacacatggaagagttgcgggcaaagcaagaggagattgcaaagaaagaaagtgatatcaaggtgttagaagcaataattcgaaccctgagtaacaaagatgatgggggatccagcgaataatttccattcagtagcattgttttttttttcaatggaatttacatgttcaagtatatcatccatgtattaatataagcccttaggtaacagattattgtaaatgttcgcaacaggacatccaaacagattgaagatgaacattacaactgatatgcttgactgttcatctgccactgcccagccctactacacctaacttgctgctggagggtctaactgactattggaaacaaagtattggttcttattactatgcaacagctagcaatcatcaaggagaagatgcagcatttgattcctagtaaagttggtggtttattcatctcttttttcgagattggatcctttatagtttattcacatcaaagtttgtggtattcttatgcttgtaatttagtttgtttccactgggatcctgtattatgcttaagaggaatacccagcgatattatgcttgagaagaactgacagacgattgcaatttgtatacaagctttgtacaacaaattgatactgtcatttgtgctcccgtatggccatataccagtaaaaaaaaagaatttacaatgaaatttctcagcgcaagaacaccaactccatcaatttaagttgtgctttggatactaattctgaagcactgatgatttgacttatgatgcttgttggtatcacaaccatctcaaaacatacaaggacgtgttggtgacaaggtattatatggacacattctctcttcctagtacaatcatcgaatgaaccttcttcctttttttcccctacatatattaatctatttttagtcatcccctcatactcaaccatgtattatagttggtagaacattacactacatcttaggcagaagatcaccatcataagctgtcatgctgatgatctctaatccaccgcgattgcaatctaccatccccgttcgttttcccaccaaaactcgcacaaacaaatttaccacaactccaggaacctcagcgcaaaacttcctctccactagtatgccaaaactcattagaccgttttcattattgaatgaattattgtcgcaaatattgtaaaaactaaatatcttaaaaaataaacctaacaaataacttaagaaacttagtcttaagtatattgaagtgtaagaaaaattttcaaaaaaatgtactatatttttccaatacataaagaaaataatctgatgcaataatactataattaagttgaaaacatggctataaattttcgcacaatcaggcgtcagcgaaaacactctgttcactataaaaaccgacttacttccttctatagtaggttcaattttaacctttttatttatctcaaaataggttcatttttataatcattgtatcaaaatttgttgtgaaagtaggagataaatatatttagaagtagataaagtgaagaataattatattgaggtttgataaagtaggggtattctagtcatcttaatgttgtattagtatccgtggggtatataaaaataggacatcatgctctggtgttgggctcaaccaactacaaaggtccgaataatgaataatgaataatgcatgtcgtaaacttgagtcaatagtcatgtaactctttgccaagttcagatggagattcacaaataggatctgaaaattgtgttttctttatcctgtgttggttttcattagtgtgtgcttgcttaaggtttggttagagtgtagttctatgaaagcttttgaacgattttttaaataatgggttatagctctttgcgcaaagaccggaatgatattccattatctaaattgtaaaaattaacttgttgtgcgacggaggaagcattagaatttcgcacaaacacagggacctcaccgcaaaaacgcaccttcctaaataatggcggccgccgaccgaatcgcagcagcgagcagcgatcccactcctcctcctcctccccttgttcgtcgtctccgcggaatcgatcgcgccgcgcgcccacgcccttcctccctcccggatccggcgcgtaaggtgcgtgcccttcccgaatccgcgtccccaccccgcgggccgtttcgagccccccgattcggtggagatttcgcggaaatccttgtgaatcttggggattctggtgatgcgatgatgatgatgatgatgttagaggtctaggacggtttgcgggattgagcgaatgcgcggtggattggattggattagggtgttaagaggcttttggccaaattttgtgcccgcctcactgtgatgcaaatcttagctccgtggtttgatggtttttgggtttgatccgtttgatgctttgattttactattttaatgttgtggaatgcagattaggtgcagaaattcgctgtgttcttttttttttcatttctgatgagttgtgtgcagggaagatgctagttatagcaaacggacggaatgatttggattatcggtgcaaatcattgcgcatgtttggatcacgcacggaatctttgttgtgacactatcttgcgctcgctttgttccaaacgcagcgctattattggagaattttatagtgtgatgtttcctaataccatctgtgaccgtgactataatcaaatggttgttgaggtggatacgtcggcaggctgtacctaactaagttgatctgcataattggaatgttcttgatattatcaacacaactacatcgagatacataaaaaagaggaaaatgccatacaagttctgtatagatattcattaatctgtttagataattagttcattttgtaagaaaaaagaaactgagcgtaaggaagtggttgctaaatttacggtttccatttttacacgttaggtatgccatgtattatgacctatgcaatttcccatttatgtttgagatagtgtattgatagtcaaatgctctaaagcctctaacatgtcgtggtgcttgaccacttacacgccacattgttgttatgctgtccaataagatgttcatgcattccaacctgtgagcctaggaaacggacaaattagatgacgacaactgaatttcttcttttctttagggtttgtacaggcaaacaaacttagcaccaattatattcaccttttgtcttaaatgtctgctattttctaaagttttgcagttggccttatgtatgtttgagatttaattagttctttgagaataacactcgttttgtatctgaaactaattttgcagagtaattgacctttgaagttctataagatgggtcgtggtgttagcagcgggggtggtcagagttccctgggctacctgtttggtggtggtgaagctccgaagtcagctgagaagcctgctccagttcaaaagcctgccccttcgtcctctgcagagaagctgaaagagatcccagccggtattcaaagtagtaaggcgaacaattacatgagggctgaaggtcaaaactgtggaaatttccttacggttagtgtccactttccattataaaaacttcaattagggttactatccacttatggttagcatcaataattgaatgctagtggaaatacgaaccttactgcaataatgtcttttgggggggcattttgataagtagtagttgatcaggaattctaggggagttccttaagtagaaactcattatttcaggttggcacttttgccttaactcagtaattttacaaatttctgcatgtgaatattaccatctcatgctgtcttgaagaaatatccattttgtactcatttaactctcagactgtacattgtctggtctgaaacgtgctaagatgccttacgtaacacacaagctcacttcgtaagcattttgcaattgatcttacttgcattgcgtccgatttgaggctttatgctgacatttctttcccttttgtttgcacaggaccgtccgtcaaccaaggtgcaggctgctccaggcggtggttcatcacttgactatctcttcagtggcaacaaggatggcaagtgacggtcactctgctgtccggtttaccatgagctctggatgaaaggtttctgctcaacaaaagcatgttttcccatgagtaactaactatccaatgtatctgctcatggtatgtcacagaaactgttgttatgtatgcatgtgtctgtgcttattctgtgttgatgtatgcgtgtgcttatcagcagctacttgtgcaatgaactgatggtatgttcatcctgttgcatgttagttcatggaaccgggtctttatgctaacattaatgtgcttgcttctttaatgtataataactgtgttctagttgtgtcatacccctcggattggacatggttgtggtttgatgctcattgttgaagcaagaaatgtctctgttctgggtggcatatttgtgatatgttttccacatgacccatgttctgtgtgtttgctgctttaatgtgtaataactgtgttctagttgtgtcgtacactcgtacccattagattggacatggttgttgtttgatgctcattgttgaagcaagaaatgtctgtgttattggaggcatatttgtgatatatttttctacatgcatgacccatgttctttgtggcgttttagttctgttctgtatttgctgaaacggtgaagatcaagtagttatctgaaatctagagctggtgagttacttggctttagtttacccactacaccagtcaaaacaaatttgttatccattgcaaattaagtgtagtttttattttgcgaagaaaattaagtgttacattatgatatttcgaaagctatatttccggaccttaagatcaggattcatatctaacgatggccttgacttgcagtacttcagtgccagccacattttgacaaattccaatgcaatgttggcctaaaaattatcttggaacaaacaggatggtgaatttttctaaaaatatttcacaaactttcaatgcatgattgcataaaagataaaggtatttctggatgataagatggtgaaaaatgaagttattttgaaacaaatctaaagtagttaaaggattaatctttctcaccaccacaatttgccacgtcatcagaataatcagagccgttacatgcagcatacatataaagtagtgaaaggattaatctttctcaccaccacaatttgccacgtcatcagaataataagagccgttagatgcagcatgcattcaatagataacagcggatctagagaggatgggccggtaaaagatgactcatcaggtcggattcaggactcagactcaggagtcttcggaaaggattagagaaagaaagcaaggattagagaaagaaagaagacctatagtcaaatggaaaaggaaggtcacgtattctctccatccatcaaagttatacctatttcacctttgagttttttcaaataagttgttcctatttgtaggctttatgcattcaaaacttaaatgaagagataaattaaatgtttaattagaacccaaggagtcacctaaacacttgttggttgcatgcttgcactcactccttgattttgtaacaaccaggatgattcgatttctccttctcttggtgacaaaagtaataggtagcataacttttatggatggagggagtactaagcaagcttcctggtattagctagatagaccatagctattgggattacgcatgatgtaattagattagcaaggaagttagtcaattttaagtgtttttaaggcattagagacaaagttgacattggttattttatgattgagagtaaaatatttgaaaatatgaaaaatattattgcaaggcaataacatgattaacaaaaatagaataataggatatataaacaaaggtaaaagataggaggatcaaaattattgaataaaagaagaaaaaagtatgtattcaagcaaattatgattcaagtggaaaaacatgattaaatttttaatcttaatgcccatggtaaattacctacggtaagagttgtaattgatatgcgaatttctaaattatgaaagattcacacaattaccactctagaccgattgcttttcttaataccactttcaatcatttaccaaataaaaaatggttttaagatattgaacatgtcaacaaatgtatattaatattatttcttgatcatttacaagcacaaaaaataggcaaaatttgccacaggatatccaaaaatcatgtaattagctagaagacacccaaaaaaggcgacactgccaatggacactataaaatttgtgcaattagctataggacacccgaggcaatattttattattttcagtgaaaaagaggagagagaaatttcaaaaggacggaaatgccctcagcctcagtacctgaaatccccatccaacttcaactgcggcggcggcttcggctggttgcggcgttgggaagcgacggcggtggtgatggctcggccggtcatggtgcaccaggagctcgccgcgctgcaggagctcgccgtgcacgccgcgaactctggtgaaggcgccacgccgccgccgtggtgcgtctcgaagctgagccccacggcgccgtcgccgccgccgcaggccgcggtctgcaggtcctgttctccaccgacccgtcgccatggatccacctcaaacctgcacacacatcaacaagaaaccaatcaacggcaacaaatcgatcgaatgcaatgcacaaatcacaatggcgatggagccgctcgccaccaccacccgctgctgcagccgctctgcaacgctgccgccgccgccacggcgcagagctcggccaagtccgcgccaccgacgccgcagccgcaccagcagttgcccgccgccgccgcgcacctatccgccacgacgcacctgtccgtcgcgccgtgcgtatggtggccgtcgcgcctcgccgtcgctggcggtgagaccctggcggagcgccgccgctttttctgctgcgcgccgagccgtcccggctcgggccgtcgctccattcctccgctccgccacgtgcgtgaggaagaagaggataggagagagatgtggaccccacttatgattagcaaatagtaatcataatgcattcatagcattgtggtacatttcttgcaattgattatgaataaccaatactatgaaaatcatctttcgtggcggccattttgggttttctctggcggaaattgcagccgccacagagcaaaggccagagaaaatatcaatattcgctagcggttatcggccgctagcgataatcaatttttgctgccggttgtgttataccggccgccagcaaaaatcgattttcgctggcggctgtgttataccgaccgtcaacgataatcaattttcactggcggctgtgttataccggccgccagcgataattaattttgagataaaaaaaaccatatgcagttgtcctccagccgccagcaaaagccccatgctgctaagcatcccaaatctacatccccaaatctcaaatccataacaattcaaatccacatcaaatccaaccatccaaccttaaaagaatactacatcaatttctcacttcattcttaacaaacaaacatcaatacatgcatatatgaaacatcaatacaaacataaattggagaaattcattaaaatcgtcgtcgtccgcctgccatcgccgccgcggcggccgccccctccctccggctagatctgggagagggagagggaagggaggaggaggccctccggtcgtcgtcaccagtcgccgtggtcgtcatcgtcgtcgtggcccggcccattgtcgtcgtcgtggtggtggtcgctgtgctcattgttgtcatcgtggcccggcccatcgttgtcgtcatcgtcgtggtacgacggcggcggatccggcctccccgcccgcgcccgagagccatcgcccgccgcgctcgagcgccgccaccccgccacgcccgagagccgccgtcccgcctcacccgagcgctgccgccaggtccgcctgtcgtcgctgccgccaggtccgcctgtcgtcgctgccgcggcggccgccgccccctccctccggctagaactgggagaaggagagggacgggatgggaggggaggggagagaggtgagtggagatgagaaagagataatgaggagagatgaatgcagtgggtgggtgggtgaaattgcttttaaatgcgtgggtgggtgatgctgtgaaggaatcgatctgtgagctgtgcttttcgctggtggatccgttttttcgctggcggatctctttagtacccgccagcgaaaacactgatttatgctagcgaacatttaagaggtccgcctcgaaaaatatagtattttttatggcggacctattaatatggccgccagcgaaaattagttttcgctggcggcccgtgaccccccaccccctcaattttctacgctggcggtttttgcttgtagtcgccatgaaaaatattttccaaacgctatgaaaaatcgtttctctagtagtgaaccttaaacatgtgattcttttgtaaaatttatatacaataagtacaaaattatctataaacaaactcttagctttggggttcgcatcaaggtgagtatagtaaaaatgaatttactataacaaatgcactggtaggttatactaaatgttgtaaaatttatttagcatatgtatgcaaaattgacgataaatatagagggtgtcatggtccttcttcttagtggcatatgccatagtccacctatagaaattgaaaaaaagtcatgatggtcacgcaacgcgtgacgaatgtggctagtaaaatgatgaaaaatgaagctagtttggaatgggggagtgtactaaaatataatataacttgagtttaaattttatcccaaatataataacatagtacttttaaaatgtgacttttacaatttaacaactcgatcatactacctctattaacattttggctttattatattctcaactagtgagggttcatatctcacccatccttaaaaaaaaataaagtagtactaccccatctcaaaataactagtttctccgtcctaaaatgtactcccccattgcataaaaaaccaatctagtactggttgtgacacatccaagctagtataatgaatctggatatacctctgtccagattcattgtactagaatatgtcacatctagtcctaaattcgtttttttgggacggagagaataagtattttttagattgacataggtattaagaaagtaggtagagatgattggagaaggggtataattggtggagaagagaaaatatgtgaagagaatggtcgtgattggttgacagtgaagggtaggtggagaaatggtttcattttgggacaagttattgtgctaaaaatagctattctagaaagataaaatttgaataagatgaattttttttaattgagagagtaattggggtaagacgaagagaaatttgaatgagataggattgaagtgacaagtactagtactctagaattgcatgcactgatttgaaaataaatttagattctgaaattgtgcttactcctttcgtaaaaaaaaactaacctatgattagatgtagcatatccttacaacaaatttgtacatgaacttatccaaattcattgtattaggatatatcacatccaatagtagatttgtttttttttttgacagagggagtatttgagatggaggcagtacatgactaatgacatctctctgttgctttttttttttcaaacaataaaaatttctacaagtgatgttgaatcctgttgtactccctcttttccataaaatcaatctaaaatggatggaatgtaagtatgtgaatgaatctaatataattttgtaccacgttgcgtggtggctgaaaggataacaccagacatggggacagacatacatactactactagtactccctccgtaaaagaaaagaacaaatctaagattggatgtgatattttctagaacaatgaataatagaagcttgtccagatttattatactaggaaatgtctcatcaaatactagattggtttttttttacggaggaaatatttaattattatagattaccatgttcaatcttttcatcaacaacaaaaatgtcaatggagtaatcgacggcaatccccggcagctataggccttgtttagttcccaaattttttttccctaaaaacattatatcgaatctttggacacatgatagcattaaatatagataaaaaactaattgcaaaagtttatatggaaatcgcgagacaaatcttttgagcctaattagtccataattagccataagtgctatacattaaccccatatgtgctaatgatggattaattaggcttaataaattcgtctcgcggtttccaggcgagttatgaaattagttttttccttcgtgtccaaaaacccccttccgacattcggtcaaacgtccgatgtgacacccagaaattttcttttcgcgatttaaacacatatataatagtagagtcaaaatatgccaagttggaatgaaaactttgcatgtcactttattaattattccactctcttgaggatctgaaacatacatagtatttattattataggggtgttcccatgttcaataatcttttcatcaacgagtacaatgtcaatatggatcagtaatcgacggcaagaccggggcaggcagctaggccggggaagaaaggaatctgcgctgcagtagcactctctgacctgtgggccccctacccccctcatctctctccaacgtacccacacagcgtcccacctcgccgccggagccaatgagagatcgacgacgatcgacgtctaccagtccacgaacgagtacaattcgccataaataaatagggcgccacacccctcagctcgatcccctagctctcgatcggctgcaagaagctatagctagcctagctcatctcgccggagaagaagctaaggcagcaggcagagagagagagagagagagagagagagagatgatggggagggggaaggtgcaggtgcggcggatcgagaacgaggtgagccggcaggtgaccttctccaagcggcggccggggctgctcaagaaggcccacgagatcgccgtcctctgcgacgtcgacgtcgccgccatcgtcttctccgccaagggcaacctcttccactacgcctcctcccacaccacgtacgtcactatcactactcctgctgcattttccatacaatacgtacaaaataacaaaagcagtagatatatatagttagctcaattaatatgatggattatttcagaaacatttaacttctctctctctctctctctctctcttccctggcatgcatcgtccatgtatcaaattaaaagatgatcaagaatgcaatgtgaaaaatatataacaacccgtgtacacctgtgagtttacaaatacaagcatttcaagcgttcataatttatccatccataaatataagtgttacaggatatactacttattctatcgtctatcacccttctttcaaacttcctccggatgcatgcatatcgatccctcattcaacaagggatattttagtcgctaaacaaattataaatacctatattaattcatcgatagagggggagttagcaagtactccctctgtcccacaatgctggtcgtccaaggaatgtagagaaaataattgctctggatgaaacttaccaggatgccccaaaacattagttgcagtagtcattttaacacaagtacaccagccacataatggtgccatacacctaatttgaatgctttggcacctagaaatttgacaggagcactagatggtgctagggatgaaaacggagcggatacggacggataatgctcataccatattcgttttcatattttttaccggatacgaaaacgaatacggatagctcgaatacggaaacaaatacggattatctcgaatacgaataagaatcgaatatgatcggacacgaatacggaaacaaatttttctcggaacacgaaaaccaactcaacttctaatggaaacaaatatcaacatatataattagctcattttatataaaatgaggtataatttataaatattttttaaaatttaaataatattaatagtatggactagtgttaagagataaactactattaaaatctataaacgtatattgaaggtcatagagttagaaagaaatggggtatgtctcatgggtcctgcggatatccgaatagcactgttcaccggatatccgaattattatccgtatccgacagaaaccttggtaccatatttgtattcgtatccgggagaaaatatccgtattcgtatccgtatccgaactatccgagaattatctgatccgaaaggtatccgtatccatttttgtccggagcggacggaaactatccgctccgttttcatccctagatggtgccacttttctgcgccattattactgccgatgggcgagtacaacgtcaaccattctaggatatttgttagccagtaaaacgatctcctttgtgggagggaggaagtagacattgtacacttcatagggcctgtttggagaactatctcagggatatttttttgctaaagattatcccaccaaaatagccctcttgctgtttggatccaagggctatttagctattattgtaccatcccaatcatttgtctccactaaaagtatacaacagccggatcttctatagctaatccaatacaggcacatacaagcatacacaattccttacaagcacaaactcataatttgtctcaaatgtataagcaagtccgtaaaataattgcacgccaaccgcggcccccacgtccgcggtcgcggccacagttggttgccatggcgcgttgccgacggcgacccattgcccctgatgagg

SEQ ID NO: 80985 - DNA, 23537 bp, Oryza sativa
  unsure (1)..(23537): unsure at all n locations
tgctagaatgacttacattgtaaaacggaggaagtagtataaaaagaaaaacagttgtttccatcaataacaggttgatgttgctcccacaaaaagtgtgaaggtacacctgcctacattctacgcctttggataaggacatatgaacagttggtgattacgtaattttgcacagctcttccataaagatttttttagattaagtcttccataaagattagattgtttggaagggtctttctattcaaaatagggtccggcagacatatgtagattttttttaatcataagaatcagatgtttacagtagttactgtggtcattttcagatacttatggaatggcctttcgaaaaaaaagagataatgatggaatgaaaaatatgctgaaaattggacatgtgtttaggatcatgggagaatcagttttataagaaattgcatttgctgatgaacataatttacttcggttttccctgagaattttatccatgcacttgtcaaataaatgattcaacatcacagaagacattcttttgctggagtattctatttttttccatggcactacaatacgctgtaatgaacacaaacatggtaacaaatcatgaatacttttcttgattacctgtggtgaaggatatattgtgaacccgagcttcgacttcctaccgtaatctactgataggcgctccaaaagtaatgaaccaagtccagagccggttcctccaccaacagcattgaaaaccagaaaaccttggagaccagtgcagttatctgccagttttcttagtcgatcaaggcaaagatctaccacctctcttccaactgcagcagaaaaaaaaaaggatttgaatcattactaaaaaaatattttcattataaaggaatatgacagtttctctagtatgacaatttatttatggaggaagctaaatttatggcgtcatatttttcactaaaaaatagtcggcatgtcgtaagttcctaaattattattacaagtcaccccaaggatataagttataaacaattaatgttattccttatgtgagcaataatccttatggatcccaaggatatgtaagcaatatcatggattcagactcctctaaatccacccaaaccatatctttgtggatcaatcatacctgtagaatgtttcttgtgaatactattctagttggagtatatcaatatgttggtttagacattttcatagacacattttatttctgcaaaatggctcagtttcagggtaagcatcacacctgtgtagtgcccacgagcaaagttgttagcagcgtcttccttgtaggagatgagctgctctgggtggaagagctggcggtatggcccggtcttcacctcatcaatcaccgtgggctccaggtcgacgaacaacgcccttgggacgtgcttgcctgaactcgtctcgctgaagaacgtgttgaatgcatcccttgcaattccaggagttgtgtcgctgcaagcaagcgtcagatatgaccaaggattaggatatcgtaaactaggagccactaggcaccgcagcaagtcacagactagtattcttcttgaaatgaaattcgcttcacaaaaaaggcacaggctttctactctcaaagcaaccggcttggggatcacagattcacagatagcatctctacaagaacagtgctagcatgcatggtgcaaatcaaacatcgaataaaaatcgctaatttcacttctgattgtcatacatgactggagctggagactctgccccaaaattctcctcaagatcaattcttttttaggctacagcaagaaccaaccaaacaggacaaaaccatcatccgaatatcagaatttcacaaaattaagtaggaaaagacagcaagagatgcagacgagcaagaattgggatcgagaagaacctgggcatgaggccgtccggctggatgccatgctcgaggcagtatagttcccagcaagaattccccacctggatgcccgcctgccctatgtggatgcttattatctccctcatatctctctgcctgtctctgcagccttcagagttcagagttcgggattggttcagggttcagaggaagacagaagggacctgagcagtgcagcacatagaaaaagctagggataaaaggagggcaggcacaatggcgtgaaccggaacacttcagccccgggaacacgttgcagggaaagtgactccactatttggtggaccaaataacgagcagctactacaagaaaggtgactaggcgactggagatgatggtggtcttctccattctgcctgcctctgactgtgagtatgcctggtgtaaaattatatcgcaattacatgaaatttttgtctatatatgatttttagggcatgcttattaaaaaaatcgaactggtaaacttgttttctgacatcaagtcggccattcagacagctacagatgtacaggtacagattgtttgcaagatgtctgacaaaaatgtcaatgtacctacggtagttttcaagcaggaccaagtttatcatctgctgataaaagaggaccaagtttgtcatcgattccaaatcgaatgccgccgtgacttgacaaggacacgtccatcataacatatgctgtgatcaaggacgccatccatgaccacaacgctaaaatgagcacatctacggcgcatgccgacgagttcaatggggagtcggcccggaagttgattgtcttgatgctgatgatgaactgaacagagcaccatacactgattgattatttttttctggactgaacagagcaccataaattgctgacaccacaaaatagttgcatagactctgcacctgtaatctgaatgatctcacatcgaagaccctcaaaacgaaaatcacatatctatcagtgattttttcccaacttttttctattaagatacccttcgtacaaaactacaaccagatggttctgcacttctactacaaccttgttcatctattgcactagccaaatactactactactctatctacccgtgttattgtgaaaatgaaggaataaacagtgcaaaaatctgttcagcatcaagtgcagaaactactcacaaagaaaactttcttttctgcacggcataagtccgcgactttcttgaacaattcgcaatcggcgggttccctccggaagagggcatcagaacagaacatttgtttagtaggcattcgtttattctgttcttggtttcttcagcaatcagtgtacgacgtcacgcccccaagatcgatgcggattcttcttctgtcacttggatttctgaacattccttcgcactgtgcaggcgacagcgaggcgaagcgatggagcaaactgacactgctactgcgacaggttgcacatgccggggtggagcgagcaccagagcggctggatgggctcggcgcggatgccgcgctcgaccatccggtgcctccagtcgttgaggcggtcggtggcgttcgcgtagcgcttcttcccgttggagcccttgttgccggaccagagcgtctccgcggcggcggcggccctcggccacagcctggcgtccagcaccgtctcgtccgactgctccgaccacagcgccacctccccgcccagcaccagctgcgcctcgtcgtcggtcagcccgtgcaggatgtcgtagtcgtagacgcgctgccacgtcttgaacggcgcgcaccatgacccgcccgtgccgccggggtcgttgaacagcggcgtgccctcgcgctccttctcctgcttgtcgtaccggctgtcgttgcccacccacccgccgtggccgcagtccaggtagtagtacgacgccgacgacacgatggcgcggtagcccgcggcgacgacgcgcttcgtgttctccggcccgtcgttccacgtctgcagtatggtggtctccctgggcagaatcgtggggccgacggtgaccttgggcccgaggaggacgtcctcccagtagaccaccgtgcggttcagctcctgcgccacgaacgggcgcgtcgcgttgatgaacagctccaggaggtggtcgtgcgtgccgccctcggcgaggaaccggcgcaccaccgggtcgtcctcccagcacgccgtgttcacctcgtcggcgccgccgtggaggtacgggtccgggaacagggccaccatgtcgcgcagcacgtcctgcgccacgcggtacgtcttggggttgagcgggttcagctgccccgtgccgggctccgccgccagcgccggctccgcgtgcggcgcccagaacctgttcgcgcaggtgacgatctccgggtacgctcccgcccacgaacccgtgtgccctgatccgaagcgcgcgacacttagccttgagtatactgtttattcggagagcaatggaattgaaatgcaggagcagcagagggagtctgggatttctcactcaccgggcatgtcgatctcggggatgacgcggatgccgaaggaggcggcgaagctgacgatgtgccggacgtcgttctcggtgtagcgcatggtgggggagtaggagccggagttggcgaggttggggacggtagggaggacgatggggaaggactgggcgtcggtgatgtgccagtggaagacattgagcttgttgaaggccatggcgcggagggtgtggaggatgtcgcggaccgggtagaaattcctggcggtgtcgaggaggatgccgcggtgggtgaagtgtgggcggtcggagatctcgatgccgctggggacgatcggctggccaccggaggcggcgccgccgccggcccaggcgagctgggagaaggtctcgagcccgcggatggcgccccatggcgtggcggcggagatatcggccgatccggagtccgggagcacggagagcgtgtaggactcgtcgacggcggggccgagcgggacgtcggggtcggagacggagagcgtgagggtgcggacggggacgcgggagagggtgtagttggcggggggaaccagcggcgcgtggcgctcggcgcggatgaggcgggtgtagaaggctaccgcctggcggagcgacgggtgggacagcaccgcgcggacgctgaacgacggcgagagcggcgcgtacaccgcggacggccacgagatggacgtcggcttgggccacacctgcaccttctgagcaagcagcggcggcgggaggtgaggctccgaggtaggcggctgcgaagcggcgccgggcgcagccgctggtcggaggatcaccaggatgaggaggaggaggaggagataggccggcaatgccgccatctccgtggaggacgacgagcaatcctggtcgcctccgcgagtgcagcagtgaggcactgagggattcagttgctttgacttttctcccctcatatcgttcgtgatcgagcgaggttggtggcgactcggcgttatccgcaacacgtggagcaagacggcccatgtactactcaaggcccgtaaaggcggcccatgttccatgatttcttccactgtcaggtatctcctccaccctagccgccgtcgctccgcctgctgctaccccgatccgggcgagagtacgccggcgccggaaaacgtaagctacatgctttccctgtttattatcgtattcgtttcgttgcgcgtgagcggagctagttcatggcagccgctgaacttcccccttcctttacccctagctcatggtcagatcctcttggttaagatgtttgaatcgagccgttttccagctttacttgcgccttctgtcacctgtaaaactatctaatttcaccatcttttatcatcaaaatcgattttgtgactgacgcttggagttcagtatggtctttacaaggtagagtaggtaggagcattttagaggaacagtgtaaccctgaaatcgtgtatgatcacaaataaaaacatattgaatgtttacaacaaaagcagattgatggtttgcacccaccggagggatatgcttagccgaaatcggatttgttacgtctgaactctgttgtgcctgcatatgaaggggtaggaaagatgacgcctgattgaattgcaccgcattttcaacatatcttgaattcatattagttcagaaatcagtacttgcactgtcacatcatgttttatggaccacaacggttttagatatagtttaggctaagtcattgttttcatttatgcaatcatgctcaggacccagctttctgagatgacctgagcttctcagatcaatcttttgcagcatgcaaattctgtaaaggtccatgcactattgatcttgaatatgtgtgcattcccactgatctagtttcattttgtgatagtgattatcttcataaccagtaaactttgttggcaggtatagctgctgtgagacgaactgtatcaatgatgagctcacgaggcactagtgctatgctttcaagagctgctcggatgaggcaaaagctacagtctgctttggaggccagtgcgctagatattgaagatgtttcttaccaacatgctgggcatgcagctgtcaaggacaatgcaaatgagacacattttaacatcagggtaatttcgcctaagtttgagggccagagccttgtgaagcgtcacaggatggtgtatgacctcttgactgatgagttgaactcaggacttcatgctatctcaattgttgcaaaaactcccaaggagtcaggatcctaaatgtcaaaaatgtaaggacttatatgcttgattacttgtcttgaaataagttgattgcagcaatattgtgtaaccataagtcaattttttcaaaacaatgttatggacgcttatgttttcactaaaatgcagtgcacaacttctgttgtcagtgaacatctgtgctcatgaaaatttgtggaaaacatagtgagtatcgaattgatatatctgtttactattcgatcagatgagatttttctatctggtatattttgtaagcatatatgaaccttttgtcttggtgctagtctgttacatatatttcttatttacgccaattggtatattatccatcatgacatcgctgataaacaataacattcctagttctggcagttgtttttgctctgatcttctgtgatgaaaactagcatggctgaataatatttatcagtctgtgtttgttgctaagattattaagtaaatgatttgtctgtgaataaaaagcatgcccagcccagttcattatctttgtgacattttgtgcggatacatgtttctgcttcatataatctccttttggttcaaagtagcgatctatttatcatcaatattatcattctgttcaattccaagaaccatgtggatatggaggaattcaaaatatcaggcctcacttggaacatacaccctccatcccaaaaagagtttatttgggctattcagctagacaaaaatctaaagagtttatattagcgaggctcctgcgaaagctgagactattgcaaacaatgtgtcggttactgtttgctggagaatccatgagcaggagtagagatgcagctttctggccaatctgatgtgtagaagcgtgtcatgtaaaacagcaatttacctggttggacaagaattcttaaagttgtatgggtcgtcttcttctctttgtgtgtgtgtgtgtgtgtgtgtggttcaaaattatactgagcaacattttttgtttatctatgtttggtgaaactcagttacataattcaccctttgaatattctgtcgatgtccaggtttggaggtgtagagggtatgatggtgactaagccacagtattgtaacaactcctttgagagataaaaggatgtctcacaatatgtattttgtgacgtaaagttcaaagttatgagtaccttggagacttggtggagatgagttgaccttatagttagaacaggattccagtgtattcataacatcctctttgttcgagtaaaaagattttggtgaagatgagttgccctaacaattggaacaggactccagaacatcctttttattggagtaaaagaaattggattccggtgcattcaaacatcctctatgttggagtaaaaaaatgagtagaaaaaacgaacatcatctttattggagtaaaaaataattaaaaaaacgagttggaaaaaggtaaaaatgcccccatgcaggatcgaactacagaccttcagtttacaagactgacgctctaccactgagctataggggccactgctacaagtaaaaagcttcagtttactgtcataagtttaactgaaatatatacactaaagatccagtaacccagaacactggctatacccaaaccttcagttgcaaacttgcaatggaacacttgaatgacagaatgtagaatccagaaagtccaccgtccatgattccaactatggttaagggaacctgttcagtgttccattgactttttcaggtgcatctagctaaactttacaaatatgcattcacctttggtttttcaattccaaaaagtatcatgaagaacaagaaagaggtcggttctgtgaaatgctgacacagaatttcttggagtcatctcacgcattacagtgcatatccataagagggtgacaatagaaaaaaaaatggagcggagcaccaactccccgttgaagaacaagttcccaggaaagacaactattcccatttatctgaatatttgtatcgagcaaaaaaacatcggttgataacattttaagataatacaatctatgagaaatgcccatacacaaataacacttcaagacattaaatgtcatttcgacaatgcagagcttattctacatcttcctcattatgaacaagcaacttgccttccgtgaattcgcatggcttgatgggtacagctaattgcttgcgcatttttcttacaacaaatgtttcagtttcttcgcatattgtgaccacagttcctttccgccctagacggcccgttcggccagctctgtgggcatagtgtgtagagtctgttggaagatccagattaatcacaagatcacattctggcacgtccagtcctctggcagacaactcatttgtaactagaactctgaattcaccatccttgaactttttcagcacagttgatcttgcaagctttccaagatctccatgtagctcagtagctttcatcccacgggcctccaacttaaatacaacatctttcaatggcttggtgttgttcataaatgcaataactgtctgagcttccagagcatggatacatctcctcaaagtgtcaactttgtgttgagccttggatatacaatagtaatgttccaaagatggtggtaagctgttaactgcagcttgattcactgaatttgatggagagttggggttggcatctgtctgggacagcacaggtcttggaacagtaattgaatcaagtggaacaacactcatagctctaacaaggactggatcgtgaccccaactcctggctgctcgtataactgaaaacggtattgttgcagaaaccaagatagtctggcgctcagaccgccttgcaagagggccaagaatatctctagatgaagtaccagatttccttcctacatgttcaagtattctatgcatatcttcacgataattgaaagacaaaagctggtcaacctcatccagtacaagaaagcggcaaccatgggtgtgtagcttgccccctgctgaaatttcagaaatacgaccaggtgttcccacaacaataagtggcttgttctttttcaatgcttcttcctgcctcgaacgattagccccaccaacaagttgttggacaagcctcttatcattagggcccaaaatcttctccacttctcgcactatctgcattcctaattctctggaaggagcaacaataactgcctctacacctgatctcttatcagaaccatcttgttctgtaggcctctttagggggcctatttcagaaagaatagggagaaggtaagcgagtgtcttccctgagcccgtatatgactggataactgcatcatgcttttgtgaaatgataggaatagcagcagactggacctcagttggagtacttagaccttccttgttcaaccgatctataagcaaaggcggcaaaccaagctcttcaaatgattttgcagagaaaagagattcatctatcttcagagtcttcttcactactgctgatttcggtaaggtgctctttgctggtttggaattaaatgaagaaacttttggtttcaccttaagagcagaagcccttgaagacggctttggacctccaatgcgtgttgctttttctttcttaccatattcaactttgttttgcccttcaagactagctagagttagtgaagcactcttatcttgtactgtttcagtaccaagccaagcggtctggtgaaatctaaccgctcgtggtaatgaaagcattctcaatgggaggttgtcaccgaggacgaagcatgatcgcgaagatgccaatgcaagcacatgtcgatgcacttggccaacagttagcctcatctgctgctctgcttatgaaaaccaattttacagcagccgaaatgtccttactcccaactgatctcgcaaattcaccgggggtgctcttggctgtgcaaagaaccaaacaattgaatcatgtaaactgcagcattcacaacttgcaatagtaaaacaaagttagacgcaagaagtctgtggagtatcggtggcatcaatcgtgttaaactcggttgaacccccaaattttcttgggaacaaactaaattgttattcgtgctaaggttaaggcaaaaaggtaaagagaaaggcaacctacagatctagaagagaagctagggccaacgcaaatcggaggggaaaaaaagtgtgggttagtgagagatgagaaagaggatgcgcgtaacgggtggggtgctcaccagcgggcgaggatgcggcggaagcagcagacgccggcgccgctgcccactggagatcgacgcaggcgaggcggccggcgaactcgcgaggagggaggagacacgcgggtttagggcttagttagcctgaagccggcgactggctggcgttcgtctatccggttgagtggggagggggctcgtgtggtcagggtgtcagagacacgaggtaggagtgatgggccggcccatcaactgtggcgccggccgcaggttgtggaagcgggccacacgggccacggcgccgccggacatgggggagaagactgtttaaatgaagacaaaccaaggataaagttgattatcaaatataattaagactaaattacaactgcgcattttcttacatccatggcatcatccattttctacctcaaatccgaaaatgtaacatgcccacaaccaaccacaatatcaacatgttttgtacatgaaaagtgacaaaatatagaaaatacttttgagatgttattgatattaaaacaaaagaatactccctctgtactcgtaaaggaagtcgttttgaacaatgatacggtcttcaaaacacaactttgacttgttatttctataaaaatatttattgaaaagtgatatatgtacacttttatgaaagtatttttcaagacaaatctattcatataatttttacattttcaaactcaataacttgagagttattcatgatttatattcctaaagtttgacttaaacattgtcctaaacaacttattttacgagtacggagggagtataccaatagatggatcagtcttggatgagctgcctccaaattttaccttacagttactaggaaactgcaacccaacttgctcacactctgccttatagcatagataatagtgagctataaattaattataaacttacgtggatgagagaggtagcaagaaaaaaaatgaagggtgttactcttgtgcaagaactagctcaatacgtgctccaagacaaatacaataaatgcataagtgagataaaagagagaggacaacaaaaattgaaggaaccttatagctaatctattatatatgttgtctttaaagtatgataatagctgatagtgagctctaatattaaatttgctcttaagacgtgaggatatgaatggaatccaggtgcttaatagccttacaatatccagtcacatattggactcctgcaaccatgagcctaatataactagtgatctttagaaatatcttagctcggattgaaatccatttacatccatgccctgatatgttacacctataatttggtcatagtacgccacaccaatttgcagttagacaacaaacttctcagtgaggcatcggttatcttcaagcaccaatccattcttaggctatttaggctactacaacagcaagagccaatgtttctatggactctagtcactctacactaacatcaacatttgccaatgacgagagtctctaggttatgggaaaagttagccagtggatagacttatcaccttactctgttataatccagcggttttaatgaaaccaataacgctgaaaagatctcaacgtattttacctggtcgtcatcgctaatccacatttttttatccatattaacatcgagccattgcaatcttcatgcctccaaaccacgacactattcactatcatcgagtcgctgcatttgagactagtctttgtcctttatcatgtcaaacttgatcatggcctcctaaccttctattttctttgccatcacaccaaagtcattatagttagcttactagatccatgtgtcatgtggtgccatgcagaccaccacacacctacactaacatcgctaagttattactataatagtcttcttcatcactttgatcgatcgtaaggacgattcctaaactgccagtgctatatactattcatagtgtttatatcctctacatcacctatgatttatattagacataactctctcaatacacatcaataatttaatgggctaatttaatgtaatttatttctcacaaggtttagatgtaatccatatatttttcatctttccttgttaactcatatgacaaaaaaatccccacattctatatgaaaatactcattccatttcaatttacttgccgttcttgtatttatctatttttccataataatcatctttttacaatttatagagatgtgttttcttccctactatttttaaatatagttatattaatgctattatctgttacaattaattgtactacttattttgaaaaaacaagatataattaataatggtaataaaattatagttcattaatattttttcgtatacaatgtaataaaacaacgacgacgacaagtaattcgaaacggagagagtacataggtgcagccagcaagggcttaatgagcaccaccacccaacccagccaaaatggccaacgagtccatcctcgtcctcctccacctccgcctacagaaccctgaccggggtcttccccaaaaccctcgccgagtcgccgggctccgccgccgtccccatcgcgaactactcgcaggctactcctccggccatgaggggctcggatccggaccggggcggaggcgagccggacatctccaagctcttctgccactacaacgccctctacttccacgactccctcggcacctgcgccgtctcctgggccaccgacgaggatccactccccaatcggtaaagcgtcgccactccgaattctcgccgttctcggtgttatatgggggggggggggggtccggtttactgaatactgcggatttaggtcttgtgtggatgttgagttgtgtgcggtggttgcaagattgctccgttcatgtcctgccactaagcatgcgtatcttagtagattcagtgcagtatgatggctttatagggggaacagcacacgagaacaatcctgttctgtaggggttctgattcggacattcggtatatgttggttcaccccgcatcaaatccactcattcatccaccagtggatcaatgccaaaaggaagtgcttaacccatatatcccttgttcgttagaactagaacatcaatcccctaaaaatgaattagggcatcaaaggggattatccatattcgggtattttgatctaaacgttcagccagaacataggtgatccatattattctacacgattatgccttgtcattatctgcagttctatctgttaacctctaaatctttgcgtcgttctcttgttcattgaccgtaaaaactacactctttgagagtatggatcaatgcctaggtctaaaccatgaaaaagtggaaagatttaatgtatgcttttggcatgctttctagaaagaaatgggaaaatagtgtaaaaacatttacttttgggaaggagtgaacaaatttatctagacagtagaatgaaaaagtcgcttgaactcttagactgattacatagacatctctgctccagttgttttgaacttcgaagacactggtatcatatctatgggcctattcattctgttcattttgttgccacgttctaccattgctattctaccaaaattggtagttctgaaagtttcccattcccactcataatgacacaaccaaaatttggaaagaaatctaacaaaacacatccaagtatccaacgctaccaaaacttgccacttcctaccctgccaaattttggtaaggttgtttttggcaccaaagtgaacaagccctatatacttcccaaatatgtttgatttgcaaatctattggtgaatgtgcatagcattttgaatggaacacagtgactgatgtattgctatgcacaattatgaagtatgtcagccacatttatggcactgtcatgtgcatatttttctagcaagcatgttcaacaagattcgtgagttgtctgtcatagtgtcatttagctcataatcgtcaactataattgactggaaatgatgctgaccatccgacccttccatattttcatcttaacactatctttttcacataaactctgtactattggataactttgtgagttattgcctataattgttttcttctatagttattctctgaaataagaaactttcatcaaagaccatagtacctgctattaccagtatgattgttttgaaactttccatttttaatcattttgatgcagtgaagtaggtggctgtgaatattatcctggtggtggtggctgtattatacttctttccagatccttgtatgaacaccacacagatttggatttaaagaatgcgctgcttcatgaaatgattcatgcttatatgtgcatcaaagatagtaatgataaccataggtactttttagtaccatgactggcctcttcttgtattacacctgaatttctgtctacttttttttttctcgttttgactaatttaaaaactgtgatcaagcagtgaccatgggccaaaattccagaaactgatgaatacaatcaatttaaactctgtagccgatcctcatgtaagttgaattcaggtgtcaattttcaatcagcatgtgcttaaatatttcttattatcgtaacgatatttttaattatatccagcgtcctcttggtggctacagcataactgtgttccatgagatcagaaagaaattttatatacacaaagtaagaacctgatctttaaaagtaaatcttattttctaatttcagattggcagctaacaatctctgtagtgtgaaagctgtggagatttgatcaagtcaaccaaaatcaaaggaccatcacaggatgactgcattgaggcaatgggtgctaatgacttgtgtgacagtttaatttgtcactggcattggtattagctatatatttctttgcattttttttgttccatgcatgccttattggtatatctctaaaggtgtgttcggaatccccagttcccaactcatccatctcgttttccgtgcgcacgcttttcaaactgtaaacagtgcgttttttacaaaaagtttctatacgaaagttgctttaaaaaatcatattgatccattttttaaaaaaagattagctaatacttaattaatcatgcgctaatgaaccgctccgttttccgtgcggaggggataggttcccatcctccattactgaacacagcctaagagtgcacataaatattcatagaaatataagctagatgtacattttaaagctaactgtgtaatttccaaaatgtgtaatttattactctctgccttgttagtgtatccttgcaatgtgggaggtaggatgtaaacctcagtttgtgatgaacaaataaatcaactattattattgttaaatttgacaaagagagatgttaaactaagaaggtaatgatgggtgtctgcttcaatatctaacattttctttgtgttgtcctgtcactttggcaattgcataatctaaaaagtggtaaatgatctgacataaatttttctttattggaggtgaaatcgacatgtccagcagccaaacaagattagtaatacctgaacaactatcatgctctttctcctccttggggtcctgggatgcaacttactctaaatttagtgtcattgagttcatggatggagtcatgatttggctttctgtattaatatatatataggcacaagaagcggtgcactggtagctatcacagagttcaaggatcatcatcaggttgtgtagagggttcaaaaggtaacatttggcttaaaaaggaggttccagttatgataacattttaagaccataaaacagtctattttgttgaaatgccttgagatgactctttactgcagatatacattttaaactcttagtatgcctactcatacaaattgatgatactgctaatttttgttggtagctttatctgtagaagcacctgattgcaaagttgaagaatcagcccctggaagttggcacaatgcgcatgcatcaattaagggtggaaaaggcaataagcatgaactggaagaaacctctgctgggtttcctcctgatgactctattggtatttctggaatggagtcctcttcaagagacacagctaataagaaaatcaaattgtcaaaggatattggtttggaccgtctaaccgccacaactgttcaggaagcaccgaagcgtccaagaacaacctcactaaagaagaatcaagagtgcagcagacagaagaaaagaaaaataagcaagtgggatggttcctactctgtaatcattgaatggttgaattactattctgtggatgagtcagatgaagatgaggtgcctttgataaataaaagaaccgaaagaagaaagcggcagaagttactgaaacttgttcttgctagggaatccaatagtggcagtgaaggtgctagttctacatcttttgtagaaaatggcagaaattctagcagtgctggctcttaccccctaagccagggggacaatgacaaatctgaaaatgtgcaagctaatcgagttgatgtaagttcattgccagatcatcctgtaagtagtcatgtagcagcagaggatcaagctggccaagctgcatcgtcaccattgaactcaccaactagaggtatcgttgttgacatttcagatggttgatggccagagttccattagtttctttcagctgaggcctggacgtacaattatccagactacagttgtaacacttacttttaattccttgcacctgtctactgctagacatgcaacgggacgatcctgtgaagcatgtgtcttgtacatgtcttcgtttcttcctttctcatttcaccttttcttttcttagcatagatcagttcagtatacttaactctgtcaggttgtgtgacccatcagtttctctccgtactagtctcttgaagaacagcaaagatcaggttttctctttggttgattgtgtgtggaagatcaatccaaatatgttcatttcttaagaagataaattcagttctattctattcataaacttttgtaaaccttctaaaatcctttaataaacaagaagcaaagtgagtaatacgaaaccattcacaaaatagagggaaaagaggcccaaattcccaagggttaattggattcatggcccatttatccaaccgtcttatctccctcgtgtccttccccaattatccccttctatccacccacaccagcaagccgctcaggcgcgctctccgctccaccgccatggcgtccatcaccctcctctccctcgctcccgcggccacattgctccacctcccggcctccacttcgctctccacctccttcgtcgccgctccaggccccatctccggccgccggtccgtcgtcctccgcgcccgcccgcgccgctgcgtcacggtcgtgtgcagcgccgcggcggccgaggccgcggaggcggagcccgcggagaagttccggctcgacaacctgggcccgcagaaggggtcgcggcggcggccgaagcggaaggggcgcggtatcgcggcggggcagggcgcgagctgcgggttcggcatgcgtggacagaagtcgcgctcggggccaggcgtccggcgcgggttcgagggagggcagatgccgctctaccgccgcatccccaagctgcgcggcattgctggaggtgagtctcttcgagcttcccgcttcccctcctcgccctcaatcgaagcctcacacattcaaatgcactggaaattgagtgggaacacgctagcaccttccatttggaatgcagaaatgctgggattgagaagtgacccgttgcaagttctaccttgcgattgcaggaatgcatattggcttgccgaagtatgtgccgttcaatttgagagacttggcgcgtggcgggttcaaggatggtgacgagatatcattggaatccttgaaatcgaggggtttgattaatccgtctggcagggagagaaagcttcctctgaaggtacactatacgacgattatccttcttttttttaagtcggttctgtagatgaccatgttttactgaaaactgaaatatgaatgccttgcatttgatctttgccagtgaattcatcaagttcaccagcagtcttgggtaatcctttagttgttgatgttgtggattgaatggctggcctttttttttcttgtagttctcaaatgttgctgtgttggtctgtccttagcagcaattaccaagttgagtattcgaagtctcaaagttgtgtgtcgggatcaattttcttagctcgtgttggacaaacacggtatgatttgacgagtgtttctattggctactcaaggatctagaacgtatgagttatgatgaacccacacatggtgtaggcctgcatatgagcatatctgtcaggcataaacatgaagtggtatcaagatcccaacaaaaccatgtgctcttacatgtaccactgcatgtctgcatcactcccaacatacccaaaatatttactgtttgtctccactcttagttggcggattgctggagtagatgcattagtgtgctactgggttgccccttatagtgggtagtggtgtggcgcttgatcactgatgtgacaaagacttctccaagggtggaacttaatgcaccttgaatagcataattgttcaacttttattgttctttctggtcctatttcatttgattgattttttctatactctaggctcctagctatgtggtacatataaggtaaaacccacagggctaaaacaggtatcaagacctaagtcataatgtggggagctatcaactttatccttatgataggctttttccttcttgacatctgattctgatgttcagcagatggcgttcctttcatctttgtttgagtacaatgatactgcaatgttgctgttgttattgtatcttttatcatgcgggtagtattagtatgctaacttttgaaaacctatctgtagattttaggagatggtgatgtatcagtcaagttgaatatcaaggctggggcattctctgcttcagccaaggagaagctcgaggcagctggttgtactttaagtctggtaccaaagcggaagaaatggctaccacaatcttatctgaagaaccaagctcgtgcagaagaatactttagcaagaaaaatggtggtgctggtgaatctgatgaagcatctgcatagaattcatatacactgtacttctcctttacccttttctttaacatatacttatttctcttaccttgttccaaaagttccacgttcaacgaattttgaatccgtgcgatatgcaagcatttttttttgtgtgtttcctgtttaaatggagaaaattccttctatacccctgaaagtttagccaatcccttctacgcctccgagttttgtccactcctttgtatgcccctgaattttggttttgatccctttcatacccataccgttagttgaatgtttaattctaatgaaaaggacctttttgcccttagacatgaaggaaatctaaaaattgtagactagctatattgttggaagtgtataattttgttatataagactatcatattcatgactttattgtacaaggtattattcatggcaaagtttatttttacctaatgacataaaaactaatatttatttacctactaaaagagtatatgtagcatttgtttatggtagttcaacatattttctcctgttgtatatattatataggaatgctttccaaaactatgtttatcatttaaaaaaatgctacatgtactttttaaatatatattaaattttttatgtacataaaacttatgaatatgataatcacacaacaaattttatacttccaacaatatagtttacaaatttctacatattcctcacatattgaagggtaaaactgacttttatatacctattaaacggtcaattaacggcaagggtatggaagagatccaaatcaaaattcagaggtatacaagggagtgaaggaaattcatgggcatagaagggatcggctaaaatttcaggggtatggaaggaattttctctcttttaaatgtgatgtatgtcaaatgtcagtatgcataccccccaacacacaccctcaccctcttgtgatcttgcacttatacttcaagttgcctatagtattgttgtccatgttgtgttatagtttggtgacagtctttctaaacaaaaacaatgatggttcatctaggagctaaactctgtttcgcttatttgatcctgcctttttcaaaagaaggtagttatcatttcagtgtcttaattgatgcccatatgtgataatgtgaacttgtgggcttcttaattgtccatgtatacatttcgtgatttcctgggaaagtggacagctggacacacatgggggcatgcacacttaattgctgcactgttcatctagtgacaagaatgggcaaatgttatatagggttgcaagtcattctatgtgtgcttaacaattgattttgaacacaaatttcaacagaactcatccatgaatattgcttgtttgaagaagttatataaggacactgctatatctactgtcacataaattacaagtagtttcttgtttgacttaatacaataaggacagcacatccctcctcaaaggctcaaactgactacagttatatcatcattttgaacttcatgttcatgttctctcattttttattcagggatttaaatcgccacttactgctgcttgtttctttaggagttagttcaaagggtgacataactcaccttttactgcagcttgaaattctttttcctctctctttgattcattcttgcaccctcttgctccctgtggacgttgatgcttcttttgtttgatttgcttcttgtttcaatcgtttacataatctcaattatacctcatacttgttattttcctgttgtttttcgacatttctttaggaaaagaagtcttgactatttaggtaaattctattccatctttgactgtgaaggtgttaatttgttgagatgtttcccatttgatcaaaaacaattatttatggccttttgatgataaaatttatttgtattttagattaacacgcaaatcatcgccctcattcgggccctaggtccacgcagcatcgggagaatgactggcaaataagggtttgggtaaatttccagtggcatagaagaaaatttacccttcatttcagtgtgcagtgcagatttgctatgaactgcgtaccaagatcttgactagttgtgcttgcattgcatgttcatatcagcaatttaatactacctccgttttataatatttcatattataagactttttagcattgtccatgttcatatggatgctaatgaatctagacaagccactagcctattattgcaatgtagttgtccttaactacgattgcaagcattagaaaacttatatttccttccaaattgatccaaggtactcttcgtttcaaaatatagcgaacttggactgaatgcgacacatcctagggcctgttcactttgatgcccaaaagttgccaaaattttggcatatatagttatcaaaatttggcagcaaactaaatatagtcacttttttggcaactttaccaaaatttggtaagattgaaaatggcatcaaagtgaacaggcccctagtataataaatttgggacggaaggagtaagctagataaaaatgaagtcatttatttattgttgcatatttaatcataaatagagatatcaccatggaattagattggtgtatacgtatgcttcgtgctactgatccgaagactcccctgccaagggatcggatctcttgctcatggattatgcgtgtgagtagacagatgatctatgatcaccactgtgccatgtcgggcaagatttgtggcgcgaagttagcatcaagttggaatacattcaagaactctgttctggatgaatttggacatagcagaatgctaaatggcgacaggctgttattagagggcgatgtgcttttcatgttgtttcgggggaactgaagacactagtactgtagcacatacatctgacttgttgcttctgcctctcgaactgatccagcaatnnnnnnnnnnnnnnnnnnnnagtatcagtaattagtaagcgtataaggatggtattagtgttgatcgggatattgtagaaggatggatgtattatagtgttgatcgggatacttagaactacgagtgatagcttcgtgctacgctgttctatagtcaatgtggcacaggagaaacgctagtatggcctatcagagcactatcagctgccgccatcaagcaaagctgaggccgggctgtccaggttgcttcagggctttgggagctttcgattgctttccactcccctccatctccatggcgcacaacagcgacgccccgtgaatgcacgacgatgcatcgtgcaacgcaatcgcgtcgccataactccccgctccctttcacgccagcctaacaaccagaccccatcgtcccggtgtggcatggcaaggcatcgcaagtcgcaagccaaaccccgcccgcaagccgagagggaaggagaccaaacccccccccc

SEQ ID NO: 80986 - DNA, 4307 bp, Oryza sativa
tcatctataaataatactccctccatttcatattataagtcgcttcgactttttttcctagtcaaacttcttttaagtttgaccaagtttataaaaaaatttagaagcatcgacagcaccaaattggtttcatgaaatctagcattgtatatattttgataacatgtttgttttgtgttgaaaacgttgctatgtttttttataaactcagtcaaacttaaaagaagtttagactaggaaaaaaagtcgaagcgtcatataatatgaaacggatggaatatatttgttttcccctacaataacaacgcatggttgcgtccgcacaatcccattgtagtaacaaaagcatcaccattcaatcacaaatgctctacaaattcacctgcccgttccctgaaacagaagccaatcaatacagttgttacaaaggcagcaaagcttagctcccactcggatccatccattctacaccgatgaaccatcacattgcttaacgtttatccacaaaacaagagcatatggcatatcaattgcagcttcttcttttttttttttttttgcgaggatttccccaccaaaaccccactaacaacagcagcagagcagagcaagcaggctcgccgcagttgaggaaatatacacggcgaccagttgaagaggtgcgcttgccttggcgaggcgggagcaggtggcgtagttggcgtcgaggtcccccacggaggtcatctgcaccacgcccaccctcgccgccgccgatgcccccgcggccgcagatggtgacgacgaggaggccatcccgcggcagcgggcgagcgacacgcgtgacctcgccgcggcggcggggaggagcgatgcggcggcggcgagggaggccaaggccatatgcgaggagaggattgagatcccctcactaccttaattcacatggctttgagtcactgacatgtgggcccactctgctatggacccagatgtcagtgactctgaagcgcgacgagtggggtagacagtagacttgcccgggtgcgcgtagcgcgggcgggaggacacgtggacggatcctggccgtcggaccggcacggccgttgcctctatccaccgttcgattccgcgagcccacgcatccatccggtcactcgccaactagtatccccattcgccgccgccgccgccgccttcgccgccggcgatacggtggtcagcgccgccgcggccgctcgtatctaaaggtgagaccacttgctgttcctttcctcgcagattcgctgcaagactaggatcggggttgggcggatgatttgggtggtagtggtgcctcaagaatgtcgcagaagttttatctgtctgattagagctctgagattacggatgcatctggatccggtttagggaggaactctagattattggttgatctgatagttgggaacaacttcgttggtgaggtgatgatggatgaacatgttgtgcgctgcttttcttatctagccgttttctctgaattttgtgtatcccttaaaaagggtgtagagcagctgaatgcatgtacaatctcatgcattttgttccttgacacaacattattttgttctcggtaatttagtaatgcgtgcttccgtcgcagtaatttgctcattgcatatttgcacttgatttgctgcttgcaggtatatggccaaaatggttagtcagtgtatctctccgcggcagtcctttcgcgttcctcgtttttcatcagctcggcctacgctaagttcacgtttagcaattggctacgccaacccgtcgttttgcggtgttaaacgctcaaatcgtccgagttttatagcagcagcactggatgtaccaaaaagtatgtcctcccctaattcagagagctccctgcctttgaaaggtatcgctggaaacctttagttttgtgtggtcatgctatggtgcctatgcaggcctgagtctcctaacaccgtgcatgcttcttctcttttcaccagaggttatctgggcatggtgcaatgctgacgcggtgtgcttcgatgttgacagcacggtctgcttggacgagggtatcgatgagctcgcggacttctgtggggcaggccaagcggttgctgaatggacggctaagtaaagatgctgacttttaaagctttgccaattaatccatggaaatttccattcaagcgttcaatttttattttattttttgaaaaaaaaaaaacatttccagggcgatgactgggtcagttccgtttgaaaaggcattagctgctcggctatcgttgttcaagccatctttggggcaagttgaggactgcatggagaagcggccaccaaggtaagctcctaagtattaatgattcttaggtgtttcagcctttgggggggctgtagttactactagccagaactagatggtttgctttcttttgttttgtataactttcagtgaaaatacacagatcttctgcatttctcaaaaaataaaatcgctactatgtttccatttttgggatggccatgccataagagaatactaagttgtttttaatccttttctccacacgttttcatgttttattttttttcaaattggatacagaataacagaactacttgataacttcttgtttattctaaataaacaggaatttatatagctcgttgttcaaatattagctgtttctcgtaagaaactgaccctgactttttttataaatttgctacaaactatgatctatctagatatttgtgcgtcaagcagacacaacgttcatgttccttggatgtattgcgttgattgtatctagccttcacatcctactatattttatgcaaatgacattttatcgacagaatatctcctggaattgctgagcttgttaagatgctgaaagctaaaaatgttgatgtgtacctggtttctggaggcttccgacagatgatcaaggtataatgattccattgttggatgctttcccagtgacattccaggaaagtcaccgtacgtgctatactttgattttactccgccaacattctgttgttttcagctccaatctttactttaacttttgaataggtccactgctttagtattatgtgatgttttttgccccctcttgaggaaccgatttcaaaaaaattggaagaacaaaggaaggttgtggcaagaaatatttgatccatatttcttttgatgcatttacactcctggtttatgacaagctttagctattttcaagttgctatttcttcacccagagtcagtctttgacttaccctttgctctttccatcagcctgttgcaatgcagctcggcattcctcctgaaaatatttttgcaaaccagttactgtttggaacttctggagagtatgttggttttgacccttcagagcctacttcacgaagtggaggcaaagctgtagcagttcaaaacataagacaggttctgattttaactctccactctgccatgttgctgcttattaagcacattgcttatgtacctttgtgtgtgcagaagtgtggttacaggacactctttatggttggagatggtgcaactgatcttgaggtactattattgtgtccatagaacaatgatagccctacagtaggcatagcattaccattttcattatatgttaggagtacactgctgccacaaaaaaaaatgggataaatgttagcaagaaaatgcaaaaccacatatactgacacatgtattacactactaccttaggaatacaaagtattttgatacctaaggaagaccatcccaattccaaatcaataagagactgaatggccaatttgaattttaaagttcacataaatcgtgacaaatttgttgatgttcatagtatgtattaacgtgtatatgtaggagaaacattctcatgttaacaaactatttatgctttcatttcatttagcaaaggaaacataaaaggggtcgaactatttttcttcctcagttactttgactaatgagatgcatggttttttccttcatattttgatatgagcttttgcaatgaactttttccttcatattctgattttagcatggtgatgctgtatcgctgtattggctccatgagtagattagttcataattttgtattggttaactgttggtatatcataaaggaacttctgtgtggatggaacttcagaaacatcttaaactatgtttttcatgtgtgcaggctcggcaacctaatggagcagacttgtttatctgctatgctggtgtgcagatgagggaagcggttgcatcaaaagccgattgggggctgcag

SEQ ID NO: 80987 - DNA, 24569 bp, Oryza sativa
tgctctttgtatacacaatgctaggcttcatgaaacccatttggtgcgtcgatgcttctaaatttttttataaacttggtcaaacttaaaagaagtttgactaggaaaaaaagtcgaagcgacttataatatgaaatggagggagtattatttatagatgatcgatcttttcagaatggaaatgtgtgatgtgtgttgtgcccaatgttgattgatgttcataaccctgtactccagagcatcttgaaagctcatcctcaccgagtcgctgtataattcatgtctaaatcactatttttttctgtctgtaggtagttctgaaatctgaattgtacttccattttttttttgttcttctgttttgttgggtaatgccaaggggactaacatagagtcattttcttcaggaagcagcatcctctggtgtcaaatttctttgctttcctgaggtattctcattcataggctccaaggatggcgagtctattaagattgctgaaccattagatggcccaataatgcagagatattgctcacttgcaaagttagtaagaacaaacttgctgaatttccattttgccattacatataagtgcctcttcataggaaccccttttctcaatttactttatttattagagttcacattatatgacatattaaatttaagtatttagtattttgtgttctcaatcttgacttctgtgccttacaattgtacaaatgaatcttctgatcatttgttcagtatgaacatttggtcaatctgttaacttagaaattgttttggcttatagaaagaatgaaaatctatctaatgctctgtaatttccagtttaaggaccagtgtgcacttgtcgtgcttattttgaaagctaccgcaaataagtaaatttcataactcccagtgccctgtttggtaaattagactgtagcttaacaactcctgtcatgtaatagtttaatccttctaatttcctctagcatgaacctttgatatgcgattctctgatatattttgttatgtggaggcagaacacaataataccactttcacaacacaatctagaaaaaagaactagccaaatatcaaaacatgcatatatgatatatgatgactaatccattccaccacaaggccaaatggagactagctgtgtcttgagtcttgaaacatatttctcttgtattttttaaggattttatttggttatcggatagcactttgagtccttgacttaacataatttcatcctgcagggaatcaagtatgtggttgtctcttggagggtttcaagaaaagggtcctgatgattcacaccagtacaatactcatgtactaattgatgattctggagaaattaggagctcatatcggaaaatacatctgtaggtgcttattctttctcagctcttaggagaaacatgccttcaagaattttctaaacagtttacttgcgatgcctattttaggcattcttagaattttaacagtagttttttcaagttgacatagtaagggcatgatatttgatgctatgcagttaagtactagaagtttcatatgattgttggttctaacaagagaacatttatcttacaatagccatggataaaatagatttatgagaaatcgtcacaatatcccagaagtatatttctgcattactttactgtctaaatggtgaaatttttggtcgtacgcaagacaactgttgcatctttcttcgtttcttcttgcttgttatggtacactgcaacatctcattgttcagatattcaccttcacatttttacgctgaaggtttgatgtagatgtaccaggcaatatggtgtacaaggaaagtcgttttacgacagcaggtactgatatatttcctgatattttagttttgtcatattgggatatgtaaatttttagagttagttctaaaatatcacttaaccaattgtacttttatatttcaaatccccctgcggaatgttgtgtttgtcacataaattattctagaattaatttattatacctaaattatcaacagtttcttgatgtactttttaatatgctcaattaagtgtcatagtcaatgtaccactaccacaatatcagttcaatattcagtcttagaacaaatttttatgagatgtttttggtctgcaccatcctgcactatcttattagtttctgttcttctagaagttactctgttatagaactcatttttttcacattgaactattgaagcctatttaagccaactatctgatttctagtgcacatgactctcgacaagatagttttatgagcgcaagatgggacactaacttatgcttctacataaactttagtatgcattgcatatccttgggtcaggcattatcaactgaagctttttttcttctgaagccaaatataaactgacttgattgaaaagtgattgaaactaatactgcaatagtgatatcatggagtgagacatacgtcgggttgcagttgataacgctatatgtgatggtgtatttatttatttatcaggtgatactgtcgttgcagtggatagtccttttggacgacttgggcttactgtttgctatgatttgagatttccagagctttaccaatgtttgcgctttaagcatcaagctcaggtagtgatttatggcattatactgacataagtttttcctgattgccttatcctaagcatacctgtcatatctctgaggaaagctcaggtgaattgcatattgttttccagtattcttctaatatgccagtgacctttttaggtcttactagtaccatccgcgttcacaaaagtaactggggaggcgcactgggaaattcttctccgagctcgtgccattgagacacaatgctatgtatgcaaatcctaactcttataagtctttcacttttgcagacacatcaggctgtttcatatggttgggagtgtgatcaataatataaaatccaccatatatgcattacatatttgttattgttaaattttcaagatttgcaataggttattgcagcagctcaagctggaaaacacaatgagaaaagagagagctatggtgattctataattattgacccatggggaacagttatagctcgacttccaggtatatctcttcattttgttactgtcttctatcagaaatcttctgttgatattttgaaggttttcttgaattttatcagcaccttgtaccttgacaaccaccaagattttattgatcttctgttgaactcctcaacaatatttgctagcactgaagtttgaacttgtcctggaaaatattgtagtctgccattaccatactgcatttatcgtgtttgtatttgttcaaatacaatattctgaaattatgtggaacgagtgtgtcacagtatgcccgttaaatatcgttctgaggaattaatcatcaaactttggctacagaccggctgtccactgggtttgctgtcgcagatgtagacttgtcaaaagttgaggctgtgcgaactaaaatgccaatctctgaggtaatactctcatggagatgctgtttgcttctgtccaagaaacaccatttagttgtgttcttcaataacagtttatcatcttattttgtagcaccggaagtttgacagcgtctggaaaacctcatcactgtaatagtatagaggtcttgcacgcctcctttctctttcttttttctttagagaacagtcgacctattattttgtgtatcaaatatcaattgcaaggcacacatgatgatccaatggtttgatcggcggtaaacttcaattgcgaagccatggttgctgtgaggtttcttggtttgaagaattcctggttcagtggaacttcaagatcccaaatccccaattaggctaggaatgatttgtcagaccaaatagtccataaataatagtgttggcttgaacgcgacgccaccaacctaggacatttcaaataagtgattgccattgaatctaatgtaaatttgttatggtacatttgttgataaatcaaagcttggattttttttttggttactgcagaattgtttataaatatagtccacacatacacttgaccacatcaggaaactcttctaatgtatacatgacttataagggcacccgcaatggttatctataggctctctacaagagatccatgtcagcatatttttctacttggaagagattaaatgaagaaagagagagagcaaagttatctactaacctggaaatagtctatagaaaaaaacgaggcaatggattagagagctatagatacccatgtaggtatatcattgaagtggtttactattaatctagtctattactgagatgtacatgttttatagataacaccttactttaccattgcaggtgctctaaatgatgaaacaaaaaaaaatgacagattggctgtgaatagtttctgaagtatctttaagttttaaaaaaatgcacatgaactatctccaaccaaatatgctcttttatccttgtgtggtggagttcagtcttgattttttgtgaaataatatatatcacttattgttaaaatttttagaaattctattagtatttttgttgcagctaaggaggagaacaaatgagtaagaatatctccttgaggtattatattctagtaattcagaccatgcccacagagtaagcatagctctctcacgtgttattgtaaatagtatactctaatcatccaccgtactccaaaactttaataagcaaaatttttaaactttgatcattcataacttctggtatgcttagctttttatttagaaaaaagaatggtacgcatggaattgcttaggcaaaatactatcataatatagcataaatttattatattttataattttgttataatataaaattgatgatcaaattttcaaaagttgaccgaatcttcttctaaacatcaaacgtttataaatagagggagaataaaaaaattttaaaagtgaaaactgaaaaagaaatgtttgcatttaactcagctgcaacttctctaacaacggggattgcctgctactgctagtgctaatgtttgctgccggcctgcaccagcagtactgcagaggatctgcactcctctaatgctatccctaatgtaaatgctgagagagagagagggagagagaatataggaggatattatttgtttttctttcatgttaacatggtgttgagtgatgttggagtgtaggtgtggttgcataaattaatttgttaaggttcaaattcaggtaaccaaactaggtagtttttttttcttttgaggtttatggatttttccctaatgtctctttgttgtgttaaaagtggcgtattcgtagatatatatagcgcgctgtgcatcctacatttgtattaaaaaaatgatattatttagtcctaatatggattttggtgtaggtccattatttagcaaatgctttaagcattttaattgcatgcaactaattgagacttcctttgaaatggggtgtttcaaagaaattgagctgattcgttttaaaattcctataaaattcttgcgtttaagcaccaatcctttgagggatatgatctttttcgtcaagaaccaattctttgctaagaggaaatattttgaagaatattttcaagaaaaagataatctctctaatattttttgaataagccttttgtcagagtgctagctttactgccaatcaacaacgtgatggctggcgtatcagtagccatgtcatatgtgtaaagtgtttggatttaaagattttatggaatgccaaattttgtttaaaaggtaaaaatttctccttcgccaatatacgaagggcctcattgtttggctgatgcttatgcttataagctaaaatttaaattttagaacttgattttgaatttatttttttttcgtttttcatcgtagtttattttacaacatctgtttttatttagtcgctaaagagaagtgcataaaacatttaccgacaaatattttttattggttaataaccgatccgaataagcatacgaataagggaaacaatattcgaaattagtacgaaagagaaaacaaattacaaacggattttattacaaacccgtttctacctctttttttttccctcttattacagagaggttagattagagttaggctcgccattaaacaacactcatctccccctcccccttgaaaccctagctccgcttcgccgtcgtcctcctcctcctccccggcggcggcggcggcggccatggcgtccgcggcggcgccgaagcggtgctactacgaggtcctgggcgtcccccgcgactgctccccggccgacatcaagctcgccttccgccgcctcgcgctctccctccaccccgacaagcagccccccggctccgacgtcgccgccgccaccgccgccttccaggagctccagcacgcgcactccgtcctctccgacccccacgagcgctcctactacgactcccaccgctcccagatcctcttctccgaccaccacccctcctccggccccggccgcggcggcggcgtcgcctccgcctccgcgtcccccgtccccgacctcttcgccttcttctcctcctccgccttctccggcttctccgactccggccgcggcttctacaaggtctacggcgacgtcttcgaccgggtcttcgcgcaggagctcgcctacgcccgccgcatgggcatgcccgccgacgccgtccccacgccgccggtgatcgggaacctcgattccccccacgcgcaggtcgccgcgttctacagctactggctcgggttcggcaccgcgatggacttcgggtgggcggccgagtgggacgccgcgcggggggagagccgccgggtgaggcggctcatggaggaggacaacaagaaggcgacgcgcaaggcgcggcgggagtacaacgacgccgtgagagggctcgccgcgttctgcaagaagagggacaagcgggtggtggacatggcgctgaagaagaaggtggaggaggagaagaggaaggcggaggaggcggcgaggaagaaggaggaggagaggaggaggaaggagcgagcgatggcgtaccaggagcccgagtgggcgagggtggacgaggatgaggcggcggtgtttgaggacgacgaggaggaggagacgagggcgaagaggaaggaggagctgtactgcgtggcgtgtaataagaagttcaagtccgacaagcagtggaagaaccatgagcagtcaaagaagcatagagataaggtgtccgagctgaggatggtgtttgaagaagaggaagaagctttgaaggatgctgaagaagaggagccagaagaagttgatgtggggtttgattttcagcgtgcacaggaatcagaggagagtgaattttcagatgctgctgaagagttggctgacgagttgagcgagggattggaggtgcgtgatgaagaagagaagggtgataagcacttgggtaatggggaacaaaaggttggttcatatgatgaaaccagtgtgttagaggaaatgctatcgaggtctaggcgcaagaataggaagagtggttttgtcgctcctcaggaggaagcttcaccagctggtgccatggatgatgatgacgatgaggatacaagctatgagattaataatgtcaaaaagaaaggacgccggagacgggcagcaaagaagggaggtacttatgctgataatgggcaaggtaggaagagtgagaatcagcctgaggaatccaggcataataatgatgaaaatggtgctgatgataagatggaaggtccatcttctaatgaagacagtgctgcagcaagtaaagaagatcagcagaaaggaaaaaccggtaatactaaaaagaacaagaaaggcacagaaaagaacacaactatatcttctgaacaaaagggtacatcgaagggaaagaagcaaaaggtacattcacattattttctcctgttaacttcttcatatttctttttcatgtatagttggcaggaaacttgttatgaatttgtgactaaaacccatgtattctgtttctctgtttaagtcaaagagcaaaaacttttagcctcatcagtactatgtgaatcacatatgcagatacctagccgtgtaggtgcttcaagaaccacctaactaagccacttattagaaatgcttacgtaaaagctgtgctactttatagaggaaataaccaatgttttgaattttgtggaatacatgattagagttgcttcctttgtgagaaaagaaacttgtcctgaaaatcttatgatttttgcgggtatcaacactcacatgttggattgctgttgttttatgattttttttccttatgcaaaaccctaaatctgtctttgtgcagcacagtagcagtgatcttgctcttgcttttcacattttggaaagaaacctagaggatgattttgcataggttgaaatgatatttgatagcactgattaacatagtggataatgaatattatgcttttgtgaaatacttgttggagacagcctttcttggttttgtgaaatacttgctggagacagcctttcttggttttgtgaaatacttgctggagacagcattttgtgaaatatttgatagcactgattttgtgaaatacttgttggagacaagcctttttttggtttcatgtcaattagtatattatgccttttcctgtgatgtctgttaacagtttaacttgttgatctataattggcgtatcagtttagctttctgtgtatttgttctaaatttgtgggtgtgtacacagttgcaaacagagttaaagaatcttggaagcccccctggtttcactgttatcacgattttcttatcttgttttgattaaaaagtagattagtgccacctagagcaaagagcccttccgtttgttctgtatcatgtagatgtctagtgcaaaatactttgttggagaacatacaacttgaagctgcaaatgtggaaaagttttatacgtactaattcactgtctactgttagtgcaacccgatgagcttaaaaccaaaattcggccatgccttgagtacccatgacatgttttggatatattttgtgtggataatattgtgctatgcattgtctatagattcataaaattctatatatatttctgtaagtagttataacactttgaagctaccttcttgtaccaggaggtttcaaaggcacccagtaatgactgtgaaacgtgtggatcaacgtttgactcaaggtatgtacttgaagttcagctttccttttcctctccttccctttcatttgcactttcccatcatatgttgctatcttacaatgaaattggaaacgcagttatggtttgtctcaaatacttcttgttgcaggaacaagttgttttctcacttggaagaaacaggtcatgcaatgctgaagacacgacagaaaaatcgctgaagaggacaagaaagtagttttcttttaccgtttgtcccagttgatgctgatagattagcacatcgacaaaaaggccatatatctggtttatagcccaattttgatatgtgtagtagagccgttttctttcttcctggatttgtttcattggtttgtggtacagaatgacaagaactaattattattattcaatcgaaatacacaccatcttgtaatttttctcccttttggtgcattgtcttgttcaagaatgaaccattttgtacgcgtttgagcctactgttgctggtgctcagcttctttggaatttcaccaataacagggacattattaaaacaactcgtatgtcatgtaccatttcaaattttaagcactgaacatcagcatcgaaaccaaaacagttactatctttcttatcattcaggtgaactccaaatttccctatgctatctgcaaatgggtcttttagaattcagagaaagggataacattacatttatataatctgacacaaacttaaaatcacaaatccacaaactatcttagtttgttccttttttccccttatgtacagctccatccaaatggaaatttcatgaatggagtttcattccatgttggcatgatctgcttcctggagacctggactgaagtccccccctgcattgctgcctgaacttctttgttttctgacagcaagagtggtttgcgcttgcaaacaccaaattaaggcaagagatgaaaggatttgaatcaatcacttggtgctcctgtgacctgatgaagccatgagcaccgcgaccgcgacgatgaacatgaacagcatgaacccgagcaggatatacgtctttcgcgacgatttccggtactccccaaacaggagtattccccagaatgtgctcacaagtggcaatgcctgatgaaacagcaatgctgaagcagttagaatcatagtccagaaaagttgtacttctctgaagatagtgtgaactgctaaacctgaagaatttgcctggaagatctagtatgatgttcagtatctgaatttatctaaagatctagaataataagttgcagttatctgaagattgtctgaattgctaaacttgaagagaatttgtctgaaagatctagaatctcgccacagccatcgcgaacacgatgaatttctcttctgatgtgaagaaatgataagatttggagattggactaacctggacagcatcagcagcagcatagccagcagcctgaccacccatgaactgaaacccattgccaaagccacataggaagccagccaggagagcccactgcctgccttcccagtcattcaggtaagccttgaaggatgatttcggcacaccggccattggacggtagaggaacaggatgttcaggccgatgccgatgacgaagcacgagatcgagaagtagaagaaggcggtgtacaccaccaggtgtggtacaccttgtttcagggtgtgccattggtcattggtggcgaggttgaatgccggggagaagagtgagaagcagactcctgagaagaacactatcccaagccctatgaaggtgcttgatccgaacacctgcgcaacggagaggttcatcagatcaatctagttcattggtacaagttttcatccataattttggtattgattcaacaagcatgataaaggatgattagaatggcagtgaccgaattaccttgatcgaacgccgttcttcgagctcaatcaagtattccgcagttcctgcttcagctttggcaacatatttggttgcagaagctccattctccaagtccttgggagcatctgaaattggcagagttaagaactaggatctgatctgcaagaaatcaacattactagtacttacaacattaaagtcagttttttttttaaagaaaaggttatggcatacctttttctatgacttctttgtttggttccacacttccattttccctggaaattacaggttattaagatcataggggtcagtaaattaaaagacgcagaatctttaaatagattggaacctaaggcataatatattttctaacagaggtatccagataggctaaccagtgtgtaatgtgttttatgtatcttgatgtgaaatatcttgatgtgttgaaaaatgtgaaatatcttacccaagtttatagatatttgtggagccatttagtttttcttcattatcagctgcattggaggcatgtacagcagagccaagaatgactgcaacaaggaagcaggccactccagggaaaagaatctctgctctgttgatgcggttgtccaggaaataattcagtgttgtgcctgaagatccaacatgtgagttttctgatctactgaataattaggacaataataatggatacagcaattagtttgctgtagctactgaataaagtaaactggagatattgatctgaatatatgttcttttcaggagtaggaccaactataatgtattcatactattactaacctaattattcagtttcttcgactaacataaatatagataggttgtgatgagctgtacttcacatgtatcaccaagaatcaataattttccctcaattttctttacttaaaaaaaaatcaaacaataatatatgttgcagtgttgtaaaagagaagttttacctacctattacaacaaccatacttgagctgatgacctcagtcactgagagacctacatatgcccatgcatactgagtagagaggttccctatactgagcacaacaccccctgccattgcaaacagcactgaaggccaattatccttcattgcaaacaaaaaaaaatcactgtcagcaaaatttcagactaactaacaatcagaaatgtattaattcagggatatactatttcagatgcttaagagaaggtggctaacctgactgagctgggtgaagaaattgggcatgttgggcttgctatcgccgagctgaccgaaggtgagcgcgatgaggaccgcagcgaggaggttcgtgatcgagtagtcgaggtaggtgtgctgcgggagccggcctcggcgctcgaggagggtgaggaccgcaggccatgtccccaggaagaagagggaggccagcatgagggcaatggcaccccctttgtcctctatgatgtacatcttgaggcctccttgtctgatggacaacagggaattcacaagggggccttcaaaaacctgacaaaaaataaaataaaacacattttttcatcatgtaagagggttgagctgctactcatttggattgaatcatcaagaagtttcaagatcttgcagttgttatccacaaaatcttgtaaaatcagaaagtgttttgcatttaatactgtcctcaaatctccatctcttcattcttgcttgttacagcaagcaataatatcattacaagaaacacaagaaaaaaaaggaaggaaaagaaatcaggaaatcaaattcattccaacagccatagggaagatcccaaattgtggataagctatccttatcacttatcagcatgaaagactcccagttcttggaaccctaaatccccaattcttcaaagatcagattctgctgaggatgagaagagatccaaactcccaattaaacacataaacacacaaggaaggggaagaagaacatcaagcaagtagagcagagtaccttttggcatgaaaccaaagaagtggcacaaccaaggacatggtccatggatactacttatagtgccaagcactggttaccaaaacaaaagctaatggtatctttcaaacgcaaaaagtccaacttgatctgcacaagtttgactcatgcagcaatttgcgaattcgcggcgtcttctcatgcgcagatcacccaatggaattggagctttatggaggaggaggagggagaaatggagagaaaagaggtggagaaaaagacaactatacactcgtcatttgctgaaaataatggaatggggtgatagtgacatctagggatactctcctccaccaatcaataaccttgaaatgaaatgatttttagctgaaatatcacttattgcagactccacaagtttatgaacatatggcaattgacaccattatgtctaatgaattacatatcaaggcttttttttttcttggatacagatatctaactaggtattatctgcaatttgggcactgaatttgtccaagaatgcaaagagtgaaaaataatggaagtagagaactgtactctttagctagatataatcatataaacaactatccatttctttcagtgacgtcttatctaagaaaaaggcgcattaaaagagaatttttttttgatgattccaacaagaaaatgatgcgtctactgaatctttcctttcctcctttaagcaacaaactaaacaaaaatatttctcaatagaacaagagattcataaactgacatggatccaagaactcaaaaccaacaaaaaagagagacccatgccgatgattttcaaccaagaacatcatcttctccccaaaatatcattttttttaaaaaaaagaggaagcaaacaaccaatcaacatcgacttccactcacgaatacaaagaacacaaaacgaaacagataacaaagcagacatgccggacataaaccattcatcaccacaagctaattaatgacaaatcaaagatcaaaagacaggaacacattacctaaagtcagaaggagagaaagggatgaactgctcctcctccagagaactcaagaactgaactctcaagtctcaacagcctttgtcactgcatagaattcttcaggttaaatagataggcagctggggtttgttggactctctctactactactcactcctccagctgacacgcaagaagggaaggaattaaccatcaagagattcttgttcttctctcaagagggccaacaaaaaaaagggaagaagattcttgtggcacctaaaaatgaatattttttttgggaaaaaaagaaatgtaaaaatagaaataaaaattcaatccattgactccggatctggagagatcctcaagattccccaggcaattcggcagtatttgttgctatcttccctcgctttgaccgccttgtgtggttgtcgttgtttcgcgtgccaggagcgatttgtttggagaagagtaggtgatttaatctctttttaatttaataaaaaattggaaataggtgaattatatatgcagctgtttgacaatttgacatattattatttctgctgtaacgtacagatcagtccagcctaggcgggaacacgtctggatgaataattcataattgttttattacacggtgggaaggtttctcctaacacacgccaaaagaaaaaaaaagtactagactaatagtaataactaggcattaaaaaaaaactcatgttaaaacacattcaaattttagataatgaaataaaatcacggcctttgtttacagagctatatccaattattaaaaaatgttccaaacataatcacacctcaaaagaagacattaagacataagggacaatccaaactgatagaggcgcacactgacacaaacactaataaaaagataaagcacaaacttattgaattttatttgtgaacctcccttcaagattggtgaaaagttacataactccagtttgtaacatgcaacttttataaacttaatgtcttcgtcacatttttgtagaagagcccataatcggagccaatatgttgtcttgaaaatcatatgcaaaaaacacattcatatatatatatatatatatatatatatatatatatatatatatatatatatatatatatatatatatatatatatatattcaatattaatatttgtaggcatcatgatctgaacctataattttttagtacacatagaatttctcttaacaaacgttgtaagagacgcacgagaccgtgactaatttctagcgataaataactagcttcattaaggccctgtttacttcctacacaaaaattttacaccctgtcacatcgaacttttgaacacctgcataaaatattaaatatagactaaaaatataactaattgcatagattgcgactaatttatgagacgaatattttaaacctaattgctcaatgatttgacaatgtggtgctacagtaaatatttgctaataacggattaataaggcttaataaattcgtctcgcagtttactgacagattctataattagtttttttattagtgcccgaacaccccatgagacaccctatataatatccaatgtgacacaccaaaactttacacccctggatctaaacaccccctaaattcctattaaaaccatgcacatatgtactggcactaatatagatcttgtttggtataactctaaatccaagattttataagctggatattcctaactctacataaccacagatctggatctgctattacgttataacatttagataaattattttattttcattttagataaagatataacattttactagaaattttaaggctgtgagatctggatcagggcctaagatctcaactctacgtgtgaagatttttttttttgtttttgagaaaattggcatgattggctttgttttcggtgtcagcctggctgttgggtgcgacgactttggaagctattaacatgtgctttcttacattaggtgtcgtggttgtacaattagaatataaccttgatttatttgtttattgaaaaaaacatattcgtgcattatatacatatatattttcttgacatgcatttcattttcatctttatcccttgataaattttattgctgcactaccaaatgtacaatagtaaaatacaacctagaagcataaaattcactttcttttcgacgacatatatggacctttaaagagtaattttacaaaaggctaccttaattctgtgatgaaagtttcaggggccctcaattagttagcttatcctagctaatcttgcatgtggcaggatactatgcacgacaattttctatgtccatgttcgaaatcttttgatgacaggttaagtagaacttgctaatggatggattaataaatatataaatatttctaccaaataaagcatggcagctagcctagagcgcaagtgtcaaagcaagtgaatagttttgttagaaaaacgtggctcgtgacttcgtgaggaggttccatatgcatgatagatatcataaattagtaccctccagttttttaatagatgacgacactcacttttaaacacaattgatcatttgttttattcaaaaattttatgcaaatgtataagatataaatcaagcttaaaataatttaagtgataaaacaactcataacaaaatatattatatttacgtaaatttttttaataagatacatagtcaaacgtgtgataaaaggttaacagtatcatctattaaaaaacgaacccagcaacaaatttagattatcaaagtgacaggcattgagtgaagattacggtaggtacgaatatgaataatcaagtggccctgaagattcgtagaagtcctacgctgcatttcgtattgcagtgaattagtaacaatattttttgtgacggtttttaatatttcattatttggtaaatagtttctatttagatttaattatgcaaactataatataatcatgctctaaaaatataaaacaattgtgaactgagcataattcagctggtaaggtaaacaaagttagaaaacatatttcagtcaaaaaaaagttagaaaacatatttttatttaattgtaatttgatatgtaaacaaacacacgctactaatttttttacaaggacccctatatattacaattggaatgtaattggtcatgcgtgtaaaaatcgatctccattttcgcatatggctcattaagaggcacacgtgcaaaaatctattttcgcaagcgggccacttagagagccgcatgaaaaaatgagcttattttcccatacgatcctcttaaggggccacatgcaaaaatagattttcgcatgcgaaaatacgctcttcttttccacggatattttctcccctcctctctcttttccctctcaacacttcaaattttttcacctcctctcctctctctcttcctctcacctcttcctctcctctcctctcctctctctctttctctcctatcctctctgtcttcctctcctcaccaagcgggagggagcggcagcggccgccaccgcccccgggtggatctggcggccctcactctcctagtccccattcctcttccctctcctccctcactctgacggcagtggcgggcgagggtggtggtggaggacaagggcgatggcggtggagcgcgaggacgacaggtgcaggctccagcggcgacggtgaacgagtgggatggcggcgacgggcgtgggtgacggcggtggtcctcccccgctcggatccgacagcggcagatctcccctgcaccgatctggccgccaccactctcccccacccagatccagtggcagtgaccctccccgcccggattaattaatcggtggttgccctccccaaccccgatctggtggcggcccctcctgcaaggatccatcggtggcgatgacgacggggtggggatgggaggaggacgatgtcgatggcggcggctggaggatgaggacgacagcggtggtgactagaggacggtggtggcaatcgcaacgagaggacggcggcgatggtagcgacggtgtagttttctattttcagaatttttatttttttcatgattttccttttcgtgtgcggtcagcttaagtgctcgcatgcgaaaatcgcatgaggttgtgctggtcgtatgcaaaaatccaattttcgcagacctttgggcgcatgcgggccgcccgtccacatgcaaaatttgattttggccgtatagaaaaatcgaatctatattagtgacatcaattataaatttatatttttacagaataaaataaacacaaagaaaatacacaatatagacaacaacaacgcaaccttaatatgtcacatattagtaaaatatcatttttaattacgaattgaggtatcattaactcatgcggcaaaatatttttacccaactcgaatcaaagacttaggttgtgtttagttcacaccaaaattagaagtttggttgaaattggaacgatgtgttggaaaagttgaaaatttgtgtgcgtagaaaagttttgatgtgatggaaaagttgtaagtttgaagaaaaaaatttgaaactaaacacggccttagcatgagcatttgtatctattattagaatttaatcctaaggctatgtttggataatggaaaatgaggggtaggattgggattgggaaatgtggcaaggtagagaggccaagttggtgtcgtcccgtgcgatggagaccgagaccgagccggtacaggagatgcgtgcggctgtagtttgagagaattacaatttaggtttggtaattgaggatagagtcctagtgtgactaggagttgttctcctactttgagtaggaggttttcggtataaatagagagggagaggtagcctcccggtatcgcttttcagagcgtggagttgatagtttagttagggtttcgagattagtcgagatttttgtaaggagtgctgttgttgcactttgtaaacacagagagaagcaataaagttgtcatctactttgagagttcttcgatttgtatttcatcgggttcggcggtctaaccggtgacataccgacggttcaaccggtgacaagacggcggttagactggcggcatacgagcaatccgaccggcggcgacaggactacgtcgagatttccatcgatttgagggtaacttttatttccgctaaaagtttttgggtttttggttttccctaccattcaccccctctctggtaggtttgattgcttgtgttcgatcctacaggaaataaattaagacctaggataaaataaggtagaaaaaaatgaatggttaggatttaaagttatcccttcatagctggaaaatcatttccttttccgttatccaaacggtgcctaagaggtagtacatgcacagatccaggtcgtcaaggtacagcggagaagcactgcagctacagtgagactgcagcacaatatgctgagtctgctacagtgagtcaatgcagtaaaacagtgtccaaatactgtggtaaagtactatataagatcgagttctacaagtcagctataagcatatgaaggagagaagagaagagagaaggaaaacaggcttcccatcaaaaacaaaaaaaagaaaacatgctacagacttatagccaactgcaatgcggactctaatacgttgtgtgtgtatgagaggtgggaccatatattaatggtgtacaataatagactataagtcggctacaagcttatgtggaggaaataaaacaggagagagaagagaagtggggctacagatttatagccagttgcagcacggactccaaaacgctgtgtgtatgacaagtgagacagtgagaccaattattaatgatgtaggccgcgttcttttcagcagttgggtgatgatgattagctacacgtaaaacgagaaacatgattagcaatgtaattagttaagtattattatttaaaaaaaaataaaaaataaacttatttgatttttaaagcatcttttatatagaaaattttcacacgaaataaaccgtttagtagtttgaaaagtatgctaatgaaaaacgaggaatagctaagctgcattagctgtttagaacgcggtcgtagtatatatttgtagttaactattatataaataagctattagattggttataaatgatttgaagctagtagctggctatactactaattaaacaataattcgatcttttactatttcaacaattacggctcgcattcactgtttagttatactgtagcactttattttggaccgttggatgtggacccaacaacatacactgtagctccctctgtagtctcttcataattacagaggatccgaattaaagcacgtgaccgtactcacgcgaggttagacctctaatcttgtcaagacatgtgctaggacatgtctacacgttggtgtagtatcaaagtgtgggtacgctttcaacttgtacttcaaatactacctatctctctgtatttaatgtatgacgtcgttaactttttatccaacgtttaatcattcatcttattcaaaatatttatgtaattgtcatttattttaccgtgacttgtttcgttatcaaatattctttaagcatgacataaatattttcatatttacataaaaaattaaataaaacaaatggtcaaacattggtcaaaaggtcaacggcgtcatacattaaaatacggatggagtatcatttaatcccaaaagagagagtttatatgattatactttcaatggtgtgtttgagtactcttacactccaactggacggtcaattaacttaaaggaggatggcgatatggcatctcatgtgttctcgcgtcgcgatcagttaaatattactcatataataagttttctatttttttctaaatcaaacttgatcaaatctataaatttattagcaacatctagaatattaaattagttttattaaaatcaacactgaaaatattgctttattttccaataaacgtgatcaaacttaaaaaaaatttgattagaaaaaaaaaggtcaaagcgagtaacgtttctaaagccttaattcagagacatggactttggccaaacgtccaacaatcaattaattgaccaagttgctttctctcctatatggacgatgaaaacgatagagtagtgtactactcctaattactgtatcgatcacatcgaccaatgttttaacgtgaagaaactgtgagcctaattcactgcagagcgtcatcatagaccaattatgttcattaattatggtaaacatcttattacagacagttcccccggtcatatatactgatcttccagtcatgaaaaacacgtcgctttagatatatatggacgcaattgtcaaaatgcaaaattgacaattcacttccactgcaaaatttcgttagaaaaattctgattagaaaatctccgaaatactttataaaagtacctttgggacaaatataaagttatcattttcaaatatccattcaattaaataacattaatttctgaagttactcatccaaataggcatgctttcattgctggaccgagtacggttttacaaacgtgactatctctattgaaatatacattgaaagtgagaggtagcatgctatgatgtatacctctcttctgaaaagaaaggcgccctactatacgtgtcgtcaaatcttaaaatcttaaatcactcatgtatgcaactatgcctacattgaaaatgcgaaaattataccaatagatttgtcaaaaaaaaattcatataattatatttttaacaatttatataaatatatactttgaaaactaattataaagttatcgattcgatgtccacttcacccatgaacgattatcaagtgtcaggtattcacagatttcatcgccgattggaccgtccccgaggaggacaaagttgatcgtacggacaacaaacattggacaatggcctttgatggtgcatttaacagccaatgagcaagagctgaattcattttcacatcaccaaccgaagatcagtttcgacatgctgactagttagatttctgagcaaccaacaacaatggggaatacgaaggacttctcgctggacttagagcaaccgcgtcacttgtggtcaaacgactagtttggaaaggggattcagaaatagtcgctaatcaagggcacaaggatcacaaatgctcaaatcccgagttgtccaagtatctagcagaagttagaaagttggagcgtaggtttgatgggctcgaagtgtgccatgtctatcacaaagataacgccgatgccaacaaccttgcctgacgagcttttaggagagagcaggttgaacctgacacattcctagaagtattaactagtcgatccatcaagagttcaccagacggcaacattaatagcaccaccaacgttagctcaaaagctactactcagattgacaaaaccatcacggacattgagaccacttaggactggcgcacaccgctcatcgattttctcaacgctgacaagttaccggaagatgatacggaagcagaaaatataccaagttactagcccaagccctccaaacgatccttatgtcgttttcgtgttgggggcttgacatcctcgaatatttttcacgaggacaaggcgactacaaatttttattcatggctatcaacaagttcattaagtggatagaagcggagccaacaagagaaatcagagccgaacacgccatcaagttcatcagagggatattctatcgatacgggcttccatatcagatgttgacagataacggctcccaattcacaagcggtacctttcaggattactgcttcgaactcaacataaaaatctgctccgcattagtttcccatcctcagagcaataagcaagtcgagtgggccaatgggatagtgtatacaataggctcatgacctgccattcaagctgggttgaggagctcccttttgtttcgtgggccattcgtaccaccttgactacacccaccaaagatacccctttcttcctcatgtacggatctaaagttatgctccctttagagctactctatcggtctacacgagattttttttctgtagaaaatttacattattggctttgtttccggtgtcatcctggctcttggtgctatccagctatgggcgccactagtttggaagctattaacatgtgctttcttatagtaggtatcatggttatagaattagaatataaccttgatttatttgcttattaaaaaaagatattcgtgcattttatatgttctcttgacatgcatatcggtttcatctttaccccttaataaattttattgccgcactatcaaatgtacaatactccctccgtcccataaaaattacatttctagctaatttaggacataacaataggattgaaaaatgaccacaatgaccttatttaatgaacccattgcatgcacacattccatatatacaaatcattaaaaggaagtttgagagaattaacccatataattagcatacttaaattacaagctgagagaacttaaggaaacttatctagataaatcaatttgctgggccccatatggctagaaatacaatttttatgggacaaagccttagagttagaaatgcaatttttttttggacggaagtagtagtaaaatatgacctcaaggcagaaaattcactttcttttttcgacgacatatatatacggacctttaaagaataattttacaaaaaggctaccttaattctgtggcgaaagttttagtggcccttaatttaattatgttattctagctaatcttgcacgtggcaggacaatatgcatgacaatttcttgtgtccatgttccaaatctttcgatgacgagagatatatattgtacgatttgtcacttttagatgtgatgtttaatatttaccatactatctacatgtcatagatatatagaaatctacatatgatacatatataagtggttaatagttaaacaccacatctaaaagtggcaacttgctaatggatggattaataaaaaaataaatatttctaccaaataaagcatggcagctagcctttagcgcaagtgttcaaagcaagtgaatcattttgttagaaaaacgtggctcgcgaggaggttccatatgtatgatagatactaatccctccgtttcgaaatgtttggcgccgttgactttttagcacatgtttgaccgttcgtcttattcaaaaaaatttaactaattattaattctttcatatcatttgattcattgttaaatatatttttatatacgtatataattttacatagggctgcaggaat

SEQ ID NO: 80988 - DNA, 21702 bp, Oryza sativa
aatatcgtcccgccgttgcgcccgcctcgtcggttttctccgcgcccctgatctcggtctcctccgcgcgcccaccggtaagtttatgcctaatgttaacgctgtgagcctgtgactgagatctgaagggttgtggtttccattatacaagagccattaataggtcttggttttttggggataactggtgggaaacgaacaatctttctgtacagaaactatcttgatttataccgtttccacaattccaattgctgtgtcgtttgttcagtacatacaatgtttccacgaagatcaggttgtggaatggggtgaactaatacatttggattggtgagatcaaggtgaatggttttttttttcagtttttttcctatgataaatttgggatgtttctcatttaggtgagatggttatgttgaactatattgtaggcaacactgacccttttatccttctcaaaataaatattatggaagctaggttgtatcattgatttattctggtgtgtaccattgctgctgtgggcagcagtttgctggttactggcagaagaaacctcataaccttgtttgcctatgtgctcaatgatgtatagttgacaccatcctccctgccgtctccacgcgtcccaccgcgccgcccccagtctccgcatagccaactgcttcctctcctctgcgcgtcatcaattgcctccactccacctcgtcaacagcctccgcacgcccactggtcccggcctcttcaacaacgtctcctgcatcaacctgattcaccggaaggtacaaatatcatcctccttccccctccccccctctctctctctttattcccatctgaaagaatcaaccaaaataaaacaacgagatgcatcattcatgtatttgatcattttacgttttcatttttaagtgcgactatccaccctttttgtttctaaagataagcgagggcatctatgcacactttttattttacaaaataaaaaaaacaatgacaaatatcatagtacattgagttgtacttcactggttctttgacgaataagtgtatgatatgcttctccataagaatggtgctggtctgcactatacttcttattaaagtcgattgcccatgcaacaaagttgcctgtatgggttatctaactcttaaatcagacaacacctattagcttgttgcacatgtcagttgttcatggttatttaattcaaggttacttaaatcttctcctatggcctttagtactgtcatccatattctgctgcagcttaactttttttcttaatatacatgtattatttacaatatatttagaaatttagtgccatgggactgactgcactgtagaacgtgttccttcgtgcctggtagtgctactttatttctcttaactctctactttgtgtgaatgaaaattgtggtggaatattctttttttagatgaatggaaagctatgtatatatatttgcttgtacaacgactgtcgtatgaaatgatatttatgttgttggaggtagaggtaaaatgtgtaataattgctgcgtattttgttgtttattatgtactctgaaagagtggataatgcaattcgggagatgaattgagaaatgaatttccaaatttgattgcatgacgtatccaatttgggaaatgaattgagatattactcctttgttcttatgtctgaaaccatatttgtacatgtcggtgaaaatagttagtgtcatgcatatatcatcagtttccatgggtcagtttaggttttctaagtaatcatcaattacatcatccacattgatttggtttttaatgaattttgctaccatttatgttgatgtgatcatatccttcttacacttagatatttggtctttgaagttctgaacataaaggttctaaaacaaacatgttgctgcttgaataagtggacaggaacaattagctcttttaatgcatagaaatacccttgaacatgtgaaccttattgatgatatggaaattggttattcccttattgatgtacacattattgtaatatgatacacaatatcatattattgtacttggcgtgaaatacatcttatgtacgacatgaattgagttaaagctcaattgtttagatcatagaaaaatattttttctatcatgaaaatttaatagttattaaagataatagaattacaccgtagtgtttagcatgtgcatattactagtctcctttgacaactgcaggatatggcaccgacgaccatggagaaggttggagaggtgtcgggatcccggtcaagggcgtagcggcggcggcggcaacgacaacgacaacggcaacggcgacggcacagcccgaccaaccgggcaggggtagctcaatcggaagctatggcatcatcgcaacaaggcgagaggaaaattcctctggagagaggcacgagcgagccggtggaggcggcggcggcgacttcacttggtgcatggcatgcctcctcctccacggaggcctcgtctgtggtcagctctcccatgcgttggccctctgtcccagttatcaccaaaagaccgcgagacgaataaaaaaaactaatttcataactcgcctggaaaccgcaagacgaatcttttgagcctaattaatccgtcataagcacatgtgggatactgtagcactttatggctaatcatggcctaattaggctcaaaagattcatctcgcgatttacatgcaaactgtgcaattagtttttctttttatttatatttaatgcttcatatatgtgtccaaagattcgatgtgatgtttttgggaaaagtttttggggaactaaacatggccatagttttatcgtgtttttatttttggaacttgtctcaccgtgcacttttgtaacttgtctcactgtgcagaacgtcaattgaagcttgtaacacttgaccctcatgttcctcgctcgtgtatgggaaatcaaaatcttcttcctgttcgtgattcttcgaccaaaacaattctagaaggagctaaagttgttattagcctttcatcttatgttggtatgtaatacactgcctttattttgtgtatattctgttatttatttttgctaactaatcattgcttttattgcgtgtttattttatgatttatttttcctaaccaatcattgcatctacagatggcacattaatggcacggtcatctggttttttcatcaattgggatgaggagagtaaagtgtgcactgtccttacatctgcacgtctaatctgctcaaagtactcatcgatggaccagtggttaggttcagatgagtattcacctgatgctacggtgagttcacatacaaacttaactgtagtctctttgttagttgacatacaaagtaataatggtcttttgagcttaggtttttgccacacacaaataaatacatgtctagcacacacatagagcacaacactttaattagaaagtaaaggaaataatacacttttgttaaataatgtgatttattcttaaaataatgtaacacatgtcttttgcatttgtatttttaggtttacgctcacttgctagataaagatgagacaactgtaccagcagccttgctacattatgacaggcactttaacattgctctgtttaaggttgatgtagactcatgtgctaagattcctagtttcagcagtgaagtgacttgtggtcaggacatatttgcccttggtagagatgatgatttaaatttgactatcaatcatgggcgtgtccaatttaagggtccaagtatgtttgagcgccactactatatgtatactggtttcacgactggtcaggtataaatatcactacgattatcttataaattagtattaacttttgttgcttttggttctgatatcgataatttaaatattttagtctggcattggagggccaattattaacttcaatgggcaagttttggggatgactaatgttctaggaatgggatttattccttcatctgttatacttcattgcttggatatgtggaaaaagtttgggtaagtttcttttgctgcattatataatactaccttcgtcccaaaaagagtttaatttgtctatctcactcatactaataatatagaacaacctttaccttttcaaactcaaatgcatttcacacatactaataaatgataattatgtgtagttatatccctcgcttgcatattgggatgaaactttcagccatgaagtttctagatccaattcatgtggagaagatctctcgcaaatgtaatattgattcgggtctaatagttaaagaggtatatattgactgttgtttcttactttcttaaacaatccttacctcttttatcacatattgttggctgtacatgacaaattgcactataggtgtcctatggatcaaatgctgagaatagaggagttagagctggtgatatcattcaatccatgaattgaaagtgtattgcaacaacagtggaggtatttattattaacagtaatagcagtaaaggtgatttattattttgtgagtgaagtggatagaaaaattacactttatgatctcctcattaactcacacatttattactcttgttgctgctgtcagttggagattgaacttatgcaaatatgcgaggatcatcttgacaaaggaagaggcattggttccagcgtagacatacaagtaagtttactttatatctgctataaatgtcattatgttggtccatagttacaagacatttttagcgggcagaccactaagagaggcaaaaaatataattataagatagcatttatttactacatataaaagacaggagcttttgtgacttctattttttgttttgatgagtgtttagtgttgctatttttgaatctaagatgtccatatttccattatagatgaatgggaaatgaaatattatatcaatagcagatgaaaatatagttcagaagccagatagaatgtaaggcaagcggaatctactaactacagtaccaaaggctagtctagaagagatacctgaacaaaccggagagaagagatacctggacaccaaaagcacatccttttcgccacaattctctgtcttccaggcatatcgcatcctgtagctgtcccttgtaggcatatcattaggagcatgaagtacattagcagaaacatgttgactagcagtcttgtaggcatatcattgggagcatgaagtacattagcagagacatgttgactagcagtatcacatcccatcatactacatgccaacatgccttccgattattgtaggagttcttatttgctcaccctgttcagcagctctactttatggcaatacaatcatggagaattatgagattgaattgtctttccaaagcagcctctatttcctgccttccattttgcccaacacaactgcctagcccagtgacatgtctctcttaacctttgggtaagaatttctcaacccatgaggaaaaacttgtagctgatctgggaatagcatcagcatgaatgaacatagcaatttctcttcaaacaacaggtgtagcacattcaaataagaaatgttggacagtttcaggatgattacagttaaagtatttgggatcacccagccatttcttttcaatattttacctttgtttaacagcatacctttttgtaacaaccacaaaaatgtttgaactttgacaggtatttagctttccatacgtgtgtaaaagaactatcaccataatttctcatcatctatatgaatttcactaaaaaacctgccttcgttcccccaagatcctgtggtaacatgaggagcaacagacagactaacatgttgcgcttgtgacagtacatatctcatttatcttttgggaaacctgttaaccatctcctaaaactttgctgccattggtatagcactgactcactaatttatccttgtcacagatatcataaatagcagatattattgagcaaggtttatcaccaatctatttagcctctcattatctgctattatcaccattacaatttacaaatgatgactttcctgcctttcaaatgaatgttttgatgaaccttaagtaggtcagcgcaacaagatgagtcatctaccttcctctttttctagtttccaccaacatttattaaggacacttacattcattgcctcagatttttaataccaagaccccctttctttttttgagtgacaaaatattatcctgtttgacctgttgatactatctttgtccaccactttgccagacagtgttcaggaataaggacatggacatacagtaaagtagggatgttggataactggcattaatcaaagtggccctgtcatcaatttacagatctccctggtagatatcaagcctttttattatttttctcatctactttatcctagtcacatgtgttctagatgcactaacagatgcactccaggtatgattggaaagtttcctaatcaacaattgaacatgtttgcataagatcttccccccataacacctcacctttagctaaatttattttgaaacctgtactcatatatacaacagaatcaccattttctggaatctatatttttcccaagttatttttaagactgagaattgtccttggtatattgcaacattgctatgtcatcatcaaataatgaggaatcaacccattattttacatttcctgtaccatcttatctatacgatcagcactgctttgcacctttctaactctggacatgtgtgcctatctggtttgttatttggcactaagtgtcgcattacacatgccgtttcaaccacccctgcctatttgggctaaaacatcatttttccaaacactagattactagacagggaatgttcatttgctttcttcttttggtttcatgtagagtctcatgttggggcatggtctcatctgttttattcctgttaatagaggcattttaggtttgtcttatcaatttcatgtaactatgtaaggctctaatctcaatgtcaattacaagttcatacaaataatttagcagatgggtccgccttgttgcattcagctatttgctcaacatgaccaacttttggaagaagtctagaagggtaactatcccataatctaggccactaacatcaaatttattgtcgtaaaactctttggagcgtttttttttttgtttatttcttcttcactaaaaggcttacccaattcaacattgtgaatgtttgatagtctctgccctgctaaatatattgggatcaaattgcctgcgctagccttaacaatccttacagaagtcattagtcagtagcatttctatctgagtttctgccccagtaataatttctccccatttttagatttggtattgttttcctttctactaccattaactatcctacaaaaatactctgtgtagttatcgcctttcctcaacagccaagtcaaatgtgttctttttgatcagatttatagctaaaggtagccatattttgggacagagggagtagtgcttatttttgcagctaaaacctcaacccaatctttgaaagcattctttctttttcctcttatattcgtattttgtcaataatatcttaacctgattggtttgtgccaagttctattaattagtcttgaaaatcagggtgttggagccaatacagctcagatttgagtttgagtgagctgttataactgagatctgctgttcctttttttacatgcatgcttacaatcccataaagaacctgtcaatttacaatttcatttttctatttttatttttactctttacgctgtaatttagggggtattagaatttaaaaggccctgaatcctcttcctaactttctgcaactttaaaattagatttattttcctagagcactatttttgtgaactcacaggaataaacttctctgcaccagagctcgagtgttttaaaaaacttcaataacttgatgaaatctcaccagagttctctcttatctgctaacccatacatctagcttttctcatgcatgtatctctatctgatatagtttgaaaggaatttgaggaatgtttaggagtacgttccaaatttctcctccttatcagtctttcagctttatcttgtcctttgactgggaaggccccctggctctaggtcctcctaggttgcccaaacattgacttgttttttctttccttttgtattccacaaccttgtatacatcatttaaagctccagcatttacttcaggcttacctcaggcttcttaagatcacctttctatgttatgaccataccttcttcattcaacttcttgtcttgcatattgtctgcatatgggttcacatttttgcttgactcagcagttccaatcatcaccaacttcattcttttcatcatatatcttggtttgaatgtaatcaacaaaatcaaacaatttttttctacagtggcagaataatgtttatattttttatatctgatcaatcatacttgtttacttctagatgaagaggcttcattccttctttgagaaaggatccgtttagcatatcgcccatgccatcttgaccatatgaatcgttaggaatttgtccaactttcttggttttgtccctgttgtttgcttcatctatcacacacctttttgacctgatgatgcgcataactcttctgggcatttgtaatgaactttttcacaattgtggctaccagaattgttatgatcaacaagatatgtctcccactctgaccttagcaggagctgatttgaatttggtcagagtaggttttgggttatagcaagtcttttcaccacgtataaattttttaggctttcttctcttgttcgatatttttctcccttttaaccaccatctttatcatttgaattgtttcaatttacaggttggtatattccgcatgtgcaaaggttccacgtgcactataagtctgagattaaatatatcaaatgatgtagaggtgtttgcaagaggtatgcataaatcctttcaactactacaaagcttttatattatagtaaatgcatatggatatgggccttggttctgatactgttatatgattttttttatgtctggatatttacatgtgtatttccctctgttcgtttctatatgagggacataacttgacaatgacattatgctgtccaggcaaatacattttctctgcaagagattgtacctgggtgtttgatgatgtgggcacaggtatttttaactttgttttctctttagttgctaaatattaatttatgaaacaaagattgatacaataatctgctattcttcttttttgttgcacttttaggtctttaatttagatgatgaatttaggccctaatattgcaagatgtgcaaataacttcatttgataatgtattagtacattttatatattttgtgaagatgactatccctttaggaagtattaagttgagttgtcattcccatgtttctaaaaattttgacttttttgtttctggaatttctcttattggccagaatgatctttaatcttgtggggtagaaaaggcaggagagtacaacatttcactctcagccacatattccttatggctttctcaatctagctagttgattgttgcatttaactggaaaaaggaatcaatcttgtacatgatcatttgataaagaaattataaaacagtgcttgcttagtttaccaaaggacacttgatctagattgcttgttgtcattctcagccgtttgtaatttgcagatcttcaatcttgaaggaaagtgatgtgaccatggctaccacggatgcaaccattgctcacatcatggatgaacaagaagatatcaaggtcaaggcatccaagtgctggaatccgattcggccacctgctacactgctgatttcaaacggccgccaaatctccatacaagctccgttttcggcccgtgagtacttgatggaaagctctcggagtcctctttccaacggatccaacctcatcaccaaattccatcccagtcaaccgcagatgaagaaacaaggtgcaacatcacctgtcatgggcctttgggcttgtaacttcgtttgggaccccggcccaagtggggcccatgtgaggtgcgccccaaccaggtggagcacaaccctaggaccctcttggtcgttctcccacccttataagtagctaggtaccctttcagggtttctcgggttttgatagattaaagtttagccattgctacttacttgcagcgcgcgtgtcggctagaccgtccgtcttcttgttcttcagaaccccaacttattatttgtattaaattcctatttgcaatatcagattgcttttatgttgttcttacttgtttcttcgatttgcttgcaggaatagggttgatctgcaccggcaagatcaacaacccacggagaggtgtatcgatcgctaaggcgcaacacaacgtctcgtacagttgtagtcggatcgtcaacgtttctcccaaatcgtagttatcacaactcaccgaaagatcgagccaacaacagccttgagtgtcgagaggaactcagggttcatcagaaagcaacaaagtgatggagtcctcgtacgcaagactactgatagttcctaggtagtttatatatgtactacggagaccagggtactgctattacactggctgtggcctgggctagtggtttcagggctgttggtcgaagttaatttatgtaaactttgttttggctgacccatttgctgctgatatgggcactcgatgaaggtttcagaggctgttgcttaggtaattaaggtaagcttattttggatgaactggtagttgctgacatgaacagttgaacatttccgccgggcatgctttattgaattattgacggtcaaaatagctgttgctagtccgtttgtctttcccttggtcaaaatttgattgtccagatttgctgtattttttaaattgctggcaaagatgcttatattgataagtgtccatcttgtgggtggaattaaacatggtggtattacttagtataaacacgagttagcaaatactccctccatctcgatttgtatgatgccacaagccaatggagtgaacaatctaaaatgagtcaaaatgtatgatgccacatggagtgaacaatgttccaccatctttcccttctccttaaaccatggcctgatggcgtgatgcggagccgtttgcatttgcatgtcgctgccgtgattcctgaggccacctcgaaccgccttatgctcatggctcctcgccaccgtggtggcagtggttgacggcctcattggtatcatgtgatgtagccgccgtcctcgttgtacacgatagagttaagctggtgctatgtttgagagaggccatgctactgttgcacttgcatcgcttgtgccgccgtcgagaaaaaatcgtgcgcgttggcggcggctccccaatgttgtgttgggacttgggacagtgggcttttgaagggaaaaaaagtacgaggatcgtgacaattaggatagtttatactccctccgtcccacaatataagggattttcagtttttgcttgcaacgtttgaccactcgtcttattcaaattttttttgtaaatataaaaaataaaaagttgtgcttaaaatactgtagataataaaataagtcacaaataaaataattaataatttcaaaaatttttgaataagacgaatggtcaaatattacaagcaaaaactcaaaatcccttatattatgggacggagggagtacaattttgaatgtactccaattactatattaaaagttgaggaatcaagccaagcagaagtgtccatattgagtcatttgtccatttgcccaggcagcccagccaaggcaaaccaaccagctgccgctgctgtaaatactcctgcaacagtatttgttgcatcacgtacggataaatcaaacgtcttttttttttcatatctctctctgcttacccatgcgtactcatgccgttgtcttctcgcagttgcgctggtccaaccgtggaaacgaacacagtgaattcgaattcacggttcgttccgtcctcctccctggacgccaacccggtttgcgaccgcacctaccccaggaacaagtccgcgtacgtccgcacccgcccgctgcatgccacctatgtctgcgttattgcttctccgccaaatttaagtcttcctttacctaccttctccttgctccaatcgatctcgccggtatatatactgctccatctcgtcgctcgtctctcgcgttaacccctcgtggcctcagctcgtcgatcgatcgatctcttagtccgatctacttgcgcgcggctagctgctgctgctgctgcgtgttgggggtggtggtgcgaggagtgattggttggttgatagattgatcgatcgagcgatggccgtggcggtggaggagatcgtcaggagggccggcgggtgcgccgtgatcgacggcggattcgccacgcagctggaggcgctcggcgccgacatcaacgacccgctctggagcgccgcctgcctcatcaccaagccgcacctcatcaaggaggtaactaatcttcttttcttctctccccgtagttcaccgaccgggccgtcgcgcgtgtgcctgcatgcgtagtgctcgtcagctcatgccacgcttgcgccacatgctgcatgatgcatcttgctgtctcgtcgttgtcatggcgccatggattgctcacgttgttgcaccgccgcgatggaatgtgtatgtgccagctgagctgcgtctctgtttgttgttcggttgaccatgtgaaaagctatatattagctgttgccgtgttggtgttgcgttagagatcgatgcgattattccacaggtgtatgtgtgttcttcgtccctttggtcttggaatacaacgttcggttggtaactgtgttatcagtcaactctcgtttccttttcctccacaaaaaaaaaaagtaaacaaatcttaagatgtgatacaaactgtaagtcttgctgtcttggtcttgacctggacaagaacactgtaccttttccctttctcacctatggacctactaccgaccaaccaagttttttttcagatgtgtctagattgctttttggaaaaaaaaaagaaacaataaaagattacctactctgttgagtgcgagaggaaaaggtaggtaagcacctctgaattctctgaatgtcgaacattctcagagcattcagtttcatccatccttttccctgaagtaatgccatcgtttgactcaatttaatccattgtcaggatgactattctagtgtgtactgtgtacacttgaattgtgtttgttgcaccaacttctgataggcaggaccattcaattgtgtcaaatttacttcggacgtgaatatcacgattcttttcgaaagatcaaatgtcacaattgtttcaacttctttatgcaggttcacatgcaatatcttgaagcaggtgccgatgtcatcatttcctcatcataccaggtatcatcggtctggcgatcttcattccccagctgacataaagagtaatctttcagtttcagcatcagagaaattgatgccttcctttcttgtatctctctgaaggcaactatcccaggattcttagccagaggaatgcttcttgaggaggcagaagggttactgcgaaggagcattgaattggcactggaagcacgagatgaattctggaagtcgacgctgaggaagtccaagcctgtttacaaccgtgctctggtcgccgcatccattgggagctatggagcttaccttgccgatggctcagagtacaggtaacttctaagattcagcactgcaaagccatggattagccatggatcggcacgcattgtaaccttaacctcgtatataatattttgcttgtgtcattgatgcaacattgtatctgacagtggatcgtatggagaagacatcacggcagagaaactgaaggacttccacaggcgccggctgcaggttcttgcgagcgctggccctgacttgatcgcgtttgaggccatcccgaacaaaatggaggcacaggtgaggctagtgaatctgaatctctgaaagaaaaacacagattgtgcaatgtgttccagacattcaatagcactgaaatgctgccacctttgatgtttcttgctgaaattggtgatcatgcatgcaggctttagttgagcttctggaggaagagaacatccaggtcccctcctggatctgcttcagctcagtggacggcaagaacctgtgctcaggagagagctttgcagagtgcctccaattcctcaacgccagcgacaaggtgaccatcgtgggtgtcaactgcacgccgcctcagttcatcgagggcatcatacgcgagctcaagaaggtttgcaccaacttccttcagcaccatcgactccatcttgcacacaccccaacattttctttctgcaccggttctgcaatcgtctgaaactctgaatgtgtttctgacagcaaaccaagaaggcgatcgcggtgtacccgaacagcggcgagatttgggacggcagagcgaagagatggctggtgagcacgacctgttacacttaatctgttctcatcactggcacgccaagaaagattagcacagatctgttctcatcactggcacgccaagaaagattagcacatttccgtgcgaattcttggtcgtcttgatcatcaaactgactggtttttttgatgcgtcgcatgcacagccggcacagtgctttgggcacaagagcttcgacgcgctcgcgaagaggtggcaggaggccggcgcgagcttagtcggcggatgctgccggacgacgccgtcgacgatccgggccgtctccaaggtcctcaagggcaagacgtcctattcagcaactcagatttgagaccgactacttggtagtgcaacttttaattaatagcgagaattataccgattcagtattagtttatgctaaattttgcagcggaaattaccgtctaacgatttgtaatgctgatgtgcaaccatcgaattttatacgagcattagcatggagagtgttgcagaggcctggggatgtgatttatcttctttatccttgtaatataaggaaagtagcagccatgtatcgaatttatgagttatctatatatccaaattgcactgataatgcaaaagaacaagttgcgtgtcctattgtttttgtgaatagttgttgtattggcaatacttaattccaaaatccagaacatctacagtctagagagaagacatgtagtatgaaactacaatatgccaacaatttcaatacctaatgcggaccatgaaccaagtcagcctagtgctagtagatgcgctctgacttgccaactttccaagtgaacagaacctgaattgatgacaccttcaaaatgactgctttatctgatgttagatctgcagtgatccggccaacaatcaagcatttggatgactcaactggtgaatccatatatgaatacccaccatttgccagatgatctaatgtttatcaacagctagcaaaaaaaaatgctagttcacctgtctatccatccacaacacttattacagtgttaccccaccatgatttcctacgtacaggtgcagataggctacacatggcacccctgtgttcattctttgtaagccttctgaattataatgatgactacaacaactctacaagcccacatgaagaaggggggtggcattagccattttactgctaaaggttataactttgcaggattaccaagcgcatatacaagacaggggataactcagagaggatcctcctgtttgatttcggtgtcatcttctattttcccaactttagttggaaagtgagataggaccaaatgcccctcggaatacccattcatcaggagctttcctatctttgtcttccaatctgtgccagatctctcgttccacctgtcatgaactacccggtcacggtaattgagcattgtgccaagcccagaatttggtacccaaccatattcttccaaaacccgcgcctctccttccgtcaaatcttcaccaatctgtaaaaaatagattagttcaatgtcctacaaactccttttactcatgaaagaactcatgagtaaaaggtactgaggtagcacaaaattataaactcctttcactacggaaggtacatatgagattggaccgttgaagctaatgtcctatgtgaacatatatctggtgctaaaattttctaaaacgagaaatatattcttcggaggtatattatgaacgatatcacaaacttagttacatcagaaagaaatatagaaaaagagtcgagtgcatgaatgtatgattgtatccagcttcaaaactagtaactgcgtattctgatagaggatcctagaaacaattgtcaactggaaaagaaactaagaaaggctataacacagtttattaatggttaatgggtagttgtgtacttgtgttcataagcaaggatagaagacattatgaaaagctatgctggtaacaggtaaactgaccagttactgtaatgtttcaagtctattccagtttaccttttaaaaaaaaaatcttacaatatatttttcctcaaatgtaaccttttacaatcaccagcttcaagattacatacaacacatcaaacttcgtataattttacccttgtactggctttatcatatctattggtcacagacgatataccagtaaccagcatcaatagagctgattttttttcctcctctgatcataagtcgataatagggccttttactttgaccacatttctacgtacgttgacagtcaaaaagtgcagcacaacactgggaaaatgcaggggaaaaaaataccaaagcaagaaatcttaccaataatggcctattttcaatcagagctgtcctgccacaaccactaagcttcattgcagtaaccatcctttggatctgccattgtattggcagtgatttcacaatctcaaagaagtatgtcgcatacccatattccggtcgctcaagaacaatcctgtgaaacaaaaaaaggaaggcataaaggaaagaagcatatcaaccattttaaccggcagtacctgaataatagtattggctaagaaagattacctgttatggcttttaaaaataaaaataaatgattgcaggtctctacaccatccccattcaacaggacaatcacgaaactgaagatagcgggactacaagagataaaggtgtataaaacactaaaattgaaagcctcgtacaagtgagaaaataaaaatagcaaatgttgtctagatgtggataaatacctgctcgatgagagaaattaaacaggtcaagcagtatatagccttttcccccttctcatgcctaagtgcagatttcaacagggatgttctttgcggaaacaactgtgtattgaacaaataaaacatgtcagtaaactataacatacataaccaccccatgccatttgctcttcacaattagcccataatactaaagatgcagatgtagtccctcaaccttggggaaattaggccaataacctctaagtcatctgtatttacagacataacacaattcacactgaacttcctggtgacatgaccaacaaatgaaatcatgtaaaccaaatcatagctgctgtattgctgggggggagggtgattatatttttcagttgggaaggggaaggaaaacgcaaggtaactaacaaacatgcaaatgtttcctcttctgttgttgctgagtatggaaaattcaacattctaactactcggagagttaggaacagtaacaaggagaagcaagaacgagtccactaatacaacatggtcccagtggcagtggaatgcttctgaaaagatgatacattatccttttccttttcttcggcgttgcttgtcacatatgaagctggagcacttaaggtgtctttgtgaaagttttgcagtggtgttcgctacatcatgacaatggggaaccacccgtaggggtttactgcacaaggatcacaagggccctgcagaggaaaggcttgacccaggctagtagaataacctctacccgctaaaaatagcgggagtggtatgataccatccgaaaaaggtaagcaagtgaggcatatcagatgttatgcagattctcaacaaaccattttcaacatgtcaagtggtggggttgttgagatatttcaatgatatactgtacaatgtattttctttctcaaagacaaaaatacccattcttataagactaagtaccattttaaaatcttacttttgtaataacattttcaagatcttgaaagtcactttctgtgcagtctgggaccatatcatcttcttcttcaacaccgtagagtttaatctctttaaccagtattcctttgtccagaagaatctgcaggcacgaaagatacggaaacacagaatcagaagttggaatgaatgcttactgaataccgttattgaattaaaatagaactatgaacacgacaaatgggtacctgcagtagtcctggggcatcttcttcaagtgccgtttcaattgaatccctgcgtacatcacgtttgttatcagattctcaaaaatagttgtcaacattgacagaagttactcatgtagcatacgttgctgtttttctccttcgcctttgacgagaaaagtaagcagtaccctcatcatttctgagggaatcttcttcaagcgtcttttcacttggatccctgcatacatgatttttataagcataatctagccaaaaagagaatcagtgtgaacattaaaaatgttgcctgtgcagcatacctcagagtcttcctccttttcctttttcgagaacagtaagcaaggaccccgtcatggtttagagtattggtttttttggcagtgagctctgcgatactgatagaagtgagaccacacacaactagaggtaactcactcccggtaacttcgctttttattcgtgatgatggcagtaggccttcaacatgagaattctctgggttagatcttgctgcttctgatattcttttggagatcgctgaagaaacagagtttatagacccaactagattagagccctcagtgccatgatttggatctgttctctgtacagaagatgtaattttctctgtgaaatcccctgtgacatgcaagagttcaaaatcaatattgatgtcttttgggttttgacaaacatatgctggtgctaaatcaatcttccagaccactgttgtttaaggaatagtggtgagattttgctcaaacaaaattcagatggtaaatatcataaccttccaatgcaggttccaattttatgtcaaccaaaagggtcctatcatctgtcccttccaactgaatgtttttatccccaaaagttggtgttgaacttgaagaagggtcgcgactataaataagagtcttgccgtttaccaatagatcatgagagcacacaacttgacattgtggtggagcagcagaagatgatgtactcaagaaacctgattcacctgcagtaagttgtttatcatcacttgtttcagagtatagtaatcaatgctttcttcaccattgacatgtggaagtaaggactcgaattaaaaaagaaaaggagaagagatttacatccagcctcatgactttgctggttgtttgaaagaccttcagttagcaacctcctgttgttatcattgtcgatactacctataatggccggtgcagaagaaatttcctgcatataattgcaaacaattgaacagacccgtttctcgtttccctccctcccacagacaatgtgcaaccttgaatcactaaattcagttggcacaatgaaaaataaatttatatgttcttgatagaaaagctattgttatgcgcatgcttattgaccaagaatggaagttgtgataagtcctaatgaggcatcagggataacaaaggacatttcaaacatgatattagaacataaatttaatgcataaccaaaacagttgagaaagtgtgcttgtacctgcaacatgctatacataccatccctgaaggcagtcccttcatgaattctacatgcaaaattacaatatgaacttcatatcagtacaaaccttatatagagcatctttcttgaattacacttgtcaatgttcacatcaattcccaaaataattggagatatgttactttttttttctcttgcgaatgcaatcaactttgactttaaagttttactatagagcatccttctctatatctccatatttaggtaggattattaagaacttagtacacaggaaagtggatgtaccataaggacgggtgtacagggatttttttttctcagaaattatagctacctacattaaatgtatacattttctcaccccctcaccttttaggaatcatcccattagttccaggcttgcatgaattctccaaaccatcaattgcacattgttcagaagatactacagcagaggaagaatgattttctgccataagaattctgtagcgctcttgcagagacatatgatcaagctcctcgatttcatcatgatcattaatttggttcccaatatgcatgttgcttaccacattgaaataacttagtttgtccagattaggacatgtccctgtttgcgtctgcttttgcttgttttcattgcctgaagagaattcagtgtcatggtctatgttacaaaaaatgcatttaaaataaatggatgtgaatgaggacacgaaccttgaacagaactattttcagtaatcatattaaaagaatgattgtccaactgtaattcctctttggaatcatcatcgattgcagaagcaccctgcatagaatttcagaaacaaacatctagcatgtgttacttaaaattaattgttataaagccccaggaaattgagtgcctgttaacttcagaaagttagcagaaatcaactacaatgaatgaaaactttacaatgagtacaagactagacttaaaaattaagcaataaataagataaagaaatgcaaaacagctacagccgaatatattcaactaaggaaacaagaaacagattgataccaaagaacaggtaaatgacgcaaaactaaaagaatccttgtgatcaagcataccagaatcacagtacctactctgagtagagtcaaggtaacattaattgcaaaagcagtttttacttaactagtaggatagcatccatgttcaagtaaactaaatgtgaattagtatgaaaatcctgcaaaagaactgaacagtgttcattggccaatggatcaaacaaaagtcaatttttaaaatcatgacagagcctctcgcaatttggttccaacacgtttaatataacaaattgctaatactaatccaacaaatgtagcttaaatatttgccttgcagtgtttttttacaatgatcagttaacttactttcagaattatttttaaaacaaaaaaaaagagtcaagggtgacagggttatctcataccatattaaactacaagaaaaatacaaggataagtaatacacctgtgctgactgagcgtgagatttctcagcccatttaaattgatttttttctaactcgtagaatatctttgacaccacc

SEQ ID NO: 80989 - DNA, 6788 bp, Oryza sativa
agtagagtgcattttctttcagcgttcgattcaaatctggagtactgttattattgtactccctccgtcccaaaatataagcttttttagctatgaatcttggcaactatgtgtccagattcatagctaaaaatgcttatattttgatatagaggtagtattacttcagaacagtgtagcaacaaactcataacaatgttcaaacaattgcttctcaactatgaaaatataggattcgtttccaggacttacaaactagctagttttcctgatgaacggcgtttttctcaagtcaaccatttgcaaaataaaaccttttcaaggcattgatgccattctcatcctcaacaacaggaaatatttgacttgaatgtgattcaagagtccaggaaatcttacaataaagactaggcttgaatgcaagtttttgtttgtaaaacctttttataacgttttaaaaataaaccctctagtattcttcttttcaaaagtatacattttggccatgcttgctaccaagacacaccacacccaattgcatcgtaaaaaggtaaaataaaataaaaagattcttaaggagggaaaaggagtgtaacaagtcaagacagaagatagctgcattgacagatgagtattttctagatttttttttcaggtctgttatgtgttgtcaattaatgattttagctgtttaggtggcagttgttcttgatggttatatatattttaagtgtgacattgctgcccattgtatattctgcttctatcatttcaaagattggtctgctgaagatattgagtaagcaaaagatgggagtaaaaaatgaataggtaaccaaacatgtttcacttttatgtactgttatctcaaatacaaaatttttcagactagtgtgaagatttaaaatagtttgaatgactttgttgctcttttcttttactaccacctccgtcctaaaaagaccgcaattttatactatttatatccaacaattgaccgtccgtcttatttgaaaaaattttatgattagtatttttattattattagatgataaaacataaatagtgctttatgtgtaactaatattatttttaatttttcgtaaattttttaaataagacagatgataaaacgttagacatgaaaacccacaactgcactaaaaattagaaggaagtagtacataggaaaataatcatttattcaagatattacaaaattgtcagtgtctggaaattttagagctgtttatattagttgagcctacatttggagtaagaaagaaataaaagatagatttgatagagcagcacgcacgaacaggatgtttgttatgcaaaactcaattgaagagaaaataacttgtatataaatcttttcatgcactgttttttttgtcatcaatctagttggttgaagttaaaaatttaaaatcctaaaactattgcatatgcagggtgctaaattatcatttagattcaaagagatggcaaatcctaacatcaaatattcaaatttaagtgtatcatatgataaaaattacctcataaccatttcagttcacttttatcgcctggcgaattcaattcactgatcagatttatgggttagtactttgaattcagatattcatgggttagtgctcggaacagcagtttgcttcctcctagatgagacccagagtttatatgtgatcaagatcaattgaaacaaaacatcccaaaagtgacaagaaccttgtttttttaagataatagtaccttgtttttctaataacggaataacataatctcggtcaaaccaagcaaccatttgttatacaagcaggatcatcttacaattatcaacccaaaggcggcagcctacacacagtgagtgttttcttacaattatcaactaaaggcatacttaaggtcaaacaaatgcaagctatctctccttttctttttcttttttttttactgcacgactctaaaatggtcgggaaacaacacttcaggacaacacaacaaatcagaaagcagtcatggtaatgactgctgctaacggttgttgattaacaggaaactgataccattgcctttgtcagctgaagagtgactgccccagctccggtgatgtcaggttggctacacactcaaactgcacacgaagtacaattaaatggtcacaaaagatgaacaaatgaccctttttagtctagtacctcaagaagctggtgaagtggtgatcatgtaccttttgttgcctatacttttcacgtatagcattgagagggcaattactggtgttatgctgcagttcccgtagagcacagacacatatttgaatatcagagcttttgtaagaagtgtagtgctcaagagtatgattctgtaaaaagataccaaggttgaagattagaaaaaatgttttggggtgatacagaggtcgatatagtgcatatccttgttatacgaacccatggaatgtcagattggtcaagtgtccatcttgcaagaaagactgcagatgctgccaccactgaaggaagaaatttgaggaaactgtaatcgatcagggtcagctctgcaagataattggccagatatcccaaggtaattgaaggaacctggaaatacagtttgaaaatttggcgttcagggatatacacataaaaggaatgaatgaaaattgtagctgataaaaggtcgggtgccaatcttacattacgagaagcctgtgcggctctaaggaatctcctgataaaatataaagaaaagcaggacggtcatgttagtgatagaaccacaacttagattggacaagaaacaccatatgtatgtggtaaccaaaactacctgagaaatgtttttgttgttggaacagatagatgaaaccccatatcattaagcaccaggccctccattttcagcacctattgaatcagggggatatcatatcagcaatggcagttcaatggctcttctatatacataaattagcaatttcttcagacatcacattaaacaaatacctcagcttttgtgtatgtattgtcagttatgaaacaaaattcttcaacacgaggagcacatatctcttcatatttcctataaaaagaaggtagacttagcaatacttccaatgacatgaagacaacatgcaattccaatgacatgaagacaacttgcagagttgttagcttgtactttacattagctacagactaagctgcatcagcagctaggtaaacctttctatggtacattttgggaaaatcacatatatgtatccaaaacttacgaggcaatcagcatgcttgttattccaagaagttggagtttctgtctttcaatataatgttgagaaagaaatcggtcaataagattaatggttaggtagagtgtgtctggcacaagcttatattcttcagaaacctgaaatgaagacaatatacagaacttcataagctcagaagtcatgaacagttcatattattaaattaaaatgtacaaaggatgatcatggtttattataacaaaaaagaaaaggcagattcttcgaattttgcaagaaatgtataaagcttgcttctgatgcagaagccaactactcatattctcacctcttcagtatctcaggctctccgctaaatgatgagaagagtgattttataatccacaacttattcaattatctcatataaacttttcatcattgaaactatggtactttcaaagggaaatgcaaaggacaaatggaaaaagtataaacaataatgattcaatagaaagaatgttcttgtaggcttttaaccagatgcagcatccagtatgtaacattcacatgtaactatgtatttcatgtttgagttgcacatacatgagtttctatgtgacatgcagcgagatgctaacggcctaacaataaacggcttaaattcgtttgaaaagatagcagggcagtttatgtgcaaattacatcaagagaaatcaacctcaacaagccaatcaatgagaatgcctcgcatgccctttgtgatgtcacgttgcaaagcctccatgtaatttgacctgggtcttctgataagctgggaatggcataagcagaagatggagtttgaattcaaacaagaagaaagcaccaataacacagggatgaaacacaaccatgaaaaactgaaattacttttgtcatactagaatgtttgaaatatgaagaaaccatgagcatgttaagacagtaaacaagattttgtttttcatcaaagaacaaaaacatacctcagaggccatcagatttgtgtatatctctgaagcataggaagcacacatttgaggatttccattatcattgtcaatatctataaaacctaaaccactagagtcacctggaacaaaataaatgactctttagcaatcagcagtgtacagaaaaatttatattcatgtttttcttgattatgactagcaaaatacccgtgcattgcaaggggattacagtaaagcccaaaaagcaaaataaaattattaccactctctaatcatcatatcatatttggtacaattgtatacatgtaagtcgagctacacagttgctctagcgataaacaattggtataaattatccacattgtatttgatttatatagtggacactgacatcataggcccacatgacactggcagaaccaccaccaccactaccaacatctgcagtagtaagtacagattatctacgaatatctcagaagtcagcagtgtacagaaacatttatagtcatggttttgtacagaaacattatagtcatggttatcttgattctaagttctgtgacaacagaaagacaatcaagagtatgttcctgatagaagtgattgacaaccggtagataacatgacacgctaagggatatatgaatcttttttatagaattagctgacttgaaaagaaaaatcagtaagtccagatactcattgctaaaaataagcacgcaacgtatgcaaaataactaaccaggcttggagtcagcgagttcatgtttatccatggcgtttcttgcctcaaagaatgcctcatggcaattactgtccctgtttcgctcaatattctgcaatgacagtaacccctcgttttcaaacaaatttgtgggttcctctgcttttgccaaaagctccaccttttgagtttcttcagaacttttagaatcaatcacaaatgaagttccagcaacagccggagggggtagcttaggaaccttctttgcacactgctttttgctcgggatttgtttcaccctttgggtgggctttgacttttgctggaacaaaggaataaccttatcactccatcaacaatgttcatggaaaataaaggtctaaaaatcataatagcataatgcgataatgcagcagctcttgatacctgcagcttgctcgtggtggtgcaatttttggatgagttggcacagccgatgttggttacatccttgagcactgtgcgccgtttaggctgaggagctgaagttgcagtacttgcactagtgatttcatccaaagctcccctttttgtctttccttttgctgtctgctttcgttcagttcttgcgggtagtgatacggagggagcaaacccaaaccgtccacgatttgcagcagcttgagctcgtgtgattcgaccactgggtgcttggcaagcagtaagcaccggattttccttccttccagccatgtgagcctgaatgtgttaaaaggaaaaaaaatgacataagaaattgtgcagttttgacgcaaaaaaaagaaagaaagaaattgcacagtgagcaatgaagatatcaaccaaggcaaataactttatggagctgaatgagacggtgtattaagcattaagtatcagtgtgaaaaagaaatcgaacaagtagatgcaatgcagacataaaacagtatcagatcttatttgcaaatctaacaagatcatatttactcacaagtgcacaagttaaaccaaaattattcagtcccttcgtagcataattgagagaaataatagataatcccagggcatacagatcggaattagcagtcagttggcacaaatgtttacagttatgatctataattcaaatctgaaaccagatttatttgtccatttcgttatgtgcaaaaaaggcagcgctttctatagattttatggcgttctttaaacaaaagtcccttctaaaactgccttgcaaaatgccatcttcatattcaggttagatttcctaacacttttgttttctttcatggcgttgaacagatgcaaaattaaccttatgcaccagattgtgccaagaaaccctccaagtcaagctaccatcagatactcaactaaaaactcactttttttttcaaaaaggatgccacccaaccttagccctaaagctgaaatcctcgcaaacgttaccaacatggaccaatctacgcacatcccccatcctcagacgcgcacagatcaagcagatctaccacacagacgacggggcaagaagccaagaaccccccacgagcgccgcgaaaatcaccaatgcgtaccaagaacccccaaatgcaagaccaaatcaagaaccccccaccccacccggccccaaatgccaacccacccaaaattcccggaaacaatcggagtcacccaccccctctgcgcggcgcgggcacccgggacacggagaggcgctcccccgtcccccgcggccgcctgcggcggcgagtagtgccctagaaaagtaaaaaaagggagtcgcggctgcggctgcggcggcggcgg

SEQ ID NO: 80990 - DNA, 9170 bp, Oryza sativa
ccaggccttactactgctactactgcaaatgtgcaatgcacctcaaggagggcagtttagatctgacaaagaggataaaatttctgcaattattggggtacggtccacctaaggtgtgggcccaacagatcacatcctagtcacccggttggtgaactggctcgtgtgggccccacctgctcccaatctccattctcctcatcacatatccataagtctgctactactacttaattagctaaggtttagctatagctaagctcactgactatgcatgaagcttccagaggcagtgaggcaccacaaattttcagacacatgctggctggagtagtgtaaatatacacacacacacactctctctctcatagtaacagggctcaagggccaacaagattagcactcactggttcttcttccttgtttatttggtatgttcattagttctttgctttgcatgaaaaaaagctagctgttatgttgctatttctgcacttaccttgagcaaaactgttgaggtgttttgctgtgaatgtgtgttctgggtgttttggtttgttccaagataatttaacaaggctgctagatctgtttcaagttcagttcttgagctcagagatggtttcgttgtgcttcttgaatctttagcaatcctagagctgtggtctgtggtatgcaggaacatgaagcttctcttctccatttcttccagagtttatgggaatcgttgtggttcacatgttcttggtgttagaacatgcaagtgcatgtgcattgacttcttaatttgttgttcctgcaagtgcatgtgttttctgttatttgctcacacagtgtgttggatcatgttgacttgaattatttatagaagagattgttttggagagcatagatctttggaaagtaatgtccatggattatgctctgcatctttctgcgtcttctttctgatgatgctgaaaatgcttcttgtaatgtttccactccaatccaaagctgttcttagcttcactcttcagtgttccttccttctgtgagttcacttatatggtacagctgaacagagactgatagaagcttggttcctggattgaattttaagttattttagccttttgttgtagaggaatctgatctgtatatgttgtcggaaagttcaggtgaacaattcttctttgttactacctctgctgtttcctgaacagttcttgagctgcaaccatgtagctgaagctgtatacttgtatttcgctttcagagatcacatatttccatcgcacacctctcttacatcttccagagttcagtctatgttttttttttgttctcatgttcttggtttcaatgcaatacacaaaatcctaatgaatctttcccactgagagtttggattgaatcttgttctttccagttcatagctttacacagtgatctgttgctcactgactttgcagagtaacaccgtttaccaagtctgacagagtttcatggagcaggtaattactctgtccctgattcttctccggctccggcgagatcatgtatcttgtgaaggatatcggcggcgccattgcgctgatgggcgtgtcactggtgctcctgggcacatggccggtggtcctcgccgtgctggagcgccgcggccgcctcccgcagcacacctacctggactactccatcaccaacttcctcgccgccctcctcgtcgccttcaccttcggccagatcggcgccgacacgccggagacgcctaatttcctcacacagctcacccaggttagtgcccatggttattcttgtctgaatttagacatgttagtctgaaggaagtgatgctcatttcagacattcagtatgttggtctagtacagttttcagacttttcagacatggggtacaaccttttctgaaaaactgtggtttgtcactaggaagtgaattttgttggttttttacattcatgttggatgtagaggccgggttccaatccattgtctaaaaaaaaagggaagtgaaccttgtttcctgtcggaagaggccaaagatgtaaactgttttcattatctaaaaaaaggaagtgaacccagtgtatcaggcttgtgttaatagaaaactctgaaaatttcagttgatcaatgctggataaccttttttttttcaaataaagatgcaggacaactggccttcaatcttgttcgcgatgtcgggtggcatctttaacggcctagggacactggccacgcagtacgggtgggcgttcgtcgggctttcggtcaccgaggtcatggcgtcaagcctgaaggttgtcataggtacaaaaaaattcagagtgatatgctctcctgataataagaatgatgcctgatgcttgtatagcatttactgttcagaatctgaaaatgacaatatggtgtgactgagaaacttctcttccagggacaacactgaactattttctcgatggccggatcaacaaggcggagattcttttccccggtgtcggatgctttctgattgcagcctgccttggatctcttgttcactcttccaatgctgctgacaaccaggagaagctgtctagtgccatggtgaaccacagcaacaccaatgggtataaactctcttcttccgtttttcactcatgtggtgaatccgtttcatcagttctgcctaaattctacttctgaaatactgaaaattttgaaaaataacacgtatataaggtaatttgcttttacttgaattttatttggttgttgctaattgcgaccaatgtatcatttgtgcatcagtacattattccaatgcagtaaattcatctgaacaaacaatgtaattaacttgaactctcaacagggacactgaaaatgaagaactcaccaagcacctccttgagataggtactaatcagatttagtctgaaaataatagtatatcatagagctatgtgtactaatctttcaattgacagaacaacccaaggattgtgaagaacaagagcctgaagtggcaccggctgcccaggctgtggaaaaactagaggcaggaacagctgatttcctggttgaccttgaggggaagagatctattaaagtacgtacttataatactaaccgtaccaatatattagttaaaatgtcatgactaaactgcagaaattcaggtggagcaattgcaaagcagagttgctagcaaaatttccacaaatgaaaatccatgtatctctaaggaactttttttaaaaatctgacacaaccttccatgtatttccaacatactccctccgtttcatattataagtcgtttgactttttccccagttatacttcattaagtttgatcaagtttatagaaaagtataatagtattttcaataaaaggcaaatgtattatcaaaatatattcaatattagatttaataatctaattcgatattttatatgttactaagttttcctatatatttagtcaaacttaacaaagtttgactgaaaaaaatcgaactgacttatgatataaaacgggggggaagcagtaaaattcacactttcacaacagaaacaccaactcaacaacattaatttgtttcttctccatgacacaaaagaccttctgaaaaaaaaaaaacttcacattcaggtgctcggatcgaacaccttcctgggcctcggcatcgtcaccttcgccggcgtgagctactccctcttctcgccggcgttcaacctcgccaccaacgaccagtggcacacgctcggggagggcgtcccccacatggtggtgtacacggcattcttctacttctccctcgcctgcttcgccatcggcatcgccctcaacatctggttcctctaccaccccatggtcggcgtgccgcggtcgtcgctcacggcctacctgaaggattggaaggggagggatcttgctctcgtcgcaggcatggtgtgtggccttggcaatgcgttccagttcatggctgggcaggctgctgggtatgctgctgctgacgctgtccaggtacaccatctttcttcaatccaggccgtctgcagtactgctgtcgaaactaaatttctgctattctaaaagggtagcaaacaagctagaaaagtagatgggttatgagacggatgatttatataggttcacgtcttataggtatatggtatccataatctccacaactgtagaggatctttctcagctcaatttgcatttcttgggagatattctctctcgttataaatatttgatgattaggataagatttcattaaaattttgggatttgacattcagtaacttctcaatttggctgtatatatccacttgtagatatatagaccggatttctacccattatcttttttaaaaagtattttttaaaaaattattggtttaaaaattagtgtgtgcagattaggataaacttgttctgaaataaaattaatggccaaagttttgatttgaccaaatcttatcctaaacgttaaatatttacgacctggagagaggagtacatgacttgaacattttatcaggcaagcattaatgatcctcaagatgaagattcatatgtgcaaattatgatctgatcatggttttggaatttgacagtatgagaagaagacgatatgggttttctgaaactctgaacatgaatgggccggggcgtgtgtctgaacttttctgaacattatttctgctgcaggcgttgccgctggtgagcacggtgtgggggatcgtgctgttcggcgagtaccggagatcgtcgcggcggacttacactctcctggggagcatgctgttcatgttcgtcgtcgccatggtcatcctcatggcgtcgtcggcgcaccggaggccgctctgatggcggccggccggcggctgccgtcgacctcctcctctcctcatggacatgaccgagaaacatcagaagaagaagaagaagctgcatatgtacagctccattgatctgaccacatcagtgtgtagttcctgaccttctcgacgtaggatctatgcatattgcctcccggtgcttgcgcatcggcgaggctacacatcaattaatttcttctgcaatgagcaaccatgggatgggggagtgaatttggagatgtgattggactagtatatagtgtaatgttgtaatatatgtctcagcttctttgtgtgaagcttctgtgaagggaaccaaaataattttcaaatgtataaattttgatcaatgttatgaggagctacttcctccgtttcacaatgtaagtcattacattcatattaatgctaatgattctagatagatatatatgtctagattcattagcatcaatacgaatgtggaaaatgctagaatgacttacattgtgaaatggagggagtagctattaaggctagctctagtaaaaccagattaataacctttttgtaatcctcaaagtagaaatgttacaactttgacaatgaaagaatcaataatggcattatgacgtcatgagggcttttttcctgaaatcaggttcatattttcttttctatacgtgcagtctaaatattggtcctagaacagtttttccccccctgaattttgcaacgacattaagttgattatcagtgctaaaatgactccaacaaaaatactaaaatgtgtctcccggtgaaaaataattgtgtttttctttgacagataagaatatatactcacataggcatctccttaaagttttgagtaaattttacaaagggtggtgacttggcaagtgatgtcatcagcacataggtgaccggtcccacatcaatcgctgattagtcccttgcatggtccatactccatccataccagttcttgtcatggttgaaaacagagttggggcacacctacaggctactctagatctagtctgtgttggatagtaaaggttgggaaaacttttcccgcacacagaaaacgtgataactcattaatatatgattaattaattatgaatatgattttttttaattaatatttttataaaaaatataaaaacacgatgtttaataattagggaagcatgcgtctgagaaacgaaagagtagagaggcctcggtcccgggccatctacataggtgagatggcatttcaactaaaactctggtttgtctagatcagactaagactaacacgagttattttaactagaggttcgtttgcatgctacagtaagtggcgcgattaaaatatttgcagtgtttgaatcatccaaggatgttgaacacactatatatattttaatttgtagatgcaatgaatgagtgaagatcatttcttattgattttgatttatatgactgagctgatggtgatccagtaagcttgcgtttaaaacagccctattgactaactgactgcttgtgcagttgtgctcgatatataggctgacagaaactatctgtgaaatcttcattttttggttagttcagtgtcactgtccatcaagaggaaacctattaccagtaattaatactgtcacagtataggactgaatgattcgtactccctccgtcaaaaaaaaaacactcaaccaagggacaacgaatctagctagataacgagttttttttttacggagggagtaaaagaaaaatacagtaggaatcatctctgctgtatcacaggtggatgatgacgatgatcatgatgatggtaattgtgacctgtacgtattcctggtgtattttcgaagaatgcatggtgggagtggcgtgctactggtctggaaggaatcacaatggaagagatacaagatcacctaggataactcccatttggttttgccaaaagtagttaatttgttaccagcaaaacccagttaagatctactccctccgtttcaggttataaaattttctagcattgtccacatgtatatagatgttaatatgtctagattcattaatatatatatgaatatgggtaatactagaaagtcttataatatgaaacggaggaagtacttgggtagggacggatctaattctaatagagggggcttatctccttcttcctcctcaagcccctactctttcttctccccctcttcttccccctcctctctccccttctctcaatggtgatgattcagtaaggtaaggggacttgagtccccccatcacccatgctagattcgtctctgttcttgggtttaacccctttccttgtttaagtttcgattgttatatatatatatatatatatatatatatatatatatatatatatatatatatatatatatatatatatatatatatatgtggtcacacttgttgtaatatgtaacatcttcatataatcttaataaaattggtcggggctttttctttattgcaaacccaatgaaattacaagtacgtgtattacataagtatgatttcttttagccatctatatataagtaactaaatagttttatagctaaattcatcttaccggtcactacctttgttattttttgttaatgttttggatatcaacacattctcccgtgcacatgttttataattacttttcagaagtatatatttatataaattattgaaaaatataactatatgaaatattattttatgacaaatataattatcacattttaaatcttggtatatttgcatctatagattttgagatttgacgacacgtgttgtagggcaccgtccttttcagaagagagatggtacgacataatgctacctatcacttacaatatatatttcaaagtcacgtttgtaaaatcgtactccgtccagcaatgaaagcatgccttttttggatgagtaacttcagaaatgttatttaattgaatggatacttgaaaatgataattatatatttgccccaaaaggtacttttataaagtactttggacattttctaattaatctgaaattttctgacgaaaatttgtagtgtggaagtgaattgtcaattttgcattttgacaattgcgtccatatatatctaaagcgacgtgtttaattcatgacactggaagagtacatatgaccgggggaactgtctgtaaaaagatgtttaccatatatttgaacacaatattcttctatggtgacgctctctgcagttaattaggctcgcaatttcttcacgttttaacattggtcgatgtgatcgacactgtaattagtagtacactactctatcgttttcatcgtccagataggagggaattaaagcaacttggtcaattaattgattgctggacgttggccaagtctatgtctctgaattaaggctttagaaactttactcgctttgacttttgacttttttttttctaattaaaccttattctagtttgatcgtgtttattagaaaatatattatttttaatgttagttttaatgaaactaatttaatattttagatgtcgctaactttttttatagttttgatcaagtttgatttaaaatacataaaattaatttataatgtaaaacagatgaagtaatatttaactgatcgtgacaagaacatatgagatgtcatcgccatcctcagttaagttaattaactgtgaagtttggagtgtaagagtcaaacacaccattgaaagtacacacacatttgaaagtataatgatatgaactttctcttttctcttttaggattaaatgatatttgaagtacaagttgaaagcgtacctacactttgatacatacaacatgtaccaacgtgtacacatgtagtcttgacaagattagagacgtaacctcgcgtgagtacggtcatgtgctttaattggtgtcacacccgtgtgcatacatgtagtacctcttgggattaaattctaataaatacaaatgctcatgctaagtctatgattcgagtcgggtaaataggtaccaccacatgaatattgatacctcaatttgcagttaaaaattagactgtattaatagcaggcatgttaaggttgagtttgttgttgtagttctgaaaaaggagtttgttatcgtattgctatattgtgattttttttcttattttattaattgcttgaaaataaaatttatagttgatgtgtttgttacatatcaattacaattaaataaaaatatgatatccaactttgtttagttatctaaccagctgaactatgtccagtttgtaa

SEQ ID NO: 80991 - DNA, 39594 bp, Oryza sativa
ccccccccccccccccccacacacacacacacacaccctcatttcctcggcccaaccaacacccacccccggtccgtcgccagccaaacgcatttaacgcctcccaaccgcgccacgcgcgcctgcgggtgcccgaccacccaatccccgctgcttctccccgcgtccaacgccacgcgacgcgcgacgccaagttgccacgacccagcgaggtgaggagtgcgcgggggagcaaaacccagcgcagccgcgctgcggccaccggcaacgccgcgccgcgaccacgcaaccggggaaaaaagcccatcttgtcaccttcctcggccattaactgcgatccctccagctagccaccacagcttagctcgcgccagcctcgcgtccacacgcccacccacccacccacccggcgctgagctgcgcctcgtccgcatttactagcatccgatcggtctgatgcccgtgtgaggtcgtgaccgtgatgacccagccacgcaacgcacgcagccgtcgagtacctggatcgaacggccggctttcatcctcaccggggagtcgaccgtcgccataaatgtaaaagcgattaacgtcctccacaccggagcatgattgatgttttgaggcggaacggaaactgaggaagaaagccgtcttctctattcaaggaagagcctgtcccggaaaacatgtcggcacggcgactgcatttatttacgtgttacagccgtataaacagagggatattggaaattcgacaaagggtaagaaagggataatcagacaattttggattattgtacatctaggggcaagggcatgtttggctttcagctcctccgaagtgaagcgggctagaccgcttaagcgctcccaccgagactgtattgggtttagtattgggtttaggctactccacaattttatttcaaacctaactattagagttaaatttaaaagttggagttattctcagctagtcctctaattgtcaaccatagcagatcgggcatgtaagtaaacccacgtcgttgtcagaatttataacagaaatggaattctagcttaagagaggaataaaacgtgagctaatgagcacaactcacttcaaccagtaattagatggatcatgtctgaccggttgcatgaagtgcgagtcgattttaatctagtaagatgaactcaacttcagttagtaattagatggatcatgagttcggttcgagctaaaactcccaacgacggatcatgagtagctcgtgccctctccttcagatttttttgtacaatctcctaacatattccatttcttatcaccaaaagttttaagaccggaaccactgatttttcaggaacaaagaaggactgaaatatctcagtataatactacctctgtcctaaaataagtgtagccatggatatccgtacccaatatttgaccgtccgttttatttgaaaaatttatgaaaaaattgaaaatatttagtcacacgtaaagtactattcatgttttatcatctaatagcaataaaattactaatcataaaaattttcaaataagacgaacggtcaaacgttgaacgtgaataatgcaaaactgcatttattttgagacggagggagtacgcagttgtaatcaggtagtcatctcagtaataaattacgcatgtctgtatttggaagagtaatgtagtaatactgtactagggttttcgcaaatcaaaagagattaattggtgtgcagtgtaggcctaccagtctaccagagactatgcgtgtatccctttcgccagtaacgatacggattgcaactggagcctatgagattcgatcacgcccctcaattccccaatccctctccctcttcatggatcctgacacgaacaatcgaacaaccacggccacgctaaattggaaaattaaaaaaatatataataattaatctcctgtgaatgatcattccttatgtgacacatcagacaaagtatatcgatttaatccgtgtttatagcgaaaaaaataaaaataaaaggaagacaagaaaaaaaattaagaagcgagggaggggaaaggaggaaagaagaaaacaccacaaattaagaagctccaaagtttgaggacgcacgcttcgcgggtgacgtacaggtgtaggggaggtaatgcggcggcggcgcgacggccgccggcgagggcgaggctgaggctaccatggattcgatcacagcttgacgacctccgggatgtcgacggggtagcggtggatgcagtcgtcccacggcccgtcggcgggcgtcttgactgtgcggaggcacttccagacggcgctgttgcacttgaatccgctgccgaagccgatctgccagacgcggtcgccgcggcgcatgcgccccttggcctcgatgtaggcgagctcgtaccagagcgagctgctcgacgtgttgccgaaccggtgcagcgtcatgcgggacgcctccacgtgctgcgcggacaggtccaggttcttctgcagctcgtcgatcacggcgcgtcccccggcgtggatgcagaagtgctcgaacgccagcttgaagtccgggatgtacggcttccacttcttgttgatgagcttgcggccgacgaggcggaagaagaagagcagctgctccgacatgggcagcaccagcgggccgatggtggtgatgttcgacttgagcgcgtcgccggcgatggccatcagctccttggacagcgagatccccgagtgcccctgctcgtcctcctcctcgtacacgcaccggtacgcgcggtcgtcggcgcccttgtgcgtgcggaccacgtgcatcagcctgtacttggccctcctcgcctccctcctcctgttcgacagcaggatcgccgccgcgcccatccggaacaggcagttgggcagcatcatgtcccgccgggttccccagtagaagtttggtgtgatgatctccgtcgacaccaccagcgcgttcgagttgggatgcacctgcgcgtgtccgtccatgtcgctcgttaatggctcacctgattagttagttagctaaacagtagtaacatcaaagagctggctagtacttacctggagcatgtcgcgggcgaggtcgagggagatgaggccggcgctgcagcccatgccggacaggttgaagctgcggatgttgctgcggagcttgtacttgttgatgatcatggcggagagcgacggtgtcggggagaagagactgcagttgacgacgaggatgtcgatgtccttgggcttgagtccggtgcggcggacgaggtcgtcgatggcggagaagattacgagctgggcctcggcgcgcgacgcctccatggacgggttaggcgggatgtagtggttggccggcgggaggcaggtctcctccccgagccccgaccgctcgaggatcctggtctggaaccgcacgctcttctcgtcgtcggtgatgaggcgcgtgtgctccatgaacgtggcgaacggcacccggcagctgggcggcggcttgtagcaggagtagtcgacgaggtacaccggccttggccgcgacatgaagtacaccgtgccgacgaacacgacgaggaacaccgagcagaggatgtggacgaggtcgagctgcagcgaccgccacagcgacagcagctcaccgggccccatccgcgccagctccagcgccgtcgccgccatcaccggcaccagcagcagcgtcaggaagtggttcaccagatactggtaccccagcttcacgtacttcagcttcaccgacccggagtaccccgccgcccccggcatgatcgatgctctcactacttccccgcgcgccgccgcgcaccgcaccaacgctcgcacgccgcgtcctacgtacgactttagtttcttcttttttttgagcggtgcagcgtgcacaatttgtaggtgcgatgcggtgcggaggcggatgggtttgcagtggtgtgttggtgatggtgtgtccggtgcccggttggggggtctaatataggggacgcgcgcacggtggcggagacgagacgagatgacgaggagtaattgataaatctggggcggatggggtagtttaaagaggccggtctaccgccaccaaccggaagcgttgggctgctcttattagatttctgcatcatgggggggacacaaggttttctcccttgttttttgtttatacaagtgcaactcgtagtgacggttaacggcttaaccccggtgtcaatttggatatgtcatatgagtatatgattgctaaggagtatcatactcctcctatagctcctggactctggagaggaccatttttcagtgacaaccttgttctgcgggcattatcggaggaaaataatagagttcgtaattaagtggagtaatacacaagcaatgtgcacaggtactgtactgctcgcatctggatccaggtgagtacgttcagagtttagtcatgcatgatacactgaacataattctcttatgttgctagtagctgctgtctgtcccatctaaatttgcatctgatttttgagcaccgaatgatgtaacaagccaataacaataagtagtactattatcagtagttaatcaccaagtgtccaaatcataaccgagttagttcaactgttaagacccttgaggtcttgacccgtcgaaaaaactcttgctactctattcgtcaacacctgatttgagtccaaatcaggtcctctcctatcgccgagtgaacttatctctgaagataggtttcaaaaacttatctctgaagattggtcctgttttcttttttactcacttccttttgagatgtatgcaatggtagatcagatgagagggtaactttccctgcggaagtacggcaatacagataatggctgggactgaattgggctcccttgcatctgcaccgtatagggttgtgtgtttcgcaatggcatcaggttcaggactgcatgtgcaaattactctgttggtaccctctgcttgtacaatttaaagcactgttgttgcaggttgggtacccatcattaaactacgagatgaacactcatgtccaagtcttgcaaattcacatgtaatcttgtaagaactgaacagttttacttcgaaatagtactctttaaatgttgactctgattcgatcggatcgacttcgtcagtgtgcattacaagctctgtttggacaaattctgaccctgttaagcagctctagctggatactacttctatactagtacttttttttttgaaagatcaatagtagatggtactcctattaggctattaccattactctttggatggccacatctaagtgcctgatctggtaatgctatactcctagtatccttgaatcctgataagggtagtacagtacggagtatactcgtatttttgttacgagactccacttcataaattcatatactacagtagtaatagctcagacaagttcaggcagagcagtgatagctgatgacagaatactccctccgttccataaaaacgaatctagaaccggatataacatattttagtatgatgtatatccagattcatagtattaggatgtgtcacatccgatagtaggttggttttttatagaacggaggagggagtagctatataggtgcagacagcttctgagcttgtaagaaagagttaattgcgtatgcagtgatctgcgtagcaatagtgcaactgtacaattggtgaaaatctccctaaaaaatggctaaatatatggcctcctattgtcccggagccaatgacagtgtggtcctttggctgcagccctggcagcagcattaacgtagtagtgagtgtccagtgcgcagtgatccaatcaaaattcgagacaggatcctccgggaagcatcaagcatcttcgcgtacgagtcgtgagacgatctgtccatgcctctgaagaaacggaaaaccacggattgttcttcttcccctcgcgctgatacgagtgaaagtgcagccgaagcagctgtcgtagtggccgcgtgaaatgctgaagttgacgggtctgaatatgtgatcggtctggaggacgaatggacgatgggccgacatgggatggagttgggggttgggagaaagcgtggcgaaacgcgctgtgtttgctcgtcatcgatcgaccagaggaagggcagagactcacattaataaagcttagctgcaaccatacatccgccgcaggtgtgcaagggcaatcctgttcggttcacgtctctcttgcccttgtttcgcacgagcgaattccgtctcttcgttttggacctgtccctcatgtactacgacgaacggcacttaggggatcgacatcttcgtgggacaggattgtaaacttacaagtattattctacctgttcccttcatactacacattaaatgtgatcatctgcttatttaaaattgatcatgacctgtccatcgcgccaaactgccaatctgtattaggtttgacagaggccattacctgcaaagaaaaacgcttgcctaagttaatgctctaactgtacgtgagtacatcctgcctagcgagtggttctgattgctgggtcctttactcctgaaaagtcagtttaactataatcagttgcagagataatcttttttattttcataaacaagtattttctctgtttatgtttttatcaataaaatcgaacctctcagactcaattctttgaagctcggaggaaactacggatcggacgtccgattcctctaaaaaatcggagggtcaaatattgtagttgaccaacaagtgaaacattaagttatgtatggtgaaataaaaaaaatcagcaactgaaatatttaaaaattttatgaaacatggtgatgatacttgttgaaacatgttactattatgtattaaacaacgagtgttaacggattgaaacatatgtttttctttcgtcaaaatatagtcatgcgatatcttgttataaagatttaattacaacgaatacaactgtgtgatcggatcgtagattggataagtagtttaagaaaaaatttattttgaagattattaaaatgcatatatgcatggatagaagggagagagagaggagagagagagagtagtggcaggtggtttcgtgaattttatgaaacacattgaatatatacattgaaacatatcaatatcacgtatgaaacattcagctttaacggtttgaaacacatgattttattttattagaatataattatatgatatcttcatgtaaagatttaattacaactaataaaatagtatgatcggatcgtagattggataagtagtttaggagaaaaacaatatttaaaaagagaaaaaaaagaaaaagaaactagcttgtagcgagaatgctcgccccgggtgaccggcggggggtggagcagatcgggcgctccccattttcgatgtacttagtgaaacaattccgatatacttggtggaacatcgtgcaatatttaaaaataattcaataataagctaaaaaaattttgtccgaatatatccatgtgtggccttgttttgaagatttaattgcaacgaatttaatggtacaatcagataatgatttggataaataatttaagagaaaaattagtttaaagcgggtttgcacgcatgcgtggcactgacgtcgtgctgacatcagcgcctgatttttgcacgcattgatcgggatcgacgcccgatcggtagttccctccagtttacagtatacttgcatgcatgaatcgggcaccctattgtgagcattctcctcgaaggttacgtctcaaacatttctatttcactacatgatatttttatgttaggatgtatgtcgcatatcgaattttgagcagtgtctttaattaatatgtaaacttattgagacggcagccgtgtcaagtacgatacatacccttctaataggtcctacaagagctcaaaaacattacaagcttttagtgtccatgtttgacttatgggtaaaatgcccatacttatttgaatatacaaatgttattgtatgttattaatttgatggattcaaacaaatatatattagacttagactattgcataatatcaatgactaatttgtaaatcttgtaaaagtattgatgatggactaacagcagaaccaccaccaccaccactatcgttttttttcagtagtatagattgatgctcaaagcatctatacacttcgagtgccatcacaaagcccatatttgtttgcacttttagcacattatacatacgtacagcgtttctctaaaaaaaattccacgttttgctatcgatggacgatctgttctccaaaatatcatcaacatgaatcctacaaaataccatgttacaagcatttttcattttttttatcaccattaggtttatatctatagaccttcattagttatttaaacagaggccatttttccctaaaaagaccttcgatacacccatttctacagttttttttggggggacatttctatataatttgcatgtgagaatatgcaaacaattttgctattaaattatttatgagatttaagggtagtttgggtatttagcatgatgacaatcaaattatagggacaaaatggtcttcttgaagacgtgatggaggtttatgaatgaagacttaacggcggtgggaaaaaaaagagagaaattgcttacattatggcatgttgtagatgtccagtttgtcgatatcaattcatagaaccagttgcttatcaagtaaaatgtagaatttctcaagaatatataagttgcatgctcgttatactatttttttcagcgttttggctgggctgaacactaatgcaaaacgagtcagatcatttgctcatgattaattaagaactaactattataattaataaacaaatttgtttgactatttttttaaaaaaacttttatataaaaaggttttagacgaaacacgctatccagtagtttagaaaacacactcataataaacgagaaaatagcccataacgcacccttatttgcactttccaccatgtcaattgcatcatggcttcactttataccagtgtgggcatatcaatttcagtttactatactacagtacatcatacaccagtgagtaggagtatgtcataaggcttcactttctccagattacgtcctgaaatctgagtcataaaagacgagaataactcatgagactccttgaatttcattcacgtactgtacgttttaggaggtccatgacatgtactattacaaagataaagttgagaagtgaataatgaacagggcaagaaacggaaagttgactatgacgttacgcattaacttgatgcttatcatatatcctatatatctataaaatttatcgccactaaatatagttaatgctaattttcttttctctcatgaagccatatcactttaattgtttttagtctttggatgattaatcaagggtgtaaagtacatctcttcacatcaccttaactatttttagcctttggatgatttatcaagggtgtaaattgcatctcttccctctaaaagacaccatatatacaatccaatcatttataacatttagataatttataaaggtatgcatgaaaaaaatattatagtagataagaaagaaaattttagaactcatatcttctatattatcacacaattctaccgcagcaaccatctactcctagcatatataagacagaggccgtgtttagttcaccccgaactaacctaaacttccaactttctatcacatcacatcacatccaaaacttttctacacacataaacttctaactttttttccaaacttctaactttcctcaaacttccaacttttgtcactccacataacctaaaagaaacaaatgcgtagctctgctgaacagacaacctcactcgtcacaagtttgtgcaccttttggttttgcatacaaattaagcaacaaaagcaatccagtttgcagaaaaatatagtaatatttttaatacaaaataaatatattattaaaatatattcaatgtcatatttaattaaaccaatttggtgttgtagattttgttaaatttatttataaacttaataaaacataaataagtttggttagaaagaaaaatcaaaacaacttataatataaaaatataaaacgaagggagtattaacctattatatgtgcaagttggatcgcagttgggcgttggtaaggttggttgtttcctgccgtcgttgcaaggacggtaaggtggtctgaactctgaacttcgacatcacccagaatcttcagtttcgcggtgcatatcacaatcgtacatgacatcgagagatacacggattcacgaaaggccaaatcttacatctagttttggtggacatcaggagtgcatgatttattaacttttttcagacagtcgatcccaactcccaaccgaccgccgtgagcccgtgagaaatgaacatttggagttgccatcctccattgtgtgcaagaaaaaacgatcgattccaaccatgatagccactgacgctgatgtgaacgacacagcctttgggactagaatcttgacgtatagacgactaaagaacgtactccatgttagtttattataagcttaatcttttcgatcggaaagaataagcaaccagtctatgaataatgatatcaattcaagctcatcatctcgttgcagatttccggagttagagccagccgctcacccaaccgtttccctaatccgtcattaagatttcaataatcacgtgttggtgagccgaaccagattagctcccgtacgccatcaggaaaatcaatctaccgccgtgtacagcgccagtaatgtgtcacgccgtacgtacaacgagattataagaatgtaacgcatcgtgagcgtgaaaacgatcagctcgcttacgcttcgcctgcatttcctgcagtttcggtaacatgcgtatatggaggcccatttagggtctctgtttcttctcaagttaataaaaaaaaacagcccacaggctacagaattggtgtatagtagataaaaagacacaaaaatgaatgacaggataactactatactcagggtgtgtttgaggagattgggaagatacgcaaaacgaggtgattaattgagtattaactattttaaatttcaaaaatggattaatatgattttttaaagcaactttcatatagaaaatttttgcaaaaaacatcccatttagtagtttggaaagcgtacgcgcggaaaacgatgtgcattcttactccctatcacccaaacaaacacagccttagaacacatataccaatatatggattaggattactggtgatttgggaacaaccaactagcagtcatcttaaaaaaaaaaagagaagtcagaagatagctacagtgaattcattagtgtccagagagtgcttgtttgacaagcaagtcaaaagtgtcaaacattgataacatcaggacggttggcatgcgatcgtgcaggtttaaatgcagtcaacaaagaagtcagaaacgactcattgtacgtgtacgagtacggtcgctgttttgctttccgtgatgcggttggacgttaaggtctcatcactagcgcgatgtcccacagcgatccagccagcttcatatggttgcatatacagaaatactactactttgcattatcaactatgctccattcagcttcgtgttcagatactctctcgatacttgcgtgaagagagatcagatatggacaacgaagacgtgcaacgtgtgctttcaaaaaaaaaaaaaaaagacgtgcaacgtgttacatgaacagtacggcaaatgcgatcgaggatgttactcgagttattacggcatggccaatcaaagttgacagttaaagtccaccctcagcgaacaggtgattgatcgattagtactcctaacgctgctgtacttctcgaataaacattgggttattcaaaattgttggagtagttataactggaggagtcatacaattattataggactgtgacctcgatcaggatggtttctaactctgttcctatcaggtagccttcaactccaacacaatctacactctgattgtatttacaccctgtatatgtactacttcctccgtactcgtcgttttggtcgggactcgggagtaaaatggagtttaaccgttattattttctactaagcaacttcaaagtgaataggtttaagtgtatgtaagatattggtaaaatattttgtcgacgtttgatgtcgcgattccggtatttgaatagtatggggattgtcggagaatgaactcctccaccagggaaccgtgaggcccccctttgtgagttcggccgggggcagcgggtgagattcgaggatttggtgagcgaaactgtgtggtcttgagggggttaggcccctccaagacgatcagaccaaagaggtttatacaggttcgggccgctatgaagcgtaatatcctactcctgtgcatgattgattgaatgtagaacaccagtgcttggggttgcgagacccaagcgccagttcgctccgaagtccctcccctccaccactaggcctagacctccttttatacctcaaggggttaccacatgggcccaacaacctaacctaactccggtggagaagtattataatctttgcattaaatgcatgtcttgtttcttgacttgggaagccaagcacacgtcgtcttgatgatggggcctgtcaaatcttgccgcctgacacggggggtgcccctgtcaatcaccatttaatgggtgaaaacttctgggctccttttacaccgggaaacgggagccttgctttgaccagagcgggaggaccgactccggctgggataagaggatgagaacctctcaccatcactatttgatgggacatgtcaggctgcacaccgcctgacacacgagcagcgcacaggcgcactagccagtctcatcggtcattcgaccggtcacagaccggttgagtgcactgcacgccacattaaatgcggcgtagcgcgaccgcttgggacgccataaatacgggtaggcggacacctaacccaccgtacgtggtgacctagagatggggtcgggggagcccgacccctagtcacgggagggggcggccgccgcccgacctcgggcctgatcccccctcggggggggggggagccacgtggcgcctggggcggccttctccctctagtctcggccagggagtggccgccgccctacctcgggcctgacccccctctggggagggccacatagcattggagggcagcgtcctccatccaatttctgggaaggagtggccgccgtcctacttcgggcctgactcccctcgggggagggccacgtggcatcagggggcagcctcctccgactagtctttggggaaggagtggccgccaccctacctcgggcctgactcccctcgggggagggccacgtggcatcggggggcagcctcctccctctaaacctgatacccccaggcctatatcaccgacaaggatcgttggtactaggatatatgcgagattgaggtaaaagagacggagacgatgatttttatacaggttcgggcccctgaattatcaggtaataaccctacatcctattggccggagccggtgttgctctttattcactataatcacaccagtacaatatttagggtagcctatctaactattgtagacttggcggtctgaaattctaactcgtatcgacaacagggtagtcttcctcctcgaatccgtgcccggcgagatcagagatagcgctttcgtctctcctgacagtatccggagacaccgtaggggactagccgtgcttatccctgaagccgctttcgtctctcctgacagtatccggagacaccgtaggggactagccgtgcttatccctgaagccgctttcgtctctcctgacagtatccggagacaccgtaggggactagccgtgcttatccctgaagtcgatatccggcgtcttgtcttggcttatgttggcttgtatgttgtggcttctgttgttccgtctccactctcctcttaggaggtcttatatttatacccataggtgtccccttgtccaagtagaactagggaaaccaatatggatacaatccgagtagtccttgtcgttttcatgtggaactctattcatccttccttatgcggaactcctcttatatctgaaggttgtttccgtataagagtatgtggtgggtcctgtcgagatttagtcaactactattaggtatgtggtatctataacactgacatattttccatcgcaaaactaataataagtagtacaacattgatgctaaataattagattatttaagtatcaaagctaagcaactcaaagtcaaaaccgatgattaacagatgaagtattaaatatatttttttgcgggaatgaagtattaaattttgacttaggtattattatatatgttaagtttcaagttatcatgcatgtaacatcatgtacgttttcacgaaaatgctcacacccgcacgaccggcggggtggagaaaaatcggacgttgtctaccactacagtatgcaaagaatcttttcttttcttatttattcaaaagatttttttatcgtaaactatttatctaatctacgatctgattgcaccactaaattcgttacaattaaatctttacaataagaccacacatgattatatttcgacaaaatttttattgatttttttaatgttgcatgtggtcacttatgtttcaactagtagttttacaatgtttcagctagtgtactcatgatgtttcactgtgtacggatcaaatgttgcagtggaacgtgccgttgcaataaatcacccacatattttggaaaccctctattaagggaattttgtttattttttgttccacaaaaaatgtttcacctaatgcactcacaatgttctactatgtatagatctaatgttgcagtgaactgaaatatatcattgcaacaaaaaacccacatattttggaaaccttctattaaggaaattcgtttcattttttgtttcaccgaaaaatgttacatctagtgtacttataatgtttcactatgtatagatgtaatattgaagtgaactgaacattcttccgctatttgctgaaacattgtttttatataaggtgaaacaacaccagatttaaacgagtgaaacattttcgagaaacaattccgatatatctggtggaacatcgtgcaacatttaaaaatatttcaataataagctaattttttttcatcggaatatatccatgtgtggtcttgttttgaagatttaattgcaacgaatttaatggtgtaatcgaatcataatttggataagtaatttaaaaaaattagtttaaaagtagttttgtatgtaaatcgaacgctgacgtcagtgtccgattttttcctaaagcatcgaacgtccgacgcgtaccctctccatgttttcatctgcaaaaagtgtacaaatgagtattaattggcacgtgtctgagtctcagtgcccatgcatgttccgcttgttttaattcagttattttcgataggcaacaaacaaatgcaacttttatatgcacaagaaaaggatacagctgccgaacgcacaccaacaccaacagctcacacggttgggacgtgttgtcacgttgaggcgccgttgggcacgggtggcatcactccacccgtgggtgggcaggtttcacccggatcgagccgtacgcggacacgcatggcgtcgacctcaccactgcaaatgcgtgcggttagtccaccggtggcggcctcacatcacatggctcgctctcggtctcagccaataagccaaacgacaacgaggcaggcggcggctggaaaagcaaagcgcctccctggccgcgccgtacatgattcgagcgcgtgcgcggcgtcgcgaactggctggccggacgtgcccggatgagatagcgcacgcgccaacgtgcatatgcctacacgccgcgcgtgcggtctgggacgagtttcggtgcgtgagatgacggacgatgttcggttgcggactggcggcgatggatgacgccacgcgacgcaccgcgcagcggctggccgtttttcggttaatctatagtagctgagctgggtggtagtacaaaattatatattttttaatataattttacttaaaattaaaatttattaaatagttaccttgttgtcttaagattttgaaagaccaaacatatatattaaccatttcattattaatcttacaattattattctgttttataatccgatcacactattgtattcgttataattaaatcttttcgacaagatgtcatatgactatattctacttaaagaaaaatatatctttcaacagttaaaatttaatgttgcatgcgtgataatgtggctactccctctctctcatattacatgcatgtagtaatttttaaaataaattttcttctaaactatttatccaatctacggtatgatcgcaccattatgtttgttgtaattaaatctttacaacaatatataacatgattatattttgatgaaagtaatacatatgttttaacatatgttttcatttcataaactttttaaataattcatttgctatttttttcagcatgtataacttaatgtttcacccatgatccattaaaaatttaatcaaccatttatttcaaggacaactgtgttattgcccctattttatgttgcaattatgattttacccttcttttttagattggtgtttttacctttactttttgctaagaaagcttcagtttgccccaattctaaatggttgttaggtggcccagatttgtgagataaaataaaagagaaaaatattaacgaagtgcaaaaggactattgtacccccaacacagtattcgttcagccgttcccattcaaatattcctatccaagtcctgtgtagaactcgagcagttagcggctgaggctgggggtaggcgggtagctggcggcggctctggcacagcgccacgggaagacaacagcgggctacggcgagccagcaacagctacggcgcaacacacgggaaggcggcagatcttgcgcatcaccacgggaaggctgcggcgagcggccggcggcagcgctccggcgcagcattacaggcagttgagcagtgagcagcatggcgtggcacgacggcaacaacgacacatatacggcgggcagttcgtccacaaagacgaacgatgccgttgctgcttgattttccttttgttttttcccatctcatagtatttgtgacttgcgaggaatttatgtaaatattagtgctgaagtttcgcaaccattcgaattatgtgaaaatgctatcaaaattctatgaaattttgggatacaaattctaaaatacatgtctttttacagttgaattcacacaccgggcaaattgaattttcgtttgaaaaaagtagggatgaaaacacaaatcctaaaaaaaaaggtaaaatcataattgaaatacagaataaaggtaagaacccgtttgtttcagaattcatgcaacctgctgtaaacttgtgtgtcgggggccttgcaggcttgcagctacggtagatggaatgatgagttcggtcaatatttttttctttcacaaagctaacatgtcagggtaatcagatgttaccgtgtaacacgtctaattaataatctaaaaaagaatatagataatacacctgatcgtgagtgatgttcacccttgcggccttacctagttaccttcattaatgcctaaaatgattccgaaacaagttattctccatgccatccgtaggctacaggttccctttatagtcgactagattcattgcagaacgaacatataaattccttccattgtatatatgttgtacatctaaaataaactcacggcttttatgtacatatttgagggcacaatttcatgtgctggtagcctggtaacgtggtagcatagtacgtaccatgtgaaattgagtacgaggacgtgaaattgagcaagttcactttaggtacctcaatttatctctcagtctgaaattcatccctaaactaaaatgacaggtatagcaggtctttcaatttacaaaaccggatcaaccgagatcctaggtagtattatcaccaattttaactgattgacaagctgggctcacatgtcagtggataacatttcccggcgccatcctccgtgttcatcgtcgcgtcgatctcgtcggccagatgacgacgcacgcagcagctgtggctctgtggtcggtcaccgttagggaaggaggaggtggtggtcacggcagcggccatgccggagccggccacggccacggcggcggacatggcagcagccacggcaggccggacccatcagagcaccacccgggcaagcgcagcgcggcgcccggtgtcgggcagcctcctgcgccgctgtcgctctgcttcccctctgaatgaatcctgacccgaaccgcaccgcacccaatttcaaatcttgaatttaaatcgattgatcttgttgtgtacatagaatgaaatgaatccaaaggaattttttgcgaacgcagaatccaaaggaatcatagagaatccgcccgattcgggatttccggtgagattttcccgcatcttcaatctgcaatctatgtgttctttccaagaaatcaaggttttttcttggatacgttcatagaatcgaataatgcattgctaaacctaaaagggttcaaaaaaaacgtagtcagctttcaagtcgcatttaaatacgtagctacggccaacctgcgaaaccgagacaaattcaagagaaaattcctgtgtacccttaaaaattcacctaatcccttatacgtccttgaattttacttattttcttatatacccatgaattttagtttggatctcttccatgcctttttccgctagttgactattagttaaccgttaaatttttaatgaaaaaaacccattttaccctctgctatgaaaaaacatataaaataatagagtagaaatttgttagatgggactattatatttatgagttagttatgcaccatattatttgcgataaatatacttttagatataacataaaaaatagtacttacttattagttattaaaagttttctatgtagcacattagtatatttttcttatacgacaaatttgttgtattactgtcaaaacacatatgctacataaaaaaaagttttaataactaataaataagtactactccgtttcacaatgtaagtcataaaacttacattgtgaaacggagggagtattaattttttatatgatatctaaaagtaaatttgtcataaataatattgtgcataacaaactcataaatataatagtttcatcaaataaatttctacactccaacaatctactccattagtttattatgtttcttaatagtaaaggataaaatagatattttcataagaatttaatgatcaactaggaaaaatggcataaaaaggatccatgtaagtaaatgagcaaagaatggattaggtgaacttttatggatacatagggagttttctccaaattcaatgatcacgaaaccatggctcctgctcctcatcttcttcctcctagccgtgttcttgcaacgggtgattcttctattaacgggcaagcgattcatttcatcctctccgttgactctctctgctcgtgattagattgatctgatcttagtggtgttcttatcctctcttcctacaaagttataatccattaattactaaagcttaacatgtaaagatgacacatcatcgttcactaacaatcattaaatttaaacatcatgcaaacatgctatattaactataattttataatttattaaattttagatcttttaaaatgcaagcatgttaaattattatcccacataattcacataatatttttatatatatcttgattgtttttttatattatactatgtacatatatagttcatcatcacttagttctctcttctctcattaagtcatatcacatcaattgtttttagtgcttaaataaaatctatggtccaaattagattcgtctcatgaattagtccaagattatgtatgggttttattaatagtctacgtttaatatttataattagaacatccgatgtgatagagacttaaaagtaagtttcagtcccatctaaacagggtcaaccagcccggcaccacccttcttgtgacccctctgtcacgaatctccaagcagtcagacggtaaggatggtgggtacttatgtacccgagctcaaatctatgttatatatatatatatatatatatatatagattaatcatctaaaggctaaaaattatcgagatgatatggattaataagagaagaaaaagagagataatttggaccatagattttatttaagcactaaaaacaattgatgtgatatgacttaatgagagaagagagaactaagtgatgatgaactatatatgtacatagtataatataaaaaaacaatcaagatatatataaaaatattatgtgaattatgtgggataataatttaacatgcttgcattttaaaagatctaaaatttaataaattataaaattatagttaatatagcatgtttgcatgatgtttaaatttaatgattgttagtgaacgactattgagcctaattaatccatgattagcctatgtgatgctacagtaaacattatctaattatggattaattaggcttaaaaatatgtctcgcaaattagtttttatttatgtaattagttttataagtatagtattctggcagggagggttaaatgtagagcatggagtaacccgtactattgctacacagggaccgagagcaagaatcccggatttggccttttgctgtgtgaggaagcgtcttacttattaaaaccactcttggcgcaggctcttctcattcaccaaattaaaatgacatttacaaaataaaatatcgatctattatatatacacacgctgaattttttttttgttgaaatgatatatctctattcaccaaaaatgatatttacaaaatgaagtatcaatctattatatattttgactttgtttttacaggcatgatgagaacagatgggtggatggcaacccaaatttaaagggcaaaactagataataaggatttcagtaaaagtactaattgatccatggcaaaagattacaagaactcgtgtgaaatcaaaataaccggaagatatattatagaacggaacataaggaaggcaataaccttctcgagaaacatgagaagaaggtagcagtagcacccagcaacaggccaacagctagccttcgagaactggaactggaaagaaaaaaaacagtaaattgcatcttgggctattttttcttacctgtactgtaacttagaccagtgaaaaagtaaacttttcactttgaaccgggtatgtttacacaatgtttcaatttagactctcttcttcttcctccaactccctttcttcctctcttttctccgtacagctcaaggtctctttctcgatcaggtgcagtgcatgaaaaggcaagaagcaaaacctttcacagggtagccacccgccgaagttgatttcgagctcaaatgcaggcggcactacgaaggcggagcttgagcgctgcaaaacttgttgaagctcgagcgacacatgtggaaatttagcgcaggcgtgcagcataacatgtagcactagctgaggtcgagcatgagcttgagagcgtggctatctgctacttgacttagttcttatcgtcagttcagaaagtagcagcaactgtctgccattgccggccagcttcttcgtatgctagttgctaccagtaggaatacttgttgtgcaccttccgctgtccttgaaattaagccacaagcactaggtagtcgagattgaaaatgcaaactaccctttgaattctttggaagattttacagattgaaggggagattgggggaagagagttggaggaagaagaagggagtccaaattgaaacatcatgtaaagatactttgcccaaattgaaaaatttagctttagcctagtccaaattgtaacaatggtaatcaaaggtggctcaaagttcaattcactaaaaaaaatgcagcaagcgaaatacaaagagcatgcacatgaactgggatttttttttctcaagatcaaccaaataatttttcacatcaaggcaggaccttccatgactgtttcctcgccagagagaggggagagagagatcgggaggaacatgcagtggcgaaggatgaggtagctgcagaaatcctccatgtcggcctactctcatgggggatgcgattccgaaattatgtgcgcaccgctggttccgcaacagctttatctgccggatgcccagatcatcagcttcagcgctcttcgcacacatcataaaaaaacaaatcaaataatggaaataaaattaaggaaaaaaccaaatcgaccaagaacacccgattcccaaaaatccaaagaaaactcactacttgggggcagcggaagcagccaccgccgggctgcgctgtcctcggtcctcgtcaacccagtgcctcctccctacctcgctgagacatggatcgagactagcagctacgctgcgctggcgacatcacatcgccatggacatccacacgaattatccagcgctaggaggaacagggccgtccgatctatcgcctaggaggcggagggctgccggatttggtggccgtggacccttcccgcgctgacccacgcaccatgtcgctgctcaccttcctactcccactcctctcactccttctcgacgccgacgcgcgccatagcttcaagatccggcgcggggtggaccaaggagtctcgagccagtccttgtggtggagtcaagctcgagtggtcaggcggaagcttgccgcccctcaccggacaagctcgccgccggtccatcgtccacgagcgagggcacagcccgagtagtactagaagggcatttcgggtaaaactacagtaccattgtgtacccaccgtccaatcccaccagctcctattaggtgaaagagctacttttgatagagcagatacacttcactaggggtaaatgtaccatgctttaagattcgtgtgcacacgtgtagggtgcagatcgtgggtgcatatgaacccaggtgcagattatccaactcctataaataattactgcctcatgttataagttaaattttaactgcatgctatgtacctggtggggagcaaggtgagtgggttagaggctgtatcaggtgttatttaatacgtagcaccttataacttataagatgaggcagtaattattttactcagccttcactaggagtggtgtacaggcaaattagaggagagatgatccagtgatttttttacttgccgtacaatttttttactcattaagcgttcacatcaccagacgagtaactttttaactcgggacaaatgggatgggaaaagcctttgcaggcggtggtagtagtaaaagcggtccatgaggatgcggcacatgagaaaggcgagaaatccgaagttggacccagaaaaaactaaaagccaggaaggcgagcgctgagaggcgcgctacttccttcgtagcgccaccatgtgcgcgcgcatatatatatatatatatatatatatatatatataaaatatttacaaatagggagagaaatagaatttacaaagttattacatcaccgtgtatatccatgatttccaaataagtctttctactttcaaataggcccaaactatctcaatatttttcttctttcataaaatcatatcaccttacttttacatttaatcatcattctatatactattaaaattaaattatcataaaccacgttaacttacgtaatcttatgttatgtacctatgttacacattgtttttacttattgttatcatactaagctcccgcaacaatgcgcggagtttcatctagttgtcttgatgcgtatgtaccagcaggagctaaggagacgacgacgaaaacgttggttggcgggcagccgacgtccagaacgattgggaagagggagaaggggagagagagaggagaatgaaagtgctacccactgacatgtggggcccacgtgggtcccatgctaagtcagcttgtcacgtcagttaaaaccttacacaatactacctagatctcaggtgatccagttttataaattgagagatcggttatatctgataatttggtttagcaatgaatttctgactcggtgacaaattaagggatctaatgtgaaccgactccattttaaatcgagtgaccaatcgtagagtccctccgttccgttgtttcgtgaggcgtgcactcgtactcggtgccgaaagcgtccgctcggccacatttaacccaccacagcaccacggcctaaagaaactattttgacttccgtcggcccagcactcaagttaattaacgatttaccgctcgctgcgcggaaaggaataaagtccatcagaggtccctcaacttgtcaatgaatctgattttcatccctcaaacggaaaaccagacacaacgagtccctcaactatcaaaaccggcgcagattaggtcccttagcggttttaagggtggttttggcagacgtggcgtctacgtggccaattggactcggtcttcgtctgacgtggcattgacgtggcgcttacgtgacaattcgatcggaaaaaataataaaacccgtgggacccacatgtcagtttcacattaaaaaaaggtgggacccatgtggggcccacatgtcatactcacagccttcctcttcttcctcctctctccatctctctcccctctcctccctcctctcgcagtctcgccagccggcggagataacgacggcctggagaggcgtgacctcctccgcttccgccccctcgagcctatcgccggcggccgctgggaaataagcagcacacgagcgtcagccggagggaggagaggagcggtgcgcaggcgcgggcgtgggcaccggccggaggaaggagaggagcggcgcgtgtgctcggccggcggaagtataggagccacgggcggaggccaaggggagcgggagaaatccgcgacgcgctccgcgtccacatgctctgtcacggcgccccgcgcccccaccgattcaccacctacctcgtcacgcgcgtcaaccactgcctcccccactcgccaccaacgcctcctcatcctcgagggcgatggcgggctcgagaggctcctcgacctcctcgacgcggctgacgccggcgtcgatgcgcgggcggcgcttgagcgcgacgacggcccggtcttcgaggccgtagagacggacgcggagcacggcggtggcggcgcagagggggggcgcggcggtggtgcggcggaggcggggcgcgaggaaggaggagaggcggcggtgcgcggtggaggcggggcacgaggaatgaggagaggcgacggtgcgcagcggcgtcggggagacggagcttgatctcgacctccatcacgggaggcatggaggagagggaaggctagggtttggggttgcgattgggattggtagggaggctgatgcggttggacttggagggcgcggcgccgggcagcgggtggaggaggaggttggagttggaggacggcggggtcgtggtcggagtggatgaggcagtgggtgtgctggctgccgcggcggcggcggcaacgtagaggtggtcttcgagctcgtcgcagttggaggtggtcttcgcgcgccgccgctccggccgccgtcgccccacttcgcccgctgccctagtgcacatcgtcaagaagagagagaggataacgggaagaagatgaggggtaggaggatgacatgtggggcccacgtgggtcccaccatttttattattttgtatgtgaaacagacatgtgggtcccacatggtttattattttttcggatcaaattgccacgtaagcgccacgtcagatgaagaccaagtcgaatttgcgacgtaggcgccacgtcagccaaaaccaccatctaaaccgtcgagagatcttatctacatcagttttaatagttgagggacctgttgcatctggtttttttggttgaaggaccgcgcggaaacgtcgccggtagaggcgtagagccggtagatttgtgacgacgtcttccgcgccgccagatcggcccacttctcatcttctttattgtgaggccggctccatatatatcatatttatggccggctattacatcttcgattcctcctccccaaacgcaaggcactttccttctcctctctctctctcgacgcatcctccaacttgtgcacgtcttcctcctcgatctccatggccgagttccttcgccggccggagttttgtctgcccatgcacatatacacatcacgcggatcgaagatgggatgaacgtacgtggagcggtggaggtgcaaccggcaggcacggtggcatctcgatcgatctatcgatcgatgaggaggccacggtggcgtctcgatcgattcgcgacatgttcgccgagatctatcgatgaagaggccggatcccgaccgtgatgcgcgtgcgggcgtgcggcgtcctcggcggcgccgatatgctttgtggtcgggtatggatgttccgtctcaacgtcaacatatcgagctaattagtatttctttggacaataatggcgatggagatctgtgctgaagctttccctctctcaaggtaggttatcaagtttgtttgcatatctcggagctgatccctatcaacggaatggatttttgtgtacaacgacgagggagaagagaatcagatatccagttccggtggcgttcatggccgcgagatccggatccggactccccattccacagtagccctaactagttgttcaatactctagatctgaatcttattatcacccttagcatgtttccattaaattttagcatctccatgagtccatgaccatgccggtacgtgcatgcagtagagtgccgccgccggtgtactgcatgcgcagtcgtgttcccaatttgctccacatgtgccttgctgccattgatgacctcgaccaccactgtgagctagtaattcaaaaggcatcagcagtgccgtggtggtgggtggtgtgagcttgaaaaggcaaatctcttcgttagaggtgggcagcatgcgtggtgggggatgggacaggggttcagcaatctttgtcctcttcatttaatttcttactcctagctgttagtagaaattttctttaccaaatttgtttttgcagattcccaacgctggagaaatcttactgcgcagactcgagagacaccgaacgctcgcacaacactaattggatcactgaagtgcatttttcaaaccgaggaagcaataaactttggatctctgaagtggcaaaaattaaaaaaagaattcgttctctcaatctcagaaagagtcttgggcaagcaaggttctctagctcaaccggatgtatacatgaacaactactcaaggttagaaacctacttttttttcctcgaaaacacattagagaattgttcctcatttaattaagaagaaagataaagaaaacaaatacaaaagagagaatataaactgtcctccccataaatcacaaccacccatccatacaccaactaaaaggcgcgacgcacaagaccagctctagctgtccagattaagcgacctacatatagaagcttatggaggacttgggctccagctaagcaccacaaattactctcattttttactgctctaatgcttgtgctaattttggtgctaactgctacagttttattcgctcaactatatccatgctggactttctgcagaatcagttaagtttcctttagtttttcttctgtatgtatgtactccttaagattttcagaaaaggctacattagttagacctgttgtcaattaaccgtgtgctttttgattcttcatgtagttgccgttcccatgtttgttgaagaaactatcgggactatgtttcgccatactcctatacacacgttttgctggatatataagaaaagggacatgtcagttatcactttgcaaaggattcagatggtcttcggcctaggaaggtacgttctacggcctttttctatatatttattctatttttttttcaattacaaaggctagaactcccaaacccaatgacgaaccttgcctgcctgcccttcagagggaagcataagttcagaaaatgccactctcaaagacatgatctttgggataagacagttgacctcccatgaaacactgaactgtgcaaagcgaaaaaaacgacttaatgaaacattattgttgactcagagtacaacttttttttatatcaagggacttgaaacacagccaaattctaattgaagcatttttatatcagacgtgaaacatatagctctaactattgaaacattacaaaaagtatttgttgaatacatccagaaaatatgttgtgcaacatttgatttaactgaaaattaccacctccactaacctcttcctcaaacaccgcccgcggctatgccatcatcaccaattctccttcaggctttgttccgtttagaggggattgagggggaataatttcacaccacaataggtgtggaataaatcccctccaatccctttcttatgggggttaaccgaacaaggcctcatagagcatggccccttacatcaccccacaccccctttttcctagctcggatctatgccattatggcactgagctccctgtcccctaggccaccatcgtcagttgcttccccttggttcctcccttcgcctaggtcgctgtcacatactataccctgagccctccccccctctcccgttctgcctatgcctatcttgagcttccgcactccggtagtgagcaacggtgtatcaaggaggatcatcatgatgagatgttgttgcattcctatgtttgaggagggagcaagaaaggaatggtgagatctggaggtagcaaggaaggagatagagtaaagctgagagtgggggggtgtgagggtgcccagtctgagtggttatcggtgtgctcagtggcgaacccagaacaaaagttaccgggggtccaatacatactaattatctaattattgactaatatattaattaatatagtgtaatttatataggatttgaataatctacccggtatcttgtgacaccggatagtataacctaggcacgcccctgggtgtgctacgggaaacattttctgaatctttgaaatgcccactagctctctctgtgacatgcatgcttggacccatattcaacgagacttggatcattgtttcgcttggacccatatacttgtctagtaaatgctataaaataaacaacgatgaaaaaccaaaaaatcaacttcaaaattaaattttagctataaaataatccacgatgaaaaaacacaaaaacatatttaaaattaaattttagcttataagcataagtataaatgaaacgaaatagtggggattgcctacagtgttgctggtacagtagcagacattgatattcaacagtattgtagaggatctacatccgagtgcaaatctctttacttgtggcatttcctttcatctcccctccatgtgccttgcagccgtgcttcagctccaaagtagcgagattactaagtagtgcatgtgcgctagaaacatatctcgcgcgcacgtggaaacgcggagactggggtggagacgacgtccttaccgtacgggatgtgtacgttgtacgttgatcattttccttaaaaaatgtaatttttctttctttttttttcaaaaagagtgtcaactccttttttttaaaaaaaatgacaacattctattgaaatatttacaactttatttaaattgaaaagtaaaaataaaattaattaaattataaaaactttcgactcaaatttcaaaaacttttgacttaaattttgaaaactgtcaacttaagattttaaagtttttttactcatatttgaaaactttcaacttaggattttaaagttttttactcacttattgatttgatgaaactaatttagtattataaatattactatatttgtttataaacttagtcaaacttaaaactgtttgactttaaccaaaataaaaacgtcttatgacctgaaacagagatgtcacactagcacgacttggcaataggcaatagaagcacgagggtggcgacaagcaaggacgacttgtctcaaccaaaggctggaccaacagcacacatcggtctcaatcatccacttgtgcgtgatgctctaaaatgatgcaactaaaaacaacttcacaccaggccaccaggggcagaatattattagaaaaaatggctttgccacgtattagaataatcgattttgcaactcaaggaggacctacagttttttttttcagtcgaacaccctactagtagtatgctacataactccttttcgaggtaaaatcccctagcactgctgatcgtatgatgcgacagcttgtgtagtttcctttaggaggatcaattttgcaacaagtgaatggcatttattctttcgccacgtatatgcgcatgacatgtggtccctggacctgattgtcatgtactcgggccgtggccacaaataagcaaatgcgactcaactatataaagggtacaagagcacatttccttttcgaaaatggcacgatacgtaatgtagaatgatttcctgaaaccaaaggaaggtatttgtgccaacactcaattgccctgagtatttagggcagtcctagtggtggtggagctagaaaatttttcatggttatttatgtagatttggatggatttatatgaaaatttaagagtctaaggatgaatgcgaaaaggctatggagtcagctcacacatggcagcgccaccaatacatatattactaatcaaatgtgctaatttaatatcacatctcttacatcatgttttcgatactccaggtctcatgccaaacataattccatcatttttttctcatttagtatggagccttcgatgtgcatactccatgtagttgggttcccaaacggggaaaaattctccacgcgtgcatcacttctctttgccatggtgctcacttgtcatattgtgttttgtgacacgctgaggtgctgataaaccttcttttgtgacgctgaattatcatacacccaaccattcatttcattttacgcgatgcgagagttggttttcggccgccgggatgccggcccgtcccacagtgtgcagcctggcctgagttggatgagaggcctggagggcaaattcccggtgcacatcagactacccatcgtctcgtcctcttgctgtctagcataaataaaccaccaaccaccagagccctagcccgtaggcgccgtcacacgagaaccctcggagcctcagccgcctctgcgaagtcgagccaaggagctgcgccggcaccgcctccacgcccttccaccgccggctccgtctcgttggtgccctttcgtcctccggctcttgtgcaggtcgctgccgcctcctctccacgcagatcgagatttggctggtaatatactgctcacgcgaatcttgcccttccgtgtttagattagattgaagagtgggagaccatacaattcaattcttagacgtaggatttcctacggaatcaaacctagctaggaactaggaccaatacataaatggaacatattattttagcctgcaatatctcataagctttgtcaatcgtcttggtctcctgactctccatgtttcgggttggaagttgccttgcagtcaccttgcagcgcaacagggtatttacctccacccgtaattgattgatgaaattgttcttcgtatggacctgtccaataacaaagaaaaacatatgcatggttgtctacaagtgcccatgttgttgcagctacccttgagtataaattgcactcccatcgggtagacacttctttccaatactgtgaatacattagtgggtctgtcagttggcacagaataaccacccactatgtgcgcccagtctttttgtaacagatcaataaaaaaaaaagatgtggacctgattcagcttagtcacaaaaatagcatgtggaatctttctgacatttccttctaatcacagtctttattccttttaatgatgtctttagttaatgataaatgataaattgccaactgtaaattttcattggtcacatgctctccaatatgctgtgctggaattgcttctacctagtcagacttgtaactgtaaatttcaatgcgccacatggctgaattgcttatgttcatagttctctggtttgtctgattaaggtttaattatctgtatactatttcaatagatggcaccaccagacaatttctccaatgcattagagagatgggtataccgcaactgtgtcagctctatcgtttgtgtggagctccgaccagaacctaatcttcttttagactggcagaatcatttgtttcctattcctgatgatccagaagcggatgatcagcttgctcagagggtggcggactgcctagtccccgtgcattgccctggtttcgtgatagaaccattactacaggatcccttgcatattcatgtgttgacatgtgcacatgcactaggcccagtgttcaatgccgagcagccaatagatgtagacgatattaatattctgtatcaacctcatattatctgtgaccatatgtagcaagcgtacctgaatgagctccagcataacaatcagattgcgagggagtatgtaataggaacagtgcttgccattgactgtgctagcgatttacttcttattcagagcacaagagtccactttatgttgcgctgtgggatgcctcaccccccattacctattgcttctcagtttcccaaacctctcagtaaggttgtcatggtctcttggccacatcctacgaggaatcggactgcagtcactggagagatctcacacccgggtcgacagtttgatgagttaagcccagtgaatcctttgggttttacaacgatgctgtctgaggttcaaattcgatcagaacaaggaagctccggggggcctttgctgaatggtcaggttcaagttacgggcctcttgcatggtggcaatggcagtttttcattcttcatttctcttccgaatggggtaaggcacaagaacgacctaccttctaatgttcacatatgtttcctaatttaaattaatgcctattatataagtttctaatttcgattgtttgtatttgtaggattccttgtatgatttgctggccctgattcaacattgctccgccccctttacctctttctggatgctgtgtgtatgggtgaacatgctgcgacttttttgagatagttgcaacttgctctacgtttgcgatgatctatgaatttttggtagaacctactttacctgtctgttcctggtaaagatgagaattttgtacctaagatattttccttaagctcaaagattcctggtcctgtttgaaaatgatcggatacggttatatcttaaagatgagaattttgtatctaagatattttccttaagctcaaagattccttttcctgtttgaaaatgaagatacggttatatttgccaagtccaataatggacttcgttatgaagttgtgcacgtgtatgtgaggctggatgtcagcatgtgtggttagtcgttgaatttcccttgcaacttcctctgcgttttatccgatgttcttgatttcttattcctctgcattttatccgatgttcttgatttcttattaatattttcactttgcaaaatgacaaaaaccattctagcaataactgaacaaaaagaaacatgaatctgcataagattgattggttccacagctgtgggaaaagtagaagccggtttggttagagcagctgtgaaactgtagatgtagaagaaatacatgttatgaagaaattttaagcataaataattttaagcattcgtgatagtacttgacaaactgaaattgttcactatttggcaacttagaagtataaagcataaacatgtataagagcaatcagattgtgacctcaccaaagctgctatatgttgtcagaaaccaaagatatatagaaaatagtactgattgataaagcataactttagcaccataggtttcaattttatgcacagtagaattaaagtttgaatgtaaaaaaaaatgtattgcactctatatttctatataaattatagaaaatcatagaactgcttggcgttggcccggcagtattatcaattgattgattctgattatctagaaactgtaatatagtgagtgtaaatttcatagtaattgatatagtctaatattttatcagaagttgaagcagcctaagtatcagtctacaaaacaatgcaatctatttttgtgtttttcaacagtcataagccgaaattaaaaaaaaacagctgcattgaaaatgaacttgtcatatatatctatagtcataagctactctaaggctcagttcgtttgtgatggttcccaacctctcattctcgatttccgcgcgcacgtttttcaaactactattttgatgtgttttttgtaaaaaagtttttatacgaaagttgtttaaaaaaaatcatattgtttcatttttgaaaaaaaaaattagctaatacttaattaatcacgcgctaatggatcgttccgtttttcgtgccagagccaaacattcccaacctgctctttcgaacagagcctaagttattacaaaacatcctaagtatcagtctacagaacattgcattccagcctatgttttccaattctcaaagaaacacatgaggtgcttcaggctgaatgttttggttcaagatcacaaaacacatgaggtgcttcagtctgaatgttttggttcaagatacctttcggcggcggaggaacgacggcgtggctccatatcggcagcggttgaggcggaggccgaggaggaggtcgccgaagcagtttgtcggaggagaccggcgatgcgtgacgattttggtagcggagggacagcggcggcggcagtgatgccggttgagatggagtccgaggagacttcagcggccgagggacagcaacgggagaccggatcggcgatgttggttgaggcggcggtggcaggtagtcgtcggagaggcggcgaagaaaaaaattccagatctagaagagaagctatggttaacgcaagaaaattcaagaaaaaatgggtgggagatagagggatgatggtcatttcatattagcttgtacattcaaactaattttattctgttcacttataaaatcatatcaagagatttttatgaaatgaccatcagacttcataattgtaacgccccgattttcgttcggaattaaaaattattaaataatgcattttctagaaattaaataaaagttaaatcaatttaatcaagtgaaataatgggagtatttgaaatttcctttaaaaatcattggccgagaatattttgtaatattttttgtgccctaatatactctccggaattttccgtaaattttcggagctcaagaagtaattttaatagcacaaagttcatttaaccaatttaataaaaaaaacaattaaatctcccctccttcactttgggccacttccggcccaagaatccttcccctcccccgtggcccgcgcgcccctccccctctcgggcctctctctctctccccctcggcctgctcgcccttgaagtctaaataaccccctgctccctctctccctcaggccgacaagtgggaccgcgggatccacttgtcaggtccatccccaaccttcctccatcccggccagcaaccgcccgaagccgccatgccgcccgttgccgcccacgtcgccgccgattccgggtcctcccgctcacgccctcgcgcccaaaccaagtaaaatcggttccccaccacctcctccaccttttcccctacttttccccaatttttggcgccaaattgagctccacttcgcccacgtcggcgtcccacgtcgccggccggttgccgcccgatcccgcctctcccggccacgatctccatccccgagccctatataaagcacccccgtgctcccctcttccgtttcccctcctcgcccgagctccccgtgccctttcccgctctccccgcgtcgctacctctctccactgtcgccggcgagctccagccgcctctagccgccgctcccgccgtccccgcgccgcgccgcttgtgccgccggcatcgccgctccacaccgcaccccggcccccacctttcttcccctaaccgtcgccgaaaccccaccgccaccgccgacccgagctacatcaccgccagccacctccagccgcacgccgtcgccgcctgagccgctccagcaccgtgccaccaccgcagccagttgcgccgccgcgagagcaggcctgtccgccactcttctccaccaaaacggctccgcaaggacgaggatgtcctcggccgccgcccctcttcaccggaaatccgccggagttccccttcccttcgcgcgccggtgagctcccctaattccttcgccttcggccggtttttcccgctgcttcacgccttctcccatcctcctaaccataccactgcattccccatgtccttgcagccgccgtccgccggttcccgctcgcggaacgccgccggaccgccgtcaccgttgtctccccgaggagcgccgccgccttcccgtcctcaccttgtcgtcctgttcgctcggtgagcatccctccctctccctctatctccccttcgccggtcgcccgcgttgcgccgccgccgccggtggccatccggctaggccgtcgtcgccgccgttcgccgccgctcggccggccggtctcggccgcgcccgcccttccctgtggccgtccgtggaccggcgtggtcctggtccacggcgcacccgaggtcgcggtggaccgtgtccaccgtgggccgcccccttgagccgctgatgcctggggcccacctgtcggcgctggttcccctttgatgacgtcagcagcaggcctttcctttgagaaattatttaataattgcgtcataaatcaataataattctagaaattcatataaatggctcaaaacttctaaaattcatatctaattcattcgaactccaaattgcgccattcaacttgcaaaattcatctaaaattgagttctacatgtaagtttactttttatgtaatgtttccttggtttttattagagtttttcctcattttgcgtgccagcgtgtagaatccgtcgttttggaagtccgcggtcgtgaggaaaagagttcggaagatcgaagtgaagaagcaaggcaagtcacacattccccttgagcattttgatcctaatttataaacgttttaccgtttgtaaataaacatgcatgtcttgctaattacatgggatccgggtattacctatctgcttgcttatgccatgtttacttgatatctgtcccttgtcaatattgggtaataaatcgactagctcatgttacttatgtgacctagctagaactatatgcttagccatgcttaattacaactagctcagttgatatgataattacagtattagacctttttagtatcagaatgagctgcgtgctcgagacatctggccatgcttcatggtcgtaattatccaactaaaatgcgactgtatggtgggctgtgggtgcatggctttgctaatcacacccatggcagttaaggaccggttcgcgggaaaccctggaagaattcagcgtacttaccccaagtcagcgtgggcaacggctgggcttgtagtgtagctttcctctagctaacgcatccaggcaagggtaggcgtgatggagtttggatgggccctgcgacggcctatgcagcttccggattcacctaggcacgagaggggactgcccgctgccttgcgaggagtggggttgaaacctaaggtgtggtgtgcttggttagagggggttatgcgaaaggtcctgtcatggcctctttccggtatgtcgtggtggcatgtcagcgcacggtaacatgtcgtggggctgtgtcttgtgggcagttgtacacctctgatcagagtaaaactattcgaatagccgtgcccgcggttatgggcggtcgaccagattcaccgtgattagtcccaccttaataaatcgactcaatgcactgtagttcaggtgttttggttgggcctgttcaacgtggtgtagcgttgatcagtggagatttaatgctactttaattactcaacagtgttactgttttgctcaataaaacgttttacaaccgccttttatgcaaatagcctcaaaccatccttgtattccccttgcacgtctgcatcgttggtgtggcttgctgagtacggtggttgtactcagccttgctattattcccccttttcagaagtgtagtgcttctgagctgaagacggagttagaagaccaaggctcagaccccagttgagttttgcctgtggagtggagctgaagccccgctaggatcgccttttttccactgttgctgcttttgtttcggtgtgaggactaagtgcctcttctgtaagtattttacgctttatttatgtttggaactgtttattacttgtcgttttgtgtaccctagctgatcctgtacagggatttaatgcacaaaatagtctgaaaatttgggctaaatttttgggcgtgacaataatgctggatcatataattatgatggtgtttcccattcaacaggtttctgacaaacaatgcacatatacattacaagagaattgtctgtgacgtcgcagatcaaaatggggacatgtgatcaacctaacaaactgggtatttcttaaatgaacccaccccaacagaagaaaagaaagaaaaacaacaactgtccggtattcctctgtctgcaatgtagggaaaaatcattaccaacggaaatcatttgtataatcaccccccccccccccaatgcatcagctatcaatgtagaccaaaagattcagcaatatgaaagttgaattagggaaaccattattaatctacctataacaggaaaagataatctttagcatatcattttgtacccacagctttttcacataagcattttaacaaacacaaattgtgcacacacctgatgaagacaaggaagcagcagtcctccacactcacactgccacaggagtaggcgtcaacggcggtggcgttgtcggcgggggattcagtgtcggcgtcggcgaggaggagtcactgcctggggtggcggcgtctgtggcaggtgggcggaaggaggaaaggcggggggggggggggacaacgtctgcgctagtcgtc

SEQ ID NO: 80992 - DNA, 6587 bp, Oryza sativa
cattgggcctgataattagttactaagtgcggatttgcgggccctgaacacgtgcacatgttgcaccggccagtatatgggcctgatcacgacttcaccatcacactactggtattgttttaatatgcattcatgcttatcaacaacatcaagtgtactatcaatgatctatttccttttttaagatctcttacctcatcggagataaaggaatatcaaccgttggatctacaataaatggatggcccaaaacaattttgggaatacagtaaaaatatcccctcttttataatactcaatgcgttaatttgacccagaatgtttgttttctcaaagatagtgtttgacgttcttgatattgttccaccacagagggtatcccttgctgaccttttcaggtcataaatcggaattacagatatgcataagcttcactcaactagccaacaactaagcttaaacatctgacgaagcaaactctaccaatatatatatacaagaccctttttgttctgtcataaaatatatattcaccttccaaaccacagctttatatggaagttggacaatgtgtgtaaagcagaaaaaggagagaagtgggagtaacttaagcacatcattttgctgcagatgttgcactagggagatcgaagctgccaattatcaatatatagctttggatcgatggctagacacatacattatttaaatttccatattaattgtgtcttcaggcgtgcatgtgacctctgtgtaggaataagagtcgttaggaaaatagagatcgcgagcgtcttcatcggttgagcatcagcaattatttcctccggcttaaggtgtcttccaagctgtgttctcttagttcattgtatttcgtgaagcttgagataatatatattcatgacatatatgatgatagagctgcaactatagggcatgagctaattaattcgattcaagatgattaattgtttctgtctggcacgatggctctttgatctcaaaatctattgtatactaaaaattcattagacgtcctaaaaacgctcttaagccgtcatacatgtgacactactacaaatgttcctgggctgtcacgagacatacgctctattttctgaaaagaaatagttagatctatcttctaaagaaaagaattccgaaacctgctgttcagcatgcaggtagctagccatccctcctgttgatttccttttcttctctctcctatggtggtagttaagttagttaagttaaaacatactatctaattccttttttatggccatgcaagcatacataatggtctcggtagtaggttttataaatagataaacaatcttttaaatggttgtaactttcaagttatatttcaatttattacctatttgcacttgtatttttaattaaatcaataatttaaaatcaaatagactaaatttccaatgctacaactgttgaacccacatttatcccgagacctctactaaatacaatcaaagcatcccactttattttttttacttatggactgttagacatctaataactttgtaaaaacttaactaatttttgtcaacatatatctacacaaattgatcttaatgttttaatagataaacattttatatgatcatagcacctagcttatagatatgatctatgaagtcactaataaattagagaaaagtatttaaatgatacaattattttgttatggacacatttatccatgctaagttagggcggaggtcgaaaacattacaggatgcttgatagtatggtgtaacaccctgaaaattcgaccgacaaaaatcaaaactctaaaaatgcggattttcaaaaactttttaaataaattgcatcatgccgattttattcgattattttattggagtttgggttcagagtttataaatcgcgaataatggataattggttaggaataaaccctaaaaagtaaatggacaaagtaaataattaaagtgcaatttaaaataagatttggtgaggatagaaataagtaaaatattattacgaccatatttatatccatcaaatttaaaagcaatggaatgagaattaactctaataagttcaagtaaattacaataataatatataaaacatggaataaattaatctagaatgaatccatggattggaatggcgcaaatattgagtatacttcatttatgcaaaatttgggaattaaagaatcaaatttaaataataaataggccaaaatcgggttaattagaaaatggcactgttcattgcacctaaagtgttcgacgaggtcccctagccctagcccctcctttgccgcgttgccctcgcgccccgcgtgccgcgcgccgctccgcctcccctctgccgacgccgttgccatcaccgcgcctagccgcccctaaccccgcgccgtcgtcgccgtcgtttccgtcggtcgccgcgccgccgttccatcgccttgcgccgcgcaccgccgctaccgccgtgccgtcgcgcgtcgctcgacgccatcccgtcgcgccgtcccatcgcgctgtcccatcgcgtcgcgcgccgtcccgtcgccactgccgagccgtcgccactgccgagccgtcgccgtcgtcgcctcgcgccccgtgccgcgccgctcccccgagccccgtgctgccgctgctaccgcgccgcgctgcccgttccatcgccgcgcgccgtaggcgttcggccaacgcgtcgccgttgccgcgctatcgccatcgcgcgtcgcatcacctgccgcgccgcgcccccaagccccgtgccgccgctgctgccgcgccgctgccgctcctcgcgccccgcgccctgccgcgccgcgccaccccgccgacgccatgaggccgccgcccctctcccctcttccccattatctctctccccccctcccttatataagcccccctactcccactcttccccttcatcctcacctcctctcctctacccacgccaccacgccgccgcctccacgccgccgcgccgccgcctccacgccgccgcgccgccgcctccacgccgccgcgccgtcgcatagagccgccgcgccgccgccacgaagccgccgcgccgcgccgcaccttgcgccgacgtcgccaccgtcgccgtcgccgccgtcgccgccaccgcagtcggtaagccgccgcctcctccacttgctcggccgccgtcgccgccctgggtagcagagagccgagagagagagagagagagagggagaaaccgagggagagaaagaagaaggaaggtggagagaaaccgggagggagagggagaaggaaaaagaaaagaaaagggagagagagaaggaaaaagaaaagaaaagagagagagaaagaaaaaaaaaagaaaaagaaaggaaggaaaaagaaaaagaagggaagaaaaagaaaaagggaaatagataggaaattagagggagattagggaagtttagaaaatttaaaataattagcatttagttatagactagttatagacgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgattcacagtagaaattcggatttaatcactaggatttttagacgtatattatatttagtcgtttagtcctagactaaaattaaatcgtataatattataagataattataggattccgtccgatatttagcttgcgatagaaatttccaacctattatatggatataatgctcgggtagattaaattaaaaacttatgataacaaaatatttatacccgcaaaatagtttaggatataaaaatcgaaattgggtttgccctagttcgcgaatagtaaagttaatataaaagaatcgacttacgcgttcgacttccatttggatttatttggatttttatttgaattctaaccgaattcaaatcaattttcgtacgtaactatagagcccgagggagttgcggatccaagtgaaggccaagacccgcaagactttgagcaaggcaagtcatcactattcttgaacatattgatcccaattgcgaaattgttttgtttacaaataaaattgcatgcaatgaggaacatcctacttgcgattatgccatgccttgattattgtttaccccttattcctttgtaaccatgtttacgtatgagtccctagtcaactatgacaaatgcttagaaatgctattctagaatcatgcatactcatatttgtcaaatgctatatgcttggacaattacctttgggaaggtaattgagatgcggcatgtggagacatgagcgccacattgccatgatattgaggacatgatttgtgaaaggagaaataaactaaataactgttttcgactggggcggacggaggatttgggtggtatctggaaaaggctagtaccgtctccggtcaattaaggaccgagccatgaaattaagcatgaaacgaccctcgtacaactgcacttctcgtatgggtatagacctagcggagtagatagccgagcggaggcagtatccctgcatagatggttcacccctgagtgaggcaggtgcgttacggtgggacagccgttgaggtagggccaagaggcgtgccctacatcggtgtcgccattggtaggactgccatgagtgtgtgtgagagagaacttaacttgaaccataatttaatatgtgtgtgagacttctctttcccgggagcgccagaactcctctcactactagaaacatggacgcctagagtgcatgaggatttaagttcatggagcgggtactgccaatgcgaggttatcaaaaggctttgccgtggcgcgtctcatgtgttgggacgaggctcatgtgttgggcagtcgcggagtgcgggtaaagtgtacatccactatagtgtgagtaaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcgggaatgtggacgtcctcagaaaaccataacgactcaatggcgggaagctatccttgggatcacaatggatggtggacagaaccgtcattgtttaatatgaacacaggtattaaaacttgatcagtctatgctaggtcttaggcttgtgaaaagaattacaaaacttgctttgtgcaaaagaaccatagacatcctttgaattcctctgtcatgtgcatcattgctgtggtggcttgctgagtacggttggtactcacccttgcaaatataaaattaatcagaagcgggagatgaagcttcggaggatccctatgcctactaccaggagggagatgaagacgatggcactcagtaggtcttagttacggtcgttacttgtggcaatggcgtgccgctgccttaactccgctgccttacctacttctgtttttggaatgtattccggaccgctcggtccgatgatttaagactgtgcctgcgggcttatgatgtaataatttgtactagactctcgtatatgtgcacttgatatttcagctataagttcgtgtgtaccagactacttgatccagggaaatggtactgtttacacgattgattcctgttataaaaacggggtccacatatggaaatccccaaaatttattaaaaaatggacataataaatttgattaaaaaaaaaatccaaaattgataaactttgttgaattcaaaacccatgctaaattgaaaaaaaattgaacattttagtaggactgataaaataaaaaaatacataaattttcaaataaaatctataaaacaaatttgcacattttttggctagggggccaggggtgtaagatatcctattggggaggtgaaatacccaaactttcagaaatttcagtttgaaatatagaacccttggctgcaatttaggaggggtgaagaaaacactctttccaaaaaaaaactctctccgattcgtaaaaaaaattaaaataaaggccattgagttatttttcgtataactgctaaaccatagaaagcaaagacatgcttctagagtgccccacgacatagaaataatcatattagaaagtttgagtatgtaatactttacaaatatacaaagctaaattaatcgactcatgtacaaacaaaccaatgaaatctgtctataaatgacactcttaacaattattatctcgatcccataatataagggatcatgaattaaggacaaaggaaaaactatgatacctttaattaaaaaggttatgtctagagtgggaagatggttggagtataattaggtcaaaattaaatgaggggtggttggatgaggcaagtactactatagaattattaataatatacaaaggacgtaactacacagctacacagctagtggtagctggtttataaaccagctaccactccatctataaaac

SEQ ID NO: 80993 - DNA, 11369 bp, Oryza sativa
cactacatatgtgatttgcactacatattttccgccgaaaaagagtatatattgtagcaacttcaggatgaaggtccaatgaacttagcatattttcttcatggcgatgatgtgttccagggaacgatggatggataagtcgttcctcgatcctaggttgaccccaaatttttaaatttaatttctggttaacttatcgctgtttataacagactgcccatatttagctatgggagctactgcactgtacatcattgagttggctgggggggatagctacaaagatcaaaaacctttctgattaatgccactccatttcatattatatgttattttgacattggtcaacgtcaaaactaagtttgtagaaaaaatgtaataacattttcaacccaaaccaaatataacataaaactatattcaaatatcgatttaatgaaattaatttggtgttataaatattactatatttatctacaaacttaaataacttatagtctgaaacgggggagtacaacttactacactccagccttacaagaaaataaaaggatggccattagctagtacatcactgatgtgtcaaaattagaacatcattgttgtgatgacacaaaattaagtcaaagtgcagtgacagctgaaatctatctatgaacatcatcgcagcatcagttgagatggctacaaaatgtcagatggaatcatacatgagaaggtactcaaaggaggagagatagcagtaaattaagtgttaatgtgtaatcttaattggtgttaggatggagtttcaggacatgacttcctaaaatatgatacttatataactggttagctgtatagtggtgtccttgttgaccatctgctggcaagaggcggatgttatgtttgttgtgcatgtgcagataactaggatatggccagttacatcagcatggtggcataatcctaggatcgttctagacaatttcttgatgcctcttaatcctacaagggtccattcatgtatgcataattgaatgttgtctttaaagaaaggctaatttccttagtttacagttcttgttttgtctgggcagctcatgttctcgccttcattcacctgcaggtaaaaaattgaatatgattggacatatacagcctgtggttctttgttcttggataatcaagtggagatcaggaaaaaatgtcgagaaatcaacaaccatgcattcaatgatgttaaggaaataaatgcatatggaaagatgcctgcttttaacttttggaaaaagtacgaattacacccctgaactattacgatcgatcgaattaccctcctaaactcaaatactagatgttttacatcctgaattattcaaaccggataattaaccctctggctcaatccggagtggttttaatcctacgtggcagtctagtcacctgtaagactctcctccctctatctactctatctcttcctccctcttgtgcaatcccatccccctttctctcctccctccccttctagcagcgagtggcggcggtcgacaaagtcggagctcacgctcggcgaaggtggtggcaatgatggcggagccaaagctcacacatgtggctggggcggttggcaccgaagctccaggcgcagtggcgggcatagctagggcgattgcggcaactaggtcctcttcaaaggggaggatcacggcagcggcggtggtggagtggaggctttagtcctagaagccggtcttctcccaaatggcgttgcgaacgaggcagaggtcatggtccttgagcgtgcggctggtgccctcgtggacagagaaggacgcggcggtgcgctccaggctgagaaggacgcggcccagcccctgcccctgtggaactcctcgtcgccgcactcatccaacggccaccgcgtcgcgtccgcgcctgcactccccttgccgctgtactccacaccgaggatatttggccaattgaggatgttcactggcagcgatgtcgctgcccctcccccaccaccaccagctccctcccacgccctcgcgccagcgccgccaccacctctcttcccgcccttctacgtcatccccacaagcgtcagcggggcggcacataggtacgtctccatgggcgacaacaatgacgacgctgacatccccgtgcctccctgagctcgccgccaaatctgcaaggactgtgccacttcctccgccgcctctgcgtccactgctggaggtggatctagagccgccgctccaagccccttctcggcttctcctgccatatgtgcagactagagagagagatagagcaaggggagggagggatggcttgacgggagagatgacatgtggacccatgaatttttttatatattttctttgctgactagattaccacgttgacgccacatgtgcaagctcagatcaaaaccacctaaaacagtgctgatggggttaatcatccggtttgaataattcaaggtgtaaaacgtctggtatttgagtttaggaggataattcgatcgatcttaatagttaaggggtgtaattcatacgtttctcttaacttcttacgcgtgttgttttttataaaaaaaaaacctaattttcgaacaagtccccttttactttattggcagttaataaggaaatccacctctgccaaatgacccgggtcaacagtgttgttttaagtcaccggctctaaaaattgatttttagagcacattgttttaatcgagatctgctagtttagaatagcctcattttccagagacggttggcttaagcgtccgcctcaagaaatagcctctccggaaatagcttcactcaaactcgactttgttttacacataatgtcgtcttgtccctgattttaacggactgcagatcgtgaagctattgagttgaatacgctatatctgaagacaaatagagtcaattagaagctttttctgtccacaaaggttaaaatccttacggatatatgctattgtgatttataatatacaacttgcaatttgctacactctagtcagacaagaaaaagaaaaataaaaagaaaaaggatgatgatctctgatgtgtacaaaaatacggttaaagcaccacctgttcatatggaatttgtagccaacaaatgaaaatgttgatcatatgagaacacacaaccaatcagagaacaagaaacatccatcacgcccatcttgttgcgaacataaggtatcctccattttgttaatttgcttacacaagaggtatatatcctccattgatcgctgtacagatctgtacattgtatagctgccgtctgttttagtggtgtagctcctcgctgcaaattttctctccctttcgatcttcagcttctcacagtagtcatgcaagcactaggccaatgcattaacagatactacctccatattttaatgtatgacgctgttaactttttatccaacgtttgaccattcgtctcattcaaaaaatttatgtaattattatttattttattgtgatttgattcatcatcaaatgttctttaagcatgatataaatattttcatatttgcacaaaatttttgaataaaacgaattgtcaaacgttggtcgaaaagtcaacggcgtcatatattaaaatacggagggagtaaatcttaaagaacagactagctaatacccacacataacaatatgaacaagctgagcaatatcaacacaagagcaaatgctatcgacctatactattcaaatccgtgtttccaaatcacttagtcccaatcactgtctctacaatgatcgcggctacatgacttggaatctaggattgaatgaggattaatggtgaatcatgttttcctgataccgctcattcaatatatacatgttggatgccgggctctttgccgtctgctatcatcgatgctagcatgtgtgcaagcaggtagaaataataagaaccgacagaactgagcttgtcgatcagttcgtgtgctaaccattaatattaaccaagtactccctccggggttttttaatagatggtattttattcaaatgttaatttgaccattcgtattatttataaaaaatatgaatatgtaataaaaaatgtaagtaacgctcaaaagacctttaatgataaattaagctactagctaaaaaaacaaatgataattacttcaattattaatttttaataagacgaataatcaaatgtatataaaaaatatttcaacttttaattgttcacataccaatggaataggcagtcacagaatagaatttcaaggaaagcaagttggatataatgccattcaaatagtataaaaggcgagtttaattaaattatatgagctgagcaagctatgatgaaagaagaataatgccatccaagtagaataatgacgtgtggctgtagcttcgttgaagtgaaggtcgggatttattccattatgaaaaaaatagaataatggcatgtgtgggaggcaggtgaaatggaaggtggttaatcgtaaagaaattacttattactctgttgtgcatactactatagtagaacctactatagtgagaagattaaaaactttgatcaatgcactgcatagttacagttaggtagaagtggtaaacaaccaggactttcagctctcgtctctggcctttacctatacctattcgtttttcaaggttgcaaatttgagtgattatgcatcgtttgaagggcacacaattaaactggactaaccatttgcatagtttcaattcaagaaaattggtagcaatttgagatcttttaatcttcaattcttgatttgcaatcagtgagttcgacgatatttacaaacactgatatacaactagataatgaacacgtggaaggaggagtttaaaaggctagaacattgtttcctgcccggagatgatatgatcctgacatgcatgtgtttggaggtattgttcaaggcctgattctgtctcattgcccatgatttaatgttgataccatggaaggttcacaaaaagaagcttggtgttagagaactagcaatgcaggctgcgactgccatctctcgtctcctcctggtgcttctcattctcaacctcttgtatgatgtgttctatgttcttggtagagcatagcatggatgatagcttatagtatctgttctcaccttgtgattttgctctttgactgatgtgggtttttattggtagcgagctgaggtatgggcaggtgaggatgtaaagaagtaaactacagtgtggatgtaaagaagccacttccatgagcactcgatgacctaccataatatttgaccaaattcataaatatttgaaaaaaaaatccaaaaagttcggtggagatttgtgttggagttgttccaaattcacttcaagatattggccgggcttctgacgaagcggagcggtatatatgccctttgctagggtttcgtggagacttgattctcttgtaagccgccataggcgtgtaacccaaaactcttgagatagtgagattgttgctggctggtgcccgtggttttttcccctttcgcattaaaggggttttccacgttaaatcgtgtgtctccgctgtgattgtttttcgtttactttgtatttctatacgtcgttcataacaagtggtatcagagctttggttgctgttagggttcatgacgacgtcgatgaagttcgatcttccgctgctgaactacgacacgcggttctcgctaaggcaagtcaagatgcgggggattctggcgcagactcatgactatgatgaggcactggataacttcggcaagaggagggccgagtggactgctgaggagatccgcaaggatcagaaggcgctcgccctaattcagttgcatcttcataatgatattttgcaggagtgtttgatagagaaaacttctgcagaactatggctgaagctggaatcgatctgtatgtccaaggatctaaccagtaagatgcagatgaagatgaagctgttcactctgaagatgaaggaggaggattcggtgatcacccacatggctgaattcaagaagatcgtggccgacctagtgtcgatggaggtgaagtatgatgatgaggacttaggtcttctactgttatgttctttgccaaattcatatgcaaatttccgtgacaccatacttttgagccgtgatgaactaaccctaaaggaagtttatgatgctctccaaaacaaggagaagatgaaaattatggtgcagaatgacgggtcgtcgtcctcaaagggcgaagctttgcatgtgagaggcagaactgaaaacagaacctcaaatgaaaagaactacgataggagaggccgttcaaagtccaagccgcctggtaataaaaagttctgtgtttattgcaagctgaaaaatcataatattgatgagtgcaagaaggtccaggctaaggaaaggaaaaacaaaaaggatggtaaggtctctgttgcttctgctgctgcttctgatgatgattctggtgattgtctggtagtatttgctggttgtgttgctggtcatgatgaatggattcttgattccgcatgttcgtttcatatttgcactaaaagaaattggtttagttcttacaagcctgtgcagaaaggggatgttgtgcggatgggagatgataacccatgtgctatcgtggggattggatcagttcagatcaagactgatgatggcatgacacgcacgctgaaaaatgtgaggtatataccagggatgtccagaaatcttatttcattgagcacgcttgatgcagaaggttacaaatattccggttcagatggcgttctaaaggtatcaaaaggttctcttgtttgtttgaaaggtgatcttaattctgcaaagttatatgtccttagagggtgtactttaactggttctgattccgctgctgctgctgttactaatgatgaacctagtaagactaacctttggcacatgcgtttgggacatatgagtcaccttggtatgacagaattgatgaagagaaacctgctgaagggctgcacttcgagtaagatcaagttttgtgagcattgtattttcggcaagcataaaagggtacagttcaacacttctgttcacaccaccaaaggtactcttgattatgttcatgctgatttatggggtccttctaagaagccctcacttggtggtgctcgttatatgcttacagttattgatgattactctagaaaggtttggccttattttttgaaacataaagatgatacctttactgcttttaagaactggaaagtaatgattgaaaggcaaactgaaaggaaggtaaaattgcttcgtactgataatggtggagaattttgttcgcatgcctttaatgattattgcagacaggaaggcattgttaggcatcacaccataccccatactccacaacagaatggtgtggccgaacgtatgaacaggaccattatatccagggcccgttgtatgctgtctcatgcaaggatgaacaagcgtttctgggctgaagctgcaagtactgcctgttatttgataaacaggtctccttctattccactaaataagaaaactcctattgaggtatggtctggtatgcctgctgattattcacagttaaaagtttttggatgcactgcttatgctcatgttgacaatggaaaattagagcctagagctgttaagtgtcttttccttggttatggttcgggagtcaaaggctataaattgtggaatcctgaaactgggaagacttttatgagcaggagtgttgtattcaatgaatctgtgatgtttactaacagtttgccctcagaacatgttccagaaaaagagttgcagcgtatgcacatgcaggtggagcatgttgatgatgatacaggtgttcaggtggagcctgttcatgagcaggatgaccataataatgatgttgctgatgatgatgctcatgatgatgttcagcaaactcctcctattttgcagctagaggaggaattacctattgctcaacgcaagtcaaaaaggacaacaaaacctcccaaacgtcttattgaagagtgtaatttgtcttactatgctttgagttgtgctgaacaggtggagaatgttcatgagccagcaacctataaagaagctgttcgttgtggtgatagtgagaattggatgtctgctatgcatgaggagatgcagtctcttgagaagaacagtacatgggaggttgtacccttgcctaagaaaaagaagaccatcagttgcaagtggatcttcaagagaaaggagggtttatattcaagcgagcctccaaagtataaggcaaggttagttgctagaggttacagtcaaattccgggtgttgactataatgatgtgttctctccagtggtaaaacacagttcaattcgtactttccttagtattgttgcttcacatgatcttgagcttgagcagttagatgtgaagactgcgtttttgcatggagagcttgaggaggacatatacatggaccaaccggaagggttcatagtgcctggcaaggaaaaatatgtgtgcaagttgaagcgatccttgtatggtttgaaacagtcccctcgtcagtggaacaagaggtttgattcatttatgttgtcacacagttttaaaagatctaaatatgatagctgtgtttacatcaagcatgttaatggatcacctatatatttgctgttatatgttgatgatatgctgattgctgccaagagtaagattgaaatcactaagttaaagaagctgttgagtagtgagtttgatatgaaagatcttggtagtgctaagaaaattcttggtatggaaattagtagagacagaaaatctggtttgctatttcttagtcaacataattatatcaagaaagttcttcagcgtttcaacatgcaaaatgctaaggctgttagtacccctattgcaccccactttaagttgtcagctgctcagtgtcctagtatagatgcagagattgagtacatgtcaagggttccttattctagtgctgttgggtctttgatgtatgccatggtttgctctcgtccagatttgtcatatgctatgagtcttgttagtagatatatgtctaatcctggcaaagaacattggagggcagttcagtggattttcaggtacctcagaggcacaacatattcatgtttgaagtttggaagaactgataagggccttattggatatgtggattctgattatgctgctgatctggacaggcgaagatcacttactggttatgtgtctactattggcacttgtgctgtgagttggagggctactactacagtctgttgttgctttgtctactactgacgcagaatatatggctatttgtgaagcatgcaaagagttgatttggctaaaaggtttgtacgctgagctcagtggagttgaatcttgcataagtttgcattgtgatagtcaaagtgcaatttacctcactaaagatcagatgttccatgagagaactaagcacatagatatcaagtatcattttgtgcgtgatgtgattgaagaaggtaagctgaaggtatgcaagattagtactcatgataatcctgctgatatgatgacaaagcctattcctgttgctaagtttgagttgtgctcaagcttagttggtttaattgaatagtccaagagactattgttggcaccagtggttttctatctttgttgttcaagatgattggttgatttatgatacaagaagaatttgtctcaaggtggagtttgttggagttgttccaaattcacttcaagatattggccgggcttctgacgaagcggagcggaggcccaagccggaggcttgggcctgctagggtttcgtggagacttgattctcttgtaagccgccataggcgtgtaacccaaaactcttgagatagtgagattgttgctggctggtgcccgtggttttttcccctttcgcattaaaggggttttccacgttaaatcgtgtgtctccgctgtgattgtttttcgtttactttgtatttctatacgtcgttcataacaatttgtacttaccggtggggtgcgaaattaccgaaattttgaaccgaagttttaaaccctgccggtgaatatagaaaggatagagttatcaagatctggtctgctagtcacaaagaaagacctgccactatttttctgcacctcgtgcagtgatgagctaactgatgacgggtgtccttcctcaattgaactactccattgtttctgcaacacagatggacagattaatgatgggatcagttctgtgttgaactactccctccgtcctaaaatataaccacttttaaactttgatatagtctccaagatgttactttgaccaataatagctataaaagtaagatgttttaaataaaagagttatacattatgatagtttgtttaatgataaatctagtaacatcaattttacatgagtgatcctttttatttttttttataaatagtgaagtttgaaaatgtttgacttatcactatgttaaaaatacttatattttgggacgaagggagtacaaaggattgcatcatccgatgtgaaaggccacacggtcagatgagatcatgcatgagagggtattcgaggtacaaattaaattaccagcaaatttggtgttagtctataatctgaagggccattactacgctggagatggaccatcgcctgaaatttgaaatactaatatagaagtacagaatacatccgtgcaacttaaccttgatttggtttctgaaaaatccttacaagtggatatcaatcatcacttgtacctggcattgtgttttatagggagccctaagtggatcaccactcaagtcttggtttatacttttatattgttggacgcactaccaatgtcgtgtgtatgagtcaacttataaatatttggcttgtaaacttgagaaggtcaagcaacacaaaacacgtaccagattccctatttctactatatatatatacatatatatacacacatatatgtatatacatatatatatatacatatatatatatatatatagagagagagagagagagacacacacacacatacactcatgttgttacttaaatttgcttcggtgctctgtctggatgcatgctaattgctacagagcatacacgcagtagaaaattggttgtagacctgcattttggatttggaggtgttgggaaagtatagatggcaagacactggagtttcccatccatgtggcttaacaactgcagtgtcccatccattgcattagagttatcacggctggaacgcttcgaaatacatcttcatatcaaata

SEQ ID NO: 80994 - DNA, 83263 bp, Oryza sativa
ctggcgccccaaaaaggaccatttttggataagtttttttaggggtctatttgcgaaataagttttttaaaaggaccaaaatgtgaaaaatccagatttgcacaccctattataccactaccgtcagttgactttgcgttgaccgttaactcaaaagtgaaaagacgtatttgtcccctctaagctgttaggcatgtagtaggttataatgtcagattttttaatttggttgacatatatatatgtatgtacaacatttcagctaggcattacacatattttgaatacatgaatatacagcattaatttatatattgaatatacggatatttttcagtcacataatttttagccactaccatcacgtatattttccacaaagacattatacatgtacaaaagcttcaacatgcagtaaacatatgtttccaaatcatacttagggacaacattgaagccatataatagatcgctaagaacaatatttctgtgtttcacagtataacaaacatatcttgtttgctggagcaagaacatatataaacagcggcacagaaaattgaacaaaaactagccgccgcccctccagcgaccgggcgccgccaccctcgcctgccgcctgcctgctccgacgcctcccctcccgcgaccgcgaccggccgtcgcacctccagtcgctagccctcccgtgaccgaccgccgccctccctggaccaagcgccttcgctgcgccgcctgctcaggggagccgcgccgcctgctcaggggagccgcgccaccccggaccgccgacctcgccgcgccgcctgctctcctccctctagggttttgtcgcgccgcatcctcactctgctcaggtcaatgcctcctccctgctagggtttttttgagaggattttgggcttgggccatttaggccaaaggctatttttgtcatttttgcaaaaatctgacaaggggttagttcctaacaactggcatataagggaagagccgattttcagtgacatataagggatcgggccaatttttagtggcatataagagattctctcaatttttaaaggttccaagaaaaataaataggaacagtggtagatcgagcaaacaaataaaggatgatatggtttgatctttcaaagtcttaagacaacatgataactatttaataaattttaagtaaaatcatattaaaaaatataattttgtatgttactagccccgcaactgcgcgggccacccaactagtttatcataaaataaagtctgtaggactgaaacatctcacatgtaagtgctctttgatttctttttcctcactttcatgaagcttaaagtaaatttaacggtttaaaattatataaaagctatatacaagtttttctgttgttacaacgtaattatatttatattaatattgtatttgttaaatttttaaaagaaaaattgtcgatagtttatagcaaaatcgatgccgattgaactttgcgtgcgtgattgcagggaatcacacgcaatctccggctaatcgtatgtctatcagtggtagacgggcaaatcaaccaactaacccccataattcccctcccgccgctgcgcgcaacggcaccgccaggccacgcatgaccacaaccgcaggtcatgcggccacgcgcacccgtacctcctagctaggcttgcggacggcgacaggcacgcgggggggcgtgggcgccggcggcaacttgagggggcggccgcggtggctggccagaggatcgatcgatcggtcagatatatctggatgcgacgggccgtgtcgtgcagcagctgcctctgccgagccgtgcgaacgctggcacggggcgagccgcgcgccaagcgatcgggcggcgcgcgcggtatacgcctggtcggaggaggaggcgtgtcgcgagtccgtttccgtgagacgcaggggggatatcatatccacgtatatagagtatagtactacgtgtagtagtagcgaccttagcgagccaaatattatctgggcactgtacggggcaggcgggcagccgtgcactgctacgattagtcggtacatcaatctgcatgcgaactgttgcgtgttccatccacggcgccgtggaacggtggaagcaagaacgaccggccggctgtacggtggagatcgatgggcacgcataaaactgcatttactcgaaagaggccggtggcatgggcgcacaggcaaagtttaatgatcgaaaagaatgtcggggcaagttgtacgtactgtgacgctgatactaggcggtggggatacaatacaggagcacacgaaagcggttttcggctgtggtaaatggtgacaggtttattgttttcgttttcttcctttattttgtcctgttagagggattcgggctagtttgatttgaggccggtttttctttaaaagttttggaataactactaaatttgttagagtagaatatttattagtataggcaaaatttttcatcaaacaaatattatacaatactgttaaagttgttaaaattttggttggataaaaaatagcttcaatctaaacaatcattggtgtttgattcttgtcattaagggattgtatcatactgttatcaataatcatttttgttttattatcgctgtacactacagtttttccaaatactaaggggagaaaaccctagctgccgcctaagcataccaccacggtgcaggcgcaaggaaggtggctatggggctttcaccgtcgcgtgtcttctatgtggtagccattagtagcggctagccacaaattatcgatggcctagcgtcgtccggttgaggaacgtgtggatggatacgatgacaacgggtagtttcgccaacatcaccgatcgatgaaaccacaaccccgtagcactatggtgatgtttcgggttgttgccgcagtggccgcctcgacctactttacattgctgactcctcctgttagattgttggtgccggtgccacttcaaaggacatgtctcccatactatagcgttccgagtcccttgttgtatgatcgcctatgttgtttctctatccatattcaatgcataatcgtttcatcctcgatctcgagagattgggtatggccttgaggtcgcgatggctctggcaacaaagaacctcaccagataagctgtggcagggactaaatatcccaattttgcagaaggaacacaaccttgtctcgattctatggtttgctcagtgggcgatgggaagttggtactgttctgggaggattgctggctacagggctcttcaattcggtcactcgcgccggctgtctacgcagctgttcccgctcggttccggaacaggcgaacggtggttgaggctttgcaagacaagaggtggactcgagacatctctgcggcgctggggatccaggcaatactggaatatctcaagctttgggaccttcttcgatcggttcagcttggggagggactggacacgatctcttggcgttgggagagttcggggatttactctgcacgctcggcgtatcgtcttctcttcttgggaagaaccaacctcaagcacaagccaatttggaagtctctagcgcctcctcgctatcggtacttcttgtggctggtcgccctcaatcgttgttggacagcggatcgccttcggagttgagggctgtcacacccggctcactgccttctttgcgatcaatgtgatgagacgattgatcacttattggacgcttgcccgaagtctcgctggctatggtggattgctctttcagctattggtcatctgagtgtctacctctcaatgagcactcttttcattcctgttgtgtgacagtcgcaaaagaatggcaaaggagcatcgtcgaggatttgacaccattgcaactttggtagcatggacgatttggaaggaaagaaacaatcgggtcttcaaccagaagagcaggacatgggcggaaattgctagggccattacgggcgaagcggatctttggcggttggctagagccacaataccggccatggcgattcctatgtcgggtgaaagctaaggtctccaaatccgttaggagattaggcttttgttttcttcctcttccccctcctgtatcttgtccccttcgtttttttgagttttcagcccgcactgtaaatacttttattccttcttaatacaaagatgcgcccctcgcgtattcccaaaaaataatcgttttgcgacatgtgcatgctttgggcgagacgttagttctccctccttgcgaggagagatgctatccgtaattcatttactctccgatgagatcttccgcttcgattcgatgtcagtcattaatggtgatgtgcacgtgaattgatttgcagaacgatcaagcgataatttcagagtctgttttcaacttcaagtttaatttcaaaatttgggaaatgatcatccaggttcaaggtaaggaggtcttcatggttagtagattttatccacaataccaagacttccattcctggatatggaggacagggttaattcgattgaagaaggatatggagttaacgactacatgcatcttacaagctgttgttgaagagacaatgattgtgtagactttcgtcacctatgaatagagattcaccgataagattttttattgataatgctatccatgtcttttagactggtgtttaattattaaaaatgttatggctttttcttttagtagaactcatatatcgtcgtgtatagtcttatgtgtacagcttcattaatcggaatttgatatttcactttagtggggttagaaaaaaaagacaagacaatagtaaaaggaattctaccgttcagaaattgaccaagtttgcccaaagtcccaaagtactggagtagaaggtaccaagatacatcaagtggatctgtggatgcctggcggatatacatctggtggatcttcagccttcaggagtactagccatcgctgttcacggcctatcacgctgggtgggccacgcggcaatttacgaggcccgcacaaacaaacccataaggcctagttgtctggctactccttttgcccacatgcagcccgcgtaccggcttcccaccgcattgggttgggctatcccggaccgcagcttgggagactgagaattggcagcctgcctgtgctgatgtggtggaagtatatacttcgtgaaaaaaaagtgaattgttgttttgtctagtccttcatccgtcagtgaatataatggattatatatttttttaagaactaagaaaatagtaaaaggacatgtgatgggtgaaaaaaataaagtagtataaaagttagtaggtgggagaagaaattagtataaaaatagatcatggaggaataaattagtataaaagttggtcggtgaagaatatagtatttgagattctaaaaccccttatattttaggataaattggatggagaaaatcttttctattcatggacggagggagtagtagactagtagtgagagtggattataaactctcaaatgacatcctttcatggtttacatatcatttaaatgattatgattttttttaaaaaaatatttaataagataaattaatactttctatgttcaaaaatatagtaacgtttagctatgaatttgaacaaacaattatccaatttcatagttaaaaatacttatattcaacttatccaagttaaaaataaataaattaaaccataactaggatgaggagggagatccttcttaggactggacccgcgaggtactcatacggcgtagactgctacgctgcggtccacgaggttcgaatacgcgaggacgacatgccggactggcaaaacgcgctgcatcctgcatgcattgtggtagcccggtaggctggttatgtgcgaaaagtgtagtgcaccaacgttcgcgattataatccggcaaatcagtcggaagggacacgcgaaataggaggacacgccattttctcccattttcatttttttctcttcttttacgtgattcttctttaatccgttgcaagtatcaagtatttctgttttttttctttcacttatgtttatttcttagatttcttttttcgttatacacagtatttttttatatcttcttaacagaaattttctatatataaataatttccatggaaactttctatataccgtgatattttatatatgtaaactttatatagaaattacatcatagctagaaagtttagtgcagaaataacaaaatactaacatggaatttttcaaatgaataatatccttggaaaatttctatacatagactttctatatagagagattttatatatgtaaactttatatatatggactttgaatatataaactttatatatagaaagatcttgttttctgttcgctaggttcgccgctagcgagctttcgcgcattagacatgcctggttatgtgagcctactccatcagagctcggcagctcgcagagaaaacgaatgctggagtactcgtgaaaacgtctagccccatcatttcacatataggagaaaaaaatcaaaacgatatatttgtaaattaaaaataatttttaaataaaactcttatatatatgtgttcttaaaaaatatctaaaaacaaatgttaaaaataaactatgatgaaaaaactctaaaatcaactctaaatttaatgttgaaaacacaaattttggttgataagcgtaacaatactgcttgcatactagggctatgttcggaatcatctgttcccagcatggacagtgcgcacggaaacggagcggtccattagggctaagtattagtttttttttcaaaaatggatcaatatgattttttaagtaattttcgcatagaaacttttttttaaaaaaacacaccgtttagcaatttgaaaagtgtgcgcacggaatacgatagagaggaattgggaacccaagcttccaaacacagcctacttgcagtcatttgcagtataaaacatcttttgtgccatttaattttgtcatcacacagtactcctacttggaaagttggaaacagggcaacacagcctgatactgcctgcggccaggccggtcttgatgtggctgtagagcctcagcaaaaccccagaaaaaacaaaccaaaaaggaaaagaaaaaagaaaaaccgaagcctataaattactacaacatttaatttgggacggacggagtattccacctaggaatagcaacaggtcgggtaggacacgggtagagcgattccatgcctgaccggagacccatgtgcccgcgcccaacccatgcccacaaggtctatcaggcaaaatcctatgcatgtgcccatgcccattgagcacgggcacgggcatatcgggcccgcctgcaccgtgcgccaccactgccgtcgtgcgacgccgcctgcgccgtgcgccaccagctgccgtggggattgaggtaggagaagagagtggggaattaggttagggtttctattagttgagtatatatatgtccctggttagtgggccaagagaaaagggtatgaggaataagagatgggccaaaattagcaaatacatatgtatcgggtcgggtatgggttatccgtgggcaaaaaataatgcccggctgctgtctgctatgttcttgggtctcgggctggcatggccacgggcaaaatattacacccatgcccatgcctatcgggccgggtattcgcggatacccggaccgatgggtaaaattaccatccctaattccacttgggagtaggggtgaaaatgatacgaaaactttccacttgtgttgtaccgttgagacttaacaattggacttatatgattgtgttttatgataaattgttgaccgttgagacttgagaattggatttatcagtttaaggggccttttattccgataaatttttgttactgtatttgcaccggttcgtttttgcgtcgttttcggtttcgataatatccggggtttccaattccgattcagattccgaaaaaaaatataaaaacgaaaacgataaagatggtttccgtctattttcgtaccgttttcatccctactcgggagctaccggaggagcatggagctaccggtcttatgtggctgtagagcctgcagctaccggaggagcttaatgcaatgacgctaagctaggccctgccatgccatcctatgcctgtctctttttcttcggttacagttccaaggtctgaaccatgtgagatcgatgagggcgtcatgaagacttgctcatcctcgagaaccacatgagtacctcgcgggccatggggactggaccatcgagaaccacatgcaggcagtcggccggcctgctgtccatagtgaatgtgacaaaccggcctgtccatagtgaggagcctacatttgctcctcgccgtttgcgtgcgatgttctgcacaaccgagaaccgtgagagagaaagaggctgcgtgcgtgttgtaggctcctactacttctgtagtagccatgaaattcaaggcgactactaacgacgtgcaaaatacgggccgtgcatatatagactgtacgcggcgcacaacacgctgcgtctttgcgtaatgccccaccccgtacacgagtgatccacctccctcttattacagtcttactgttgggatcgacatctctcaatttgggatttagcgtgttgtcagcgacaaatagaacatgtatcttatatgctaaaggtacaccgatttaatttatgtactcgtacgtgaatatttacaagaattacagtgaggtacgtagtgatggcctcttaatatagttgagcagtggctaactaatatgttttcatttacttgtatttcagatctgcctgttcacggtttgggcacaaaccgttcaacccgtgaaaccaaaccaacccaaaccgtttttccatttattcacgggttggtttggaaccggcgtaacccgttgaacccgtgtctcgtccttccccctccgaacctgcgctgagcttccgcggcaacaagacgccatggcgagaaggcatctgcgtgatcgaggaaaccaagcaatagcatcggctatttagctcgcacgtaagtgcaaaacaccgtagacgttggtgccggcagcgccgatgctggcgacgacgccgaggcagccaaacggcggctcccatccgaggaggaaacaatcgctagatcgccgccgccgctggcgtgttggtgtcctgcttgttgcctgcctgcctccatcgcatggaaaggctatacgagccatggtgcaatcggctgctgttgagcttggaaggacagccatggctgtgttgctgttcttatgcttgatccccttctttcacgtacgccggaagaaagaaactttctacggtttaacccgtcaaacccattgaaaccaaaccatatgaaccggtatttctaggttggtttggtttttctgaccaaaccgccaaagttgatgaataccttgaatttcagatatacacaaccattcaaacattttaggatggtctatggatttctcatcttttgtgaatatattattgtattatttttaaaaaacaaccacacttaaatatttatcttcaaaactgaaaatatttagtcacgtgaaatagaaatatctgacataacattagagcatatacaaaagactagccattaagttagccatttcaaaatatagccaacaaaaaatgcttaaaaaaagtatgaataagaaaacacatgattcttgtttttcatgcacaagatgcttacgagttacaagaaagaggctaaagtggactttttttctataaaattatagatagagaataatgttcctatgaaaatcaagatagccaatcatttaaaacgaatgcatctattagtagctaattcaaaggaactagtatcaatctttcattttttccttcacatttccttcatgccgaatgagcccatagcttagttttgtgtattagagattactccgtatgtcatatatataatgaaaccgtggggtgtttcaaataagcgtaaacattgcatgccattccagtaggcatagaaaagcctgaattccggtttgctcttataggacctatgctatatgcatgaatgcagatcgacttcaatgcggtgtataagcataggactccatgtactgtagcactacacgtctgccctctacacactgtgtttagttcgtgaaaaaagttggaagtttagaaaaagttagaagtttataaaaaaagttaaaagcttatatgtgtatgaaagttttggatgtaatatgatgtgatagaaagttagaagttaggggtagttgggggtgaactgaaatggccggccaccatacgccaaactagtcgatcaactgtaaaaatgcagttctaaaaaaaactgtaaaaatgctctgtatataaagagttccaggtctgtaaaatggccaggtgccctcctctctctctctaaaagaacacgtgacgccttcaaagaaacaaacaccagttgacatagtactagtgtactccactccactacggaggagtactatactggctgtgcgcctatggctatgtatgcggctacagcgaaacatgggagctacaggtagaattttgtcgtcttcacttgtcgcctgcggcctcaccagacagcaggactgagccgacgctgctgtagacggagtaggactgtaggagtactcgtactagtagatgcgtacgcacatcgatacgcatttcctcccatctgcagagaatttttggtacttatgctatttatgacgggcttgccctatccaggagagccaacctgagagatttgctgaacgaacctgcaagtgcatagcctcgtttcttgctgccgcctccctggagtcttccctggcccggttaacctggttaactcgtgagccaacatcgaaccaccgaggtataacgatgacaaaacatcctcgatcgtcttgtaaaactaatatgccctttagttttctgctccttctctttagacagtactctttccgtttcacaatgtaagtcattctagcattttccacattcatatatatgtctagattcattaacatcaatatgaatgtggaaaatgctataatgacttacattgtgaaacggaggaagtattattctctttgaaaaagtgaaaacctaggtgctcttaagtctttgaacaagtgagagaatacaatttactcatctggccataaaaaagttgcatattacaatagtttaattaacgataaatctagtaacatctattttacatgattggtcttttttattttattgctattaatagttaaagttaaaaatggttgacttgatactatgttaaaaatgcttatgttttggaacggaggaagcaagtttttgttttgagagttttcgcttgatgtagcttcacaaacaatccttatttatatgaaataatacatattctcacgtaaactgtggctataaaatattaaaatatagaaaataaatcagaaactaactaaaagctagattctcatgcattatttctcagaatacttagctcggaaatactaggaccttcgtacgtgggcgagttgaatttgattgacatttcgcattggcagggaggcgcaagcagacagtaggacagttggagcttcttcctatgccttcccttgttactggtcgtgctaggtgtgaagagaaatagataattatctatataaatatataggattaactcatcatatacttaaatagttctgaaacgtaaatgtaaagtccgtttttcgtctgacgtaaacagagccgtccgtactctaacagcccgattcatcttccacggcaaacccaaatcggatccacaaaaatctatcgccatctgattttaaccaaacatccagcgcggcatgtggcggcggcggtgctcggggtcgaggccctcgcgtcgggaggggcagaccgcagacaggcaggacagccgtaacgacgtactacgccccatgggagtacggaggggatcagatcgatggcgttggtggcgaacgttgtacaccgcaacagtggcggcgtcgacggctcgacgctgcgctggccaggtcagttatctcgcttcttatttgagaaaagaaaaatgtaaggtgtggacagtttgcctcatattttcttctgttagaaacgtttgctctaatgcagtcatctttaaacacctaccattaccaacaacgcctctacttcgcccaaaaaaaggagaaaaaactctacttcacccgtagaggttaatccaattttgacatatggcccgcgttgaaataatacttttgctgaaaattatacaattcgtcatagtattgattagagtatgtgccttcgcccttcgctaaacaagtttggaagagctggcttgcggtttcgcacaatagccaatgcaatatttattggatttacacttttggactataggacatgtctcaagatttgtagtcggctccttctccgactaactccttttcttcaacactagcgacactccaaaatcaacagatgacttgtggattaggattgtggtcggggtaggaaaaagtttgaaggaatggccgtcgaggatggtacttatagtggacgattgccggagaagtgggaacccgggtccccacctctgattactcgggacatcaaagatctccggaacaggtcacgcggtactgcatcccgctagtcaccagtagactaaggctttgtctcttggtccaactaggtgtgccccaagctcatggccctgagcttggttttctgctcgttactcgggtcccctagtgaaccataagtccataacgatgatacgacctgaaccatcatttccctcacgtctcacggcgatctcacatttaatgcgaaggatacaaatcgaacgggcatgcgtgaagagcaacgaatgacaagatggcgcataccgaccataaacaagccatcattactcctaaaaacccaagggtatgggctagcacgcgacatggttgactgctatgtcacctcgtcgagccccccctcccccaaatgggcatgcctctgcccaacgtcaacacatgttaccaactccaagccatgcactgacacgaggacgaggtagttgtgcgaccccactgcatgcaagcgccatcgccatcttctctaggggagctcttagggggtctagcacaacccccatatgacagcatatgaaaatactcctcttacatgattcccctatgtgggctccatttgtaagtgacgatcaacgtagtatctagattcgggaagaacctatgcccgcaactccgcaaggatggggggtccgattccaaatcagtatccgacagggctagctagagaaagaaaactttgcacaccctgtaagattggcaaaaaagattgagagaataactcgagaatatggtattacgctttcgtgcggcttgaacttgtataaagtgcttgcctccatccatttcaccccatcgtgaacttatgtccgtacacctgctcccttgccgaatccagggggttgtgcttctacttgttattgaagcttgagctctggcagctggcaagcatggacagacggtggggatgatacggaaattgcgcagttgaaggagggtggtaggtgggggtgatggtggtgctagggcgctaggcaaatcatcgccacccaacttagagaagaggagaggtggggagaggggaagagaaggagaatggccaacagagcctcgtcggtgctgattagggggagggggggagagcgtgctacgcaagtgagactgtaacactggatgaggaggtgtcactttgataggagaacgaggagtgcagaggaaagataaggttatactgccgtttaatattgattgagattggtgatttacttgcaaattttccatagccagtcccaaaatttattacagtatatggaatcgaactgtttaaatgtgacccacaaaagaatgtcgggcatgagggagcctagaaaaagagaaggaaaaggaacatctctggtagggcacattcctctctccaatctccatggggcctatcacaaatccgaagaaaccacaaacagctggccagccgaagaacaaagtgattgatttggtagcagcaaatcaacaccatcattgcgcaggaggacaacgagagagattattcgacctcctggctcctgctgcgtgtccggcccgaactaactaaaactatacactaaacgcaacacagctgggaggaggataggagaacttatccagctactactggtcactgctggttcggtggttcccgggacaagaagctaggcacattctcctcccttttttcccgtggcgagacgaggggccctccgccattgccacgcccatgctgctcctcgagggaccagcgcgctagcgctcgcgtttgaaacctttgctgcgtgcttccatcagggagagaggatgatgcggcagctagcagcaatcagccaagcaagcatgcatgcttgcgcaggcaacttttgttttcgcgggcaaagcgcaacggatcgaccgatcgatccggtggtttcttgggtgcactactgcgtaggcttgggcagctgggctgggtatgcagcagtacgatcgtacgtagggcatgatctgaaggctgaagctgccatgcatcagacgagttcatcatggtgcggcatgccggcatgcagctcgttacggcgacggcaacttgggccgtgctaggtttcatgggctaatgtttagccttgaccttttagctttaaattagccctcagagcagactattagccagctataaacatattctaataagataaaagatgagagagaagagcagcgggctatagatttgtagccagctgcagcacggactccaagacacagtgtgtgtatgacaggtgagaccatatattaatagtatagtaagcaactattgtatgaattagctattagattggttatagatgaattggagccagtagtggcctatactattaaacttgctctcaaggatctaaacaggtgggctaattttgagctaatatgaattagcctccctcaaaacattaccctctccaagggacgctaatggggctaattttgtgttgggaccatcaaaatcagctctctctctctccttccctctcctatctttctactctctctctccaccttttagccttgaattagcccatggatccaaacatgccaccctaggctaatgtttagcctactaattcatgactaaacattagctctcaaaattagctctgggctaatcttccaaacagggccttaggcctgggttcagcacgtactcttctagtagtctagcactatactgtactaccaagggatttacagcttttctttttagggatttacagctttaattagaagctgcccaaacggttcagcttttgatttaggccgagtttagatccaaagtttttcttcaaactttcaactttttcatcacatctaaacttttctatacacaaacttccaacttttctgtcacatcgttccaatttcaaccaaattttcaattttggcgtgaactaaacacacacttagattctaagaagctagccagaagctaaaaaaaattagcttttccatattctcaaaagctagataccaaccagctacttctcataatcttaagctctcccaaataggccctctattacactaacacctcacttcccagcttcgagggcagcgacagaagacttctcaaattcttcgaaatagtaccaagcacattaattcaagggccatatttttcccttatcaaaatttaaatcttaaaacttacttttttagttaattttatttttttcatcacagtttcttttcaacattaacgtttaagtcactaaaaacacatatgtaaatattttaatcataaattatttttcatcgctattatcagtaattggccaaccgatggcaacccaaaacttcaccgagcatatatgcattgcacaattgtatcacttgtgttgttagggtttcctttggattattgaaggattttcagatgaaaaaatcttaggaatttttttctagggaagttgtttgttttgtagaatttggtttggcaaagtcctttggaattcatttcctatgccctaatttcaaaggattttaaacatgggtccaacctcatgttatccgtttcctataaaaattccaaagtaacatctctctttcactctctttatcttactcaatcaaagtaatacattaatttccctaaaaactaaagtagtacgcaatcttaaaattcctatatttttttctaggagccatccaaacatatgctatgtacaagcatgtgattttatttctcatagggtccaaccgccacaacatttcaatccttttttttattcatgtgtttttagaatgatgatgtgttcctaagaagcccttattgcttacttctagtactactaagagcactatctatttatagtaccgtcttatctgtctggtatttcctctatcctaaaatataacaacttatagcacatataatttattccaaaatacaacaacttctacaccaacattctttttccaatcaataacaacctttcaccattcacttttcttatatatctctacttctcaaccaatcataactcatccccatttaattatacataatttcttaataatcgtgttcaactctaaaacttcttaggccatccctaaccatccatgtcatctagtgtccataccgttaaatacattgtcacatagcaaaaatccgatgagataagagagttaatgacgatagatgtaaaaagatgaagaaatcattctcatgcaagaaatcatctatacacaagaatcaagaatgaaaacaaatggataggtggataaaaggagagagaacagaggtgattggataagaattttatttgaaggcaccatccattcagtggcggagccagaaaatctacacgtgtggggctgaattaacgggaagtcaaatattttcagaattacatggtatttttcaagattacaatgggaatcatggagctagtcatggggctcaagccctagctgccccatgcctgtttccagccctgcatccattggatatatagtttctatacatggtgtttatatgatacggtaatatggaactacttgatagtttctgagttggggatgaccttaatatagtattgtacagaagtgaccttaatatggtattaaataggagtatgttgttgggaacggtgatgaaggtagtgcaatgcaccaaaggatattggggagtcaggcaatactccctctgtaaaaaaaatcaaatctatttagattcatccataggatttgattgttttcgggagagagtgagtcgtcattagcaatagagttcaaaattgcaggcaataatcattcgtggtagagttcaaattgcaggaggaagaacagtgcacaaatataccaggaactcgtcctagccgttttattgaaatccgatccgattgcccataaggatagctacagtaacgacgctgcatgctatacatacatggatgcacaataaactcagagtattgctacattgcattgctacattgtctctgtagatttctgtcccatccgccacagacacactgttggcacactgcttctctgccgtcatagccagatccacgttccaaaccggcccttcacccccgaacaacaacaggaggtctggtgacatcgaatcacaaaacaatttcttcttcttctctctctctcttttgaaaattcacaacaatttcttcaatattgaatactcctactactactcctactgcattgcagtgaattttagtatattcagatcaagaagcacactttcagggagaaagaagaagacaaatgctgtttcctctttatggcaattgcgtgcactgatttccctcctaaattttaagcgatccgtatggaatcagaatgtttggcttgggcaaaagtgaagccgggctggcttttatcatgccagtgggtgactttggggccctttcctcatcattcctggaacatatgtgaaggctggctaccaaagacccacacaaacgcacagcacaggcattctttgtctgcatggctgccttgcgctgtgcttctttgaccaaactccaagccaaaaacaaacgcacacagcacactagtgtataatactagtagtaataccttgacaaagcacaagtgtttattacatgcatgccttgttcatccggttgatcagaggtgaagcgcgattaactaatgcacgtatcaaccgccgctaatacgtgccaatcttgctctttttgagctttctagaacacgtccaagttgagcattgtttcagtgaagcagtgtgctaaattgaatagcagtactccggttaagataattaataggcgggcttgattcgttcgttcgctcgcgggctttgctcgcatttgcgacacaagcagtgcagcccagctaagctagctgttactgttgcgaagtgactggctccttgtacagttgtcctgccgtttcaatctctgttagatacactctccccttgtctctctctctctctctctctttctctctccaatgtccatgaagtctgtggcaaaagcagccttctttcagccactctgggcagcatccagctacatcgtctaggcagcagtagcatatggtggaacagagagaggaagtcctggccatcctgtccaatggcaacttcacaattaaattcttgcatctttatgggggtgcttgtttgtgcttgtgtgctttgaacagcatggtgcttaattgcctcgataagaaaaggagagggggttaagcagctaggagtaccagtggtgttcgtggcttcatgtcatgcaagagagctcagctcacagatccctatggagtggatagctatcgtgggagaggccaagaacaaactgctctagattttgtatcgtatcctcgcgttgcattacggctactactgctgctgctgctacttatccaccgcttttttgctttggccctctcattccttttgcagtttttttctgctcagctcaccgggtcccctctctcatcttcctcgtcgtgcaccttgcatggatgtagaagtagcgagctagcgcgcggcgactgcgagccgagagagcaacgcaagaacggcacgagaggctggcagcgagcgagcgtgtgcatggttggtgcgagcaaatggccagcggcggcggcagcagcaactggttaggcttctcgctctccccgcacatgccggccatggaggtgccgtcctcctctgagccatcgactgctgctcatcatcatcatcatcatcatccacctgctgctgctgctgctgccggagccatgtcgtctcctcccgacagcgccacgacctgcaacttcctcttctcccctcctgcagcacagatggtcgctccttcacctggctactactacgtcggcggcgcctacggagacgggaccagcaccgccggcgtctactactcgcacctccctgtcatgcctatcaagtccgatggctccctctgcatcatggaaggtcactgttcacctctcccttctctctcgatcgatttatataatctttgtctctgacattgatcttcttggtgtgaagtaggcatgatgccgtcgtcatcgccaaagctcgaggacttcttggggtgtggcaatggcagtggccatgacccggccacctactatagccagggccaagaagcagaggatgcaagcagggcggcctaccagcaccaccagctagtcccctacaactaccagccattgacggaagcagagatgctgcaagaggccgcagcggcgccaatggaggacgcaatggcggcggccaagaacttcctcgtcaccagctacggcgcctgctacggcaaccaggagatgccgcagccgctcagcctctccatgagcccagggtcccagtccagcagctgcgtcagtgcagctccccagcagcatcagcagatggcggtggtcgctgcagctgctgctgctggtgatggccagggaagcaacagtaatgacggtggcgagcagcgtgtcgggaagaagaggggcaccgggaaagggggccaaaagcagcctgttcaccggaagtccattgacacgtttgggcagaggacatcgcagtataggggcgtcaccaggtaatctgcttacaaagattcagcttttgtgtgcatcatgtatcatcagatcatcatctgtgagctgtttgcacatagggtgtagaggccggaaggttccttccttgttatctgaaaaaaagagaaaaaaaaactgttcttgccatggttcttgtactgactagttggcttaatgtgtttttagttctatctactgataggcatgtgtgatctcttctatgtggcatttgatagtttggttagtacacacttgtacattgctgtttttgagctaatcagttattgctcggttgccatttcttgttgtcactcctactatactagtagtaatagtactagtttccagcattgatgagttcttcattccttcttacggctctgctgctcttgttagtcagtggggcgtctactgtttcttgattactactactaataatcagtttaatgcataacgctgcaatggttggatttattctctagaagtacctcttattttggtcctttgcacaagattatggcttggggtggctctgttacatctgatgcctcttcagttccttgtattgatgaggcacctactcttttgtttttgagcaaatcatttgaccctttttatattgaatgacgaaggtttgtgtgtgtttgattcactggagcaggcacaggtggactggaagatatgaagcccacctctgggataacagttgcaaaaaggatggacagacaaggaagggaaggcaaggttgaaccttgaacatctagtactactacaacatcaaaatttgttcatcttaaaaatcttgttgacaatgtcattctgatttttatatttcatcatattgggcgttaccatgaccgaaatttgatcgcttgcagtatatctaggtaactgttgccccttacaatttctttgttctcattgtacttatattttgtatctgttgctgacctttttcttcgtgttcgttaggtggttatgacactgaagataaagctgcgagggcttatgatctggctgcgctgaaatactgggggctatctacgcatataaatttcccggtatggatgatgaaaccgtgtagtacggtgggatatgggactttgattggagtatccattttctgtaatgtggactaatttattgtgtttggcagttagaaaactaccgagatgagatcgaggagatggaaaggatgacaaggcaagaatatgttgcgcacttgagaaggtcagcagcatgctcattttgcctgaattctatgattagattattatcagattgatatgtactagtaacaagctgtttttttaaaaaactatatgtactaacaagctgttcctgctcacaggagaagcagcgggttctctcgcggtgcttccatctaccggggagtaacaaggtgtttcattttgtgctgaacaagcatatgcatttttcttgataattatttcaagaacacattcgcatcaagatacaatctcactgtgttaaatgttaactgcattgcaggcatcaccagcatggaagatggcaagctcggattggcagggttgctggcaacaaggacttgtatctcggcactttcagtaagaaagacagtgtactctatttgatcttagaatctaaacgctttcacaaagtaatgcaccataaccataagtcattgcagcttttagcactaacattaactaactagcgttcctttgggatgtgactatcgatgatctatggaaattgtcttgtcaaagtagatttgccaaagaagttagtagtagacatcaatcagcagcttttactgctaatctctagtattgtcttggagtactgtacatcgttgatgcatttctttcctgatcattctttgcttttccagatggttgttcttttcataaggctgtgacctctgaacaaagcaatcagttgactgttttaactctcctttggactaaaagatatcattatcatgatgcaaaaataaccagattgtaaattgtactttgcagtaggatctacattggtttttggatgtataaacaagatggccttattacaacggagcgtttccattggttaatctatttttatgcaatacaggcactcaagaagaagcagcagaggcatacgacattgctgccatcaagttccgtggcctgaacgcggtgacgaactttgacatcacaaggtacgacgtggacaagatcatggagagcagctcgctgctgcctggtgaggcagcgcgtaaggtgaaggcgatcgaggcagcgccggaccatgtgccaataggccgcgagctcggtgcgaccgaggaagcgagcgctgctactgtcacgggcaccgactggagaatggtgctccatggatcacagcagcagcaagctgcagcgtgcaccgaagcaacggcagatcttcagaagggcttcatgggtgacgcgcactcggctctccacggcattgtcgggttcgacgtcgagtcggcggcagctgacgagatcgatgtcccgggagggaagatcagtggcatcaacttctcgaactcgtcttcgctggtgactagcctgagcaactcgagggaggggagccctgagaggcttggcctcgccatgctctacgccaagcatcatcccaccgccgtcagcctcgccgccatgaacccctggatgccgatgccggcgccggccgcagctcacgtgatgaggccgccgagtgccattgctcatctccctgtttttgcagcctggacagatgcttaattagagccatgttgctgcttgctcgatcttgcttttgatcggctctttttgtaaactaaagcaagatcagcagcaatcaggtgcttatggtacttaaattagctggaagcctggagtagcatacttggttatgatggtaagcactaggctggtggtgtaagtgtttaaccagtaaacccataggtaggacattcaagcaaaatccaaatctctagagcatccactggtagtagtagtagtagacctttagtgttagaccggtagtgttctttgcttcttttgagcctctttttttgggggaaatttggttggaatgtatggctttttaacacgaaatcaggaatgtatggcttttaacacgaaatctggctgtggcattaaaaggaaaaggttcagtgagagctgacatggtgtctctctgctggttcgtttcgttcgttcattcattcattcatcagttaagttggttttgtaatcagtggggtcgtggggaattcactgcaggtatgatcttttgaccggagtcgtcgtcccagctctctgtctctctctctcgtgttgcattcttttgctttctctgcatggcacggcatctcttcatgatggtgacgagaatcataaacattcccttctttttggttggggaacgttgccacaaggcttcctacattccagccccaatcattccaaagggtttctcctgcagattcccacggcaatgtttccatgtcccagcctacagcttcatgatggcatggcctgtgaaggtgagactaggctgacatagtcctcgttttgcttatgttaattacttccaccctcccagaatgtaacaatctagggcccgtctcatgtctagatacattttcatcctattttggttgctatattctgggacacaggtaatataaaccgcaacaacttattgttgaagatgagactgacatagttatcgttttgattaggtttattataaaccataacagattatcaataacttgaaaagtaaataataaacgatacttatgtatgtttatagcaatttaaaagtaaaatgctgaaaaagattgtaaaattactttaaaatttagagttttaaaatttaaattttgcgatttgcttataagctgaggggttccccatcgtttacactctcttcgtatatttttttttcgcgctgtacgtacgtcgttgcatgaggataaggggcttaggggagtcggagttgcagcacgttgtgccgcaatgatgtcaatgatggcatgtaccggaatcttggcggtctcttttaccatgtcagtgtcgtggcggcacagggaggcgtttgacccttgtacattggctgcaaaccgagagcgggcgataccccgcaacagtgacgcgcactatctccccccctttgcctttggcgcttgcttgcaattgcctttgcctctccttacgcgacagcctgtgccgacaggcgacagccgcccgagatccagcaagcgccaagtcgaatttagccaaaagcagatgtacagcttcctccctagcgaaccatgttgctcgctcgcagagtcgcagtcgcaggctcgcagcggcgcacagtcacccgtaccgtgcgtcctcctagcgaaccatgtgcttgctcggccccggcgtcaggcgggcggcggggcgacgggccccgcgccgctcgctcgagcaggcgcgtgggtgcggtggtggcggggtcgggggggtcatcgtctcgatcgcgcgggcgtgtggttgcacgcatgtcatgtgatgggcgggcgcgggcacacggtcgcggtgttccgtttcgtcgttggcgtttgtagccgctcgcgaggtgacaagcgaagcgaggcgggttggtttggttcgaacgcgcgttttttgtttgccgcgcgaggggtggtagcagcatggcagggcagcgtgctcgccgtcagcagacagagcgcggtgtcgtcttgctgcgccccccgcctgttttgtcgcggcaggatttttgcaagttgcaacaacacggttgtgtgagggttgcaacgggagttgtgattttcacaggggggaacagcgttttgtttgttcggtgattgattcaagagtgcctcgtctgtcttcacagttcctgctcgttccgtggcaattgaaatctgccccaaaaactgagacaatcacgtgtcaccagttcggtcatcaatagttggcatctctatgcccgcactatagtagtagtagtacgatctgaaaactttgacaccgtaccaaaaactcgggggtgcccggttaatcgagcttagatttgcttatttacctggctcgtcctatcgaggctgaggaaacataaacacagcctgtgatgcatgatgcacgccagccgtacgtgtacgccaaccgtgtcgccatgcgtaaaagcgtttgctcgcgggcgagatggcgtctgggtccgccagcgaccagacggtcaaccactttgattacctctgcctttggcgttgctcgtgagaaacgaaggtttatccttctgcttcacgtcgcaccacacgtctatcaatgtccttctcgcgctggacagattcagtgacttgacacaaagtttcatctcttccttttttttccagtaaaacttttttctttttttctgtttcgagaggggcccccgtttgtcatgaccgaaaacagaagaacccggcttgaaagcccatcactgtttggctggtatagccgaggaacaagttccctttagttccctcaatttagcgtacagtctgattttcgtccttaaccaaaaccatataaaaatatacaacccgtcctctaactcacaaaagtaatgcaaacgagatccctcgataatactgtcttcgattttagttgacgtggtgcctacgtaggttctttgactatgtcttcatcgcacttggcatttacgtgacgcttacgtggtagtttgatccgaaaaaaaatagcaaaattgaatataaaaaatatacaaaacatatcatgttggatgaagacctagggttggtttggtttgtggcctaaatagaccttaccaaattttgttagtgctaaattttagcaagttttggcatgactaattttggtaaggcaaagttgtgtttggattgaagtcaaaataacctaaattcactattcaaatggcctattttcttagtcatgctaaaatttgacttcaaaccaaatagacaataaacactattgaaattgtcaaatattgataagcctaatttagaccttaaaccaaaccagcccctagtaaaaaaagcaacgtaagtgccacatgtcaatcaaatttggggacaaaaaagtagtgccgagcgacctcgtttggctggtgttgtaaattggagggtgcgttatcaagttttgttgttaaggaacgaatttcagacatagactaagacctaaagtgaacttattcctatagccgaagtcattagcttcataaatgggccattcggcccatcagatcagctagcccgtacgtaaccctacggcccaaagctacggttgcctcctcttcagaaccattattgggaaaattgtaaccattccataatatgccatcttaacccacgacttatggagtcctatatgtcattgagatactgatggcatatgtcgggtagacaccgcttcagcctctgcccatccaactcgcaaaaattccccacgattccacgaaagtaggaaccatgaagcttcggttgcgatccatggaccagcgcggcggcgccggcggcgccgccgagacccaccgcgtgcagctgccggacacggccacgctctccgacgtcaaggccttcctcgccaccaagctgtccgcggcgcagcccgtgcccgccgagtcggtgcgcctcaccctcaaccgctccgaggagctcctcacccccgacccctccgctaccctcccggccctcgggctcgcgtccggtgatctcctctacttcacgctctcccccctcccgtcgccctcgcctccgccgcagccgcagccacaggcccaacccctgccccgtaaccctaaccctgatgtcccctcgatcgcgggagctgctgacccgaccaaatctcctgtggagtctggtagctcctcgtcgatgccgcaagctttgtgcacgaatcctggcttacctgtcgcatccgatccgcatcatcctccaccggatgtggtgatggcggaggccttcgccgtgatcaagagcaagtcgagtctcgtcgtcggggatacgaagagagagatggagaatgtcggtggtgcggatggaaccgtcatctgtcgccttgtcgtggcgctgcatgcggccttgctcgatgccggcttcctctatgcaaacccggtggggtcttgccttcagctgccacagaattgggcgtcaggttcttttgtccccgtatcgatgaagtacaccctgccagagcttgtagaagcgttacctgtggttgaggaggggatggtggcagtgctgaactactccttgatggggaattttatgatggtgtatgggcatgtgcctggggcaacatcgggggtgcgaaggttgtgcttggagctgccggagcttgcgcctttgttgtacttggatagtgatgaggtgagcacagcagaggagagggaaattcatgagctgtggagggtcctgaaggatgagatgtgcttgcctctgatgatatcgttgtgtcaactgaacaatttgagcttgccaccgtgcttgatggcgctgccaggtgatgtcaaggcaaaggtcctggagtttgttcctggggtggatcttgcaagggttcaatgcacgtgcaaggaattgagggatcttgctgcagatgataatctttggaagaagaagtgtgagatggagttcaatactcaaggtgagagttctcaggtgggcaggaactggaaggaaaggtttggagcagcctggaaggtttctaacaataagggccagaagaggcccagtcctttttttaactatggctggggtaatccttatagtccacatggctttccggtgattggtggggattcagacatgctcccgtttatcgggcatcccaatctccttgggcgcagctttggaaatcagcgcaggaacatctcacccagctgcagttttggtggacaccatcgcaactttcttggttaagtcatttcgtgggttttgctagtatgttaagaatatttcatctgaaaagctacatataacatattgtacatattttatagttggcactttatgcatgttcagttgttaactgtattactgtactcgtaatcttttctttctttgttgatatatcctatattttcttgtagtaccagtgttatgcatgccttaatcatggtaaagtatcgtctgtttaattctctgtgctacaatatgcatttcaaacacttgtaacttgtaagtctcatttgttggatgcctttagtcaatctgattatttcatccatcaacggagaaacaagatactggtcatgttatataccatcatgatctgctgatgagattgaaactgtcacttgtttctaaagtttgcgtgaaataactggaagcaggtggtgtctttctttggtaaaagaaaagtattgtccttatcatctctttgttcttttcgttttatatgctatgaaaagatatattcatcccatattccgataatttggaatacttgcttgccttttgtgctatggcaacttatgcatattattttgttatttttatgttcgtggggggttgtagcctcacaggttgtagcctccatactgaatcgtgcaaaactgctatcctacaaagaaggacaaacaaactggataggctgtactcattaatcaatgtctaagctagtgcgattaacttgggcagcatatggtccgaaaacaaagaaggaaaaggtgaacatatatcaggaacagatcaatagacttatcacgagactataaccactggtgccaaacgaattagcaaacagataataccttagaatttttgtatttggcaataaaatctagtaagaatttgttgagctgcactacaaacatgtatagataagaaatagcatccaaggcgaggatgatatgttgttaagacatactatcgagcaaatcctgtggcaggtttctcttacaccaggttttacctatggtttgtaagtttctacctgattttcattgtatatattattttgtgattacacgaatcaattgtttccttctatatattgctgaaaccgagctgccctgtttaaatgcattagttaatgttatacgttatctgtgtttgataaaaagcttctatgaaactatgaccactgtttgcttttgttttgatcaagctttcagtgcaaggacttttggttgtgcacacgtatgtgacatttagtggattttttaaaatcaaatacattatcagtacttggggctggagcaatctgttccctggggatacttttagcaggaacatgactgaaacattatcagtttaaaacaatatgactgattgtcatttccttattattgtaattgtatttagcaggaacatgattctgaaacttgtgtcttgatgatcagatacatgcggttgtatgatgtgtaaatgcatttactctgaccaaaggaaggatatcgtactagctgataagtatacctgtggtaattatatgcagaagcccgtcacacaacctggtaggtgagtaatatatataagcactctggggaactatttatttctttctagaaatattctgaatagttgttatgttacctgcatgcctaagttaatttcttattccctttgtgtcctttttgtgtttgtctgttactttattttgtacaatgtttcgcagatcgtcaatattctcgtggcttgcatctcaattggatttctccaactgatgcttcctcctaacatatccatttttggttgcgcgtacttgttttatgataaaggagaataaaggagtcatccttttttttttcacttcgacttacgaatatggtttattttcttggttgtcgatgcaccactttatgaatctgactgtagtatttgcttttacttttatttttccttcgcaataggtggcttattatattagtctaccattccctactttgccagtacatcactattgggttgagtttgctgtggtatcatttggttgatttggttcaggtataattttttaagagattttagtcttttgtcctaagtgaatatgggttgcaggatctatatgacaataaagttcttgattttatacagaagcttcacatttacactgcagtcactacttgaattatcaacatttctcactatacatatataatcagctgaacgcctgaaccttttgagatatttgagttatgactagaggcaaaaatggatagtttctttgtaaaacgatatataacaatcaataatggtttttcatggacttctgaagcaactcgacattgatgttcccataccatatttttcttgaggctatgatggttgagtgaaccatatagctcttctctctccatagtccattggagtcttagacctggggggccaaagattgctccattttcttaaagtgggctttatattgaccgcagggagaaatatcacttttttggtgtaggcgtgcatctatctactttgcctacacatgttctattgactattggactcatctgtctttatgttgcataattaaaccatgaaatatctttcatgagatttaactttttgatcacttctctttggactgagactgaaccaccgttacgatactcaaatgggagctgtacggagtgtcacggagtccaagaaaagctacaactttcagtaaggggagtactctttgcttgtggcttggtgcactgaaaagattgtgggggaaggagtatgggaagaaagagtttataaatccaaatgggtaagaatttgagtgttttactgccaggatatctcaatgctatgattggtgatctaaattatggttaaacgttactctgtggttccatgaactttggctgctctatgaaaagtatttagtttcagttccgtgccaaatacagcatttgagtttcagttatgtggcaactaccgttcatacgcagccttatatattttcctcattgttccttttaccaatagtcctgtaaacccgaattcttctgtttcacattcaactttgtcctgcatacagtatgttttacgttctcagcctgtgctattattgaaaggctattgcattgcagtggaggacctgaagcgatactgcatcccagcgacccagctcaattcacgcatccagttctgttagcctcggaacaatagtactcctacagatagctggctgatactgcacaagctacaggcagcctcagcggagtaagtacaagaatccaattcgctgccaacacacgtctgcctgccgctggcaggatgctcctgcagcaggcattcactttgactgtattattccactgccaatcaatccttaccagcttcccccatctgctggtgcctgctgctcaacaactcaagcttcagcatcagcaaaagatggtggcaatgtactccagattccaaagcctcttgaagtgaaacagcacagtgatgaacttctatgattgacacttgggcaccctgctttgagctttgccttttgctctctcatctgctactagtagcatgctggaccttatccttatgcaacacaagtaatatactaacaggtattgcttgttggagaaggcctaaccaggaccgatttttaagccaaggtggataggataatcttgtggcaattgaaatctgcaaatgtgcaactagtcttcttcatgaagggaagttgtacttctgctatgcttacaccgaggtgtaatcaaataaagacactgggaagctggtggaagcagcagtggtggccttctagtatcttttatttcacccctcctgtcctagccacatgtctctgcatgcagccactacatggtgaacactattcgttctaccataggctggtgagtaactaacacctctgatcaagagaggtggagcagagaaagtggcagcagccctcacccccgactggtaataagaactctccccttccatcctaaatatatatcttgttcaatattttctacatcaattttatgcattttggcagaatagtttctttgtagacagtgcattgttttttcccttgatgaaactacagcacaagaacattattagctgtttgctcattaagtgccaacagcctttttactgaacggtttctgtgctccatccaagtccttttgcctctcctcaatctacacattaaagaaaggggagaagtttcaacgttgtactaacccttgtccttgcatctgggatcaatcaatttctcccttctgaatttcgagatagcccttaaactgtcatggtagaagctctgaattggtgagtagtacgaagtgtcgacagcctgtgtaaaatcgggcagtcattgtcgtgcttgacagatcatttacagtgccagcaccaaattcggatgatggtatgtacgatactcactgttgagagccgaagaatccctctgctttgctactgataacaatcagctctctttttaacttttatcgatcatagaacctaatcacttccctggtttctctgatgatttcatcgaagctttgcacattcttagctgttgctgtctttgttgttctgtggatctgattctacagaacgaacttctgacatttccattcagatttcagagcgacagtttgaactgtgtaacaactaaccttctgtccttgttacctctagcctcacatccaccccagtgaatacgcaatctgagtctttgtgttggagatttcgtttaattacaaattaaaaagagaggactaaggtttagtctgtaacattaattaccacacttgaaacgacgccttacatctaggcactgccactgaaaggtgggttcccttttctcctcttatgcaagaattgttgaacatgttaagaataagactttgaaactaaaaacttgtaagttgggtttatcagaaaaaaatggtgaagaagggtattaatccagtagtacaaaatttaagagggtttaaggctttaagcaaagatggatctggttcattaattaatcattaaccttattctgggctggcccatacagtggatgacaatagcatctgttctttggtttggtcttcattttacagtaccacctgcaatttatcttaattcagagaattttattctgattcatggatgtgatccagctggtgcatggttgttagcagtaccgacaattctattccaggactgtggtttccacctttgcccttgcgtttgtctattgcattaggcttacttaacttttcactttggacaatctttatgtaaggctgcaagggttagttgttccttgttgagccttgcaagaaattgactgccacagctcccgatctaccctaccctttaagtaaagcccattcacttgtcaaagctgacaatttagaaggccatcacgcatttcttaaaatgattgcaatatcaccctgagatcaagtatcaggcacaaggttggtggcttgtttaatttcttcatatgtatgttcttgggagttgggaactagcatctatctaatctagtacacactagatgacttatctcagagagttgtgatataatggtcatcatgtgattgatcatcgtttcttctgcagatgtattcccctccctgcagtgctgctgcaagcagccaagggcattgtttcgcggtcggagctaaccagcttgcttcgcttgaccttgccatggacttcgacgagcctatcctttttcctgtgcataatgcaagtttgcaagaggggattcagttttacaatcctaccggcggtatgtctctctcgttacctatgttctattttcaaggataaccacagtatcctcctctctttttttttttcaattagataaccacagtttcttaatttgtgaagttcctaactattacagtttccgtgttccaactccccagatactcagctaagtagaaacatgagcattgacaagtgtttgaagggcagtaaaaggaagggctcaggcgagggcagttcatcgctacattcccaagtaacaagttaattagaagctctctttgcttagcttcatcgggtgggagcacgtttcatcgtgaaaatcgtactactgcaggaggaaaccggtgaaatgcctcagagagaactcagcatggagcatgccggagagaaggcgggtgatgctgacgctagcagggaggagtacgtgcatgtccgggcaaaacgcggccaggcgaccaacagccacagccttgcagaaagagtaattgatctctccaacattaatggaagatctttctgtgtatagattttcttgctcacacagcttcaccatctgaatgcagtttcgaagggagaagataaacgaaaggatgaagcttctgcaggacctcgtcccaggatgcaacaaggtagcaacgaaatcaataactctttgagtctgtgatggtgtggtgtgctctaacctgtgtgaacatgttgctcttgacaaagcagattacagggaaggccatgatgctcgacgagatcataaactacgtccagtctctgcagcgacaggtggaggtaagtgtcccgaaattacacatcttgtcaacaagaatttacacttctcaatgccaatcactgactgaactatccatgaagtgcttatccgtgccgggttttgcagttcctctcgatgaagctctcgacaatcagtcctgagttgaactctgacctcgacctgcaagatgtaagatgaaaaaactccaactctgaagaacaaataactcatctatcaccattgctacaccttgatcctttctttttcactgccatacagatcctttgttcacaagatgctcgctccgcatttctgggatgcagcccgcaattgagcaatgcccatcctaacctttacagggcggctcagcaatgcctctcacctcctggcttgtacgggagtgtgtgtgtcccaaatcccgcagatgttcatttggcaagggccggtcacttggcttcgtttcctcaggtctacatctaactccagtgaatacagtagttcaaatccttcagaacagccgagagttattcatgttttctttgctgcagcagagaggcctcatctggaacgaggaacttcgcaacattgctccggccggtttcgcttcagacgccgctggcaccagtagcttagagaactctggtatttttcagagctccactgccctacttgctttttttaaatacatttcttctgcagctgaaattctggcgatcgtgatgctgcagattcgatgaaagtggagtagctagtcagcagctggtgatgaacaattgacacgcctgaaagtcctgaaatgatcgcgcgttggactgctaatggagggatgcactctttcaggtttgcaaaggctgcacacaggtttccattggggtgagcgaatttggtggtcgtcgaagttctcgaggaaaactctgtagcctaatcattgtacagtttgactaatcgaaaagatgaaagtttgagatttggtgtgttgtactgtttctgcttggattggttgtgtaactgggtttggtggcaaatgggtctacttggattattgccataaaatttttgctacgatttcttaaaaaaaaaaactttttacaacgaatttgtttagactacttgtgctaacctatttattattccctttatttcaaaatataggaactacaactggattaaacattactcctaagatcacgaatttggacctagattgtgtttaatctgatcgtaggttgctatttttaagacaggcggggtaggttataatatataatattcaatttatcattaaaaataaataagtagattgtccatcgatgtttatttacatttcatctgtttgctcaatttcaaattatttgtcattctggtttgtcttgagtcaaatgtttctatctttgatctctacttatagaaatatgtatattttaacaacatacaaaatgtatattatgaaagtatttttatagtgaatctaaaaaggtaaatgttatgatgttaaactataccatcaaagatacacttaaagacaaaactcctaaaaaacaaagtaatataaaacagcgagtgattcaaatgggggcttaggatagatcttgattgcttacgaattatggattattgcatacatgttctccaagctcctaaacaatacattttctgaaaaaagacatttttatcaacatttattggtaaacttcttttaaatcaaatcatcaacttttctaatatttaatttttttatttgtgccaccgaataatggtcataaactcgatcagattcacccattcatctaataatacctataagccgaaaaacatggccggagtaagataaaatatagggtaagacgtttgtagtttcactttcagtggtccaaatcttatggtaagaatcgaaagcgaggaaaatgatttaattctaaaattaggtttcaaaaattgaaataggacgtgattaaaacaagtaggtaccatttgctaatgaattgattatttgacatatagttattattgtatgtacaggttttttaggatttaggaggaaaaaaatgtttgttttcaagcctcaagtataaaagtttgggattgaaaaaaaaagggaaataagaaaacatagaatttggatagaaatatatgtgcaaaacatataaacatatagaaatgatcgtttgaatagaccatagaaaaaacataggaatagaattagagagataagtcttaaagaaaattcttcaagagttggaaatttttgctaacttcttccacaatcttcatagaattacccattctatagaaattttaaagaaaatgataatattttgtttcaaaggttttcttaggattttctttttaagattgaaattctttaatttttctatgttcccctataaatcaaatcaaaggagcctttaatctggcttcaacttagataaggatactggaaagttgttatctatactactagtaatggtggtgtccattctatcattcacccctaccactaatatttggatcccacaatttatattattactagaaaaaatgcccgtgcgttgcaacgggtaaatgctattttaattctattattgttataactaggataaaatttattgtgggaattcacttggatattttttcagaaaatcatgagctgcaattagaagtctgtatttcttctcaagttagcatgtgagttttttttttcaaaaaatttcttatatgactcattttatacttctaaaaggaaacaagcttaaaatccaactcaaatacaaatatgtatttcgaaaaacgaaagaaaattaaaaccgactcaaatacggataacgtaccaaaataccataaaacattttcaattaaaggaatcaagcttaaaatccaactcaaacatagatatatatatttccaaaaatgaaagaacttgaaaaccgactcaaatacgaatgacgtatcaaaataccggcaaaaatatttttaacttttataataggagagatatactatcctccaatgagtcatcctgtttcactgctagctctccctaaattttgaaatcacatacttattcaataagaaaaatcataaaggtactgcttgtactaaatacgtgcataactgacttgataaactacaagctcaatttgtttttcgttgcaacacacaggctcttggctagtaaaaacaaataatggtggtgtccgttttaaactgcttttcgatttagctgctttcttatctttttcgttagcacatattttaaacttttaatcgatgtgtttcatacggaaactttattatagcaaatactttaaaataaaaaataaatataattcttaagttttaaaattttgatacttaattaatcgtagcctaattatctctctcgtttttgcctacgaataatcagccgtttcaccacgcttactctctgagactgtgaccgagagtaactgtaaagaacctgaaaaaagtatagagataaaaaaaaggaagaaaaaaacacacctgctttccaatcgcagctgcctcccatggcgaccaccgcctccctcctccctcctctcctcccggccccttcctcctccccccgccacctccacccctcccctcgccacctccgccccttgccaccgatccgcctcctccgcgccgcccgccgccgccaccccgacgccgtcgtcgtcgtcccggacgcccgcccctgggtcggcgacctctcgggcgccgccgcgtcctaccgggacggcagggaagaggacgacgacgacgcgggggaggaggatgacgaaaacgacgacgacgacgaggaccgcagcctggacctcctggtccgcttcctgcactcggtgttcaggaaggtctcccgccgcgcgcgccgcgccgccaggtccgtgctgccgccttccgtccccgctgagctggtccgttcaacccttccgtttctcccctttggtttcaatcttcttcttgttcaaattgagcggatccttctctgtattgtgtgatctggccttgatatgtttagtttatgcttgtgcaggtgaagttctcggtcaacggcgtgcttgttctcacgtttctatgggtcctaaaggggctacttgaggtgagcaattcatttgtctgaggcttgtttcaaaattgtgagctgattgtgatcatgcccttgatatgaactactaagtgttacactgtgatactatccagtggaggattcaggaattttcttgagcctggtcaaacctagtgatgtataacaagtacataaaaaatcagtatagctccatacttccatagaccatatactatgaacgcaagcaaaaccgacagctgccaagttgtgatttaggaagagcaaaaccagtacgtacgagagattatatcgttgagatgatggctgtctattgccaatgggctagactatggggctattatcatcctgacaaatgtggtgatgagtgctagcttagagttgtgtcggtttgaccctcgtgcagcaaacattcaaaccggcatatcaagtagtttgcttggttggtttggctcccattcgaaccagcagatcaagtagtaattgatggagtgctgtcttgctcatgtgctgatcgcagagcctggagaccagccacagttgctggggcttggctcctccgctgatactaacagtgacatataatggaataacattatatgtccagagaacaaacattgtgcatgcttctgaatttcatgtatgtccagagaacaaatgggtgttctaccttcgttgtcattcgcttagagagtgaagaagacaatcagtgtctgattacatgctgatatgacacttttaaatgtttgatttgagttttttcccttcattctgatgtctcgtaaatttggttttcaaattttggtcaaccaagtttgatgaacatggatgagaaccagacaagtgtatatgataccacaaaaaagattgtccttttctctaactgtcacgtgtagatgagaatcctcactttgttgaagtgatgccctcttttcccttgtactagatgcttgctcccagttttgagcataaaacaaaaacatgttctagtacagagtatataataatgtgcatatatactcagagtagggaatggtgcacatcagcacatggttcaatcattccttattgattgtctactctttgattggagtcatgcttatgatcaataaacagttatgctttcaattcagaaaattataaaaaaaaattgtgatgaaataacaaatactccacatgcattacaagtacaagtttgtttctgggagacatacaagtagtttagaatcatgagattacttaatgcttataatggcgttttcgatggatgaattcagaccaaatgagaatgaatcttgtattcttttgcactgacactttcagcaaatttcatttcttagcattctggtagtttggtcatgtgatttacctctggtgcttttggaatacgagttttttattcgttgtaacatttcctattgataatagatggaaatggttcgtcttattaagatgattctctttagtgaaattatgaattctgtttagtagagaaagagcctactgctactgctgtcaagtttgatcccatacccaccccaacccccagcgtctggcgggcttccccttctggatgagctcggtccaccgctatcctccacaaggtcgtgccattgtcctccgtcgcttcccctccctccactcctgtcgcttgccttccccttccttccgtcgatctgaaggcagtgagcagagaggccaaggtggtggctgcaaggagtagatggcgatgtcgcctggatccaagagagagagaaggggtaagaaggaatatatgctggcaaatggggacagtcggattttgtaaaattatttcataatcttgctgagtggattgccatgtgaccaaattaacaccatgtagtatcaaaaccactccgttttttgccaggggggtaatttgtccagattcaatagcttggaggtgtcaaatgtccggtattgtagtgtagttcgcgcagggcgggtgggtgtggggtgtaaatcgtacggtcctaacccttataattgcatacaagcttaaactacaccctggttctcaagcagggctactgagtactgactgttactctcttcaactgacacccctacacactgtcttctagtgccatgcctttccttcagtaactgtttatattgtttgtgctcaggtggtgtgcacatttggaagtatggtgttcgtgaccatccttcttgttcgtggaatatggtctggagtgacttacataagagaaaaccgatatagctatattcgccagattgataatgatgacaaccgatggagcagagtacagactgctggctaatcatttgatttccttgactacatacatacactttgcaccaaagggatcatcagtaaacctttcctcactgttaagacagcatgctaccagttcagcaccaactgccaacagctgttgctatacagcagagttgaacaagaacaaaaggaatcccatgtattcgtcgaataagtggaattttcttcctctgcacaaatgcaggagggatggttgagctgaacaagattaatacgcgtgtaaaacaatccagcacactgatgaatgagagctgctgctgtgatgcattttctgctactcttttcttgaagagatgtatcggtccttattagtgtatgtattgttccatgctgttacaactagccggtgtagaaaaactcatgtttgttgtattgaaaggtggtgcacgatacctttttggttaaaaagtgaatatcatttcgatttcatttgaatctctcagagaaatatgaatcaagtagtacgtcttttggtttgatacctgaattctgaagtgattgttctgggatgcaaatgtgcaacgaacctgaaatagaagccccacatccggattagcttcagatcatgccggggcgatggggccggacaactgtcttttgatcggcaacaggttgtcggatcttcggtttcgtcctggcttttcgttgctcattcgggcatttttcttcgtcggcgtgcccgtttgattttcgtgcttcatttttatggctgcaattgcaacggtttgttcagcattacttgataacaatgacgtctcaaatgcttagtgggggaaatggtacagtagtatataatttatgggccttctcttccaacaaaaagtttcaacgtcctcccccttaatttgtaatcgccgtagtgcttgccgaattgcagatatgtcacatcagatctgcgtggcatgcactcgtgcaaaagtccagggctccaggttggagttagacaaggatcactccacgcagaccaaaaaaatagaaaagaaaagggaaaatgcagttcatttgtctcatgtccttttgccttttgaacctggcccggcgacgtactaaacggcaaatgcatggctggaatccattctttggtgggttcttctctcatttgccaactttgttcttttgtttttcatgtgtatattttttaactgctaaacagaatattttttaaatatatatatatatatatatatatatatatatatatatatatatatatatatatatatatatatatatatatatatatatatataggaaagttattttaaagaatcgtactaatctagtttttaagtttttactaatatttaattaatcatatgttaataaggtaacttgtttttcatgcgggaagaaaaagttcttttaactctccttctcccgaacgcacgaggtgttgtttggcgtagtcctcttatcctctcctagctaaggggggctcccatcggatggcctaataagctaaagaaaaagctaaattttaaatttttaaacttaattctaagattgattttgagatattttcaacgtagttttttttcagtattggtttttaagtcaccaagaacatatatataaaagttttacctacaaatttatttttattctctaataagtcgttttgacttattaggaaaaaaaaccaaacgatggggcctggggtgtttgggtgtcaaaaataagtttttaggccccctttgattcaaaggtaattcataggaattttaaaggattccattcctatagtaatttttcctatatagccatttgaatcaaaagaatgaatcctatgaaatcctatgaaattcctatggaatgcctaaagacatgcaagttttggaggaaatctagcatgaggttctacctcatggaaactttcctatgaatcttcatctctcctctaattcttgcgtttttcctgcggtccaatcaaatagccattcctgtgtttttcttgtgttttgcaatcctctgttttacacttacactcgtaccaaaatcctacgtttttcctattcctacgttttttcaatcctgtgattcaaaggggctcttaaaaagggacttatttttcgtgagatagcacccaaacaccccagtacgagcttctcttaaatgtacaactctcggaccaaacgaatattctgatcgaggccatcaaggcttcaggtttaatcatccagagactcgacagaacgcacgccccagcggtgccacacggttgcggtcgatctaaaacaataatactccctccatattttattaataatcgcattcgcgaaatattttattaataatcaaggccttcaactgttcaacgagacaacgagttatctccagcaagccattagccagctagctaggctcatgctcgactcgacaggttcagacaaatgttcagtagctctacagatacgcagtatatgtgttatacgtagtgcaaattataaacctgaaaactaccgtatatatactacaatagttttcagatttgtagtatatacagggatttgcactacatattatttttttggtgcaatataacttaactgcacatgtatgtatttgctcgtactaaagcagccttaacctcagattgacaatgacttgaacccaactaattaagtagtagtgtagtacacactcaagctaactaagcaagaataaattgaaaactatacacactctagtttctactataggactaaaaagattatgcttcgccattactatatttgacccacctgatgttatcacgatggagacgtcagcgtgtagataaatgctacccataccactgacgaaacgaacgaacaaattttaagacacgtgtgttgcaacttgcaagtgttgcaaacctgcaactgactcagctccaggcgggcctagcttgaccctgtttagatccatgattaaattcctatcatatcatatgtttgaaccctaattaaaaatattaaacacaaaacccatttcataaccctatactaattcgcgagacgaatctattaagcctaattaatccataataatttgtctctcaaattagctctcatttatataattagttttattattagtctacgtttaatactctaattactgtccaaacatccgatgtgacgtagaatttagggtgcgatcgtttcagcttttcatgattagattctcctcgttttccgttagcttttcaaactgctaaatgatatattttatgcgaaaactttcaataaaaaagttgttaaaaaatccaacaaatttatttaaaaatatatatatattaatacttaattaattatatactaagtgtattttccgttttgttttgtgtgcggctaaacagtccaccgtcactgctggaacgatcgaaccctttagtgtctgatcaaaacaccaccagcctccaaccagacgcaatgaatacgtacgtacgcgaatgcgacagtcctgattggtcctcttttcttttgttttttccattgttttctcgctacttgccagagttaatccctatattttctcccaaattaaattgagtgccatgcatatccccaaatccctaaatcaaagtaacatcccaaatcttcacatcacaaatcctaagttacttatacacacaaatcaaatacatcacagattatacatctcatatttatgcaatgaatcacaaattctaaaataaagaaattatacatcttagcgaatcacaaattatatataaaaaaaaagaaaggatgccggtagaggagagggcgccccgcctccatgcatgcgcgccccccgccccctctcccgacggccggcgcctgccgcctgcggccccaccggccgccggatgggaggggaggaggagaggggatgatccgatcttatctaaatatctcggtgatgaggaaagtcttgtctaggacttaaccgatcgaagatgggagagaaatatttactcccggtttagtaactccaaccgggactaaagatggatttttagtgccggttggtgttactaaccgggactataaatctctggcgccctgacatcctctgacataaatagaactgggactaaagattctatagtcccgctgcacttttaaacctggattaaaaatggtttttagtccccttttttggttgaaccaggactattgtagattttgggcaacccggcaaagatcacttctccagtagtgtctacagtagcgttcatattggaagttgatatttgaaaattaaaatggtaatctttggggtggagttctgtcgatagctacttttctgtacggcttcggttggtcccatatgtacatgtgtctgcagtgctgtagttttcgcggcgaaaaggaaatgcatcaatcatgccgaaaattcactcaatgttgcctagtagtactacgctattgagggtgcgtcatcactgtttcgatggtcagtttgaatcaacacaaagccccctcgcatgccacttctttgatattacatcatgataaatagggttcgactcgttcatgtctccacacccaggttatgccgcaacatcctagattgaaatatgacagcaaacatttgctatgggcagggattagtccacttcggtaaaactgcccaacctgtcacgttttggaagaacttcggaataggtttttcctagttaggtaactcggtttagacaccatgacccctatgaattatcaagttgcagcttcgctaataagttgtttacaaaatgaaagaagaaaatacgaaagaaaagcgtacgctaaattttaggggctgctacaggatgggatcttgtgcccatctctccaaacgatacttgatgtcagactggtacaaggtttgatactcatagataccaaacttatacccccatcaattccctagctcatacccattagtatcgtattcatggtgggatgctatcatgtgaagccaaattgtgtcgtctcgcttagacttgcttttgaggatatggattcaaggaggcacatctaaaatcgacggcagtgctcagcagtaaggatggtttgccttggacggatgcatggttaatggatgaaggtcgatgtggtggcgcaggttgacatgaatgaacctagtgtggtggaggacagcgactgccacgatcgcaagttgacggtcggactttgcgaggaagatggcatcgacggtcggattgggcggtccctgtatgctctcaccatcgaggcatcgacacataggatcatggttgtcgtagctacatggatctaggcttgtcaagatccttcgcccgaagttgaaccatgcaagtgagttaggccagtgccaccaaccactagtgacctcctagatctgcatcgtcgaggccatccctgatcttgctttacatagcctcgttgaccctagtgtcacaacctaaatctcattaggcttatccatgacggcttcctccacaacctcctagatcttgtttgtgtacgccagctacaaccttgctcttgactgcccctcctcctgccaccgccatcgcttccttagggaaggtctcttttgtcacaaccaatgccattgtcgatcctgccgcttcctgatgagactaggcggttaggacgggatgagcaaggcggaggattggggggaggggttggggacgaggaattcaaggtcgtgggttcatgttgtcacatcgtcccacgagcaggatcccaactttctattgtatgcattttctttttttcttaagacatcactactaactttataggatcacaacatactcggaacacatcctgtagtaggcataactactttttataggaacacattctgtagtgttcatgctgtcatgttgtcccacaagcttgatcatttaatctctatcacagtaccctttcttagaaagtgataaataatttaccactcatcctcccaaagtggtaaatagttaaatagccgcgaagtgagcgtagtcaactggctaggttagtatttgtcactttctagcgtagttcaagtcccaaacttgatacggatgctcatatttacggctaattattctttcagtgttaggaaatgcactcatcgatagcgagatgcctatggagatttcttcaatctcatgatatgttggcctagtcttttgtcggaggtgctcataggggtagggtgtgcctgtgtgtcttcataggggtgagtatgcacatgttgtgagcttctgtttttgtacagtgtttctaaaaataatacaccctccgttcaagtttgattatcacatttcaaaaaaaaaattggattttcaagtttgatcgtcacatttgcaatcggcaagctgtggcccttttcagttgacatgcgaaattaaccagccgttgtgttgacgcctcgggagcacttctcaaaagctcattgcatgcatgctaaattaatgtcatttacaattagctacatatcgtttgtttcaccttgattgtcaagcttgcacggcccattacgataggcatgctggtcagttggtgtaggaatagattaggaagatgataagagcgagtataataagatgatgtaagcgggctatatatgttgccacatcatattcatacttagagcaggtacaatagcaggcgataagccagctataaacatattttaaagagataagaaagagagagaagagtagcgggttacaaatttgtagtcagctgtagcacggactcaaagacgtaatgtgtgtaccacaggtgggactaggtattaattgcatagtaagcaactattgtatgaattggttattacattggctatagatgatttgaagttagtagtggactatactattatgtggaggaaatagaagaggagagagagaggaaaatggtgtagtaacatatgtgagagagaaatgtggggaaaacattaatggtgtagtatgtatccatagttaactattatattagtaggctattaagttagctatagatgatgtgttaatttttggagttagtagttggctatattattgctctaagtgtgcttgttgttcttggtccttgtatcgggtcaaaatatgacgattaaacctaaatggaggatagttaaataagctctttttcatagggaggcaaatcaggcaccttattaaaaaacacttcatattcgtcttatttaaaaggtttatataatagtattttttgttgttgttagataataaaatataatactttatacgtggctaattttaaaaaaaattataaattttttaaataagacatgcggttaagtgttggacagagaaacctaaaaatgaagtctctgtgcgtgttaaaaaaaaaagtctccgtgggatggaggggtatctcgtgcaacaactgcagcatggtcttcagccatattgaccatgcttttagttttcaaaaagaaaaaaagaccatgcttttccttttttttttcctttttgttagggggcgtgggatgggggttgggtttgtagaggcggcatgatggggccagagcgttgcatggctttggctgaaacagatcaagcacgataccctacaatattggagtgtgttgtagtcttgtagaggcagcatgatggggttggagtgtaccttatctgggacgacagagcaagcatggcgtgttacagttactcgactttacaaactaattatttttagtgctggataacgtacatgttaatatgaagacttttatatcgatttagtctctcgaagatgttcacatggtaagatgtgcgtattttgcatgtgtatataagtatatgcatttgtattgttttttaaaaaacaaaagtactttgatagtaaacaaaactaaaggcatgcttttcatttaatgatatgagacaacttccttagttaatttagatagtacccatttcctcgtgtaaaaaccaacataaaatataatatggtattggatatatttaaatttattttattagaacacgtaatatccattctagcatgtcctatgggatggagggaatacattttcgtctacttgcggaaaagagttgcatctatccctttaggtaatgtttggtttagggataaagtgggatgggttagacctatcctagttttgcgggatgggatgattccagttatctgtttggtttatggtatgggatggttatagttttctgtttggtagaagggattgaggtgggatgagatggacgaatttgtactcaccgttagtaccgtctgggggcggagtagctcggcggtgctcggatctgagaggagcagcggcggcggcgttcgcggaggtggcggcggttgcagacaagcggcggttgtggacgagacggaggcggcggcgggtgcggaggcgaggcggctcccggatctgagaggagcgccggcggtgctcgcggaggtggcggcgctcgtggtggtggcgctcacggaggtggcggcgctcgtggaggcggcggcgggcgcggtggcgaggcggctcccggatctgagaggagtggcggcagtgctcgcggaggtggcggtgctcgcggacaagcggcggcgctcgtggaggcggcagtggtcatggaggaggaggaggcggcggcgctcgtggacgcgcggaggtggcggcgggcgtggacgaggcggcggcgctcagggaggcgatgacgctcgcagacgcgcggcggagctcgcagaggtggcggatggcgcggtgacgccgttcgctcgtcccaggtgggacgagttcgtccgctagttttttggagatcagttggtcccagatcttagaggaatattcctctccagagatcaacccatcccacccacccctaaaccaaacacctctaaaagtgggttcgccccatctcatcctatccgatccttgcaaccaaacactacctcagtcttcaaacccaccttgagctaatgatttttgtttgaatcatggatctgtagctaataaagaatttgagatatatgttggccttgaagagttgaaggtagcacagctagctaggcgcgcacatgattggcccctgcaaggatgcacgcacatgtgtggattcgtccttaattttaaaaaggtgaccatcagatcgcatcaaataaatgcggtagtacgcgattactaaattgcaggctaaaattattcttgttatttctatttaaacagcactgtttatcgaccacgtatttaaataaagcacaacaataatgctagtaaacaaattaaggaaagatagcaaagccaggtttgcaaagaacaatgccttttcaaaattatcttccattttaattatttggtttctttattttatcaaaatatataatgtatgctacattaatgatttagaccaaccataatattatgaaagagtaaccttaaggctcttaagatgaaccatagccatttgtggcactgaacataagctgggaaaaaaaacaaccataagttcacgggcaacctcaagggaataaaaaaagtatctataagaatctctcttctccttttgcttcgttctctccccactcaataaaaggttgatttgaagtcttttttatttgtaaatggatcttacccatacaaaacttaaacactgtagcaattataacaactatgatcaactgacatatggtccaccttaaagctatgttttgcaataaacactgatcttgcctagtatccatcatctctgaacttcttaacacaagaggaacatgcgagtacagaaaccacccgaaaaaaatattatgtgtgaaatcgtacgttaataagcaaatatgaaacccaattactgtgacagaatccatcacgctacacaagtgatggtctgatagaacaaccaaaactaccgcttggtccacaaatcaataaagaatatcgatacgatcatatacgagcaatcattgttctcctcatatggtgaagcattcttgcaacttgcagaggtccgtggtactggtatgggcagcggcgtctgatcccatggcccatggcatatctgatctcaccaaaccaccccactaaactaacctccccagtctaataaaccagaacaaaaccgaagctaaaatttaaatttttaaaattaaattaaaaattgatttaaaaaattcaatgtatttttttacattaaaattttagtcgctgagaacacatatataaaaattttatactataaattaaatattactattgtctgataaactgttttggtttattagtaaatgtgagcaaccaatgagactttaaaatatctcatcgcatacagaaaagtaggaatactactccaaaacatacaacgggggattcgcgagcgtgtcggtgaactctcgtgcctcgtgtacgtgcggccggggcttgagcccttgatgggtttggttgccatgcagcatacaacaaatctgagaatagtgtggtgcgcgcgagacgctgctgctgctgcgggcagatcgctgcacgtgagttggcacagagcggcaggcaggggaggggcagctagcgatcggcgagggcgtatgtgcggtcagatcgcgtgacagatcacccggtcccagtcccacagggggaccagtgcaacggcacaaaggtttagagtacgagaggctcgtccttgcaagccaaaatgatttatttgaaaataagaattgatttattggtaaaatctttatatatttatttgtaacgagttaaaaaccaacgctgaaaaaatatgtattgaaaatatcctaaaatcaacttcaaaattaaattcgaaaaattcaaattttaacttttgttttgctttattacgtcaaccaataggactccgagtctagtggatgtgtttttgtcggtgtgttttacacccacttcgtgggtttttcatgttcagacaattccaaaattattgttagtactatgtttggtggattgaaaaaaatatatatatccgactcaaaatatattaactttttgaatccaaacaaaacttatattttaaagtaaaggaggtagtacacggcaatatcctataaagaatacaaattttgttgagtgctaggtatgtatcatgctcctcgcaaacaatttagaaaaatgttataaataaaaaataaaacctaatagtatacatcaccaagtcatatactatctctatttcaggttataagactttttagcattgtccactttcatatagatgttaatgaatttagacacatacatctatatgaatgtgggcaatgctagaaagtcttatattttaaaacggatgaagtagatatttaacaatatgaaggtgcagtgaaaaaaaaaaagataatttcaaaggttacgttgtgttccttatcatcatcgtccactaaaacttccgtcacaactctagtctagctctccgtgtgtcctccagccagtgtagtgaggttttagaattagtattccataaaaatttttgaaatgattgcacggtaattgatgaagacacataaaggattgcttgttgggctatcgatgatcaaattggcgatacgactttatagtacaggttgtcgacttgttctgtgtgatattggttttgatgttgtgttggaaaaattaagatgatggttgatatccgttcatcttattttgcgcatgctgcagttgatcgacattatggttgcgtggctctactcatctctcgcgacattctataatatggatcctttttttctttgcaaggtaaaaatctctatctagtttcacttcaaagagatatattagtagattttgaagattatgtcgacatataatttgaagtgacatgttttatttatcatagagatgatcaatatgtggtgattcacatagcatgaatcattttctcacaataagttttgacatacattattttgatcatgactgcaaataatttctgccaactccattaataccctctcggttcaacggtacccttgattgctatagagagtgatatattatcaaatttcttttcgagtcctaccaatcgacgtgtatcataaaatatgtatatttttatgtgccacaaaatagtatcacaacccggccaccagatattgtagacgaagatatctgataagtttacagaacaaaccaaccgtatgaaatgaattcatttgttaggcaggacccttgacgcggactatgacgacgtggccacctcttgtaatacaagttgcaacgccagaacaaaacaaaatttgcccatttggacctgtttagttgtaaaaaattttatccctacatgttacatcgaatatacagacacacatttaaaatattaaacgtagtctaataataaaataaattacagattccgccaaaaagttgtgagacgaatttattaagtctaattaattcgttattagcaaatatttaccgtagcatcacattgtcaaatcataacacaattagacttaaaagattcgtctcgcaattttatggcgaactgtgtaattgattttttttctacatttgatacttaatacttaatgcatatgtccaaacattcaatgtaatagcgccaaaaaaaaattgtttgaaactaaacagacaaaaaaaactcaaaaaaagagacgtcaaaatcgtatttttgggagttgggaaaaatccagcgatgcggaggaggagccgagccgagccagctatgaaaaccggagggaggagtcctcctcttcttcctccttcccctccgctcccgataaatcggaacaatctcgaagcatccgcccgtctccgcctgctcctcccaccaccaccaccgctgcttcccttctcccctctcgcccgccgccgcctcgccgcgacgcgcatcggcgccgccccacgaccgcagcagagaagcccaccaccacgcgcggagcggccgaggaggcctcaccactattggtgcgggatggcggaggtcgccgccggcaccgggcagctcattggcgtcgccgtggccacgctcctcgcggcgatcttcctcgccgccgcgcttcttggcagccgccggcgccggcggcgggcgccgttggcagggaagcctgcggccgtgggtggctgcggggtggccgacggcgaagggtgcggcggggatggccggaccgacgtcatcgtcgtcggagccggggtcgccggatctgcgctggcatacacgctcggaaaggtgactccttctcgcctacttagttcgcctacttagatgggttcttcttctttttaaatctgcaaatttgttgcttacgcttcgttgagaacagggtgattcaaaaaaaaaagattgaagaacactgcaagattgaatattttttttccggtaagttaggcgcaaggacgaatttttctatcctgaagcagagtcttaagtacaaattgccaacccctgtttatgcatgcgtcgagctttgatttatttctggaaaggcagctgatgtcttaatccaagaagactagattcgtgtatgaattaattgtgatttcatgcaatttcttgttttgatcaatatttttgcatgttctagcgtgccggtagaaagcgaagtctgttggtctcttccttttttgtggacatgaaatttgtgtggccaataaatgttggtgtgcaaaaaatcgcatgtcttgtaactgtgatgagaaatctctcttttccatctgcagtactccatactggccgtggccggtgaccacaagtcatctggatgcagcagaaaagggacagaaagtgacaaccaagaggagagttaatacatgatttgaataaaaataaaagatgaatctcaggtgttctataaaaccaatacaattttggttatagcaaaacagattttgttgattggtgatgcaaatcttttactgcagtaataacaatataaattaactcaaaccgaaaagtttttctcaaacaagttgtatagagcatgtccaatataattccgactgtatacagtttatcttctagtctggaactactgtaactccattactatatcttttcttatatagaagcaaagagtcacttgtgttcccttctctggttttctattctttatcatgctcctttctatctgcatcaacagagcatttatgtgctctatcttgacacaatggaatgcccaactaaatcaatgacccaatttattttcccaactcccagcaactatgagagtgacaccttcttgatagaaaaactgatactgcttgggcatatcttgagttcttgactttgcgcaaacttaggaggtggtaaaattgagataggtccaggagaaaatgactaactcaccccatgactgcttttgaaatatgagtgagaacactttgtgtgagcgtaaattgtatacacacaaaggatagtgagaacagtggaggcatggttgacaatgtcattagaactaaatgtttgtattaccatcaaccattcaatggaggggatactatacctagcacgtttgttctttgtaaatgatactcccaatgatgattttaacaagggctgttttaattttaaaaaaggtcaaaatatatacatattgaccatagtcaatttacaagtacatttagtgtataaaaattatacaaattggctcgcatttcaacgtgctctcacaaaatgtcggttttatagtttgaagaatatattttatgataaatcaattgctaaagtttaataaacttttcaaaaaaagcatcccctataaaaataatcatcggatgtattatatttttgagtctgcacaaacttccaaaagctgacaatcaatatgcttaaaaacacctaggttgcccattgccatatgaattcactgcatttcaccttaaaattactttcaataatattattttgtattgatatgatcacaatttgcccttgttattcagagacttatcgattaatacatgattttatactgagattctaatgtttgtagttttgtgggttgcgatgttccgttagtcacctagtgcttctgtatttgttaaaagcacctctactgtatcatttttgctctctaataaaaacttattgatattaaggcaattcaatggctcattatgatcaaatgatgaattacagtgaaacaattatccctgagatttctcttatcgctttttttttctttttgtgacttaggatggccgtcgtgtgcatgttatagagagagacctaacagagcctgatagaattgtcggtgaactgttacaacctggtggctacctgaaattgatcgagttgggtctcgagggtaagcttcccccttatctctctatgtatgtgtgtatgtgcacgcgcgcgcgcatatttcttatagtattagtggtacagtggactaaatctttaactatattcagattgtgttcaagaaatagatgctcagcgtgtccttggttacgcgttattcaaagatgggaaagacacaaaactctcctatcccttggagaagttccactcagatgttgctggtaggagctttcacaatggacggtttatacagaggatgcgccagaaagctgcatctttgcctaagtaatagtctttctcgacacaaatttatctttactagaatttttgacatacttatttttatgattttcttgtattgtttgatgtgagcatttcattagtattttagttgcctctagaggattaaaatattagattatgtttaagtgcttattttgctactcgtccagaatgatgtatttcacatgttctttccttctacatgcgccgtatctggatgtatctaattcgtgcacctgcatgtgacatgaggtaaatgtttggcattatgttttatatttcagtgttcaattggagcaaggaactgttacatcattggttgaagaagatggtacagttaagggtgttaaatacaagaccaagtcaggtgaagaattaaaagcatatgcacctctgacaattgtatgcgatggctgtttctcaaaccttcgccgcgccctttgctctccaaaggtacagtttttagattttgcactatccttttttgttcatgcatgtagaagatctaatactgatggaaatatgtggttaggttgatgtaccatcttgttttgttgggctggtcctggagaattgtcaacttcctcatgcaaaccatggccatgttgtcctggccaatccttcacctatcctattttacccaataagcagcactgaagttcgctgtttggttgatgtccctggtcagaaggtgccttccatagcaaacggtgaaatggcaaaatatctcaaaacagtggttgcacctcaggtattattttgctatttcagtcagtcttgtcccgagtttttgcttgcctactcatagcaactaaatgtcaatggaaatgttctgttgacagattcctccagaaatctatgattcattcatagcagccattgataagggaagcataagaacaatgccaaacaggagcatgccggctgctccacatccaacccctggtgcacttttgatgggtgatgcattcaacatgcggcatcctttgactggtggcggaatgactgttgcattatctgacattgttgtgctacgtaatcttctcaagcctctccgcaatctgcatgatgcatctgctctttgcaaataccttgaatcattctatacactgcggaaggttagtcttcactcttcatttcacaatttaccacccacctttcaaaatgtatgctgtctaatgtatggcgctttcatgttcacagccggttgcttctaccataaacacattagctggtgctctatacaaggttttcagtgcctcacctgatcaggctaggaatgagatgcgccaagcctgctttgattacttgagccttggaggtgtcttttcaaatgggcctattgctcttctgtctggtctgaatcctcgaccattgagtttagtggcacatttctttgctgtcgctatctatggtgtcggtcgcctaatgcttcccctcccttcacctaaacgcatgtggatcggcgtaagactgatttccgtgagtatctcaaatcttattcttcaaagttttcaaactttactatttccatcgtggtaccattcatggacagttttctatacaattttttcattccctatcctaaaccctaaacgctaaaccctaaatagacttttttttcccgtttctatactattgctaatccagagttttcactgcagagtgcatgtggtataattttccccatcatcaaagctgaaggtgtgaggcatatgttcttccccgccactgtccctgcctattatcgtgctcctcgtccaatggagtaaggggggaaaatgaaaggagaagcgaagagaaaatccctgccactgtcctgatcggcggatgtttttcgtggatggcaattttcctgtgtaattggtagtagtcgtcaggccgtgaggttgtgtgtgctgttgttctaatggaacgaggggacctgtatacaccgtcacattccctgtacacttgccactttcgttgttccgtcagggatgcatgtcgactgctaatccttaagctgtatatcccccatgaattcatcatgattgcgtctttgctctaactgggtgcgttgctaatccactgaattccattgggtaggactcctgtgtgtgattgattgatacaactgtgtttgctagtaaacaacatcattagggcattagcaatgcgccaccgtctcagcgagaagcccagcctccacataggcaaaaaacagacgaagctcctgtctccccagtgcgtgtagctttgggtggggtccataacagatttttttttctcacgctgggcccaccacgggaatacctttccccacccatctctctccccgagcaaatcgatcaatctcccgtacgtgcgctgctccttctctctcccgtgccgctgctccttctcctccgccgcttcttcagatcgatcccgtgctactgctgcttcctctcctcctcctcctcctcctccaggcggcgcaaatcgaggtgggacagggccgacgagatcccggaggacgtagagatggggatgggtgagatcgaggcggccggcgagctcacagcgacacggatcgagactgccggcgagctcccggcgccacggatcgagacggccggcgaactcccgaagggggcgcagatcgggatgggtgaagtcgtggtcgtcatcgccgtcattcgccggtttacctggtaagactacctccatggctgcgccgccgccgctgggctcctgctcgagctccccgcgaagggggtcgtgggaggaagggcgaggccacgacctccacaacgcggccgcgccgttctcccccacgccgcgcgccctcgagttgtcagatagttgcagaagaacgggtggccaaagtatgctccgcggacttggtttggtcgcgcgtgacgcctagctggctgcgaatctccgacgtgtcgagcgatggccgaatgacacgtcggagcactgtgaatggctatggtccaacatgccaagaggcccacgatctgcgatctgtaccatttaatattttcatcttctgtttggcttccggcgacggcgattgccagtctttgctcctcctgtctgttctgtctgctactgtttcttttatgcaaagttgcttggtccacagcactaaataaagccatggtatctatgatattcatggcattctttcatccgacgaacaattcctgcaagtagtagtcatatggcaagggccaaggggcatgtctgccagactgccacctactaataaccagtaaaaattatcacttcattaagcgccaagatccgtgcctggggatctcggactgtagcggcagaagaagaggtggtaatgcaatggccacagcctgtaaaactgggagccggacatggttttccggcctcgagattcgtgtggcgggggcgagatggacggctaccgtttgctcgctgaatcacgttgactcctgttgcgcaaagcagctccagctctgccaacacgagccacgccagcgaaagctgacgatgccattgccagctgctaatcagcggcggtccggccttttttcagctcacttcttctcccataaaacgtagtctcccgtcacctcgcttgcacttctctaagcttccacccacccacgtacgtacgcacgcagagcagcaagaaatggatgcggtcgccggcgccgggcagctcgttggcctcgccgcggccacgctcctcacggcggccttcctcgtcgcagtgaagatggggtggcggcgccgccgccgccaacgggaggtcgcgccggagggtggctgccgggttgttggcggcgatgggggtgaccggacggacatcgtcattgttggtgccggggtcgccggatctgcgctcgcctacacgctcggaaaggtggctacatttttgtctctcactcgtttgttgacgtactcgcatttggttgaggcgaatcgttcgtatctttttaggctggaattttgctttcgtaactactactagtaccagtctaccaccaacttgtaagtggcgcaccaatgcaccattgatacgaaaatgttttatttgttttttctaaaagtaatacatctgggttttttttctttaaaccgggccaacaatagctggtgttatgtacttatgttcagtacgagatgcagtttatgtacacttttcacttaggagtaaaattaccaaagcgccaggttttttttaacaatactatgttttaggattagtgcaaatttctaatcatcaagagttttaccatcatcttccttaaaaccacctagattgaccatggaactgtactagttccatttcactctatttctcacttaaaatactttcgtactataattttagtaacctgtacggtgaaaataatgtcttgtagaacgtgaagagtcaaaattgctattgatacaaacacattgagataccatagtgtcttttgtatttggtagaatgaatcacttctattgtactagtatcattcatgttatccgacaacagaacactcaatagtaaaaatgcagtcatgtatctcgttaccatcaagcgatgcattgtggtaaaaacagaaatatcctgaaaaagaaaatctaatattcctggtttcgtttgttgaattaggatgggcgacgagtgcatgttatagagcgggacatgacggagcctgatagaattgttggtgaactgctacagcctggtggctatttgaaattgatggagctgggtcttgagggtaagagtggcatttttcgaaaagcatcgtcagtactttgtacttaatgtcctttgattttattcagattgtgttgaagaaatcgatgctcagcgtgtccttggttacgcattgttgaaagatgggagaaacacaaagctttcttatcccttggagaagttccattcagatgttgctggtaggagctttcacaatggacggtttatacagaagatgcgtcaaaaagctgcatctttgcctaagtaataacttttgcgcatgcaagtttattttattgaaaaatcatatatttatatagttcttctgaataatgccatgtgaacattccatttgtttatattactctactggattaatacatttgattgtgtcaatttcttgattatctacacctccagaatgatatactctagacggatctattggatttacatacttgattatgattatgcaaaatttactactttgggcttttgctgtccactcattctctctttttatgtaaaaaaaatacacctgctttcagtgttcatttggagcaaggaaccgttacatcattgctcgaagaaggtggcacggttaagggtgttcaatacaagacaaagtcaggtgaagaattaaaggcctatgcaccattgacaattgtatgcgatggctgtttctcaaacctacggcgtgtcctgtgctctccaaaggtacatttttcaaagtatactgatttgcttcttgctgaattcaccaatactatttttgacttgactgaattcactaatattaatgggaaatacatgcgcttaggttgatgtgccatcctgttttgttgggttggttttggagaattgtcaacttcctcacccaaaccatggccatgttatcctggctaatccttcacctatcctatgttacccgataagcagcactgagattcgttgtttggttgatatccctgggcagaaggtgccttccatggcaaccggtgaaatggcaaaatatctcaagactgtggttgcacctcaggtattaatttttgctctaccaagtgtaattattattgtgtactcttcacaactagatgctaattgaaatgttatgttttcagattcctccagaactccatgattctttcattgcagcaattgataaaggaagcataaggacaatgccaaataggagtatgccagctgctccacttccaacccctggcgcgctgttgatgggtgatgcattcaacatgcgacatcctttaactggtggtggaatgaccgttgcgttttctgacattgttgtcctacgcaatcttctcaagcctctcggcaacctgcacgatgcaccttccctgtgcaagtaccttgaatcgttctatacactgcggaaggtcagacttcactcttcatgtcacagttaaccacctagttttctcagaatgtgtatacggttttagtaaatacaatgctattatcttttcagcctgttgcttctacaatcaacacactggctggtgctctgtacaaggtcttctgtgcctcaactgaccaggctaagaatgagatgcgagaagcttgctttgattacttgagccttggaggagtcttctcaaatgggcctattgctcttctctctggcctcaatcctcggcctctgagtttagtagcccacttctttgctgttgctatctatggcgttggacgcctaatgctccccgtcccttcacctaaacgcatgtggatcggcgcgagactggtttccgtaagttcctcaaatcttcttctttttttaacatcctcaaagttcaaatgcacggtcatttatacacagaaaactttgtggcagcctctctgacattttctcatcaaaatccatacaactgcagacgatttcattttctctacataactgaattttcactgcagggtgcatgtggtatcatcttcccaatcatcaaagctgaaggtgtgaggcaaatgttcttccctgctacagtccctgcatattaccgggcccctcctccaatggagtaagaatctccatgttagcctatggtgtttgctgttctttagttcttttgagctgtcgagtgtgctcattagagtagtctgttcttcctataggaaattgggatgtgtatcgattgtcaatactaagttgtatatccctctgaacttgctaatgcgtcttgctcattatctcttttagaatatttgaggtgctctgcttgtctctactgcaccgttggaatgagctagttccttgtttttatgggcacacttcctaaatgccacgcttttttgaaaaaaataatctttctagaagttttttttaaaaaaataaatgattttttttttcaaaattgtaatagttaatcataaataattatgtgttaatgacttatctcatctcgtgtgccgctgaaaagctcaactcaaccactaattcgaacagtgctttaccctactgaattccatggaccagaatagtgtttgatctgtaaagccctgtaggcttaggctggctgggaaatctaagagcaagttcaatagtatagccaactactagctccaattcatctatagccaatctaatagctcattcatataatagttacatactacactattaatacctagtcccacctgtcatactcacaccgcgtcttgaagttcgtgctacagctggctacaaatctgtagcccgctactcttctctctccttatttatctccttaaaaaaatatttgcagctggcttatagcctgctattgtacctgctttaagggggtgtttgggagtctctccaaaaaaaaattaaatctttaccctagggacttattttttagaagagggactactcccaaacaccccctaaactagtcgctttcgtccttgcaagtaatccacgatcaccgaaatcttcttttaagctgcttgttttgttgaaaaactgaaaatccgttacctttgttatgtcttatttgaagaccttaagattttaagtagctgtttgttagccatcttaagagaatatagagaaacggtaaaacccaacttttgacttctgttttttatttaattgtgtacctatatcgtcttagagaatatgatggactgtttgcgaaaatattttaattctgaaaaaattatagctgttaaaagctctcctaagcggactcttaatcgagactctagttgtacaaagaaacaaaaaatcttgtatgcaactaaagaagcaaaatcattcaaggaaaagatatagtagtaggacaaccacctggacaggttgaccagaaatctagagcacacctccaaacctgacgtatgaactcctactagtaaggacaagactagtgagcctctggaagctctttagagcaggttcaatagtatagcctactactgacttcaattcatctatagctaatttaatagctaatttatacaatagttgcttactatactattaatatatagtttcacctatcatacatgttgcgtcttggagtacgtgctgcaactggctacaaatctgtagcctactgctcttctctctcatcgtttatctcattaaaatatatgtttataactggctaatagcatgctattttacctgctcttagccagatccggataacgcatatcaatgctatcctgcatcgatcatgccgtttgtgtcccctgatctcggagctgctggaagcagaaaaaggaacagaagtaccgtgtttgtttcggcatcgaactcttcccttcaaacgtctaaatgcatgcacaggcgatatgacgtacacatacatgcagtaattaagcgccggtgggtatttggatatttggattagcatacccacgtggaggtcgtccaagaaaacgaccacttaacctcgtgtcaaaatcggcgtgtacttccgtttcgtgtcactgcagctagagtggcaaatttggccacttccctttcgttgccactgtgaactgctagctgcggctgtcctgctgctacttgcttcacgcgtgcgtgaaagtacattaggagaaatcaacatctgatgtttatggattgggaaaggaacaacgacgtcaaggctgtcacaacttaaaattaattgtaaacgttgtacatcaaaacagttgccttcaatcggctttgtgcataattgcattcaccgttcgcgtgcctagatgactgagtgactcggaattatgcatttgttcattagcgtactattcagttatctcaaagatttggcaatgacaagattttattggccacacagagattacgcagtaagatgatctgcatttgcttcctgttcgtccaaattccacttgcgctgtgatcactgtcgctacaggaagatatataaaacgacaataatctacattggatgacatgaggaataatcgggatccctttgcccataatccatccttaatctattgccactgtccatcctttcttgtcctcagccaggcccatctggatggacgtcagagtcgtgtgcagtgtctgcgataacgtgtcatgtccagtcctgaactcgtacctgcacacgcgcccaagaaaccgatacaaaatcgtcagagatttgcgggattcagaattcagatcgatcctgtcgtgaacgatcgactcgcagattttacctttgcccatggtaagtaacactcgatactggggcaacgaccaccgctgttccggtgcagaacacctcgtctgcgccgaccagatcgtcgatggagacgagccgttcttcaacctgcttggccaaagagatcacaacgatttcagaattaatttttttttcgcgaatactcaaaataattacacggaaaattttcagaattaattcagatgtgctgtcgccaaatcactgatggatgcagtgctctgcgtagattgattggtcacctgatagccgcggtccctggcgagctcgatgacgctcttgcgcgtgatccccggcaggatggttcccacggtggccggcgtggcgacgacgccgtccttgacgatgaagaggttgcaggaggaggcctcctccaggtacgtcttgtgcaccgcgtcgaggtacagcacgtcagtgaaccctctgctcttggcgtccatctgcgccttgagcacctgaacacatttagatgtaatagatattaattcctccatccaaaatattgttacttagtatggatcccattccaaaccaaagaatctgaacataacctctagccgtcagatttattgttttagtatggataccattatagatcaacgaatttagacataaccactgtccagatttattattttaatatggatgctattatagaacaacgaatctggacataactactctctatatttattgttttaggttataatattttgggacggaagtagtggatatggtatcttttgtttaccggcgcgtagttggtgatcgtcttgaccccgccggtgccgcccggcatggcccggtgtatcgagtcctctacgacaaggtttatcggcgctagaccctcctgaaaccgatccatccatcgagtccaaaatattcagatttttgctagctgctgcagcgttcagaaagacgaccgagctaatgaccgagttttgtgctcaccttgaagtacgttccaaccggtgcggcgtagatgaggaacgtgtactccggggcgggagccagcccgagaatcggtccgctcccgatgagcagcggcctgatgtacagcgccccctttccttgcggtggcacctgatagaaaaaccacgcaacgcgaccgaattaccacggggaattcatcgagatggcgtgcgagaattaattgacggtcgtgttacgttcgtcgtacgcgcttacgtacccagcggcggttggcgaggacggtctgcttgacggcgtggacgaactgctccaccgacggcgacggcatgcacatgcgctcggcgccgtgctgcatccgccgcgcgttctcctccggccggaacagcatgtacgacccctgttggttcgccgccctgtacgccttcagaccctcgaagagcccctgatcatcgagcacatacgtacgtacgcacgcagccatcaccctcgttcacttgttagtccggtcgcctggatcgacgtttcgttgcatggacatgtgtgtggactggagaacgtgacagacctggccgtagttgatgacgccggaggaggggctgagctcgatgttgccgtagcggctgagctcgccgcgggagaagacgccgtcctccagcgagcaccgcatgacgtacatgtagtcggtcggcgtcagcccgaaccccaggttgtcccagtcgatttcgccgccgctttcctcatcggacctgcacgcacactcgtacacgccccggcggcaatggcataaacaacactaaatccgaagcggacgtgaaaagaacaaaaatctcgttcaacggagaccggaagagtagaatctgcatgcatgagtagggggctcacctgtcggcggagtcgagctgcggcagcgacgacctccaccggcactggagcagagaccacctgcctccggcctgcacatccacaaggcccctaccgtgagccccaaccgatcgcatcaacacagaaaccatctcgatcggacagaacgcgcgcgcaacccaccacgagtcgaagagaaactaagcagagcgagtgggatccgaaccactgaaaaagtgcgggtaatcacacgtaccgtcgggagcgccccgcggagaccgaggccgccgccgccgccgcatccctgcagggccctggccagcgcgtggtgggcgtcgcgtgcccacgggaggagcgcgcgcttcgcggacgacgcagcagcagcagcagcagccatgcaagagacctgtgcggctgtgcgaacgggaagcgcgcgtctcaggctcagctcgtcctcgttcgtaaccaaccgttggcgcgccaaggtgaggagagatatacacgagtcgtttcacggaaacagcttcgcgagtgtgtgtgtgttttaaactactctcggacggggcggcggccgtttgtggtgttccggtctcgcgttgtacgtgtcaggatttgttggtggcgatgcaagattacaacgaacgacgtttgacgtcacggggctatcgatcgatacggagtggagagtaccatagtactatcacgaataccaataacttgtgggcaaaattggttatatagcatcgaaagttcacgtttttagttttatagcatcgaaagttaccggttcattttaatagcacctaaagttcaccatgttcccatttttaatactttcgtcaattctcgatcgttttccgtccgtcttgatccagccacacacacgatatgacgtttctacccctcacaagtacaaatataatgcatatcaatgaggggtagaaatgtcatatcatgtgtgtggctggatcaataacgatcaagacggacggaaaaaatgacggaagtcctaaaaatgggaatagggtgaactttagatgctattaaagtgaaccggtaactttcgatgctataaaataaaaacgtgaactttcaatgctatataaccaattttgcctaaacggtagcaaccttttccgtatatatggacagcacagcgacgggcgaggggtgtggacggccggaccacctctgggcccgcgagtcagtgagagggctgtagctgcggttggtacgactttgcgctgcacgcgtgatgggtaatccgggaggaaggcgtcggctcacggctctgacggtggccgttggtacggctcttaaaaaatattatcttcatcttaaaatataaaataattggttgatagccagtttctaaaaatctaaaaagattaggtttctggcttttagtttgttttctgaattctacaattacaatttctcataatctagactaaaaactgaattgtttagggagctactgattttaaaaaaagttacatcagctaaaagtttccaatatgcatagttaaaactagatatattttgaatggaggtagcaagtaatatacctctctctagagtttttaatgggaattgtggaggaaggagtgccggagtggtgttattgttgttgtttgaaataaaaaaatagatgaaacaaattaaataagaagagatggtcgtgattggtgagataaagaaaaataggtaaaaagttactatattttaagacaaactttaaacattaaaaaatggtatatgttaaaaatggctatatgttaaagacggagggagcgagggagtaactagcataataagagcaagtttaatagtatagtcaactattggctccaaatcatatatagtcaatttaataaccaatttatataatagttatctacaaatatatactacactattaacatattggaacattctgcctctctcatgccgggcccactaacatctgatgtcttttttgcacactttgtcctcactcgtgtgcacccgggaagaatttcctaaattgcttcaggccaagcacgcttaaccctggagttctttggagatcggcttccggaaaagaagttgcaacttgttgatatgagtattctattaatcccattaacctctgagccgggatgtcatatcctcaaccccttacctcttggccacgtccatgtgtccagtaccagcgcatgtgccatgttgtgtgaccactccgggtccacaccagccgtgcgcaccatgcctgcgccactgcgacacacgcgctcgtgaaaccgcgactacttatatctgatagcttttaaaggtcatagactgccctcacagaccaacacatgtcttttctgcacactttgtcctcactcgtgcgcacccggaaagaattttccggtcggtcacccatcccaaattgcttcaggctaagcacgcttagccctggagttctttggagatcggcttccgaaaaagaaattaatatgagtattctattaatcctattaaactctgagccgggatatcacacatatggtcctacctgtaatacacacattgtgtcttggaatctgtgcgacagctggctatagatttgtagcccgctgtttctttctcttctattttattttctcgatatgtgattataactagtttatagcttattattgtatctgctctaaataatctcttcagacttcacctaaaattgcatatcaagtggtgaagcgtgtcagcgtgactgtgtgagccactgagcccaaacgggcgcctgaaacaaattattgattatattagattactgttatgagttctcaacttgattaaataataaattaaatatttaaaaataaatttaacatatactccagcttaattagaactttgtggtctaaataatttcatagaagaaagtttttgagaaatagtagtaacaatatccaatgaataagctaaaaaaggtgggactgctattgaccatttttatacttaacaaataaatttctttacgtaaaaaaataaatttcttttccagaacgtagtaaatatatttattcttcacatttgtattacttctttatagaacatagtaaatataaactcacatcttaaattgtactatttcttttgtgttgcaaagattaaggaatatggatgaaaagatcataatacctttcattcctttagagcaaggttaatagtagcccactactagctccaattcatctatagccaattcatacaatagttacttactatactattaatatatggtctcatctgtcaaacacactgcgtcttggagttcgtactgcagctggctacagatctatagcccgttgtttttctatctcatattttatcttattaaaatatgtttacagctagctaatagtttgctattgtatctgatcttaggtggcttagaaagagtggctttgaaaatggtaggatagccatagtagtactaaataatctaccgtataaaaaagctatactacttttttgggacgggacagagtatatctctttcacggttatactactgccttcgctttcaccagttgaaggtgttctgaactttctgatcgagttgcgtgtaatttgtttcacagggaggatcgacgagttttccagctcccagcctcccaccaaccagctaccgatatgcttttgagctggccgctggcgcatacagtctcgatcctaccttgcttatcctcttcgttttcttcttgatcgttggcaaattgtctcttcagctagtcatccatgttgccatatttgcatgcaacccatgactgtgggttggtgatcagctacgggacagatcacagatcgataggcatgcacgccatgcagtcattattgtggattggatcggctgactctatgtctacgtgtacatgtctgtgcaagtggattatccccccccctcccccccggggcgccccacccacccaaaaaaaaaagccagaactccaatccacggcttccacgctcatgttttctatgatttcatcaagctgagtgcatactgcatacgtatatatagtagttttgtatgtattttatgaaaatttaacaagaaatggaacaattctcatacacaaaaaggaggaaagttcctacgattcaaaaaagaacgtgaaattcaaaaagaccctgccacttgtagcaatggaccagtagtggagctagcttaaacaagaaatgggaagggccaattaaaagtttcatttatagtaggaactattatgctacggagtattttgtgtaacaaatatgtgtctaaatttattaatatctatatgaatataggcaatgctagaaagtcttataatatgaaacggagaaagtattatataatattaacaccttaattaacttctctactgtataattcatattattatatcctcaacgcaacaaacacacgaatcatgataccatcgaaaatcaataaacggttggcaatataaatactaatggatagtatatgttgatttgggcggatctaccataggacataggacatggggtatctacctaaaatttttggcaagtaatctatgtaggtgcaatacatgcatatatattattagttgggttagaacaaccattccctaatgccatgtacaacgcatgaccttagcttgtggtctcacggctctacgtcggagccgagctgagctggcacgcccgctcgtggtctcgcaggcgcgcagcgagcttgtagaaaaaccgaaagaagcaccgcgcctgcgctcgggagccgtgaagccacgagccgaagcctcgcgttggaggagtcggagccccggtcgtcgcctcgtccggacccccgtgcaactgccccaaatccccatctcgtcatggtcgtcgtcgccaccaaatctgctgccaccgccatggtcgtcgtcgctgccagatcaacgcagccgccatggtcgtcgtcgtggtcgtcgtcgtcgccagatccggcgccaccggtgctccctgccaccgagctcgccccggagaggggaggggagcagtcggcgagctccccgccgccagatccggcgccaccgctactccccgccgccgagctcgtgccggagagaggaggggagcagccggcgagctcgcgctcgagaggggaggggagcagccggcgagcccgcgccggaggggaggggagcagccggcgagctcctcgccgccagatccgcctccactgctgctcctcgccgccgccagacccgtcgccaccgctgctccccgccgtcgacctcgcgccggagaggggaggggagaaaccggcgaggggaggggagaggagaagagaaccgagcgacacgatgcggctgtcggtggagaaaaatcgaagagagagagaggggaataaaaaagagagggatgggaagagactgacagtgggtcccaggttgtttaggggtgtacatatacttcttttggttactctagggttcaaaatataaagtttcaataggttttataatacaagggctgacatataaatagataggggctgatatgcaaaatacgttttggagtggtttccactgtaggtagtgtgacctttgtgtgattctatcctacttgacgtcttgagaccataattgcttgtggctaccattgtacgtgacctaataaacctagaatcgtagtacaacccatgaaacagcttcggcagaatccttttccttgaccctgatgctttgctgtggttcaatcgttgagggtaatgccagtgcgccccactgcaacgcgcggccatgcaggcgctgctcgcgtcgagcaccaaccaccaagcagcagaaaagcttggtgcctgcgactgcgatagactgatagggagctagcgcctagcgctactgacaacaaaccaacaggcaacagtgagtcagctgtgctataggctgtgtttagattttaacttttttctttaaatttttgaatttttccgtcacatcaaatatttggacacatgtatagagcatcaaatatgaaaaaaaaaatactaattgcacagttcgactataaatcacgagacgaatcttttgagcctaattacatcatgattagccataagtgctacagcaatctacatttgctaatgacagattaattaagctcaaaagattcgtctagcagtttacagtcggaatcttgttttgttagtagtctacatttaatacttcaaatatattttcgtatacgtaaaaaaaatttagccaaatttttacagtatttaaacacggccatactctcaatatcgagattgttcacattggccatactctcaatatcgagattgttcacattaaatcagtggtgaacccagaaaaaactaccataatcctatacgtaccaaatttttaataaaatctaatatactaattaacatgatatataaattactctttctatttcttattacaagtcgtttgacttttttttgtcaaacttatttttaagtttgaccaaacttataaaaaatataataatattttcaatacatatcaaatatattatcaaaatatattcaattttaaatgtaataaaactaattttgtgtcgtagatgttactattttttctataaatttgattaatcacgaataattttaaaaaagtcaaatgacttataatataaaacggataaagtagttatcattgaataatttacctgggtcatatgaccccgttaagcggttcaacactgcatatattccaaaaaaaaaaaacgttatgcacttttcctagcccatctttcaaatagttaatggttgattcaattgatatttcttgaccacactttgaagagctcgtcaagacacagtagtgatgccgccatcgcccatctgaaaaagatatggtttatatggttttcacccagagaagctcgtcgagaaagggaaagggtaacccttgacaacgccccaaagaggttatgacgtccgaagacgtagcccagtgaaccaccggactaggctttcgcctgggatcctacaaccttgactgcaggtcgctgtccaccaactcagaaccaccacacaggcaaatggcagcatgtagcatccaccacaccgcactgacgcccctccgtcggccgacttcatcgaaccaccacccctgagagctggcccaggacccctctgttccaccacccgccggccgcctcgccagtttttgccaaagaggaacccaggactaggtgtcattgcttcgacagcctgagcttcccccgccgacgagttgccgcctcaatccaacctagaatctccccgcaaagaaggggaggagctccaggaagggcgatggtgccgaccggcaacgaggaagacaacccaccgccgccagctcccttagcactaccatctcgccgccggtggcggtgccgctccagaccggcgccacccactggccccgttatccggccgcgcgcctcacctagccaccgcggtggcatctcggctgcccggccaccacgccgagccgtcacctaggtctggacgctgaggacgacctaccttgcacagggggcggtcgctgcgtcctgggctgctgccgggcggccaggtcgagctggggcgctgctaccgagccgctgctgccgcgtcgggcaggctgcgctgccagccgggcacaccactgccgcctccgtgcgcgggtcggccacgccgagttgcggccgtccgccgccacagcgcccgggctggcctcgccgagccacaaccagccgcctcgcccccggccaaaagccgctgccaccacgcccgcacgccgccgcgctgccgagccgccgctgccaggttgagcgggggcgccgctgccgagctgccgctgccgccttgggcagccggccacgccaccgccgcctctgcgcgcgggtcggccacgccgagccgtcgccgagccgcgaccgtccgccgctttagcgcccgggccggcctcgccgagccaccgcccgccgccgactccgcgcccgagccgggccggccgagccgcagctgcctgccgtctcgccgccggccacatgccgccgccaccatgcccgcacgccgctgcgccaccctaagccctcgcgccgccgccgcgcagatccaggtgggggatggccggatccggccttgggggcgccggatccgccgcctcggaccgtgctggtgggggactttgtcgtcttcgtcccgtccagttcgcgctgaggaaggaaacaccacgaagaaaaaggcctcaccgccgccttccctactcgctgccggcttcaccgccggcgagctccagcggtggcgaggaccagggatggagaagaggcgtgggcagctagggtttttcaccccaccgagccgcccgcgcgagagcgacgcggggagagagacgatgcctaaatatatccatcacaaataatttttatttctctatgacggataagcttttgtttttacggtgaaacaattttctattactctgtacctctatatatctctaaaatcatgcgtttgccactggactgtggacgaacatgccaatcaacaagactgttggtgatgcatagattagcaagtggttgtgtccagcggattcatatcctctgacttttcgtaggattaatatcaccgcgtgagatctccctatctaatccgtccatttgaaaccaatggttgagtattagggaatttaacttcacagaatcacaggtcaaggcgttgtgggtcaattaatcctcagccattgatttcaaatggatggattaattagggtgaatggctaatttagtccctcaagttttaccgaaggctcaatttggtccttcacgtttcattttgtccacatagctcctctaaatatttgttttggcttgaaatcattcttgggcccacttaatatgccatatggctatttctagttaatatttcattggaaaatgtcccttttgctcttaatttgtatagaaaatagaaaaccaagatgaataaacaacagtgcagatgtacttcctattattttaacatgtgcacatgaaacttaagctattgctatcgtatacactttatagtacataatttatttttgttttacataatttactatgcattatctataaaaaaagttaagcatgcaatttttctcttatatatgtgaatgatgggggtataagtatcatttatcaaaaagttgttggttaaaggataagttcgaactaaactgaaaacttaaaggagtaatacggatagattgaaacatcaaggactaaactgagcatcagatgaaatttgtaagacaactttgactattcatccattaagataggaagaatgtcacgcggtgacatgcattaatcctacggaagtcagaggatacgaatccgtgtcgagcttgcgtggagttgacatggattacttgctaattaatctgtctctaccaatatgtagcgaatagcactcttgttaactgtactgtacgcagtataaccgcgcacactttacacgtcaaaccatttggatccgtaacacatacacaagaacaatcttagctagaaagaaggtattcccaacatttgtagatacgtcgatcctcttattattcaataactcaagttgctactaccttctgtccaaattgatcatcatatattaaattcaaaatttctcaaattaattatcatataaccgtataaatacggatttcatcggaacaaaattaatgtagcaaaggagaatatatgcatatcaaggatataattggcatagtgttttattcgatacatgtattgtgggagattgtgtgcattgtgtcttgattgatacgatttaaattatttttaatcttgctgaataaatacatatgatcaatttgagatgaagggagtgtgacggagagtactacttaagagtatttgctgagcagtaagcacttacggagtacccctacacattcggagtaaggggctggaatgtgataaaacagtagcaaaatctgagcagttctgtactcgtgtggttcccaaagacctggggggaatgatacggctggccttaactcgaccgttcatggggttcacggctgcttcccgagctctcacttcttggctgcttcctccactgcagacaaaatagaaagacgaatgggttgaaggcatcaagtcacacttgacatcgatcgatgacaaggttgcggtctagtctccacatcagcaactgaaaagggtacatccccggggcagtgaatggtgcaatggccatgtttagtttatattgcaaaattttttaggccgtcacattaaatatttgaacacatatataaaaaatattaaatgtaaaaaaaaccagttacacagattacgtgtaaattgcgatacaaatcttttaagcttaattacgttataatttaacaatgttgtgttacagtaaattttgctaataacagattaattagatttaataaattcaactcaccgttttttggtggaatctataatttattttattattagattgtatttaataatttaaatatgtgttcgtatatcggtgtgacaacccaaactttcgcccaactaaacaaggccaaagcctcgcacttttacagctacgtgaggtcgagcggcgatgctgtaacgcaggagattcctaggacaaaaatgtgagggcctcgttgccgtgtgaagttttgtgtgtttgacgcagcctgacatggacgtgacatattagcacggctggacgaaaacttgattctcgattttaatagtcgataaaaaaatgtcgctgttaaggtactgtgtagaactttttacaacgacgcggaaaaggactgggttgattgcactctcacattttttctactctccctactttagatgaccgtaaagccgtaaagagaggattaagcttagtgatctagtactactacaagctttctttgatcacctagttcgcttgaaatcttaagctaaacgtgtagccggaatgataaaaaaaaaaaaaaacgtgtagccggtactgtaggcggggacttcccggagtccgtacatgggccggacccacttcctatgtccaggccagtggtgatgatatagcccattaggctgtcgacaaactgggcccgttggacatgtcgactctcctcgaagccccgtcaccccgtgccaccgttgtcctccgtcctccccgcctcgcacggcgcatccgttcctcgcggcgccaccgacacccgctgggcttccaccgtgcagcggcgaaaataatgctgcagccgcggcacctcgaacgcgcggcgcggggcgtctcctgcaccggagccggctaatcacgcagaagacacgggcgcaggcgtccccgcctagtacgcgatcgttgtgctgcggccgagccaaaccacgtacgcgaagacgctgcccggtgtgacggtgccctgcgcccccatcaattctaagcgagtactccaccaacactagcctcccgtgatggccgaccacccaccgatcgagagagcgtctcacgccgaacgtatgagctattcattgcacgaggaggaaacatgctcacgctgaacgaatgggcgggcggaagggaagaagattcacgctcacgcacggctcacgggatcggcagggaaggccctggcctctcggtgaaaatcagcccaggagatggtcacctgagcccagcgcgcagcccatctagtcgagatctaacgtggcctcgtttccagggctccttttggtccgttcgatcgatcgagaagctgcgatgcgatccgcgtacgtatgccgatgccgtgccggtgcagaatctctatggacctcaactcgatctcctgcctgcctctgcctacctcggcttggcttggcttggcttggccccatgattcgaattctctgctgcactagatttgctttcgccgcccacgtgcattgctccggagcatttactactgtacgtgtaatagtatctgtcagtggaaggacggacccacgacgggcttgcgacttctgggccgcggatcacatgatcgacggcttggattaattgtccgccgtgactggggcaccatgcccgctttgcctcggatgatctactcattttcttttaccacgacgcgtgatgtgtgactactataacttactttagttgagataaacaaagaacttactttacttcatctagaaaacttattacttgacccaattaggctatctcgcactttgtcgtatggtcgtggcagattcacgacatgtatctctgcaccacatactaatgccacccaaaaattaccataacgtaagtttctgcgtgctgtgttatggtgtcatgcggtcacattatgcgtagacaggtaccgaaagaaatatattataaaaaattaccgtttgatcggttcattagagattagacgaagactaaaaaacacatgcaattccttttgttttctgaaccttggtgttctctcgtgggaaagcagaggacgttggcaacgagagaacattgtcgtcagccaaggttccaattccctgcggatatattccatatctcatctgattgacctgacgtgcgggcagaaagcaaatctctccacatcgcaaatgaacagtgacgatctaaatataaaatcatcaaaaaaagcctgaggataatgttggcagaagcgagacggaaatctacgggtagatctcctgcattgtattcctctcctgcaaaccgcccgttggtgccctcaaatcaatcctgagatgacagtacagagggcagttttaatccagaaacaatattcctatcgccggccggtaggtacgctccatatcatattcgatctcatccaatttcatgtgcagctcggtacgtagaattaggatcgtttgattgtacaactactaccccgaaacgaataaattgtcacgcacgcacgatgcgagaaagataggtacggaaagtacgtatcccacaaagcctgaggtcccgagggctgagcccaatcctgatggccaatgattgcgtgaggcacgtcatgtgggcatgccgcagcgagcgtatccacaggtaaatccgccgcgaatgatgagaggctgacacagcctagtacagagagagagagaggcacaggagatggtcccgtctcgatgtgccgctccgcccaacgacccgcgcgctagtacagacctcgtcagatcgttgcctcagatctcgggacaggctcgggcgaacgtgccggcctttgttgctgacgctggggcgaaacgcgccgatgcgcgtacgcggcgctggtgtccagaactcacaggagggcgcgcaggtcgccatgatgcgcgccgcgcgggggacaggagcgacgacgcgtcgcggaggcgcgagcgacacatttaactctcggggacgggaggcatgtggacgtgcatgcatgcacgcgcgcggtgtgaccggcgtaaactctcgtttgggctcgctcgcgcgcactccggccgtttcatcgccttcacggggaaccggccggcccccgtcagatgctttggtgcaagtccggtgctgccggtatatgtgatatactactactagtcgtatagtatattgtacggagaatagaaaattatgagatcggggaactatctggagttcgatctagactagagatgccaaagcgacatcaaacgtccagatcagccaataagagctaagctcaatcatatacgtgtacgataacaaagtctcgcttgtttgtagcgccaacgcatgctacatgcatgattgatcctcgatatatactatcgtcatcgatatattgtttcgtgcaacacacaatttataaagggttatagagccaacacaacggccagagtacgtgccagatgccgccgcgcagcgcgcagcgagagagagagagagagagagagagagagagagagagcaagccgtcagaaaaggaattcggctgccaggttaaatttccaggagagagatcgatcgaacgcgcgcatgcgtgcgtgcgtgctcccgcgccggccatgccagccaagccccgcccggctcatatttcttggcatgcctcccatattaactaccacgccgcgacgcgaagctcctttttacgtgtcatgatttggtcgtgccatccctcatcacacacaccatccgcataattttcctgtgtaaattagttagtccaggaaggcaggagctagcaagggcaactagcttcgacgctgactatacctaagtgcagtaattactcaacgaactagctactactatagtatgatcgcacggaaaccgtcagtgtccaacagtacgtgcaaccggccgatcatgtatgtgctacgtacccgcagcaagagtcgatcgcgagtggtggtgtggccgtacgtgttaaaattgccttgggttaattaatatggcgtgcagcagagcagagatccagatggctagctaccgctctcaagtcctaattaagcaaacaaaaagatgagacgagagggcgaagtcccgctctctcttcctgattaaccaataatcagcagagaggcgaaagcgatggcaactcaataaatttttgaagttggggagccccgacacacacaatcattgagacgtatatccatacaaaagtaaacacatgtacacgcacccgacagggccgagcgaacaggagggaggcaggcatgctagctaagctagctcatgtcgtcatccgatccaacactgtgcgtgtgtgacactatctaagaattttaatccatcagtagtgctagtatacaagcttaatctatctagctactgcactgccccatgatgatcccctctgaaaattaactagcctgtgaaacaaaaaagaaaagtaaagctaactagtgatgagaggggggcacacagttacatacttacatgcatgcacaaaaatatacattgatcgggtactagctgtggcccggctataattaatttgactaatcctatcattaagcctatgattgatttgactgagatggactgtctagctaatggaagctggaatcccccagggcaagaaacagtagctcaaggagaggatgatgatgcatgatgatcatgtcgccaatcgccatgtatgtcacgtgtatatgttacctgtgacgtgaggtagtactaagctttagctagcagtcagcagcagtgctatgtctgtttggtgttgcagatcgatcgatcgatcgaactgcagattcatgaggatggatggatcggatcagcaggcggcggagtgggtgaaggggttgaagaagtggtgggtggtggtccggccggggccggccttggtcccgtcggcggcgacgaccttggcggcggacgcgggcccgccgacgcgctcgcaggacgggcagatggtgagcgtggcggccgggagttgcatgtagaacggcgccggtggcgccggcgacggctggtgggccgccgaggacggcggcggcggggcgaacttgagcgcgcggagctcctgcagctcgcgctgcagccgacggtttctcctcggtgagcgtctcgcagcagcgcttcaggaactcgcagtccacctccgtctg

SEQ ID NO: 80995 - DNA, 24963 bp, Oryza sativa
tcccatccattgcattagagttatcagggctggaacgcttcgaaatacatcttcatatcaaatatcaagaaaccagacccagttattgatgcaccatctggccttgcttccatgagccagataacagtaccgttctaaataactacctaattctaatactctgctggtattaatttgtgtaatcttgtttgtgaaagttacgtatcttctcatgcaaattatgcagagcaagtcagcaagagtagtgttaccgacacagtggttttgatgtgcagggaagttgtgtactataagtggtgtaaaaaatggaataaaaattcacatagcaacaatcctacctctttggctcataaattaaaatgacagatatttttgaagcttcactcaagtaccaactcaacttaaacttctgacagaacaacttccttccaagtacattcagaggcagtggtatgagataatattagattatataaaaaaagcccctcttgtcctatcataaaagtgactcacctttttttgctggaataaccgaaggaggtcattcattgtaattaagattggaacaaaatgttacaagaaaagttttacatcgacagctggactgtcgaggaaggaaatgcgtgtctcaccttccaaccacaacctttttccatatatattcaagacatattgagctataggtcactcagatgatattatacgcaagttggataacgcatataacagaatgagaaggagaagaccgagagtaacataagcacatcgttgcttgagatgaatacacacaattgatctagagtacatgtatgttctgcgcattggaattggaggtatccagaaaatggagatagcgagtggaatccactagcagtatgttcatcatgatctgtccgcgtttgtttttagtgtggcaacaactgtttcctatgaatgtgagaaatcacagttgtttatattttgtaaatcttgcgatatttgtggtatgattactgctgcaatcgtcagtgcgagaatggagaaacaactcacatgattatttatggagtacaaaaatacatgctccaatatggttattggttcatgaccagtcatggatatggtaagatttgcttgatctactggaattttaggattcgaccttgcacctgccaccatagtcaagaatactcaccagaaaatagtttctcagcattaataaaaaactggaggttgggtctatacatgcattgtaattggaatgtaggagatcacaatcaaatacttcacattttatttctttagataaaatgttttacatctccaccttctgtcataagacacatatccataagtctattaaaagaaaacgaaaaaagataaaaagaaatgaaaataagacaagaggtgatgggaaaaaaaacctcaactcctcttattattggcaagcgtttaagcacatagattttttagccaacaattgtaatggaactacaccacccatagaataagacatccttggatacagattccaaaagtatagcactattgtgcatatagtatcctgctctcttgtggtagcatggtatattaaaagttgactcaataggaatacatgatgataacctgcatatggttagacaattgtttacgattaaaaactttgtcattacaacaccgtcaaattgactaacataaaacgctagctccaactagaattttctttatggacccagttatccctctaagccaattaccaaacatatttttggcattatggggtggtgggatattaaatgcaaaaaccacacatctacaaacaaaccacaaaacatgacacccaaaaacatgtttgtctccccctattttccattagtcaggttatctttgttaggattactttcatatgaagaaaccacaaaaaaaccttgatagtagaacctttaggtcccatagattcctcttatggatcataatattagatttcatggacacggtatacttagagttaactggaaattggctattttatgaagcaaccatacaaagtaattcttttcatttgataaagttatattagctagcatgaggatcaaatcattccacccgattagcttttggtaagctgtggctctcctaaaagaaacattcaacaatgttgtgctcaaaacctctgccacggtagactacttctttcgagccacattatataaagtagggtattgatctttgagagcattctcaatcacatgtctttccaaaatcttattttggtcccattagcacatttaaaggatccatacctaagaaaatggttgtttactttgttaaatcagcctagaattgacaaatacttgtattactggacatatcagagagaggcttaccctttaaattataggaacaaacacaaataaccaaacttaccagaggggagatgaatagtagattatgtcaggggaagtcaaataatcaaattttaatagatcaaagcacaccccaatctcaaaatccaatgtaacacatgtccaacacgatctatccaatctactagggtcggtctgactgaggctaggctggtctgaccgcatgacaatgcacacggaacattgatgaatacaatgctttgcccaaatctaaatatattttttttctaacgattagaataagatgtatgcatgtctccataggatagaacactattgccggaattgaaggcaccgggaaattagagttggaaagaagtttgttatactttctgttatcacgaactaaatgccattacaataagaagtccagcttattgcctaaaacatggtgctacatagccctgatttggtttctgaaaaatgcttagaagtggacgtcactgaagttcctgggttgtggtgttctacattaccaatgttcagtgtgtgagtcagcttatatatatattattgggttggcttggcttgtgacctaagtagtgcaaggaattcatatcagattccccatttggaaacactagctactcttgttcttccctcaaataccctttaatttagtcctttgtctagatgcatgctaattatttctagtgatcagcatgcacagtaaaaaattatgtgtaaccctgcatcttggatttggaggcgtccggaaagtgaacatggcaagaagatacacaccatcgtcctgacttgcttgatattccagaaaaggtccattccagaaacgctttgaaacacatgatggagatgaagaaaacaacccagttattgatgcttcaattcgtaaagcttgctagtgtgtataattaatccctgaactatagatcagtcatgtgctaaaaaatttcctaacttacaatatttcagtgcccccctacttttgtgtacctttatttccttatttctagttaatttacttgtgcacactctcttgggttttcatactattaattcggctatcttcttccaaatatgacataataggtgtcctattaatctataaacatcattgtcaaaaaaatatgatgttaatctctctcttttaagaaataaatcagtgcaaacaacaagaggttaatatgataacccatgttctcacagtctgaggactagcaagtgcaacattccagcctgtttgaagtagttatagagttgaggcccatgtggcttagaagtggttgcagtgggtgttgtagctagtaccaccttagaagtttaagttggtaaagatcggcttataagccttggtactctaaccgtgttacttcaggttaaaccctttatacaatgtcagagaaaaaaaatacatgtaaggtactatgtgaatgtagacacaattgtacctctagcaaatacagtgaaaacagcttatttgattctgttgcacagatatttcatttttggtcccttggaaaataatttggatttggaattatttctaatattaattaagtagcaggtatccaagtaatctaaagttcctcatcaaaacatgaagtcaacagttgtgtttatgaggtaaaaaaaatcaaatcaaaattctaagagcaataatgcctgtttgctaccttatctacttatatatttgtagcacccttaatttcatttgcatttatttaaaatcttggcatttaaaattttggagttaatttggatcttgttgatttttgtgccaaagagatctcaaatcctctcctagaaattcccttcaaattctgtgaaaccctagacaaaattaaaattataatccttctcaaaattcaactcaaatcccaaagaaaattgcgaaaagccactgttcatttgggcccttattcctttttcttctcctcgggcccaactccctttcactcttctctcaagaattttgttcgattttagattttttttaatattgacagaaataatctatcggccaaaaaaattgcataaatagaccctgccaccccaatggtgggcggcaagctgacgtggcagacggtgggtcgaccacgccgtctgccgccgtcggccaaaattgcgattaggccctaattgtaattttggccgcccataaagagcttgcggccgtaatttttgcatctgggtcccttgagggcagcaagggacccagatgtaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtactttattcgacgttttagtactcggataattaatatagacctatcgcagtctcggtcgtagaaacattatatggacttaaacaaggagaattatgtaacatgaagaaatagtaggacaatttgaacatgatacaactatttccattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatctctctcctctctcaaactgcgctttagtaaccctgtattgctctggtagttcaagctgcacaacacggctaggtggagttagaacccttctggtgtctatccattctctgtattgacatctccttggtggtttctgggaggaaagaatagatgtaaagcgagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagaacccgccagtcgctctgttgttcatgacattgtcgttcataagccgcttttctctataagtattgctcagtactttcggatgcgaaataccagctaccttcttgtaaacaagtggttaggtcaagaacgggattttctgtatcgacccactcgatgtatgcgcaagccgtagtgcgggtctgccgaatagagtagtgttacgaagaataaagcgattgcccatacggaacgaataagcatatgcagataataaaatacctcacggtcatagttagggcacctaaaaaagcgctttcctcgaatatcaggattcctcgaagccattagttggcatcgatcaccgcataggcagataggacgctggcaccaaggtggtagtaggtatacacaaggatcgctacgccagtttggatcctcaacaccccggcatctagccattgacgaaagccggtaggatttgtaatgaagcaagtgggcaagagagtacggaatgtgactgagttctgaaagattgtgaggcctcactcgttaagacgacttatataggtgcaaaaaattgagtgatacccctgacatgtgaacgtggtggggtatggtgggtacgcctgattggcgccgaaagttacatgcctgatcggcgccgaaagttacattggtcgtacacgccaaatggtgggcaaatactcgtattgcacgcgaataaaggaggctgcatcggtgtggcagaaagtagtcgtgcatgcgccgaaaggtatcgtgcacatataataacaacgtagtcattacacaagcatacagtactggaaagtgaagcaaaaaaacaaagagcagactgctctactggccctgccccgcgccgcgaccacgcttggtcctccgggcctgtgctcgcacgtggtcctgggagtaggtgaaacgatccggtggcacagcacgggtagcacgagtgtctggcggaggagtggcctgcgcctggtcctgcgtctgcaccggcggtgcgcctcccagctgtgaggggccgatgacgtcctctgtcgagcctgaagcgaagtcgaagtcagtgatgtcgaagagcaaggtggaaggcagcaagcggtccgacgaggtcccagcatggtccagtggtggaccctgactcgacgtgccggctgcctgtgacgaagtcccggtgtattgccagaactgcgctgagtgcgaggtcgacgcagctgcctgagacgctgatcctgcagcttgggagaagtgggaggcctgcgtcatagcgaactgggcgaaacctacacatcgacaacggggcccttgtaagctaagacataaaatgcatgtaaattgattgtcaaagtaatgttgtttttttaagtacccgtggggggcacaacagaaggcctagccgaggaaggcggggtgctgaacggtgcacgaaaccctgaagcaatcggcaagtgaaacgactcacatatatgtgcgaggcatgtacagaaaaatccttaaaaatacttacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgacgacccggttaatgtcgtcgatctgcatggttaatttgttcgtacatatttgtaaaatttgacgaagagaaagacatgaaacataaaggaatggtgtgatgcagggtactcacagcacgagcgaagtcctggtcgcggtgcctggcgtagaggtctctagtgctcgcaatgtggggctgctgctccaagggagcgaaggtgaccctagtacgggtgtgtggctggtaccagcgtaggtaggcctggtacgcctcctcagtgtgtggctctccctcatggtccatgacctcctcggttgcgagcaaccagtcctcaacaaaagtcgccaacttggcgggccagtcgccagctgacttctgacccttgcgcgagtacctgtgaattaatgtgtaatattagtgtgaatcgacagatgttacaaattattgtgaacaggtagattttaatgcaacaacggaaagcatagtgaaagattttactggtgaacagcagctgggatggtggtcggaaatggtactggaaagggctgacggaagccgaactgccgcatcacgcggaaaggggcgtgaggctcaatgcagatgtcgaagaccatcggaaccgtagtcatccagtacgcctggtccctggtgcagagtgtggacagacccaacggcgcacgagcctgggtagccacggtactgtagggctcccacacgatgtcagtcggcagaaggcggtcgaactccatactcccaaactgcaactcttctatcgctcgcagaatgccagcgtgcctatcttgtatcaggcacacatttggcctcataccaacaacttttgttttaaccaatatcaggaaccagtacagctgtcagtattctcactctcaacaaaagcaaatgccaagggcaatacctgattgttcccatctacccctattgctgttagtatctagccccgatactttcctgtcaagaatgtcccatcaatgcagagaacaggacgatagttcacgaatgccatcttgcatgcatgtagagctaagaacgccctttgcagcacactcttgccaggatgttcaattgaggggaatttcttcactttgtaagagctcccagggtttctttcctcgataacaccaagcaggcgtggcaaattgtcatacgaggcttcgtaagttctaaatctcatctctattattttctgtttggccctccaggccttggcatagctaatagtatacttgtatgtctcctcgatgtgttggattattgaccttggttcatatgtgagattatcgatgacatgcgcatacatctcagatgcaacaaatgcacatgtaatgttcctatggtatttatgaacaccaggtagaaaacatgtatgcttggtaacgactgacactgtccaataatccttccatttccccttatacgcgtgcactctccagggacaaccatctttttccttaacacaccgaactttatattgcgaccggttggacttggcaacccaaaactctctatgaagtgacactgcaaaatgttttactgcctccttcatatcttctgctctactataaatcgctccctgaataacctcattttttttactcccatctcacactatcctcttcagagacgatcagcccagaaaaatcctcactagcccattatgctggattaatatccgtctcatcatttgacgaatcatcttcctctacacgctcgttgtcagaatcctccctctccatttcatccacaatggcaccgacagtctccccctcgtcggccactccacctggttgaatgcccattggagctactacgcccccgtcctctcgtgcgttgacctcctccacagaagtctcatttacttcagcacttggtccctcgccatcatccatgttcatttgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactcttaagcccctcattaaccatccttttatagaaagtacactcctctcagccggtctatcaattcccctttctgatacaataaattctgacagatctaccccagttggcccgtaacggacgtttcctggtccatggtaaacttggaatatttgtttgttcgacatatctgtcaatgaattaactagatcatattactctttcatgcaataaacatctataatgtaatatcttcttgtgtaagccaatgcaacggtaatgtattgattccaaactagcagatctacgtagttaccgatatatacaatacacacttctagattagtacaactaaaaccctaaaaatataatgcatttattcaaacaaatttttaaaaaatacacactatttaactcaatagtcacatataggatctatgaatattacctgaaatcggtgtctgaatccggcagggcttcgccccttcttctcttctcctcccctctcttctttttttttcactggatttgagggggggaggaatgagggctgggggctgggcggcaggccttttataggcagcgaggcctgccgctcggccagagggcggcaaggggccgcctgtaaaatggccggccccgactggcttttttgcattcgggccccttgccgccccaccagagggcggcaagggttttcctgcaaaaaaccctccctctgtcaccgcccgttcctcccccgtttgccacgtcagcttgccgccccagaggtgggcggcagggtctatttttgtaattttttaggccgatagattatttctgtaaatattttttaaaaaaaatctaaaaaggaaaaaaaattccttctctcaacccctcctctgttctcctccctgagcaggccggcccagcccagcccaactcctattcatcatcttcctcttcaggccagccagccacgtgcacacaaggtgttcggcgaaatgtctcgcccggacgccgcaccatcccgcatcgtgtccgagccacattgcatcgagccgaggccgcgctgcgccaaaaccgcgtcgcgccaagccgccctcgccccggtttccctctgggaaacatggagaagtcccgtcgccgtccatccatcaaatcgccatcccgtcgcctgtcgcgtcgacactaacggataacggccaccacctcacccttcgtcacctctaaccctaggtcgagtcatcctcggtttacacttatccattcgcccttgctttgtgacaaaggagcttagccgctaagccacgtctctctctcgctcgccaccgcgtcgccgcctataaaaggggaagcagcccgagctccttctccccacaccatcacaatcccaacccatctctctctcctctcccattctccagtttttgctctctgtgccaccaaccagcgcccccgggcctcgcctcccagtgccgccgtcgccggcggagctccgccgggcctcgcctcccaacgccgctgctgccgctgcacacagcaagagagggagagcgagagagaagtggagaagtggagaaagggagagagagaaccaggcttctgaagaataacctatgtaccaagccaatgaaaagctaaagaaataacccgtaaggaagaagagctttttcttttgtcaaaacaccatatcgttcatgcgaagccataacaaccaataaatagtgcccgcccctaataggataagcgactttaagtatttcctaattccccgtagccaattaccgaatatatgtgatacaccatgaggtaggaagagccatgtagccacttgaatataccacacacgacgggcaaattggcacacacagaacaaatgtaatttttcctcatctttgtgacaacaacaacatttcttacttccatgccaatttcgcttggcatggttatcccttcacataacccttaggatgcaaatatcataataagaagatcctgtctttaaaggtaattttaacttccaaagtactttttttatattgggcatatctaaatgtaccaaggcaagataatgcaactttaatgaaaactctccattctgggttcatgaattatcattgatgtgctatgctttggttggtgcacctgcctccgtagttaagattcctttacaaacaatactttttctttattaattgagcaatgtaggttagaatctaatgcgtatgtagataatgttactacttattatagttgtgtgtgcgatgtgattccttcttctatcaacactacttctgacagtacgagttaaactagaagtcccacttgttaattatttgaatgtacaagtccacgtctgacattgatttaatggataattttaccatccttataaatgtactacaaggtaacacatttttttaacgtaaaattagtgctacctcatggtaccaaaatttttaatgtaaatttaggtatcttgaggtacttttttaagaactataatttttttcttaatttaatactatacacttttatgtagctagcgtgagctgttactgtcagatgaatattcttgaagggtatttgagctcactagtcattaatatacgtctcacaaattgtgaagtttcaaatttggagatcagctcaaatatcttttggtttgctttttatttttgcaatatataggaactgaagtttaagaagacgtctcttatttctcaacactgaacaggtcacaaacttgcgcaatgcggcagcaggatataactattgtgtcaatccatcttgggcagaaagagattcacccaaagaactctgtgctttctttctttagtcacatctctcacaaagtatatatatgtggagacatgtgactaaagaaagaaaacatggagctcttgaggtctgaatcacagttaagatatgtgtaagacaaattgcaaataaattcagttccctcccaaaatatgtgtaataattatacatttctacatttggatggaattatattgaatagtcatgtaattgacttggttctagagcacaacacaatggccataaactgtctctaatacctggttttgtataggggctaagagcaagtttaatagtatatcccactactagctccaattcatctatagccaatctaatagccaactcatacaatagttgcttactatattattaatatatggtcccacctatcctatacatactacgtcttggagtccgtgctgcagctggctacagatctgtagcccgcttcttttctctttcatcttttatctcattaaaatatgtttatagttggctaatagtctgctaatgtacctgctctaatgagtggattaggatggttccaggggtaaaatatacttcatttgaagactatatatatacacatatatatagtcaatgctgtagtatttgccacattgccaatgctgcatgtattgacgaggaattttaccgtacatgagaaagtatcttgaggtacttaaattttaaattaattttttttactagaaaatataataccactaggtaactttttaaggattctaataaaattaccctatattggtatgcgagtgttataaaagggccatttggccaacaaagattcagaaatgcaatttcaatgtatgtagctgccattcctgttgttccccaaatttgcttcagttaggtctagcttctcaacaaagtgcacttgttgtttgcttgcttggggtgtaaaagattgtgtgtaggccagcagcatgctggattgggaggtgccgagaaagtcgagacagcaaccatctgcagttttcggagtatgattgaataccatacagtgatttatcctgctttaaagcacagtttcttctgaacaggacgatagacctagatgtatggttattcatgaaggatcatgcatgctacgttgggattgcaaggctctaaggacaggaagtcatttgtgttaattaggtgcaattaatgactgcagaagtggctaatttgacagtcctaaattcatccttgttgcactgctgaagttcacatctctaatccaagatgtcctatgttcgtgttccacttggatatattgcagagtttatcgtctagtccctgttaatctgttatttaggcgtgtaattttcatgcaaaagaaaagggattatactcagaggtacatcctcttttgtcacaaaattgtccatataccaaccaaagtatgtgagttgctatacaacaatgaacaaattgatttttaccagtgtgtcagttgattcctaacaatttgtgccccaacatcctttccacccacctttctcattctggactttcaaaccaggaaaaataatatagtgtaaaccatatatgtagtaaaaacctaaaaattactattgaatcgatggatgtatgagattcgtccatgtccatttttcaatgatgatgtggacgaatcttagacatccatttttcgatccaatgatagtattcaggttttcactacatttgtattagtttctaccatgtattttccctacataccatgcatgcaacctattgattgcaacagcagtaaatagatactccctccgtcctaaaatattacaacttttagccctcaacatttgtctcaaaatatagcaacttctccaccaacattctctttacaaccaatcacaaccctccaccattcatttttctcacctacctccactaattaaccaatcacacaattctccatcatgcacttctacctactttcttaattaacatgtccaactctaaaaaagcttatattctgggacggaggtagggcagtgttttactgttttggcacattaacaatgttgcgtgtgaagtgtacgtatatatatgctagcttgtgagcttactggtattcttgttccttccaaagtttcccacatgaactctacaagcaatagaaaaaaataaatatgcttcaggcgctcctattaattaatttgcttctccacgatgtgtaattgctctatagggatatgagtattaatttgtttgtaatggaagaatgtattactttgattattggatttggaggtattgggaaaatggagatggcagcgattcctcactctgctatatatgcttaagtaacaggagcaagcttttgcatttgattgagcacagaacatctgggatcaaccagcttttatatatttgttttgacttgagtaatcttccgaagatgaaaatgttatacatgaaggttggttatgcatcaccagtggcctggttgtgcaatcccaaatttttagttttctataataagtagatatgtaagcacagctgccattgttgcatgctaattaatggccgcaggatttagcaacctagatcgatgcattattaagcacttttagtgcaaaacccaaatgattgcaatttgtttttaggaattctccaagaaacaactcaaactacattattatatatgacaactttagcatatattcacatcagtaggcttgaaaagtttggcacacatagctcccgtacctactatctcccttctcagtcttcacattgtacttgcaaaaaatcacaatgcaatgcaatctccaccaaacaggcgcttgtgctagggtttaaattcctcgatgcattgctgagtggctcggtggttgcgtgcattggttgagctgatcgagttggggcgcttgagataggcccctcagtggttggccaagagcatcgcatggcaacatcaagtcatgcgaagtactagtcagcaaagaactacgaggccaggatatttctagttcttcgtgacgtctaacgcaaggaaaaaaatgaaggcctcccctgctctcccccactgaaatgcatgtgtagcacagatatggtggtgaaacttaattagcaatagtttcaacaagtgattgaaattaagctcgttgtagtaatatatggtgatatggcctacactatgctcagttataggtatgataattgagaagcagtgagattaggtgccactaacaagaaccaaccctgaattgctgacctgcatgccaatagagacatactccctccgtcccatataaaatgaatctaggattggatgtaacatatcctagtactaattcgtagtccgagaatttttcacatccgatactatgttggttttttatggaatggagagagtatgactaaatttcactgacctgcagcaacaaggcaccgatcattgagttgttcctggatcagggtatgaaccatattctagatgccccagcactgggcctggtggcctaccctaccatatgaagccctctgcctctgggtgcacctatatatatgttggatatgagttgtgaataagagttgacaagggttaatccagttcctttcaaggttttcccatcactctaaaattattgatccctgtccataggtaattaattaccaacttgttgctcgctaataatccgcttgaatatagttgagcactagttattttgcttcagttcaccttctaactaggatgttcgatgctgcagagagtatatatacatgtcgtgattgggttggaacaactatgtttgcgtgagtacttttgcttatcggaattggaggcactaggaaaatggagatggaatggaggtccttctccatccaatgatcacgagccttcggtactacagtgctatcagatattgtgcactatggataacctcatagtcgcagattcacctcccgggtaacacgggcagctgcctaggcttcattgcaaagttcgctggcacataacactaattcttcgctgcgatggattaattctggggcaagatttgcatgtgagagttgaatacggaaaacatgcaggatttgtatatagtgttaagtttagcatgtgggccttggtcctcggctgcctatggcctctgcctgcctcattgtaaaaagaaaaatatattagtgtggtatatgttttcactcaaattaagcaacgtactcgatgttttatcttttctttcgtccataaatatttacatgcatttttaaccatgttttgtataaagcttttttattgacaactttgattacaatatattaaaatatgtatgaacatgttttagtatagtagttaagttaggccagcccagccttcatagagctcttggttcttccactccctcacattgggtgtttgcgtaggaattgcataaatcaacaagttagaggcagtcatggaagcaacttagaagtaccaaggaggacaaatgttgtccctgtagcagtgtagccacacccattgccaactttgaactggaagaagaaaataccatagatccataaacgattgtttttcctttaaatttttgcctttcctctgttttcaacagactgcaaaaagatagcaattggagatcactggtggataaatgctttttactcctggttggtaacccctatagtcccggttttccaaccgggagtaagaatccgggagtcccggttcaaatacaatctttagtcccctaaagtttttttttctttttttttgctattttgtatatctcacgcccattatctcaaatcaatcacaggaatatagttcatcccaaatcattcacaccaacatagttcattctcaaaatcgttcacacaacaaacacagatcgaatcacacaacaacacagatcgaatcaacaaagatcgaatcacacattaaggaaaaaagaaaaaaaaaatcccggcaggcacaccggcctccattgcctgccgccgcaccggcctccgcgccggccgccgccgggtgtggccctccgtgcaaggccatagccgctgccgcccggccgcttcccctctcggatctggcggcggccggctgcctccccacccagatccgccatgcgaggccacctccgccgccgcacgaggccaccgcccagccgcctgagaatagggaggagaggggaagggggcagatccggaggaggaagaggaagatgggtgagtgaggagaggagaggaggaagagataagggtgagggaggaggagatagaacttatcccgtgcgcctcctcctttcgcctcgatctcgcgcgcatgcttcgttctcaccaaccgggactttttctagtccaccaactgggagtaaagataatagaggggtctgacacagcctgccgtttttttaaccgggactaaaaataatctttagtcctggactaaagatcaaaaaacagctttaaccttttgaaccgggactaaagattatctttagtcccggtttttattgcaaccgggactatcgtttgaatttggtcgaccgaccaaagatggtttctccagtactaaatactgcattgtacatcatgatgctcaaatgagataaatagagcatgaccagagaaactttttttttgtttgttcttggccagaaaggttaaaacacttcgctattttcagttgctacacattagtattgcaagaaaaaaaaggatggccataactacaccactgatgtctgacacgattgtgctgtgacacgaaatttaatcaaatcacacatcttggttttgctgaaatctatctatggaattgcaaattctgccaataaaattaaaatgttcatacgagcacacacagtagaggggaaaaaaaacatctatcatgcccttaattttgcagacctaaggaatcctccattggttgttgttgtatgcagaacattttagccattatctccatttctcaacctttagatctacagcttctgactgtcatgcggcaagacgaacaagctaaaatccgagcactatatttggcttccaccatcatgctcaatgcatacataaataacaaattcgaagctacacacgaggagatgtcattgacttcgtgtgcacttcgaatttgtgtttcaaaattactcagtccgtcccttcatatggatcaatggctgctgcagcatttgggctcaaagaattcaacctggagaatgagatcatgatgcatctgggtgtggaggtggtgcagctagagtacgttttcccgatgccactcatgcatatattctaagcccggctgcaacttatattaccgtgtgctgctctctaggctatagcatatgtgtatgtgcatttgccatatgttacagtcttgtagagttggttggctgcaccctctcacatatatatatcctctcttctagttaattttatgatttctggaattgaatctggtgctccttttctttatagtacagaattggtccaattggacaagcaacttctttggcgaagtactgtatttgtactcgctcaggcccaatatgtatttggaccaccatctaatctgtttcgtactaattaatgtgtatcgatctcagtagataaatgcaaggactccacatgcgatggccaatggtacagaaatattgattttttttttaatttttcggtggtctttgttctgtcggcgatttctgacggtgcacttacaggaatttattttttctgacagtaaaattaatttttctgacggtaaagccaaattttctgatggttttgctcctagagggttgattaagtctggtagtgagaacatggtctggactccatccaaacgtgagataccaagcgtcgggcgacaaggggcagcacacccacaattatagtgcctaaacacggtgttacataaccctgatttgatttctgaaaaaaaatcttaaaagtcgatattcactgaagttctttggttagatgtccccactacccacattaatattaccaatgttatgtgtgtagagtaagcttatatatcttgtgacatgagaaaggcaaggaacacaatacatatcagtttcgtcccatttggaaacactagctactcttgttttttccttaaatttccttcagtcctttgtctggatgcatactgattgctattgaacatagacacagtagaaaaactgtatgtatcccagtagaaaaacaaagatgacatgaagatagcgagaaacatagacagaagagaactgtgtatagctctgtatgttggatttggaggcatcggtaaaatgaagatggtaacaagctgcagttacccatcgatgtgagttactgatcttgcatccactaccagaatgggagtctctcccgagtgggagtaaaaggttacggtgtgcttgatctggcactgagtaaaaacggagtgtttcctagagacactaggtaaccaatcttgttatgtagtgttcattctaaacactatatatgtaatgttaggagattacagagtgcctatcaattacgcccaggaatttgggcccgatgtccatcagtcgaacaattttttttggcgtgaaagggaatgcatttagacgcccacatattgatgcatggtggcgcgaatgctatttagtcgttcgttactgtgtgttttggtgtacacacccggtaagtataagagaaaatccctttatacccctgggattttagctaatttctttcatgcccctgaattttgcttacttccttgtaccccaaaatttgattatgatcccttccatatacctcccatcagttgaccaacgaattgctataaaaatgatcattttacattttggatgaacatataaatttatgaattatattattgaaaatgctaaagtttgtcacacgagactactatagttatgagtttgttgtgcgatgcattatttacgacaaaatttatttttagataatgagataaaaatatgtatttattgctgtgcgatacactctggtgcccccttctcgtcctccactcatccccggcaatctgttactctgccatttttgcacgcagttgcttcaagagttgcccccgatctattcctggcggcggctgtgcgtgaccgataaatgacaattatatatatcactcggaaaatatttaatacccccatatttcaactactattaaatgtattaaatgaggtggtagaagaaataaatctggactctaaacccattcaaatgaaatctcacctgttcaaaatgctttttgtactaccagtagagagcaccaaagtaggatttccgtaaatatattgccatttgtgtgttataaaaagggaaacaaagatgcaaaatgcaatttcaatctacgtaattgctactctcctgtggtgttccatgaatttgttcagcttgaatatattggcatgcgtgtgcactagtagcttgcttgtttgggaatgtaaaacattttgtgcatgcctagatgttggaatggaaggtgtcaagatagtcgagatagcaaccatcgggagttctccagcatccagaatatgatgcactacaagcgagctatctgctgctttaaaacaaaatgcttgttgcactttgctagagacctaaatgattgttgcagatgctagatcgtgcatatgctaggctggttcttcattgggcaagttctatgtgtgtacaggaagttattctcgtgttaggtgtaaatgacagcagaagtggctctaatcttacctttcatcctttgttgcactgtggaagttctcatcactgatccaagaagtgttgtgcatgtgctttacttgttccagttggatattatagagatatttaaagggttaatgtgcaatttaggtggttagagcaacaaaggggttatatccaattggtacatcctctttgttttgtcagaaaaatgtccaccataccaatcacagtgtgtgattttctacaattaacacaataattggtaaaatgtgttagttgttataattcttgttactttgttataacacatcgcaatatcactaatcttgaatcagctcatgtattcttaaccatttgttccccaacatcctctccacccacctgttgattgtaataataccaggaaatagttacaatatatggctcgttaacaatgttgtgtatgtcaaatgcactttgatcaatagatctgcataactagcataactgcagatcaaaccatactaatgcctattcttgttctttcaaaagttcccacatgaagtctacaagattgatccgtaaagtcattggctttcttcctgccaagcaatagaaaaaatatgcatatttgcatgtaatggaagaatttatatatttgcttataggaatcggaggtattcggaaaatggagatggcaaattgttgtgaggaatttatagctttgctatgcctgaggaataggtgcattgttatgcattccatcaaatagaacatctgggaccaaccagcttttatttgttttgaaattgaccaatcttctgaagatgaaaatattatggagtttggttttgcatcaccatgactttttggacagtgcagtagcccacttgtgcaatccctcaggataatatgaaaaaccgtcagagacaaacatctagttgagtgctaatgactgaaatgttcagtttctgtaaatagaatagatatgtattcgtgtctgcctggttgcgtcacatagatctgatgtatggtaatgaccaaattttttttatatattttctcgttgtatgcatgactccacgattaaactagcaacctggatcaactgttttttcatggcagtcttatagaagcacttttagcgtacataaaaccccaatcattacagtaatttgttttagggaactcttaagaaacccatgtgtatgtaacatactcaattttagcatgtaacctcctgtacctactcatctcccactctcactcttagcactgtacatgcaaaaatgcagtgcaaactgcagtaagtacattggtacaactgataaccgacgctagtaaaaattgtgactgatgtgtacatgtctcaatatctatcgcataataaaatggatcaatgggtttaaattttcccaaaagaatataagaggtggttaagggtaggattgggtgaaaattaaatgagcggtggttgcatgtgacttctccaacccgacatgctactcacttaatggatggtgtcattgtatttttccttcctaaaatctcttatatatatttgggacagaggtagtatatgtcccaaaagggcaatacataggccagctacttgtgttgttacccaaatttgcttcagtgtcctctatctggatgcaggctaatcgccttctatcaggagagcatagacaatagagaactgcgtgtagcactgcatattggattcggaggcgtcggtaaaaacgagatggtaacaacctgcagttacccatcgatgcaagtaccttgatcttgcatccgagttcactgctgaaatactttgaagcacatccggaacagaagattagattgctgtttatgatgctttgatgcttcatcaagtacggcatctctctctttctgttaccgacataagatgtcactttcaaactgctaaactgctaaacaaaagatgttacagacacttattacagtgacaaatattaaagggtagtggttgtaaaattatgtcgtcactcactttcttttgccgacaaaagacaatgaatttagacatattctcttgaaaatttgaatttcagttctttttttcaacttcacaagatgtgtttgagaaaagaaaaacatggaaagtctgataaccgtgtgattacctttgcatttgtcaaccttgctgaggactagtaagggtgtccatctctttatataggtaacgcgttcgctcctatacttttttttttttgtaaaatcacctatctcatttgtaaattatgaaaggtcaaaatttacaaaagagtagatagattgatgtgcacagcaatattatgccactattgacagaaaagtcgattcaaattttcagatagtaataatgtatattgatatgcatgaagcttcaacttgaacttatgaggaaacaacttctttccaagaacaaatacacaatcaggggcacaaagccctgctgttctgtcataaaaatttcaactctcaagcactacttctaaatttccataaaaaattcacctctcaagcacaacttctaaatttccagatatattgaagaggcttgtttcatattgaggacgtattgcctcagaagtacaggagttgtacacaatcagaacgggagaaatgatactaacttaatcacatcatctttgtttcagacattgctctagggacaagcttccaatcatcaatagctagatatgagtagacaagtatacttgattttgataggatgagtgaataagtattggaattggaggtattgggaaaatagagatagcgaatggccacttgatgactcggtgagtttttcaagtggaagcttcacaattctctcttctaacctttcctaatacatatacaagcatatggggagatggaccttgtggggtttaacacacatgttggtgatcatgatcatcactagttgattcattaagattaataaataaacaactcaattttgtcatctctacatgaaatgggacggattccctaaaagcaacatccatactgacaaatgttcatcattctgaacaaatggccagatgaattgcctgtaagtgcactttacagttcgaggatctagttttccaacacaggatttattatctctaacaaaaaaagtacgactaaacacttttggtagaatgataaattcattcttcccaaataaaatatggtgtcttcatcccaaggattcttgaatgtgtgtgattgaatacacaatcaaactagaatgaaactgtacctaaatacctttttctagttagaaaataataaatcgataaggaatttagttaatgccgcaaaatatacttctctctttgaagactatacatatagcaccacacacacaaacacatcgcacacacacatcaacatatgtgttatcctttaacacacactcaatagacagatgcaaatgataaatctccgacattagtaatttctactgaatgcgtgtccgatgtgcaaaaattgtgcccaatgtcgacataactagtagataaagtcatacatcacaactccagcacagcaccaaaggtgcttcctcgagcaagcttgtaatccgtttataattgcctgggtgttaaaaatgataacgaagattcagaaagtgcgatttaaaactgcatacttgccactcttttttgttccaacttgttccccaaatttggttcggttctctggattctttaagaagagaaagtaccatctagggttcagtcagcgatggcgtgattggatctccctcattcttagcgcctcctcttcccgggtgctgatcaatggggtgccgggtccgcgcttccatcaccggaggggtcttcggcaaggagaccctctttctcctatgcttttcattctagtcatggaagtgctcaatgcgatgcttcgtaaagcctctgattcaggcgggttccttccgcttaatgatcgcgctttgcgacaccgcgcctccctctacattgatgacttggtcctcttcctctccccggttcagcaggatctcgagttcatccaggttattctctcggtctttggtgcggcatccgggttgcgcaccaattttgccaaatgctcgattacactcctatccgctactcggatgaggacttggagctggttcactcttgcttcccctgctcaatttctgattttccttgcacctacctcggcattccgctgtccattcgcaagttgccgaaggcgactcttcagccgctggtggacagggtcgctcatcgcctaccaccttggaaggggcgtctcaccactcttgctagccgctccgtgctggt

SEQ ID NO: 80996 - DNA, 1258 bp, Oryza sativa
acaccaattggtcttccattgagtagtgagtcgggggctacagatgttatatcatatttttcataatatttatcttgattgcttgcgacataatctgagtacaaaagtacctatcgagttatggagttctatcttcctatgctttccgttcggtttgccaatggatggttgcctttgggccgattcctagcacccgggggctcgttggatggaccgaataacgcaaggtgctaagtattattcggaataaatcaaaagcatagagataagataatttattttctgctcttaataattgcaaaagtacctgagtagtaaattctaatccgtgaaactttgttccattaatgacgaactcatatcactcatatgcatgtttgggaagtgcctaggccgactcccgatgcttggtggttatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggccgcctcgaccgccgccgacaggtgtttccgcctgcacggctggcctattatgccgccgttgttgggcgtctactcttcaccgaccggccgcctcgtccgccgccgactggtgcttccgcctgcacggctgacttattatgccgccgttgttgggcgtctacgtcttcaccgaccggcttgccttcgccgccgccgactggtgtttccgcctgcacggctggcctattatgccgctgttgttgggcgtctacgtcttcaccgaccggctgcctcgtccgccgccgactggtgtcaccgcctgcacggctgacttattatgccgccgttgttgggcgtctacgtcttcaccgaccggccgcctcgaccgccgccgactggtgtttccgcctgcacggctggcctattatgccgctgttgttgggcgtctacgtcttcacgaccggccgcctcgaccgccgccgactggtgtttccgcctgcacggctggcctattatgccgccgttgttgggcgtctacgtcttcaccgaccggccgcctcgaccgccgccgactggtgtttccgcctgcacggctggcctattatg

SEQ ID NO: 80997 - DNA, 29045 bp, Oryza sativa
  unsure (1)..(29045): unsure at all n locations
ctagcatgtgatctgttgggcccacaccttaggtggcctgtaccccaataattcagaaatttatcctctttgtcagatttaacttgccctccttaaggtgcatggcccatttccagtagaagcagtagtaaggcctggtttagctcaaaaaacatcacatcgcctgcatgtcgactctataggatccccgcattaaacatagataaaaacaaaaactaattgcacagtttgtatagaaatctcgagacgagtcttttgagcctaattagtccatgattatccataagtactacagtaacccacatgtgctaatgacgacttaattaggctcaaaagattagtctcgcggtttctaggtgagttatgaaattagttttttcattcgtgtccgaaaaccccttccgacattcagtcaaatattcgatgtgacacctaaaaattttattttcacgaactaaacaaggcctaagatgaatcagttcattattatctggaactcgtcaccatttcaccaaatgatattttctcttttctttatatttacgcctagtcgggtctgcgccggcagcaccgcaatgcaaccgaatagactaatatatttctaagacagaacaatactcactctaacccaaaatataaggaattttatgtggatatgacacatcccagtataataaatctggacacgtcacaataaaataaatatggacatgtgtccagattcatcgtactagggtgacgtgtccagattcattgtactggtatatgtcacgtccatccaaaattccttatattttaaaaccgaggaagcatgtgatatagctatacatcatacatccatacaaaatttcactgtcgcgctttatgtaatttaataatgcgagcatgagattgatgatttaattttatactagcaattgattatgcttgctttactggttttagacgcattaagctgatcagtgtgtttttttccggtaggttatgggacattaatttgtgaagttaaaagttatgtaaagtttgtgctgtttttatcctcacaaaccaaattaaggcacgaacttaactttgaaactgaaaagttaatttcagtacgggattctgaacgtactccccacatcccataatataagcatctttagcatagtgtcaggtcaaccattttaaactttaaccattaatagcaagaaaataaaaaaaatacttatattcttgttatttaaaacattttatttttatagatattgttggtcaaagtagcatcttaaagaccgtgtcaaagtcaaaaagaatacttatattctaggatggagggagtaagtaaaatagaaaagaggtaaatataccaaagattaaaaaagagagagggtaggcagttaggcacaatgtcacatcgcctaatgtcattatatgcagacatgcatgcattatatgatggagctgatcgataccgtttgatgccaggtagaagcatattcgtgaaaatcgcatgtgttggagttgataccgtttgatgccaggtaggtactggtgtctgaatcaaaaatagtattaacagattagtacttttacgtttatcacgactagtaatatcgttttataccattgcaaattatcagtaataaaaacgatttagactacttacttacgggtcctattacccctgggaaaaaaccttgtaattaaattgtactattgtattatatataaaattgaggtggtaggataattaaaagacgaaaacggtagactgattgcactaccgatagagaaaactaaaattgcctcaacagataagatcaacatgttataaaactagcaccgaaatcaacgttgataaccgagcacgaaaaaagactatagaagttgcaaatataatgacgataccgagccacaatatttattaataaaatttagccaaaacctatatctataggacactaattacgaatatatttttccgatccagcatattacatgaatatccgggtataacgaccctcggccggtgtggctctatttaagtgagagccatggctaaattcaactctactactatcctaaattcctaatacatattacaaactttaagttttaattaatttgtaaccgattatgtaagcatatccgactaaactctaacattctgcatagaactaagacgaacaatatcacatccacccaaaatattatcacaaaattccacggagatttcggaggaaataaaggtctagaatataaataaatatccaagtattccatgcatctcaattaaactgtacttaattaatttctttgctgcgcctgacgatccgtcggccctgtgctacatcccccagttcgcatgccacatgtgctgactgcatgagtccagctattgctgcttggactgtactccttcgtcagaaaaaaaaattaatataggaggagatgtgatttctcctaatacaaatctggacaaaaggatcgcattcccttagagcaagtttaatagtatagccaactgttagctccaaaacaactatagctaatctaatagcccattcatacaagtaggaaggtggcccgcgcgtatgcgcgagcacttatattattgaaaggtaagatttttattgtttgttaaaaaaaattatctcatagattaagggcaaactaaagttcgcatactgttattttgtaataatttaagggttctattttttgttaaggtatcttaaaaatccattcagagtgggagatggattaagtacttacgacttttgaatcatgtttttttctgagtaaatagattaaatcgtctcataaaggtgcatgatatagtaagaaagggaggggagcatattcatggagaaaaagaataaagggaaaaataaaaaaaaggaggggaagcgtaggtacccacgtacgtaggtgcgtactaaaggtggagaggtgggaccttgtagtatttagtttgttctaagatcaatttaatctaatggtttataatattggacccaacgattcaagtgaaaatcaagtaatagatactttgcttttttttagaatttctaatattttctctaatttattagagcaccatgtggcatcttgagggcattttaagaaattttaatgggcttaccacatataattagaatattaagatgtaatatatatgtatgggatgtatgttaatattcgttctagtttcgtccatgtttatatacacgtagagaaaaattaaatatgttgctagcaagccattagatgtttaattaatagcaattaattttgatacctatttacaattggtcatagtagttcttacagattcatcttacgactttgattatgcgttgatcaccaatttacttatcaccatgactcgcacgaaaaaatatgtactttaggggttaggacaactgaaattgatgaattatctaatttatgtgatagctatttgagattataaacgaatgaattgacttctaaaaagttaaaaagttgtttaagaaaagcaccatttagtaacatggaaagcgtggagcgtgcaaacgaaaattcaaaagatggaatcagggaaaaatagggccttaaactcccttataacactcttatcctatcaagagttctattgatattcgttaatattgtgctcacaattataacataataatttctttcaaccatacgaacaaataatacaaaatccaaatacaacataacacaatacattataattattatttaatcaactctcgatttcagcttaaacagagttaagtgttccacggtacttaattcttctctcgctgcatcaaatctttaattttcttttcatgctattaacaacagcggtagcgctgcagtggttgtgatcacccaagatgtctcaaacacgacactttatcatatgtgtgaaaggcaaaggtgcagacgtgcattgtgcagtgtgccaaaaagagaactttagacattattaacaatagatccgatgatttaaataatgggtccaccggttttagtgtaaatataaattagttaatatatatgttttaaattgttaatttaatgggtacacaacataatggtgatggtgtagattttattttaaaacactaaattattcgagaataatagtccaaagtaattaaaaaaatagatccgatgatttaaataatgggtctatctgtttaattacacatatatattagttaatatagatcttaaattgtttatttgatagttacacaatataatattgtgtaagctttattttaatatattgcattatatgaaaataatagtacaaagtaaattatcttacattattgattttagagctaatttacatataatatggtgtaaattttattttcaaagtctgtatagctaatttagttacctgtgtttataaagagttatacgatggtattttcctttttaaaaaattatgattatttaaacaaatatatatcaaattgtataaatggaaaaaagaagaaaaaaaaggagaaaaatggagggaggcgtacgtactacaggcccacgtgacctacacctatgcacgcgcgagaaataggagaggtgggacccatattatttggtttgttttaagatcaattttatctaacggtgtataatattggacacaccaatttaagtgaaaatcaaggggtggatgttttgtttttttcttaaaatttctaggattttctctaatttattagaacgccacgtggcagcttgaggcatgtctagattcgtagtcctaggatgggtctcatcccatcctaggttgtaacattatgggacggagggagtaatagttagatagataattaactataaaaatatactacaccattaatacccgatccatctctcatacacacataacgtcttggagtccgtgttgcagccggctacaatctgtagcctgctttattctctctcttctcttttcttctcggtatgtggttatagctggcttatagcttgctattgtacctgcttttataggttgggttttttaagatggagggagtggtatttataccattcattatcatcattcatcatctcgctcctgaatattatacctagggactcgtgcagctaaccatatgcatgttcatgatttcatgatttcgatttgaggcaggcatgcatgcagcatttgtataatctctggcaagtacctactcatggagaaaaataaaactacaagccaaaataacagatcaactacttgtgagggttcacaatctcactcgataccagatcaaattaaatctctgttcactagcggtatcattgaatttcgcggaatccgtcgatagtctaacaaaacttgataactcgaatgaattttttttaataactttgaattcggttccattttttaacttaacttaaagatcaagtgatttgtatttttagccgagtccgaaaagtcgagatcggtttccgctggaattctaaaaccctgctacttgccaacttggtgccaagtgtcatacatgcatacccatgtcccttggaaatgcagtgatttcagacacgaagatttggataattaattaatgcagggatgggcctagcttcgtcgttcagatatactccaattcggtatggttatctgcacgagtttatttaatagttttcccatagtccaatcgtttggccgtaatctgtcttacgtgctatttgcgagtacacacgagttgaacaatctgaccatattttctatagtttagttcgtttcaaaacttataattataactaaatgcagggccaaagaccaacataaaattttgctgaagtcctgtttgaaatactttgattttgtgggaattttgcaagaaataatttaatcccagcgaaattcctctaaaacccttacgactcctttggaatatatggaggatactcttagggaaaacctataaaaaatttacgttcgaaatgagcaataaattaacggaattgctacatcacattcaacgaatttgcttttcgattcatactccagcaaccccaactcctcctctaactccagttgaagtatgagagttaaggtataaggccccgggtttgaatggggcgggggcaatcatacttagagggatcaccgtgaaaaaatagtagtccactagtatgtaataaatacagtcgaccgctatcatatcagcagtgacatggccgtggatggaggagggtggttggctggcattggtagcaaggataaattggcgcttgtggttaatttaaagacggcgatcagtgatgatggatccggtgacgggagctgtcggagacaaggaattaattaattaatcaccaaagtaattaagctagtttacagatccatcaaatgatcaactagttaggctgtatgcctgggtttgtgcacacacgtagctagatgggagattccgggcgatgtgcgtacgtgtagctaccagcacacacacacatgcgtctaccttagaattgactatagaagaacagacatggatgagttgcaacgtcgtcgtcaaaacggtggtgtctggccggacggaaggagcgagacgaagatgaaaccagtaacctgcctggccatgcgtcgccgtcgccattattattcaagtcttggagctttgctaaagatacaacaattttgagctatgtccagatacatagctaaaaggttagtaatatatttttgaaacgaaagtaggtactctatctatctaaaaaaaatgtactagatatgacatatactagtacaacgaatcttgatagaaatctgtctaaattcgttataatagaatatgtcaatacagttctatatttgttttttgggacagagggagtatgtatatatatttagaggagcttaagaagcaacaagtgagaagtcagttagtgagaatatataaaaaaggtttcttaagttctggtttctaatttattttctaaattctatatataactataaattttcaaaattcagatgacaacctaaactgtttggaagaacttctgacaaattatgtaagaaattgtagaaatgagaagcactccaaacacgatgatagtgaccaggcgatatgtatatgtatgtgtatgtgtatatatatatatatatatatatatatatatatatatatatatatatatatatatatatatatatatatatatatatatgatttgcttggaattgtttaagcaattctcgtaatcgtcggccccttgccaattgattctgacttgttttatcgagagcagaggcgaattatgtaaaggcttgtaactctgcgaattgagctaattccaattttgatttgccagctacttgtttcatggctttaatttgagccgcggatcctactctgaaaacggaaatacccacattaatagcaagcccgaattccggcattgaatagatctgcccacgggtcgtcaacttcttttctcggagaagaaacaatgacggtatctgagggatnnnnnnnnnnnnnnnnnnnnnnnnnnnnnnnnnnnnnnnnnnnnnnnnnnnnnnnnnnnnnnnnnnnnnnnnnnnnnnntctgtagagtggcttttcaaggtccgccgtctaagtcctagggctcataccatggacaaggcgagtggagcactaccaagcttggagctacgcgtaggggcagaggagaatttccggtggagcggtgaaatgcattgagatcagaaagaacaccaacggcgaaagcactctgctgggccgatactgacattgagagacgaaagctaggggagcaaatgggatgatgatgatgtccgatcgatctcgacgtaccccgccgtccaaaaagactaaacaaggaggagattagtacattgaatctggacaacgttttatccagattcgttgtatttggaggagtcacctctttttcttctaagagtttttttttgtttttatggagggaatacgtacgtgtctatgtggctggactagtggactgtactacgtgtgacgtgtccactctaatccaatgccacacgtgtatatacgcatgtacatataacgcatccatgcctgaatatactggagtactatattactatgtaaaatataccaagctagctgatgttactgaactgtcagtatacatatgccacgcatgcatgcctctcgcctgaaaatttatatattagtttttctgctgggtcatactagtactgatgaagataaaagtaaagattaagttaacacgtcaaacgagaaatccatcagcagattaacaatttgatatactccctccgtcctaaaatataagaacctataaccggatgagatattttctagtacaatgaatctgaacaggaatcactactacggaaatcatctttcgtggcggctattttagcttttcgttggcggaaattgcagccgccacaaagtaaatgccagtaaagatcaatatctttgctagcggttattgaccgcaataaccgctagcggtaattcatttttgctggcagccgccagcaaaaatctattttcgttggcggttgccttaagacggccgccagcgaaaataaattatcgctggtgggtttcactgtgctagccaccagtgttaatactggccaagtttaaaaaaaacgacagacgaccgctccgtccgtctccgtcaacgctccaccattcaaaaatttcacagaaatttacccaagcatttattcaaaattccacagaaatttatatcaacaatttatagtaaaaaatttccattcaccttagcattcaagcatcacaaaattgacacattaacaaaaatttgaagtcccctcgcgaccgccgctgcatctcctccttggctacatcggcgagcgggtcgcctcaccggagttgctcgtgctgctgcctgatggcctcgcactgtaacgccccgattttcattcgggattaaaaatcatttaataatgtatttcccagaaattaaataaaaatttaatcaatttaatcaagtgaaattatagaggaaattaaaattttcctttaaaaatcattagccggaaatattttttaatattctctgttccctaatttactctccagatttttttcgtgaatttttggagctcaagaagtaattttaacatcacaaagtgcatttaatcaattaaataaaaagaaaacaaatataactttcccttcctccctttcgggctcggcccaaattcctcccctcctccttcccaggctggccttccctccctcggcccgctcggctctctctctccctcaagtctacaatgcctccctagcccgtttccccctccctctctccccgacaggtgggacccgtgggccccacctgtcatcccgaaccttcggtctcccaggtcggcaaccgccataccgccattgccgcccacgtcgccgccgattccggctcctcccgctcgcgacctcgcgcccaaaccgcataaaatcggttcccctccaccttctctacactctcctcacgtttcacccgaaaatctcgccgggatcgagctccacttcgcccacgatgtcactcacgtcgcccgccgcgccaacgcttccataggcttcgccacgccgagctgcacacctccttttctccattccaccatcgaaacactgcctttgtcgcgcaatgcaagccgccgtcgcctcctccactacatccaactgcttcccgccggggagcgagatctcgctcggccatgctgctgccgccaaaagcatcgccgcgctccaccgcccctctgccaccgtttccccgccgccgtgagccgcctaactcgtctccccgtgcatcccggtgagtttcgtcgccattgtccactccggccggcgtttctcgtcgcgcagcaactcccttccctaccctaacctttcctccttgttccccaggtccttccggcagccgtccaccgattcccgctcgcggaacaccgccggaccgccgttgctgtgccaccccgaggagcccgccgccggtcgcctccttccgccgtgccacccggtgagcccccatctcccctccctttttcccttgcaccggccgcctcccgtgcccgccattgcgctggtgtcgtcgccggtggccgcgtccggccgtgaaccgccgccgcccctttgccatcctgtgccgccgcccgtggaccgccgtggtccgggtccacggtgtcgccccggccgcggtggaccgtgtccactgcgccaaccccttgtgtcgctgacttgtggggcccgcctgtcggcgccggtctcccttgctgatgtcggcgcttaacttatcctttgagaaaattatcattaatcgcgtcataaattgaaattcatttaaaatggctcaaaacttctaaaattcatatctaattcatgcgaactccaatttgggccattcaacttgcaaaattcatctaaaattgagttctacatgtttgttcttttcatgtactattttcttggtttttattagagtttttcctcgttatgcgtgccagcgtatagaatccgtcgtttcggaagtccgcggtcgcgaggaaaagagtttggaagatcgtttgaagaagcaaggcaagtcatacgtttgcaaattaaatatgcatgttttgctaattacatgggatcagggtttacctatctgcttgcttgtgccatatttacttgatatcttttctttgtcaaccttggataataaatcgactagcttgtgttactatgttgacctagctagaactatttgcttagccatgcttaattaccactagctcagttgatgggataattacagttttagacctattagtatcatgacgagctgcgtgctcgagacacccgaccatgttgcactgatcgtaattatccaactaaaatgcgactgaatggtgggctgtgggtgcatggttttgctagtcgcacccatggcaattaaggaccggttcgcgggatgcactggaagacatacaacgcttgccacaagcgggaatgggtaactgcctgacttgaagtatagctttcctctggctgatgttcccaggcaagggtgagcatgatggagttgggtcggctggggtgtccggttgtccagctgtcggattcaccgcggcgcacgaggggactgcccacctccggggtagggggtgggggtgaaaccttagcgtggtgtggatggttaggggagagttatatgaagggttttgtcataatcactcgacgtggtgacgtgttcatcatgagcacatgatgacacggtgacatgccggtggattgtgtcttgtgggtacagttgtgtacctctggttagagcaaaactattcgaatagccgtgctcgcagttatgggcgatcgaccagattcaccgtgattagtcccatcctgaataattggttaatgaactggtgtagttcaggtggtttggttggacctgttcaacgtggtgtagcgttgtacaatggagatctaatattaccttaattaatcaactattttattgttttgctcaataaaatactttacaactgcctttatgcaattagccacaagccatccttttatccccttgcacgtctgcatcattggtgtggcttgctgagtacggtggttgtactcaaccttgctatgattttctcttttcagaagtgtagtgcttctgagctgaagacggagttagaggaccaaggctcagacaccagttgagttttgcctgtggagtggagctgaagctccgctagggttgcctttttccgctgctgctgctttcgtttcggtgtgaggactaagtgcctcctctgtaagtatcttacgcttttattttcgtttggaaatgtatattacttgtcgttttgtgtaccatggctggtcttggatagggatttaatacacaaaatagtatggaaatttgggctaaatttctgggtgtgacacgcaccgccgcatcttctcgttcttcctcgcccgcagcgccttcgtcacctctgtgcatccaccaccaccaccacacgcggatttcagattgctgcgtcaacaaaaatggtgaattgaagcgcaagaatggatgggtgctgaccttgggaggtgatgaggcggtagaccaggccaaggactagctccactggcgtcgttgggcttgtcccccgtggcagcagcagatccggcctcccctcggcgcgacagcggcggatccggcctccgcgcggcctggcggcagtggatccggcctccctgcccacgcccgagcgccgccgccctccttgttacccgcgcccgagcacgccgcggtcgtcgccaccagagctgccaccgccgtcgccggtggggaggccgggagggaggaggagagaagaggagtggataagaagatgagaggatgtgtggtgttttattgtgaagaagaggaagaggaagaggtaggtgggtgttttaatgtgacatgatatttgtggttgggtttactctagcggttttatttattggtcgctaggaaaaattcgaccgccagcgaaaattatctttttttttgctggcggcgcacttaattgaccgccagcaaaaatagacatattttcgctggcggccgcattagacgggcggccagtgaaaatttattttcgctcgcgattggtgcccctcacccccttgttacgagtttgctgacggttttcatatttttccgccagcgaaaatgataggctaacaccatgaaaaatcgtttttctagtggtaaatatcccatctggtcttaggttcttatattttaggacggagggagtatttgatattttaaagcaatgtatcgtttaataatttaaaaagtgtgctaacaaaaaccattgtaaaatctacatgttaatcatcggaaaagaacagtgtaattgacccaaattaagagcagcaggtcagggaattaaagagtagtggagtacattcctgttcgtggcgccatatattatggtctttgtttgggcagaacggttgtatgtgggccgggcctttacaaaagctgatttcccttcctcgaggaaaccttaccgggccgaaccttgggcccacacgacagatcgtgacagccgagcaacacggcccagagcccgtgtccccaccgagtcaccgacccgcacctccctgggccccacctgtcatccaccattccccatacccgtccgtgtcacggagaccgccaccgaccccaccacctcgttaccccccgccgtgctcgtcccagtctctgccacgtgggccccacacgcaccacactatttattcctacacgcgaatccgtacgcgtacacttcgactcgacgcgtattcccctcgccgccgtcgccgactcgccgtcgattcgccgccaccgttgccgccgcttcgcgcctagggtttcgtcgccggccgccgctgtatgagcagtcgccccatcgtcgccaacctggaccgtcaccaccaccaccaccgccccgatgtcgtcgtcgaggaagaccgcgggcccccgcggcggcggcggccgccgcagggacgaagaaggtgggtagtgggccgagccgggtgacgctggagaggctccgggaggggatcgagcggcgggcggaggaggaggagaggcgggcggaggaggagaggagggcggaggcggagagggccgccgcggaggagcgggcgaggcgggaggaggaggaggggagggcgcgggcggaggaggagaggaggcggagggaggaggagaggcggcggaggaggaaaggggagaaggtgagggaggaggcgcggcggagggaggagcagcggcggcggctcggcatcaccgtcgtcgctgattctcccggcggaggcggtgatggcgatcgtcgtcggcctgtgtacgactccaggaagactaaattgcaggccaagcctcatggggatgcccagtctgaagctgatacggcagaattgctgagctcgaagccgcaattggaggacgagcagatcaatgcattatctatcgaggttgctgctgccgcagacgcagtagaattgggagtgggaaggaaaactggatcatcagaagaggatggcactgttagtgatggtggtgatgattcttgtgaggacaagagcttggatggttttgatgtccaatctgatgggaattctccctgtgttgcagagggggaaacagaggacaaacttgcgacttctgcttcccaggttgttaatccagtcgatatcgatgtggctggtgaggttgaggaagatgggatccttgattctcaagatgcgtgtgcaatcgagggtgacagggtgctccgtgagacgatatgttgcatccttggccatgtggatgctggtaagacaaagctccttgattgcatcaggcacaccaatgtgcagaaaggggatgctggaggcatcacgcagcagattggcgctacctacgtacctgttgaatacgtcaaggagagggccaaaccccataaaggtgtgtcgtaatcaaagttcctgggttgcttgtgattgacacccctggccacgagtcgttcagtaacatgcgctcgaggggaatgagtttgtgcgacattgctgtggtggttgttgacattatgcatgggcttgagaagcagactgttgagacccttgctcttctgaaagaccgcaatgtgaggttcattgttgtcttgaacaaggtagaccggctttgtgggtggaaacattgtccagatgcaccgataaagaaggcactcgagaaccaatctggtgatgtcaaaagggaatttgggtggaggttgactaaggtactggcaatgccattacattcattgatccaatatgtttcaatgcaaatattttctttgattttatttgacaatttgactcatctatctaaacaggttgtgacacaactgaaggaaaatggctttaacactgcactatactatgacaatcaaaagtttcggaaagtgtttgacatagtcccaaccagtgccataaggtatgtctgctatatgctttgacttttcttgtttattaggtttcattttcagttgttatatgtgatttgaggtttaccttttcctaacatatgctattccatcctccagcggtgaaggcattccagaccttctactaatgctggtgttaaggtcccaagcgacaatgatggagaagctaacctttgtcaatacagtggaggtttgtccactatccattactatgttaatctccattactctgtttaatatcgagttacttactagtttggatatgcaccatttatcaagatgttgaatgtgagattgacttcatgtttgtttgatcagtgtactgtcctagaagtcaatgatgacaaagatttaggaactactattgatgtagtgctgattaatggtgtgctgcacaaaggtgatcaagtgaatgtttgcactaaacaggtataataacttcttaaatttgagatttcataccccttgaatttttccacaacggtttgatctcataatcttaaacatttttcatcttcaggggcctgtcacaacaactattagagatttgttgacccctcatccattgaaagaactgagagttaaggtgagttaatgattgcactctcttttgacagttatagtttctgtacataagtttttaaaagaaagaaacaacatatgcaaatctagcaaatccccagaaggtaataaatgtatatgcccatgagagtgaaacagttcatcttgttaaaacatgcagtttatatgataagagaaatactgaatgttatcatcacttaggctgcgttcttttccacatctccataatacaactttctcgttttccgttagcacgcttcccaaattactaaatggtgtgttttgtgtaaaaaaaaatctatatagaagtttcctaaaaaagttcaaataaatatattttcatgtttataataatcaatactctattaatcatgcgctaatgaggtgcccccgttttgcgtcctgttaatatgctcctccaatatggaggttcaaatggacccttaggctgtgttcgggaggaggagaacccctcctccctagcgtgcaaaacgaagctcgtattattgcatgattaattattaactatttttttgaaaaatggattaatatgatattttaaaacaactttcatatagaaagtttttgcataaatcacaccgtttagcagtttgaaagcttgcctgcggaaaacgagagaggtgggttgggaaaatggggggaagaacacagccttaattattatgtggggttttgagcaaaaatgggccacctaagcatgtacagtatatatgaatttaattttaatatgtggcaagattatttgacagtatttgttgggtgtttatttaatttgtccacttctattctgcagggcatatataagcatcacaaggagcttaaagctgcacagggggtaaagattgtggcacgggtgagtttatttcagttgtcatgccttaaaaaaaagatccaatctcgaactaattgttgcttaactttatcttttcagggactgaaatatgcaattccaggcacttctctcgttgtagtgaagccaggggatgatctgggacaatctgaagccaaaagccagaggaatgagaatgaagagggaaatgtaatacaagaaataagtaggctcaaaacttgcaaggaaggtgtctatgtgcaagcttctacttttggaatcttggaagcaatcattgagcatttgaacagccctggtgtgaatgttcctgtcagtggttgcaacttaggcccaattgagaagaaagatgtcatgaaggcaagtgctatgctgaagcggaaagaagagtatgcagccatcttagcatttaatgtcagggtgatgcctgaggcagatgtccttgcatcagaatcaggagtgaagattgttacagctgacacagtgtacaagcttgttgacagctttaatgaacacattaaaagatcaaaggagttgaagaaaatgcagtgtgcagccaatgcagtgttcccatgcaccctgaagattctgccaaaccgtgtataccgtaagaaggatccatttctttgtgatgttgaagtcttggaaggtgtcgtcaaggtacttcttttagccttattattttgagtgaattctgttaaaatgataattatcctagatactgatgcataggcatttcgccacagtttgagttagcacaattaaactttacatgtcagcagtttggttcattggcttttagtcttggcctacttatcacggtcaatgacagtgcaaaaatatggtaccttgttattgcatccaaattgagcttcacaaaaagtgtggcatgctacaccttagaaataaacttgatggaaaatcttggcatctatccaaacctataaaagtttacaaatctggcgctattgcaataggtcacatatattactgctcatcattgattgtggtaattgcatttcaggtgggaacaccaatttgtgtctatgttggaggcacagtccatggtcttggaaggatctcctcaatgcaaacatcaaatggtaatcagattgattcggcaaagcgaggagtagtagtatccgtaaaggtatgaataacaaagatcgttaggataatttcagttatcaacaactaaatagaaaaagcctaacatacattttctccaccagataaccggggagagccccaaggagaagacctggttgtatggacgccattttgatgagagcaatgagctgatcagccaaatctcaaggagatccattgatgtcctcaaagagtactatcgagtaagatacataaccacagccatttccatttatcttgcagagcccttaacacgtgcatctaatttttgtgaattcaccttgctgcaggatgaaatgaatgatgagaattggcagcttatccgcaggctaaagaaactactcgatatagcctgaaggattggaatacttctgtcgtcttctcgtgtcggcaatttagatcacgttcatcattttctggtctgtgttgtgtccagaaactccagtcatactttgtcatcatttgtcaaaccgttttgttactttgtgaataatggatgaatctatagatgtttgtaatggcgaatattgtcgttaatggtgaatgttgcatctgtgatatcttcctggagtgaaatccttctgtgttggactaccctgtcttcctatgtgctgctgaagccatgagaagtaccactgcaacgatgaacatcgacaacatgcaaccgagcaacaggtaagtcttcctcgatgatctccggtactcgccaaagaggatgactccccagaatgtactgacaagaggcagtgcctgatcacaccatatcatgaacaccatgagttttagttgtattacagctgaaatgcaggtaaaatgcagcaaacattgcagagctgatatgaacctaaggagaggatcacctggacagcatcagcagctgcatatccagcagcctgcccacccatgaactggaacccattgccaaacccacagagcagccctgccaggagcgcccagtgcctgccgttccagtctccggcataagctccgatggtcgacggcggtacaccggccaccgggcggtagaggagccgggcgttgaggccgataccgacggcgaaacacgagacggagaagtagaagaaggcggtgtagaccgtcaggtgggggacgctgtctctcagggtgcgccactggtcgttggtggccaggttgatcgccggcgagaagagggagaagcagactccggcgaggagcaccattcccagtcctagccacctgctggagccaaacacctgaaacccacaaaccggtattcaggtttctgaatttcagggcctatattactcctttataagcttcaccaatcttcagaggcagtgggtgatgtgaccttgatggatcgcctcttctcaacctgaacgatgaactctgcggtgccggtatcgaaatcgtcgtcttcgccattctccagttcttcttgatttggcagcaacttcactgaaaaaaaaatggtagcaaagtagcaactttgttagcttctgcattgcataatctcaccctttttcaggtggttagaagatagatagtaccaccttggtcagcaacatcactgctgagctctatgcctctactcctgcaaacaaacgaattgtacttcttgacatcaaaggaaggtctctcgaagaaaattcagattggtagtgctcaaatgcatttctgaatcctgacatgcttagcttctcctcctcatccttggcattggaagagtggacagcagagccgaggaagatagcgacgaggaagcatgctacacccgggaaaaggatttctgccctatttattcggccatcgaggaagtagttcatggttgttccttcaatagatcatggtcatccgcattagcgaagtgcaagataaatagctgcagattcaccaaagattcagttttttgcatgtttgggtgtacctagaactacagccagacttgagcagatgatgtttgtcacagacagaccgacaaatgcccacgcatactgcgagatcaaatgtccgatgctgagagcaatgccaccggccatcgcaaataggactgaaggccagttatcctgcattgatcaatggctgcaaatcatggaagaattcactgaagttgattatccacataaaagctgaacactctaacgacagtgacacgatgcaaccaacatacagttgggacaagtctctcatgcttgttttgcgtccacagataccatccaaattccaaagtcacactgtcaacttgaagcaattctgaatttccagttatcaaattcagctattcacttccaaattactctcattaacaggtactaactcacacagcttcttatgaaatcaccactgcattcttgatggctaagatattctagtcctagattgcatgacacaagaacaaccaactgaaccaagaaaccttaaaaaaagcactgacctgagtgagctgagtgaagaagcttggcatgctaggcctggtctctccaacctgcccaaatgtgatggcaatcacagcagcagcaaggagatttgtgacagagtagtccaggtatgtgtgctgaggcagccgtcctctacgctccaggagagtcaggagagcaggccaggtgcccaggaagaggagggaggccaccatcaaggcgacggcgccgccccggtcctcgacgacgaacatgtcgacgccgggaagcggaacggagagcctggggtgtgatctccggggaggatttcaggctagatctttcatctcaagtctcaattggacgaattgctcatgtccatgtgaactagtctcactctaacccccatttccctggcatgttgtcctcatctagttcatgttttggcctgaaaaaggtaaagagataatcaaggatgtggtcatgatgagcccgctacggcgctctctactcttagtagaaatcaatatgaaccctatatcttatttgattaaagagtttaaatttatttatactatcaccttagttagcgggagtagaatatgaaggggtattattataaaaaaaatacaaaggggtataatagttatttatcagtgactaaaccttttttttcttgttttagtgttttcgatgaaatatgagtgatgctagtacaatgaatgatcgatgtagccgggaaaaaaataaataataaagttactcctaatcattatattattagtaaattactgattaacagttgtattatactacagtaaaaagcaccagagcatctcattgcaaatatataacctgtgactgaataaagaaagcacaaagttcttgagatctggtttacaagtcagagctgcccttatttttctccacttcatgaaatgatgcaatataaaatgaactagttgaggatatgtgttccttgttagtaggtctacttgtttgcaaggatggatagattaattagctggagtacataattaacgatgggttcagttctctctgctctcttcattaactatagagaaaattacataatgggctaatcaaagagcagcagaatcagatgaaagaacccaaaatcagatgggatcacatacgagaaggcacttaaggtcgagagtagcagtaagtttggtgttaatgcgtaatctaaagatttttatagaaacaatacaattttaataaaaaatcgtaaaaatataggccagccagataaaatcgcaagtttagcacccatggggccatgaaaaaaataataaaaagtgcatgcatacaagggcatgtccaacatcccatgttcgacaggttctactgcacaacccctatcgaacaaccattgttcgacacagtgctaaacttatgattttatctggccgatccatatttttgcgattttacattgaaatcatattactcctaaaaaaatttctaatctaaatgggtaataatgcttgaaattttcatcatcaaagaaatgtgaacgaacctatatatattggctagtgagcacacaaagtagattttttttttgtgtgtgtgcctcctgtctcagggattttgaggtgtcggaaaagtggagatgccacggagttgcggtcggagaaggcggcgtcgtgcgagcttgaaggtaggggaagcatctgacatgtggggtcaggtgggtccgacatgtcagcgggaaagaacgaggaggcgggattgctgggctgggttgggctggctcgcggctatgttgggcccgcggaaagatgcacgccagagttgggctggatttggcccagatcgaggaggaggaatttcaatcgctttatgatttgctgaagaaaggctgaaatgatatttactcatcatcaactatcctatatttcattcaccaactttttttactcatcatctatatgtatatttcactaactcattttaatcatcatcatcagacaaatccaacagcctaaataatctataggagtactgtagaagcaaatgatccagatcacccatctctcctttggacacagatcgacctaccctgagtcctcgagcacagattggcctaccttgagctctagacttgtgtgcgaatatgcaaatttttaacgggggcacaaattaagtttgaattaaaaaatagtgacatggtaaaaaattgtaagtactcagtgattcactgtagatacgtccacggcgttagaacccgaggttcgtagaaagaagcttgggatcacagaattatccacgtggtcgttgatcgccgtctctcgtttcatcctgatgcttctcattcattctcatcctatcctacaattggttctatggctgtgtttagttcacactgaagtttgaaagtttgattgaaattagtacgatgtgatagaaaagttgtgtgtatatgaaaagtttgatgtgatggaaagttggaagtttagaaaaaaaactttagaactaaacaagacctatatttttcttcatagtactgcattcgatcgccgtctctcatttcatcctgatgttagctgttgacacctgtgtttggctcttcgactgacttggttttttatgggtggagagctggggtatgggtaggtgcataagcaaggaagtaaatttatattgatgtaggggtcactggtggagaaaccgtttgtagtcccggttagtaacccctttagtcccggttgttcaaccgggactacgaatccgggactaaagatagcatcccgggtgaaataaccgggactaaaggttaccaatcgggactaaagatcaaatatgcccgttaccctttttaaccgggactaaagatcatctttaatcccggtctttgttgcaaccgggattattgtggaattaggcctaccgacgaaagatggtttctccaccagtgggtgtccatggtgtgattttggtgggtgtttattaatttctgattaagatatatattttaccttgattttcgttagcacacatttcaaacggttaaacggtgtgttttgtgcgaaaactatttatatagaaattgccttcaaatattaaataaatcaaattttcaagtatgtaataattaaaaatcaattaatcacgctctaatgactttctcattttgcatgcccatacttaatcttcattggatgctatgttgaatggggcataagggagcataaaagtgtaagtacgatgatatgtgaatatggggtcgctcaatatgtagatcggataaatgcggatttggaggttggggtgttacaagtggtatcgaagagtttaagtgatgtacacaaatatggtacttagatgaaatatataatggggcttatttcttttaccactagagaccacggtaaaaaaattgtcctatgttggatcggatacatcatcagttcatcactgaagttcttaccaatgctgtgtttgtgagtcagcttataaatgttggcttgtacgtgacttgagaagcccaaaactaccatgaactctttttcccccaaatttgcttcagtctactgtctaggcccaatgcaaatttctggatagcatatgcacagtacaaaactgtctgttgtatttggatttggatgcatcgggaaaacagagatgactagaagcagaaactacccacgttcagtacctactggatctagtcgtatatctcaaccatggaaacacatgcatctttggcctaacagttcaattttgttgttgaatcttcatcaagctttttgttgtgccttcgtcaagcaacaaaaatccatgaactgcaaaaaaaaaaaaaagtacgctgaagaattacctaacatctaatacgtactctggcgtgcgtctatttgcgtgtaccttcattagtatcttaccctatcctcaaagggattcctaattataatgtggtctttaactttattagggttataagaacatcaaccgttggatcaacagccaatggatggtgtaaataaacttagattattctaaaaagaaaaaaaatccttttttggatgagttccgtgtcttttctttttctgtcggggtggattcccctattgggatttcattctaccccacttcctttttatttaaagaaggcaaaagcttgagcggtaaaaagcacacttcgtacaaacgtacacatcgtgctcaaaaatccaaaagaaaacttcttcccctttctaaaagaaagaaattcccagttgaaccaaaaacatgctcttctcaacaactctccaaaaattcaccttgcttctcccaaaaatccaaaaattttcacattacttctctcccttttgacaatgatttcatcaagcataggaattatgttcattaatattcaagagcttagtatacatatagcatatcaagccatgtgttacaataaaaagaagatgaacccatctaaagcagaacaagcaaaagtataaccatgaaccaaagattttacaattaagcttgaatcaacaatcaaaattcatgatttcatacgatttataatgcaacatcttaacaagtacataggttgaagaataaacactaaacacatatacttattgcatttattactctttctcaaataaactttataacagaataaccaagagaactttttttaactttttcttttcttgagcctttttgctcatatttttctcttttattccgggtacgtcctagtcgtcaagattgtttccaaggattcggcacccattattttgctcacatcgaatacgtccttgtcgtcaagactgtttccaaggattcggtattcattttttcatattttttattttcttcttcacaataagcaattaaagctatttgaggaataacaattcaataaagcatatatatagagcatttataaatcaaaccacatgctagcatcaatattgcatatttgcttaattcaagtagaatttaagtgtcatgcatcatctcccttaaaagcaaaatctaaatctcatgaaaagactggaatacatacaagctatgctagagacaaataaaccttcaaagtattgctagcatgcacaaaaaaataccatatgcataaacaaagttctcttttctcaattttttcattgtcatattattgcttgataaaaccatgaggtacaaattccccctcaaaacatgccaaaaggattcacgaataagcactaactccccctcaaaatatcaacaaaattctcatgaattgacacgtatccatttgtattaaccaaaactacaacctcaaatactagcatatgaaaaagctaataaacaagatagtagaataaaattatgtcaacccaaaaataaattgatgttaccatgaaaagcaatcgccatctcaacattgaaagctcatgaggagtatgccgtcaaaatacctacgaacgagaagatgtcgaggcctccgtgttggggttagaaataagaaattttggaatccaacactgagtcacacgaccagtagaactagtaggtacatatgcactaacaaaatcagaatcagacttacctgaaaaattacctttttgcttcacaaaagtctgagttgaatttcgcgaaaaattgccccgaggccggtatgaccgccgctgtacctgcggtctgatcgggcctggcaatcggtctgaccgccggttcaactacggtctgaccgctggccggtcggaccgactggtcagtgtcggtctaactgtggtcctcgaattaaaacccgatttttgccaacgtcgttttgcaaaagcaatttccctttcctttttctgtttatgggcaagtctaaaacaaaaaccaaccaaatatccatcttttccacaaaaagaacaagtgtacttctcacgacaagtttttgaagtagatggttttgcatcaacagaagtttttgcattcacaacatttgatttcgaagaagatgcattcaaagaaaacatgatgccagcagatttaaacacagtgttcttaggctcaatttcaatcaaaattccacctctcctagcaacacccaaaacagtaggaggatgtctagtatgatgagcataagaatcaaaacctaaaccacgatggtgtgtgttaactttagattgatcaagaatcatgttgaggttctttttaccatcagaaaatctttgcaaagaacttttcaaataagaaacctcctaagtaagaatagcacaatttttgcaagcatccaaaagacctttttgttttctacaagttgagcaggaaaacacctcatcttgtttaacaatttcttccatgtgtttaacatgctctaaagcatctttcaacttcaactcatttaaaacacactttgaacaatcttgagaaatcaaaacaacattgttttgttttacattatttgcacatgaagcattgaccaaagaacttgcacaaaaagcaactttgtatttttcaacatgttctttgtccaaatcacattaacaacacgagcatgtaaagcaaatccaagagcaaaagaagactccaactttttagatttttcaatctcaaattccaatttcttgcaattaacagaattgacatctcgcaaagcattaatttcagaaaataaaacttcacaagattgccaattatcatcattaggaatcaaagattttaatctagcaatttcaacattaagaatctcaatagtatgatccttctcatcaagcacaatataacatgtttgaagtttcttagcaaatttgtaagcagcatattctagtcgatcataactaagcttttcttcattatcatcatcagattcatcaacatcagaacttgcattacgagcaataaaagctagatcaacaacttgcttacctttgctctcatctttatcttccgattcatcaaaagttgctatgagttcttggattaaccactgcatgcaattcttcttcttctccttcgtgttcttcttgtccacgtcatcttccttgactctaccattgtattccttcttgcctctcccaagcttgggacaacgcgaacaaaggtgatccggagaaccacattcaaagcaacgattcggtccacctcttttcttgaacctaacattattcacagcttgagaaaatttgttagataacaaaaccaagtcctcctcctcgaactgttcgagttgctcatcggacatggcatcaaataaagcaagcacagaagacttcgatgaagaagcaccaacatccaaagaagtcgaggaagaaaccaaagcacttgacttagaatcaattttacgagaaagaatattcatctcatgtgttttcagttttgtgtaaagcgaatccaaagtcaaagtagacatatcaacagactcctgaattgatgtaattttcatctcccaaatagacatgtcaagaccattcaaaaagtgacgagaaacctcagattgtgagtaattaacatcataagaagaatcaacagacctaagatcactcaaaattttgttgaacctagaaagatagtcatccaaagcttctccaggtttcatctcaaattttatgtactttttgaaaagatctcgacgaagttttttaatatttgaagttccttgatgaaagtttttcaaagcgttccaaatctcatgagcggtttgaaaatgtgaaacacgatcaaaatccgaacgacaaatcccactcaataaaatattgtgagctttacaattttgttcaaattcagttttcaaagcagcagtattaatttgatcaggaatcacataaggattagaaacttttctccaaatatcaagatcctcagcctggatataagattgcatcttactacaccaataaggaaaatccgttccattgaaaacatggggcttagttgtaaacttattagctatggcaaaaactcaagatcggtaaagatcgaaaagagcaaacgtggctctgataccacttgtaggatcgaacacaagtaaccaagcctaccagagggggggtgaatggtaggaaaaaccaaaaacccaaaaacttttagcggaaataaaagttaccctcaaatcgatggaaatcttgacgtagtcctatcgccgccggtcggaccgtttgcacgccgccgatctaaccgtctccctgccgcctgaacccaaagaaacataaatcgaaaaactctcaaagtagatgacaactttattgcttctctctgtgtttacaaagtgcaccaacagcactccttacaaaaatctcgactaaactcgaaaccctaactaaactagcaactcaattgctctcaaaccgggaagcctcacgctccccctctatttatacatgaggtaggcagcctaaagccacgaaccaaactcatactaagagtcctaaacatcttaggaaaccctctagtacaagaaacaaactttacataaccaatcataccaaatttggactccttccaaattcgactccgcatcccataagcacacaatacctccatcgtatgccatatggaatcttcaccaaccacgtgcatcaactctagccttagtatcccgcatgatatctgaccaccacggacatcgtcttaccaccaagccgactcctggtccatcaccgcaaatactctctcgaggcatcgagtcacctacacatgaaacaaacaaagaaaccatattccgagaccaagctatctccaacttgactcattgttagcaaacaacagtattacatacgtatagtatccatctagaagccataaccatgaaacaatcacggatatccaaagaaacaacccgaaaccgaaaccaactcagcgtcggccggtcagaccgcggacctggccggtctgaccgcacacatagcaccggtctgaccggcaacctccgcccggtcggaccggacacataaaataacagtgaatccgatcatcacctgaaaattgattatctccaaaattgattatctccaaaaccacttcaatgataatctcaaaatatcaaaaccaataatcacagatgccaattgttcatcacagaataagaatcaaaacacacgttgatcttacaccttgtatatattaacattctaccccagttgtttgcttccaaagtgtctaa

SEQ ID NO: 80998 - DNA, 1334 bp, Oryza sativa
atttagatgactccttggttctaatcaaatgtttaatttatctcttcatttaatttaagtcttcaatgcataaagactaatataggaacaacttatttagaaaaacttaaatataaaatatgtgtaacttttgtggatggagggagtatttgaaaataaaggtgaatgagtactctctccgtctaaaaaataaactcaacctcgtaagggtgtgtttagttcacgcgaaaattagaagtttggttaaaattggaacgatgtgacggaaaagttgaaattttatgtgtgtagaaaagttttgatgtgatgaaaaagttaaaagtttcaaattttttttgaaagttgagtatttttttttaacggagggaataatgttgtgcagtaaaacccgtcagactgctgtgtggactgttgtcccgtggttcagtcaaagatgccatttataaacccttgccttaaaatatggagggatgtgtagctcagctcctggagctgacaactccgttagaatagtgcaggtatgtgaagaagacttgtatggccaaacgtaagggttagggtatgtactcctagggttagagtaaagatggaagctttgccgtgacaacatatgcggactgtatcaccgcgttaggttttgaagctgggaggggcggagggcagcgattttggttggtagtagtacgggacggcggcgaaaaaaaagaagcaaaagcagtgctcccgctcgccgcgctcggtttcgacttccaaaggcaccgccgcggcggcagcttccccgtctttattaccccaccacgccatcccttttttttcacactcccgccacgcctcccaacgcccccgaaatctcgtgtccctacgtgccggagcagctgcgagcttttgcacccacgctgtgagccccacccgcgtacgccgcggcctacgccgcactccactccaccccaccctactgcgccgcgccgtttcaaacccgttcctttcgtttcaccgttcccaccacgcacccctctatttatccccgcccccaacaacctcgctgcactccacactccacgcctccgcccgctctcgtcgcagcgcaccccgtcgcgtgcgacgactccatccccgtcacaacaatgtcgtcccgccgagacgtcctcgctgttgtcctcgtggccgcgctgctcccgccggcgttgtcccgtgggctttggctggggcaccacgggctggggcacgggcacgggcgatggcgcgcgccgcatgtcggcggacacggccagggacaggggccgcagcagcacgcgccgctcggcggcggcgggtggtcgtcggcgcacgccacg

SEQ ID NO: 80999 - DNA, 512 bp, Oryza sativa
gcgtgggagatctggaagactggtagggtgtggccacggggatcgggggcagggagggaggcaccggggagtagggacggcctaatgttatacgggactcttgtggcaaatgaaatgggctcctcccatgttgattttggataagttaattttacaggtgtttcactcccttatctaatgttttcattttcatttaaaaatatatatgtttgctaattttacatatttggaatatcctatgtcctcttttcttcaacttcggtttcccacttccaccgcttaaagcttgatggataaagtggcggtctctcctaattatgtttgtccatcatgcctactagcaactcagcaataaaatgcgtcaaaaaagaagtaagtcaaactcatgagccacaagagcattggtgaagataaatggagctcgagcttgagatggcactctaggcaatgcaaatagagatcgagctcagggtcgtatcgatgtcgttaatcttagtgcatggagcggattt

SEQ ID NO: 81000 - DNA, 602 bp, Oryza sativa
tccttgactaaaatagaatcccaaaaaaataataataataaggcacaggaagacaaacacgataacgcttacaagttattttctaaattcaccttgaaggagagactacatcccttgtagccctctcaaccttgatagtaccagtaccatcatcttcttcaacatgtgttcgaccattttgtgtggcatccgcactgctttttactggaaacttcggtcgctctctgccaataacagcaattgaggaacaagggaatcagataggtgttgagatgtctcaattatcagcaaaagactgcttttaactcttctctctgttatgaacagaagtactataccacataccttattctatccagaagctttggagattttctagcatttcttacaaagcggtgcttaagaagatccttggcacttagcctctgtgagaaagttataaagggaaggcgttaagggcaaggacttaaaacacaattttttgcaggttagacatcaataattatcaaatgagattgataaaaaaagcataaagcattaaaatttcccccaaacattacaatatgccaaatttgttggaaaaacgggcatatgatgttttg

SEQ ID NO: 81001 - DNA, 1510 bp, Oryza sativa
  unsure (1)..(1510): unsure at all n locations
cggttttggaaattcatttagttcgcaagcaccgacccaggtgtcgggttttccaagtcttttgtaaaacccaagttttacccatgttgtttttcagattttaagtttgaaggcgtccgctgatactcgcactaggtgcgcgaatatcgagacgcaactagatggttgcaaagggacatggtatcacaattaacaaagaaaggatcaaatgcaacaaattaggtaggtctaccaatctgccttgcagacgggacaacagattaagtgcgatcctatcaatgcataatatttttcaagcaacataattaaatttcaaatataggctcaagatgttcaaaggtggcttgccttgctcgagatctggagctcgatcctcgaaatcctcgcactgcgggtcttcgggctccgaaactacacgtgaaacgggacaactcaacaaacggcgaaaataaagccctattaatgacctcgaagcgtgccattagatagatctcaagatttgaggaattttggaagttgaacggagtcaaacggacttacggttgggaagatattgaatttctaagattattggatttttggtctaaaggaaaaggatttaattaaatcctttttggaaaataaaagaaaagaaaagaaaagagggagggaatatagacttttctcgggcggctagggcgcggcacgagagaaagggcggctcggccgggcttaacgggccggccggcccaagaaggcggcccagagcggcccaagacgcgcgcgcgtgggagggaggagagagagagagccggtggaccgggcttaccacgcgcggtcccgggtggcacccgcttgtcagcggctcggctcaccgtgcggagggagcacgcggcgcggcgctagggtggggggaggatgcggtgcacgcgcgtggttcgcggtggacgcagatgcggcgggcccacgcgcagcctcacggctcgcggtggaacgcgcgcacggggaggggctgaccggggtcggctcgacccggtcttggctgagctggcgccgacgtggcgcctacgtagctgccacgcgggccggcgggaggtagacgacgacgccggccggaacggacggtggacgacgcggcgagcggcggagcgaacccggcgatacaggcaaaacgagcacaccgggtggttgcaacgtgacgaggggagacgagccaacggctcggattcgccggaggaagcttgacggcggcgaatcgcggcggcggcaaccggcggcgggagaaggggaaaacggcgacgaggtcacgaggggccaattcccggcggcgagagcatctacgcggctacgggaatccgatgctagcgtcggattgggcggaactacgccgagcgaggccggggacgagcgggtgctacggagctcgagcggcgacggcggcgagcacacggcgagtgacgacaacggtcggggcggcgccggctagggggcatcccactagttnctagagcggcnncgcccgccgcggtgg

SEQ ID NO: 81002 - DNA, 9319 bp, Oryza sativa
cgaccccgagattcagcacctaagggagcagctccgggaactcggcgcggagaagatcttctcgctcccaggttgttttcactggcacgaaatgagccaatttcgtgagtcgatccacgattacccaaatggagtcgtacccgctaggggttcttggcaaaccggtgatgaaatccattccgatttcttcccatttccactcgggaattggtaggggctgtagcagaccagctggcctctggtgctctgccttgactctttggcaaatgtcacacaaggctacgtattctgcgacatctcgcttcattccagcccaccagaagtatgccttgatatcttggtacatcttcgtacttcctggatgaatggagtaggcggactcatgagcttcctttaggatgagatctcttaattccttcttggccggtacacagatacgtggaccgcaccaaactgtgccttgatcgtctatggagaaattggtgtctttcttctcctgtattctttttattaactcttttatcccttcgtcgtctttctgagcttcccggatttgcgactctagggtaggctgtactgtcaagctggcagggacacctgactgtaccacggtcagcctcaacttctccaattctctgcacaggcgatcttggtcaggccgtatttgagctacattgcaataggccttgcgacttagcgcatcagcgaccacgttggctttaccggggtggtaatgaattccaagatcgtaatccttgattagttccaaccatcttctctgcctcatatttaactccgtctgtgtgaagatgtacttaagacttttgtgatcggtgtatacttcacatctgttcccgattaaatagtgcctccagatcttaagagcatgaaccacggctgccaattcgagatcatgggtgggataattgacttcatgaggcctgagctgcctggatgcataggccacaacctttcgttcttgcattaggacacatcctaagccttgtcttgatgcatcacagaagatctcgaaatcttttcggatatctggcaaggtgagaactggggcagtggtcaaccttttcttcatttcttgaaagctgtcttcacaggctgcagaccattgaaatttcttttccttctttaacagctcggtcataggtctggctagcttagagaattcttcaatgaatcttcgataatatccaactaagccaaggaagctgcgaatctctgacacattcttgggcgggttccaagcaagtacagcttcaaccttgctgggatctacctcgacaccgttggaggagatcacgtgtccaaggaatgctactcggtctaaccagaattcgcatttcgagaatttagcgaatagttgatgatccctgagcttttccattattagcctcaggtgttcagcatgttcttcctcattcttggagtatatcaggatgtcatcgatgaacaccacgacaaactggtccaggtattccataaagattttgttcattaagttcatgaagaacgctggagcattggtgagtccgaaggacatttctgtgaactcatatagaccataacgcgttgagaaagcggtcttcgggatatcttcagatctgattttcaattggtggtaacctgatctcaagtcaatttttgagaaaactcttgctcctttaagttgatcgaacaaatcgtcaatccgtggcaacgggtacttgttctttatagttacttcatttagggctctatagtcgattaccattctctcagagccatcctttttcttaaccagaagcactggggctccccaaggggatgagctaggtcgcacataacctttactctccaattcttcgatttgtcttttaacttctactaactcattagctgccattcggtagggtctttttgcaattggtgcggtgcctggtgccagttctatggcgaactcaatctcccggtctggtggcatactcgttaattcttctggaaatacgtcgggatattcacagactatgggcaccgactccaaggaggtgacttgtaaacaggttaagatagaccgacttgcggtaggagtgttaggggtaaagcggacttgctttcctccaggtccttgcaaggtgatggacttttcggcacaatctatctgtcctttgtgctttgccaaccaatccatccctaggatgatgtccaagctttgcgagtctaggactatcggtttggctaggaagtcaacttcctcaattctaaggttaacttccaggcatatttgagttgcccttatatccctcccaggggaatgtactatcattggtacacgtaaattttgggttttccaaccatttcttttcacaaaagcttgtgatatgaaagagtgggaagctcctgaatcaaacagaactattgcgggtatggagttgacagagaacatacccatcacaacgtctggagcatcctgagcggtctcggcttgaatgtgattcacccggcctcgaccaaggttgttggacacacgagaaccttgtccacttgcctgagagctaggacgagactgagctgccgctggagtaggagttctggcagtgctgccattagcatgccctgagctggtgttggtaggattctgagggcactgtctggcatagtggcccatctggttgcaccggaaacactgaactgctgacggtccctgtggtgacttgaaagaggtaacactgttgggcgcagtattgccactaggggcacgctgctgtggctgaggtgccggacagttcatctgaggacgaggggcgtagcctggctggcggttagcctgagtgaccgactggtggtattgcatgggttgaccgtagtgagggcgaggtgcgcctcgggaagaatttccctgatggttagagttgcgtttcttgtattcttcggtagcctcttttctggcatcttcaagtagaagcgccttgttgatcatatgctgaaaagtggggaagtcatgagcaagcaactggagtctcattccaactgcgattcctttcacgaatttcctgatcttcttcttatctgtgtccacttcctcaggggcgtatcgagccaagttgttgaacatacttaggtactcattgacactgctgttgccttgcttaagtctgttgaattccactttcttcatgtcaatggtgctttcaggcacatgagctgcacggaaagacgtagcaaactcatcccaagcaatgttagtgggttcagggtgtgcattgcagtaattttcccaccaatctgcagcaggtcctcttagctggtgagaggcatagagcgtcttctcaaccggagtacactgcaccaagttgagttttctatccacatctttcagccaatcgtcagcctcgacgggctcgacggtctgagagaactctggcggacgagacctcagaaagtctgtcagcttggatctattgttgctcatgtgacggtggccatttccatgcgcagtatgctgaaaaccggctacggctgcggctaatccttgcaagatttgtgtctaaactgccattaagtgctgcatgttgttttccacatgaggtggggaagggaggcgttcttctccagaattgtgactggcagtgcggtgagagcggtgagactgttccatctctacatcacaggaagccgtgcgatgcgagcggttgctgcggcggggttgctcaacttctgcattgcgggaagcagtacggtgcgaacggttgctgtggtgagactgctcatgatttgcttctggctcggctctaccatcttcaaaaccaaagcgggctggtgcacgagctgcacggcgggggcggctagccatctaaactcccagaagagggcggggtaagaatcaaataagcacttaggagggcaaggagcaacgtaaatagcaactcagatagcacacactaggcataaactggatttttcaaatcataaaaacacctgatacaacgggtgtggacaagtcacagagctacgccgagcttgactgtgcgcacaccacctaggagaaccagactaccgaacaacacccacaacaaacacacgcacgcactaccttgccacgactccgaaagagttggcggcggaacaaaagggcctaacacacgggcggctgctgtagactgcctcctctactcctcgtcggcctggctgcctcctgtagtcggctcctcagtcgaagaaatgtcgatcggctgacgcgaagggaccggcggaacctgtcgagggccgacagcagcacgggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaggggctaactgggtgtgggtagggggagtacactggtgagtacggcgcacgcgagctgggggagcgcgggccactgggagtgcgggcagagccgcgggagctgtgggaggacaggtggctgccgtgacagaggcggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggtagctgccggaaggcgaagcccccgagatggtggctgtagtcgtgggccaggtgacgaagcgcagtccaggagaggtcctggtacgcgatctggagagtgggcctggccacggtgaagtggtgtgggcgaaggccagctccgtgtatacctccacgagggtaaaggtacacagagagctcacagtgagggggaacacggtccacggagtaccccgtgtactcgggacacgagaagccaaggaaacgagcgaggtcacgaagctgagcgacgtggtgaccctcaccaaaaccgtgggagctgaagctggcgttcactgccatctacaattttgaaggagggagaaaagatcagtaaccattttagaaacaaactattgaaaataaggaaaccaaagaagccttagcttttcgcaagtagttttgaacttagtatccttagggtcgtcctaaacgtcgggtttcgccctagggccaagcctgtgctctgataccatttgtaacgtcccgcctcccccaggccgggcccacttacatctgatagctttcataggtcatagactgccctcacagaccaacacatgtcttttctgcacactttgtcctcactcgtgtgcacccgggaagaatttcccaatcggtcacccatcccaaattgctccaggccaagcacgcttaaccctggagttctttggagattggcttccgaaaaagaagttgcaacttgttgatatgagtattctattaatcctattaagccctaggccgggatgttacaccctcacccccttaagagagatcgacgcccccgtcgatcaaccctaggccaggaacgtcatctcttggccacgtccatgtgtccagtgccagcgcatgtgccatgctgtgtaaccactcccggtctacatcagccatgcgcaccatgcctgcgcaactacgacacacgcgcccgtgaaaccgcgagagtcggctctgataccatctcttgtcacgccccgaactagtcccgactggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaagggaaacggaagccaggactcgggccaaacaacacaggcgcgacttgggaactaggccgaaaccctaaaactcattgtagccggcttgctcctggaagaactcctcatcagcaggatccgcttcatcttcttcagcatctgggggggattatttatatagagcaagggtgagtacgagagtactcagcaagccaggggaaataagtgtttaatgcaggcttcaaggagaggcgggtgtttttgcaattgattttatttgaactcttttctgaaacaactaagtgagtgcttcttaaacgacacggatgagacagtgcgtctcgtccggtcggagtatgtgcaatgtattagtctttagattttgaaacaaggttggcacccggccaacagcttttcaaacggccacccgggccaacaacttccaaacggccacccgggcgtagctgatcccatcagctgcagattttccaaacatcgaacccctttccacaacagcaatttcacaagcagtagtcaaataaaactacgctaggaatcacctcacatccgcccatgaccgtgggcacggcttatcgaacagtttgttaacctctgcagagggggtacactttacccacacgacattactaacccggatcacccagcccgtggggatcagccacgttgggagacctccaagctttcattacaaggcatttctaaagccgacacaggtttaccatatgccgacgagaggggtcccagaccaacaacaggttaggtcccagaccatactgtgccaggaagcccaggggtcctccccaacaccaccccggcgaatccacatgtctctcggcatcaaggctcccctgataagctagttactcagccaggggtgtcccattccacccatgtggtcgtacttgtcttatgtttggatgaaattccaaggaaacggtctttaagtgcaagagcggaaaaccgtacacccggtacgttccccggtccgcggttttggaaattcatttaattcgcaagcaccgacccaggtgtcgggttttccaagtcttttgtaaaatccaagttttacccaagttgcttttcagattttaagtttgaaggcgtccgccgatactcgcactaggtgcgcgaatatcgagacgcaactagatggttgcaaggggacatggtatcacaattaacaaaggaaggatcaaatacaacaaattaggtaggtctaccaatctgccttgcagacgggacaacagattaagtgtgatcctatcaatgcataatatttttcaagcaacataattaaatttcaaatataggctcgagatgttcaaaggtggcttgccttgctcgagatctggagcttgatcctcgaaatcctcgcactgcgggtcttcgggctccgaaactacacgcgaaacaggacaactcaacaaacggcgaaaataaagccctattaatgacctctaagcgtgccattagatagatctcgagatttgaggaattttggaagttgaacggagtcaaacggacttatggttgggaagatattgaatttctaagattattggatttttggtctaaaggaaaaggatttaattaaatcctttttggaaaaaaaaagaaaagaaaagaaaagagggagggaatatagacttttctcgggtggctagggagcggcccgagagaaagggcggctcggccgggcttaacgggccggccggcccaagaaggcggcccagagcggcccaagacgcgcgcgcgcgggagggaggagagagagagccggtggaccgggctcaccacgcgcggtcccgggtgggacccgcttgtcagcggctcggctcaccgtgcggagggagcacgcggcgcggcgctagggtgggggaaggacgcggtgcacgtgcgcggttcgcggtggacgcggatgcagcgggcccacgcgcagcctcacggctcgcggtggaacgcgcgcacggggaggggctaactggggtcggctcgacccggtcttggctgagctggtgccgacgtggcgcctacgtggctgccacgcgggccggcgggaggtagacgacgacgccggccggaacggacggtggacgacggcggcgagcggcggagcgaaccacggcgatacaggcaaaagcgagcacaccgggtggttgcacgtgacgaggggagacgagccaacggctcggattcgccggaggaagcttgacggcggcaaatcgcggcggcggcaaccggcagcgggagaaggggaaaacggcgacgaggtcacgaggggccaattcccggcggcgagagcatctacgcggctacgggaatccgatgctagcgtcggattgggcggaactacgccgagcgaggccggggacgagcgggtgctacggagctcgagcggcgacggcggcgagcacacggcgagtgacgacaacggtcggggcggcgccggctagctacggggaggctactcgtgctactaccgaaaactaagggggagagatggagcgaggaggaagaacggagggaggcactaccgagatgaggaggggcgctgggacgagaggccgacggcgcgggagtaatctctccggtctcgggccgaggaagaggaagaagagggcgcgcccggagtccccttccgcgtcctagtgtgcaccggctcctccggcacacacgcgacgacgaacggcgacggcgaacaggggcgacagtggcggcgagagacgaaaacgagggagattggagggggaggggcttgggtttaaatgggcggcaatgtcaggttgggagaggggaaccggcattggacagtcaagccggcgagctggcgctccggctagcggccaaaacggcgacaggaggtgacgccggcgagagggaaaaagggaaaaagagggagagaaaaggggagctcgccccttgcctctttgggaaaaaggaggaggggagcgggagcgtcgcggcagagggaggagggctctgcctccgtcccttggcggcttgcgcgcggggaggcggggccgaggtgatgacgacggccatgacggcggggcggtttggagcggcgcgacgacacgagcgacaggcgctgacgacggcggcgaccaggcggtcggccaccacggcacgcgcgcgcgggaaacaacgggcggcgcggcggatttgagcggcgcggctgatttgagcggcccggcttgggcacgcacgctggcttgcggggccgggcggctgcgcggctgcaggcgcggcagggcagcggggccgggcggcacggacggcgcagacggcgcggctctcgtgcacgcgcgcgcggcgcgcgggcggagctgagggggaggcgctgggcgcggctctcacgcacgcgcgcgcggcgcgcggtcggagcggagggggagggagagagagagagagagcgcgcgggggagggaggggagat

SEQ ID NO: 81003 - DNA, 712 bp, Oryza sativa
gggatacataccgcatacgggttgcagaacgcagatagtactaccagcacagcgcatcgcgatagataaaggcaagcaaacaagggatggtccaaaccgagctcgggccgcgctgccatctcgcctaaataaaaccgcgctacccatcgaccgatcctactcgcacgcgcacacacccaatcaaatgctcctcctccgccgcctcctctcgctgagctgagctgagctgtgaaatagtgccaccgagtgagcgctgagctgagctcgaagcaagagaggaagaggaggaggagggaagagggggggcgaagatgattacggcggcggacttctaccacgtgatgacggcgatggtgccgttgtacgtggcgatgatactggcgtacgggtcggtgaagtggtggcgcatcttcacgccggaccagtgctccgggatcaaccgcttcgtggcgctcttcgccgtgccgctgctgtcgttccacttcatctccaccaacaacccgtacacgatgaacctccggttcatcgccgccgacacgctgcagaagctgatggtgctggccatgctcacggcgtggagccacctcagccgccgggggagcctcgagtggaccatcacgctcttctccctctccacgctgcccaacacgctcgtcatggggatccctttgctcaagggcatgtacggggagttctccggcagcctcatggt

SEQ ID NO: 81004 - DNA, 672 bp, Oryza sativa
caacatgcccaccaaacccagattacggggatcactacccagttgttttgccaacggaaatgcgtcgcccgtgccacgaaatgataaaaaaacaactaaacaaacgacgaataatttgaaggtctacttcacatcaatctctacctcttcatgcccatgccttgtttggaacgggaatagtactacagattttacaaattttcgcaaggggaagcagtaaagggtgccgcagaaacgggatgacgggccctttggcagaaacgggagggggacccgtgactggcccccagcaccggcacaggcgtagtgaatgcacggcgtactacgagccaaaccatcgttgctcacacttggcgcgtatcctcggggcgggcacatgcgaggcgcagcgccagcgcgctgctgcaaagggacgcggcccggcggccgcgccatgtgtcgcgcgggcgaagcaggggaacgtgcaagtgtcctgtgccgtgcgtgacacggggtcccctcgccgcgtgccccacggtggtcacctacacttgccacgtgccccacggtggagtaactaacctaactgaactggaatgaatgctgtgggctggtggtgaacacgtcgcacatgcacgcaggactactactacttttgcaccccaagttctagagcaatggtttggtgtgttc

SEQ ID NO: 81005 - DNA, 16449 bp, Oryza sativa
aattttgggacgaaattcaaatgttaatggtagctatatttggggatggagagagtactgttctctgcgcctactttcctaccaaaggcatctccatctgctagctctttcctaggattatgtaacgatctgtttatcatctataataaaccatattgaacactttaccagcaaaagttgtccagactcttcctttatatgctacagaatttttttttttgtcattgccatcaccacactgttagaaagctgtaagagagaaaagcctttacgttttggggaaaatcccctctcattcttcttcacctagactcctacaggatccccccccccccttttgccccctgttgctgcatgctatacatccatggatgatgcaccttttcctcagaatttcgtggtgagcattacgttcgtgcattacttccatagcaagatttgcacggttgatgatatcagcccaagtataaataacgcgaccttggctatcaactacagatggttgaaattgaacccatttagattgaaagccatagtcctaatacctaaagcagtgaaccaaatctctacctagttgacattgataacaacgatctaatgaattatgagtttaatagatcctctttagcataaagatgtatatttcttactcatcacttattcccaaacctcgtatggggcaaatcgttttcatttaccatctcagggaaatcctgcctcccaaccactagcatcctactaatggtgtgttgaaacaagatgcagccttttcttctattcctcatgaaatctattgaacaattactaagcaatttggcatcaacagaattgagaagggagggggatgaagaaaacaggaggcaaatcaggaattcagcacttgtagattccataggatttcttataatttggatctgctgttttggtatcattcagggaagtaaactctccagtgagtggaattagaagaagccaaacagcacagttgaatagtataccttctgcataggcaacccaaagtaaaaataatacccggaaggttaaatggtataccttctgcatgtccacacctctagaacacacagcaatactgtaaagagacccaccaacactagttgatggaacctcaattacttgacggctagccatgctgcaacatcaaacatcaaaaaatacataaataaaaaacagagcaagcattcgcaaatgcagaaaagggaataaacttgattgtgtaccactagaagggtatgtgcttaaaattattccagtaccttcagccttttctctaaaacaggaagggagaattctacccacatctacggaaataaaatcctactatctctaatgttccaaaacttctcaaaatgacttcttacactttattagtacactaacccaaaatattcgttcattaattaaaaaaaatcaataccaacaaatgatcacatccagaaacaatgctgcatagtactatgtcaatcatagtccctaccactcatgtgcatagacatgaagttgcacatagtttagactgagaacaacagaggatttcatcattgcttcattcaacatgaagataatgatgaaaagattgcagtacatacctacaacacctttggtaatcctgggacacttcagactccaagatgtacagatacatcccagataatacaacataacttgtatgccattcagctagcgaataaccaagacccttgcatccaaaataaaatatacaaaactctgttactgtactgcataaatgcatcatatgagaagagcactcaagaaaagaaagacaaggcaataccttccaaaccaagttctagcatcaccagctagatcagcaggataccaaggtgccaggttacaattttcacagctatcagaatcttcactatcacttcccttcaacttgcaaagtacaccaagtagttcaacaatcttgccgtatctttttggtgagaagtgaatatccagattcggcacttgaaaagaaacacgagttgatggataactcgggtgtggaactttgatcttcaagcaatcacagaataggacagtcaatacagtataacacccgtacagaataatttgcattacaatcactaaaaagttaacagcgatgcatccctaagtgtctacgtagaagtataaaacagtaacagtatgaagtgcaaggacaatttatttcatggagtttgttcccactatttcctcccttagggaaaaaaggaacaaaacattaaaaacatataaattgtttctatgacaacagcatgatgcactgctccaacaaatagttctcaattctagctttctattctttgttgaagctattagattctttgctgaaacatataaaatgttccgataacaagagcaacttaaagtatgtgtgcaagccattagatttactcagcctacaaaaatatacaattgatcccctcaactacaataaatgctagctctctcttctttgctaaagccatatatgccctccgtccgataaaaaaccaacttagtaccggatgtatatcttagtactacgaatctggagataagtccagattcatagtactaggatgtgtcacatccagtactaggttggttttttatggaatggagggagtatctcttattttcagccaatgatgactgtagtaaggtacagattgtttgataagtgttgtaattccatatgtcttagcccaaagcctaaccagataccccaagtctacattgacatgcagtttagtatgtggtgtccagatgttgaagttcaatgtatgcctccatctagtggttttagatagctatagattgtgaatagaattatagaaccaatctgaggcccgctagtccactgcaaccaccagagcaactatagcttatggtatacaatagagcatcctacaagcaaatgttacagcatatggtatgtaacagagcatcctacaagcaaaggttccaaaagaaaaaaaaaaaggatcaatgcccatgcaagggggaaatgatatgacaactcccattcttcagtaagccaaggaataactgagtatttcaaaccacaaataatcagtacttaaagacttgacaatattaaaatacttccatttatgttacctgatcaattatcactgacattccacaacgatctagaagagaacaaaactgattagcatcaacagtaggacctgacagcacacgctgattttctggtacagaatatatgtcttcagctgtatcacaaacaacaaaagcagccatatccctcccagcaatataaaaccgtgaatataaactgcgtctttcctcttcacgtgtgccgtcctataattcaatggcatggggttaggaaaagaaacagcacttgcatcaagaattcatgaggtaacttacccttgtatgcaacgtaaaatggcctaaatccagaacaaaatgttcattccccagcaaaggttgacaagtgattaaaggaatcctaacttttggtgcatccaaatcaatatcaagtccaaaactagaaacagaacaataaacagtcagccaacataaagacatcataacactgttacaagcaagttatggatattggaaatttcttaaccataacaaaataagattgcaagaaaaaataacaacttggaaaacataagaaagcaggatgaaagtaacattttgtcaaacaattaggacacgaacaagaatgcttaattattcatggcagttcatgaataagtaaagaaaactgatgtaaaaagtcttcctttcatatatgtatctcacatttaaacagatcatgcacactaaacaagagtatagaactcaaggccattaagattgagcgtagataatgagaatacatgtacctgctctgctcttccaataccatctgaagctgctcctgagctctacgtgtgacctgctctatcttcatctgcagttcaaaagatatgatcaatcattatgactatagcgtcctatatatccaaatagtaacgacgaaatatcaaacaaactgttccacaacatggtcatgagtatccaaattcgaaagtaaacttgcctgtagagcagttgctgtttccatggttactgttgggctaacagctttgctccgtttaatgaactctagaaaccgttcatagcttcccttcaaaacctaccgaaaaaacacattattatgccatgtacataaaaaaaatgcaatagcctgataaagcatgtgcattaaggaatagcgatgaaagtaattcacctccagagctttctcaaaatcctactaaaatgtgacatgaggaagtgaatttagtcctaaaagcataatgaacacaagatacaaaccgtaacatggcatggtgatatctttgccacgagctgccaatccaggtccaagccgacaggcgcacgcacaaaactgacatctagagcattactctttccctcactgacaacactctgcaaaaatagatattattccaaaacataaatgtagggatagaaggcattcatgaaatgaaaaaaaatgttgagcaatgtaacactggaaataacacttcttatttgcaacatcatagctcatgcaactgcaatggccatcagacacccaaaaataaaagcaaggagtaatacttagtaattaagtggatagccatcatctataaggtcaggtgcaacctaatttaaatgtttgatggctagccacctagaaccttgtatataataatgtaccaattgcggtttgctaattaaacaatatggttgacgaaaacttgcattcaacagataaacaatatatttcgtgctacagatgaagtggcatttttctgagtcacatcctagagtccataggaggtttgcagcaagaaattcaaacaatcgcttcatattcactgacctgagcaagagaaccttcaggagaagacaaaccacaatatctcaaagtaacatcacaccgcgtactcttgggatacaatttcgtgaccacttgaagtttctcaaatctaccacacaaaatttctgtccggtcaatattgatgatccttgcagcagcttggccaatagacacatccaccaagaatcgggttgtattcggggagactttttcaaggggggaagacagatcatcttctggttggtaactcaacagcttattaatggcctgccattcttcttttgttaatctctcctcctcatctaactgcggttctagaagggcattctcttcagaaggtaattcagccgagttccttaaacaagaaaacaagcataattatgatgtgacaaaaaatgattcatatgcactcatgaaactatccattgttcacaaaataaatactagtaataaattactcccaacaagttaacaatggccacattgatcatctatacaatttgctcgttataatgtcactaaaccgaaagatatatgtgaaatcacactcaatgaaagaaatgatttggttgaagttatatatgaaatgaaaagctgctttctgagcaacttataactgtcctaaaaacaaaattgtctttggcaacatgtcaataaagtactttcctttcatgtatgtacccatcgattgcctaaattcaggggagcaataagcaggcactttaattaaattagtatttttaagttttgtgtaaatatcgctactattataaaaattgataacgcttttgcatgttttttcgtctgtcacctctgtgatcgagtcggtctcataccccgcacgctcgcataaagatgggcactctctacacatcctcccgtacgtaagacggagcctctcgctcctccctcaaccggcatggccaggtgaccttcagcccatcatcaccaactgagcttgcacctctagctaggccactgccctggccagtcgtgccccactggcctgatgggcctgctgcccaaaaccatgcagctttgaccacttatgtgtgtgaagcgacaaaaggtttccacggaaacagtaacccgaccggtacccctaggtgaaacgctatcctcttataatttcagttggatctcttctcttctcttttcattttcgatagttttctctttgtgatttttggcacctgtacttatcgacttgcgtacccatcacattaatccttccatccagtgcttgtgtgccatgccttggcttctcattcagcataatccttacccaaaccattaatcaagattgacttcaaacctctaatatcagtagacgaaataaccatctaactaatagattttccgtgacccaaccatgtacacactaataaattaaccaacacaagccatcacacactactacaaaaaagaattgtgtttcataactaaacatgtacaaacaacgctaatttcccttcacaattcatcaaccatacacactaattttccttttacatgtagcatttgttaccctaagtatatgagaaattattgatgattagaattttaaaaagttgaccaaatcatatcataaaacatcaaatatttacgactggattgagtaattttgttcagttattttaaaattgtctttgcccattgcaacacatggatattttgctagtaccttataaaattagtataccgttggggcctcccctactgtttcaaggttaagaaaaaaggtatttttagtagcaaggctgcttcacaccattgttattctgcaacctgcagtaaactaatggcccaaaaaaaagcagtaacagcaaaaattaggcacgagaaacgcccaggggtcttccggctagctcgacaaggtggtgggctagacgacctaggttcgaagcctcaccccttctaattatttgatattaggtccttccctaatattcgcgtcttttttgcaaacattaggcacactatgcagtatcactaaccaacaagtagcaggtgttgcaatgggccctagattccagcaggccaataagccaaagatatacgattggcttgtaggtaaaaatgcacagataaccatataataggagataaatgtactgctatacacacacctaaaagcaggtataaggattgcctacatatagttgcttattactgtattgttgcaaaggaactttggaacctgcaacttgaaactaacagggaaaaagaactaatggttgctagaatgagtaaaaacttcatttgatcacgtattgttacttttatcctcctccaaatttaactaagtgatgctcccatgtgcaatgcttaatgaaaaagttggcaagcattggcatacaagtttcattagtcctaccatctacaaactaaaccatttaagttgcacagaagttaccaacaagattgggaacctaagttaaaaagaatatctttctgcctatttctatgagtacacctcaaaggagcaatagtacagaaaaatgagaatagctgccacaatgaacataatatagaatggtaccataaaaaaattagtatcttaaaaatagacagaagcaatgaacaataaaggtacagatattattatcaacttattggacaaaccatccaaaagtccaccatcttctctttgatgcccccttcttatgtaatatttcctttgatttcacggtctcaactttagcatgtcccaacaacctgaaagtatttaattatagcaataccataaccagatgaatggtgacccaaatgaaagcaaaaggttacaaaagatacatgtacatgttctgtaccgcacctccaaagtattatgacttttgtgtccagaattttctctatctgccgaatttcggacatatcaacattagatgcttgttgcaataatgtggcatacaagtgaacatagcgtcgacgaagctggcagagatgcctagttctctcccatgagaaccaatagctgaaaaaagaataaacaaatttcataaggaagaaatcctaatttgtaaagaaagatgacagcatatataattttttgcatcaaaatatctacacaattcaagtaattgcctccaagatgcaagaaaaatgcaacacacagtccatgatgatataatcacacatgattttgtcaaaaattgatcaatgtagcgccatgaaaagaaaaaaataacagttgacagactgattgtagcaaatgttctcaggtgatgctaagagcctaaagtgtagcttgcaacataatcccaatccatccttacaagggccaattcgcctggttgacggaaccaattctgttagacagaacatagtaattgggttcgactggcatttagaaagaaaaaagtcaaaaaaccacacctccactttttataccactaaaaacccaaggccaccaagggtaataacatggaatgcaaacctcctacgcagctacgctccccccgagttccttgtaccacttgtgctgtacgttgttgtaactccatgctgtcctttaaatgcactaccccacagacatgggttgcttcacatgctgtatcaactaccatcaatgcaaattccatgtgccaatgagctgaccatggcaatgggtttgtcagggaactgatgatctgtggattagcacagattcttcacggaatgtaaatgttttacatccattagaatgacatgatgcacaaatgttccttcacccacctacgcatacctggggcccaccaacagcaagcttcacctgctgccagcctgccaccaagtacgagtggcactggcaattagcatactgctataaagatagccacctagctctcccaggcaacaatacttaggcgctaggcatcagtcatctttgaagccaatgtccagttactatcactaagtagccatcaagcttaaataggcattaagcaccatccagctgaagtagggggggaggggcaaaaatcagccacaaccaagcttacttggaacctgatcaatgggattgaggggcaaaggccatggatgattgaaaaggagggtcaaagtgggtagtgcagtagtgttcttcaggatgctatactagttcaagcagggacataactccagtaaatctggggaagatgttaagttcacggtcaataattacttaattagatgagttctaagctcctgagcagagataggctagttattcagttagatgaattatgtttgttcctcgagtaattaggtagaaggtgtttggctagttcagctaggttagctgattagttagttcagacagtgttagcctaagagtccaagtcagcatgttgcctaatcattcaacttttgggccaagttattgtggatgatgtgtttggacaattatggagaattaatcctgcgtcaagaatgccagcaagaaccagaacatcattatctccctcctcattcctgcacatggcttatggcaagtcgagcacattctattgccgctcgttttttgttctaatctttccagagtttaacaggaagctgaatttcgaataagatcaataccataattttttctgtcgcagaccagccagcacagcataacgccaccaagcacggcaatccactttaactggcacaataggccgtaaatgggacacgtcaacacgtgtcctgaaccttgaaaatgtttccaacagtttaatgccatcataatactgggcctggtgcaatagtgtaaagagagtaagcacttggtcaatttcacaatttaactgatggagaaggcacaattccaaggtacctcagtaacagttagtgaaacatcactaagaacaagtgatgctttctctaaagggatatctggaccccctctctcctgctttccaagtcgtttgtagttaagagttccatttatagggtaaactaaatagttcctattcattgcccaaacagaattgccagaatgatcatcaatgccatcttgaaatatctgtgggagatcattctaggataagaagcagcgaacaggtactgaagaatgaagttgttatgaaagacaaatatataacctcgccccattcagtaggatttagatcttcccatttcttagcaagcttccacgcgctgctgtcagaatcatggtagatggctagcctatgcagttcgaccgactaaataagggccaaaaaagaacataaatgcattggttataaataaagataataataataataaagcaaaagcagatgatcagatggggaataaactaaaagaatatcggagtttatgaaccaattgattattaatattgtgtttgtgaacttgtgatataatctgtccaaacaagctcaaaaaatggcaaaaggccaacaatagcttcacaagtatcacataagcaagcattcagaagaaaagaaaaaggtccaagagcacaataacaatgataaacaaaacataaacctggtgaaaggccaaccaaatttagttccaatgtacaccatatcgctgtagaaccatggtatataaggaggtattacagaattttactcaagtcttgatgaacattatctaacccttattttaatttgatcaatcagcgcttgaattttgacaccaccatgttcatgttagattccctatatattccctcaatcttaataacatttgggacctccttcggtcatcccggcaaaaaagatgccctatataaaaccatgcagaagggcagaaaatggtcgaatgtctcaggatcagtaacaagctaggcataacagagctggagtttaagttgaagttggaaccaagaaaaagagaatggcaatatgttggaacttataatgatatatggctcttaatagttctactagtagcatttacgcatgatgatccactgatccacctcagttttgttactaatttatcacatgatgatggactacagcagcgcaaccttaatactgggatcatattaaaaccctcggtggctcaaagggagcagattatgcattgagatgttacatttcttcgctatttttttgacaaggctttcttccctgatttctcatagttgtagctacgatttgccaattccaccattattttttccactcaagttctttcacttagatctagaaaatcaattcaatacattcacttgcagctttgatcattagaattaattgcaatatattctagtaaatacaatattatagggttagttttaactaaatatttgtgtgcagttctgtactggtggttgaaagtcaaaaggtgcacgggttctaaaccatactccctccatactcataaaggaagtcgtttaggacagcgacacggtctccaaaacacaactttgacttcttgtttctataaaaatatttattgaaaagtgatatatatatacttttatgaaagtatttttcaagacaaatctattcatataatttttacattttcaaactcaacaacttgagagttatttatgatttatattcccaaggtttgacttaaacattgtcctaaacgacttcctttatgagtacggagggagtaccaatttagggacagaggagcatttatctcaaagtctaaataacaattgtatgctgatcatatgctatggccaggtaaccaagaggcaatctacatacctttgcataggagatgagatgcctatcgaggcaggttaaaaaataacagaacatacagttaaatgttacataaatttgttctcaccttccgcagcttatctaatgctacaccagcatcaaatgtctcgttaccgtcttcgtcgactgtaacggctgcaagtcttgacaacgtgaagccagatgcaaatggatgcccagaattgctggtagaaaaacaaagaataaatttacggaagacattgggataaaagaaagactaaaaaagtgtgcaaatgacttagcatacctgacagaatcttcatatctgatatgcacgttgctgatggtgactttaaggtttccaataattgttgatattaaattgtatagccatgaattactccctggtacctgcagcatccaacaagcactatcaaaaaacaagcaacaaaaatgtgtgtaatccatattaaacaatcgaacagacaaataagagaaatgacagaaaccataataggtattaaaaacagtaatggacatccagaaacaccaaaacccaacttgaactttcacagctaaccttttagaactattgacctacaaagtttaagacaaagtgcatgttcagatgctataatactttaaacctgtactatatgataaaacttagtgtcatggagtcaaaggataatccaaaaaaaaaaagttgtttttttcccatcatcacagttagagctacagacagaacaataacttcaaatggacaaatatccccaggaccacaattttgttttccactaaaacagcatgctttcatggaatcgactataatcaagtcatcaattagtcattaatgtgtagtcacccgctggcagacaaatagcaccataaccacaacttcaagtaagtcaggacaatggactaaaagtaacaggctagcttcagctggacaggagaatcgctgccttggcatgcaagagcagccagatagagtgacaacaaaggagcaagatcaaattcgaattgtcttcacaaaattatcctcccgggtaacactatttatttgttttaagttatgacaaaaagaaattgagataaacaataaattcttccatcaaatcattaggaaggcaagcaatgaacaggaaatattcttacatcaaaggtataggtacttcaatatttatcaaatttaaaaatacaacctaaataaaaaacacgtctgagctagaatatttagccattaatgaatgaatgaatgaatgaatgaatgaatagggaaattggaaagaattggcacacggtcaattaacaggagagctccagcaatattgtttatgaaaaaagaaattaatatcaaaggccatcaacctgaccatacactcgaatgtaatattacaacttcaagaagaaacatgatatccatctatgggcacctaaaattgctctaatattgtgcctcaagaagtttgtttttatatgattatgattgcacttgttgacatcatcttttactcttataaaatgaggtgaggtgatggtgtattcaacatgtcactgatatatgtagcatgactttcatgtttgcatgctcttttgtaatatttgtattctttgcaagtgcatatatattcactgattgattcagcatatgttttgcattttgatcttcagactatagggcacttttttttggcatccattacaatggggaagtatgatgtaatttccaaatgtcataactgttcacaactatcagagtattgcttgccagaatatcgaaatagaatactagaattaagctttgtgagagaaacaggagaaaaaaatcatacaggtcctcctttcgagctcctacttgttgcttcaagagttgctgcctctgcagcctgcggataagaccattagagcttgagctttgcataaagatgatcgtgagcattatctttgaggggaagcagagaaataaaataggtgaagcagaagataaaagcaagaaaacaataaaagtaaaaatctggttcataaagctataattccatataatgattgctaaagcatataatgcaaatatgtggaacagtttcaactctcgtatgattgcattacagatcactatgaaacatttgactcttggaggtcagctctcacctcagtcccatctgacctaaattaacctaaatgatacacactcgtcacttgaatgtaccacacattgcatgactacttttacaaacactattgtattgtaccagctcctggaagccaataaaattgcaatttctcacttgcaaattgtgcataaaaagttcagtgctccatgtttaattttttttcctcgaacatgcaggagagctgtgtatcattgtatcaaaagaagaaaccaggatataaagccttataaaacccgccacacacaccacactgagactgttgaagttgcatccgtacccgagactaacaagcaccagacaaccttggccaacatttctgctttgcaaatgccgtataatatatgttaattaaagaataaattgagccataggtacaacagatcgtgctgtgggtgcacataggccatataatttgatgtttgctccccttagtcacctttcttgttttaagcggagcattcagcacaaaatattaccctgtgacaatgaaacgcacaagtagcattgactcacccatctctttatgtgtcccgctctcagattcaccctcctttctctttgttttctctctatcccgatattgaaaataaatgtgatattatgtttttacctttctgttctgcaaatacatatgcacagttgatgcttatgaccttaagttaccatgaccatgaatgattacaaggcagcacaatgcatgtttcggccatgtgttaggtttttattaccctagtgtgcaccacctaagcaagctcagtgattcaaatgagcaattctcaagcgttgcagcctgcatgcactcaccacccacaagtagtattataactgcattttactcgatacaagtgctatgtttcatatacagtgaatagtcaacacatagtcttgtacgcacttcttgtttccttctgttcaaataaattcggagatagctatattttgtaaagaaaaggtttataaatgtacttgaaaggagtttggaggaagctgcataacctggtttgtggtcaagcggaaccaagtttaaaataggtgatctgaccacccaactaacatctaacatgatctcacaagtcacaacaaaagaatgaacagaaaacaaatattatacattaagcacctaacaaataaacaatatcatggtgaaaatattgctctgctacatcaattaggcatgttgatttcatcaggtggtcaaatacataaaaaaaggaggtacactaccaagtacaagtgcctacaaaacatacattatgatgaatacccattccttacaagaacacattcaatttaaggttatttaacttatttcaaattaaccaaattgtctcgaatggaaaaataacaaaaaatcagagttttagttccatcataccaacctattgaagtagagcctaaagtaattaaaaaatgccccacatataattgtatttcattattatggtgatcaaatattcctacagtggtactgtcaaaaataaatacttccaaaactatacttctgaacctactagtctacaagagaccttatgaaatggagcaattaaaaccaacaaacattttcctcggatatggagaactttcagaggtattgacttcttgttaacaacatatagtctcaaatttaactaataatagatagttctattgactgttcaaacaagggggtaaaaaactcatgagagaagttgcaaacaaacctcaatctgctgaagttttgcttcaaaaagtttctctctatcttcttcctaacacaaaaatgtgaaaaatattaagaataagggacaaagaatgacatgcatagaatagaaatggcatcaccaataacacaataccaaattatagttacataccttcagagtctgtccatcaggggcaggatgagcaagaacaaacagacgatcaataagaacaataactggctctttacccaagcttttccatggaacctattaaaaatcaatattttttgtgtgtgaacaattaacaggtacaagataaacaaatacagtagcaaacttgatattataagctgcaggcagcaaaatcatgttcagcaattcaaccacaggatgttatcatttgctatcctgccaaaccaaaaacatacaacacaactatttgtttccgttttaaaatgcttcccaatgtacccattagatgaaaagaatgtaactgtacattcatcaataaagctagttgctgatggttccttttatgaatccttaaataaagttttactaaggtttgaggcccatttcaactgtataacacaagaagtgattgactatgtaaggttgctgctgtgaatgatttggtttgctggccaatctgaaacttgaatgttcatggaatcctctatctgtgcttcctccctaggaagcctcaaaatttactgccgtgtcctttgttctcactgtttggtactttctatcaatgaggttctttgctgtggagctgttgccagagagaaaaatgagcgctgcttcattagaaccaagaagctaggggttaagttgtctgtgcgcatattcacatatacctcattttgatgcttcctgatgtttagttaaagcaacataggaaattatttgcggctatgtttagttaaattgcatgattctagtattctgctagtttttccatgtcagaaaacttagggcaacataagtcaggctcagaaaacagaaaataacaagtacctttaaagttatggtgccaacaaacccagctttcactgttactggaagccgaagagaattcagtg

SEQ ID NO: 81006 - DNA, 3434 bp, Oryza sativa
tacgtatatgtttatgccggcctctttcatgtataggtaaacttagttatgtccctaatgtcaatggcaatagtcatagaaaccatttactgcacttcctttgtttctacctacatatacaaagtcatcgtgactttgcttatcttcacacatattgcttacatatagtcatctatttgttttttgtaagttatatggatgttccatccacgtggcacggttgattcctaggtgcataaagcctagcaagtaggtttaggaggcaatggtaacttagaaatctctttgtgaagggaatgaagtactgcgatactttatggtttagcgtgacacgactccgatgagaacgctagggcaagcaacgatggtaaaatatgtaggagaaaggtgcaaatgtgcaattggcactgatgtgttgtaaagagatcatggcaattctaacatggctatgaattttttttttgacctacgaatgggccgggcaattctaatgtgtaattttttttttgaacttgtgaatagggattgcaatttcagaaatttcaaaccctcccggcaagtgattatctcagctgaattttttgttttttctcaattttttgaccaaatatttagtcaaattcagttaaattatgttaacatttaaagaaaaggtccaaaaagtcccaaaaataccgaaatttcagccaaaatcgaaattaaaaaccctgctcgtgactagtataaataggtgaccaccaaactgtgtaaaaaaaccgcatgatgcataactgaacagtgtttgtgaatgccactagctaccactatgatattagatggtgacagccaaggaaataaactgcaaccgcgcacaacacttcatgaaataagttattattattgtttaaagaaactgcaatttgggcatcactttcaattcgatactcgatgtatatgatagtttggataatgatccgtattgtccagtccattaaggccctgtttagatccaaagttttgttttcaaactttcaactttccatcacatcaaacctttcatacacacgtaacttttctatcacatcatataatttcaaccaaatttttaaatttcagtgtgaactaaacacagcataagtactagtgtagtgctacttcatggcctgaacccgcaggttttatgacttttaggtaggattggatgtgaaaaagcattgaaccggtagtgttgccctatcactgttaaagtgttaattcacactgaaccagcagtggtagcccgttccgtggtagtatcacaagtctattatataggttacatgaaatatctatttgtggcatgcatttttttttatttttgctcgatgtatgtctcccttgtaatcgaataaatgggttgtgacaccatatgtatccagctttgaggactatatatataatataagtcgcttgtttgccagtaccatttctggtccagaggactcctccgaatgaaacatatattctcctgttgctcactcaaatgtgaatttacacctcgtcatgtatatgaccttttgggtgtgcatcatgcagtaggtttaggaggcatccggatgtacatcagtaacttaaatggctgaaaaatgcagtagtgaagaacaaatcgcgacggcagcagcgatttgggtgatggcggctagggcttgtagcagctgctgggctatcgatctcttccccttttcttttttttttgttttttttcagttggtttaatagatatcctgatgaagatcgaatggcccatattaattcgatcaccgattactataaacttattgtctattttgcactactcggcgagctctacgcatccgcggttcctgatcgcctattcaaacaacggtttaaaaatttaacttttgtgcgtttgttctaatattccacgaaatatttcctgatcgcctattcaaacaacggtttaaaaattgaacttttgtgcgtttattctaatattccacgaaacatattaattggaaactcggggcattacattcttccccctttaattaaattcgccctcgaattcgtccaaccattctctagaacacagggtattacacgatgatctacaggctttccccaagctaggcgtaatctgaagaagtttgcagccttgtcccagtgtgctaacccattcaaacctctaactcttaggctccataattccataaacttcaatacatatatacactgcactaaaaccttgaaatcagattctccctgcgtcccaaattacaaggcctatattttttctatacggccttcaataacatactagatcattaatatatttcatattatgtttcggacaaatataaaatgagcatcacattaaagtactctaaaatataaatcttgcggtataacatgcataatactttgtgtctgtgtgtaaattgaagatgtttttgccgagattttggtacattatccgtgtttgaatcagattttaagttcgtttacttttagaaatacaaaagaagtcgtataagaaacctctttaaaaaaactcacttactaatttcagatgaaagtcacactcctaattatagctcatgattttctcaaaaaaaaatatatccaagcgaattctcacagtcaagttcaccctaactaaatgtcacgccccgaactagtcccgactggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaagggaaacggaagccaggactcgggccaaacaacacaggcgcgacttgggaactaggccgaaaccctaaaactcattgtagccggcttgctcctggaagaactcctcatcagcaggatccgcttcatcttcttcagcatctgggggggattatttatatagagcaagggtgagtacgagagtactcagcaagccaggggaaataagtgtttaatgcaggcttcaaggagaggcgggtgtttttgcaattgattttatttgaactcttttctgaaacaactaagtgagtgcttcttaaacgacacggatgagacagtgcgtctcgtccggtcggagtatgtgcaatgtattagtctttagattttgaaacaaggttggcacccggccaacagcttttcaaacggccacccgggccaacaacttccaaacggccacccgggcgtagctgatcccatcagctgcagattttccaaacatcgaacccctttccacaacagcaatttcacaagcagtagtcaaataaaactacgctaggaatcacctcacatccgcccatgaccgtgggcacggcttatcgaacagtctgggctgcagga

SEQ ID NO: 81007 - DNA, 2363 bp, Oryza sativa
agcttggcgagcacgccctcttccgcgtagaactccgacacattcttcgacctgtagatcttcttgatggccactcgctgccccgacgggagccgcccccaggtacccttgccggcgccgccgctgcccagcagaagcttctcgtcgtagccattggtggcctgcttcagtctccgacttggtgaagatgtacaggccctcgcgcggcagcggcggcagcgacgccaccgactcgtcgtcgctgacgtcacctgccgtcgtcgtcgacctacgccggcgacggattgttacgattgccagcgcggcggaggcgaccgccacgacggccaccacaaccgcggacgccgagccgacggcgatggcgacggtgttccttctcgaggaggagcttgggagtgggcgcgatgcggtggtcggcgacgccggcggcggcggcggcgaggggacgaggtcgctggtgccgaggctgttgacgttctcgagcacctggagcatgcagagcgcgtaggcgcggaaccgctcgagcggcggcggcgcgcgggaccagacggcgacggtggcggccatcccgcacggcacgaactccttggtgcgcgcgctggccagcatctcgtaggtggtcgcgatcaccgcgccgcggcacgcggcgcagccggggtcaacgggcccgacccccggcgcgcgcgccgcgcccggcgcggcgcagagccgcgtagcgttcggcagcgcgcgcggcgccatcgcgcgcgcggcgtcgatggtggcgagctggcacggccgcgagcccgccgcgagcttccccgggtcaccggtgaggtcgcacgacccgttgtttgcgaggagcgacggcgacacgaggccggaggagagcagcctggcggcgaaggcgccggagcacgcggcggcgggctcggcggggaggaacgcggcgccggtgcggttggcgtggtcggcggcggcgaagatgtaggcggcgaacacgtaccagcagcagccggtggcggcctggccggcggtggcgttggcgtagcactcgcgcgggatcatccgcgtcgccgtggcgaggtcgtaggggcacgccgtggggcctctcgccggcgccggcgacgccgccgccacggcgagcgggaggaggaagacggcgaggcgaagcatctggcggggtggtggtgaccggagtgagagggggagagtggcatcgataaatgcgagcgggtgggagttttttttttaaaggtggggcccacaaagtgatttgacgatttgacccttggagtgtattgcagctacagtgcaaattttgattatgttgataatctctttttttaaaaaaaattaatgatagagaattatagagcctgggactgggagatgatggatctcacaaagcatccatgtttagaaaaaaaacatcaaatatttttgaagttttgtccacctaaacatggtatgtaccaactagggagtgaactattgacgtcaggtactattgtgaagtgttatatgtttggaaatctcgaataaagtaagtagaacatatgtagcttgaccagaaaagttgtgaagggtaaaatatctttatgccatggaaggaaccaaaattatagctcacctctaagatcaactacagagtacctccgttctaaggccctctttttttaggcttattggcctaaacttttaaattagcttattggcttatatgatttataagccggtggatttaatatcctaagtttagtggttgagtcatacatctacctcacataagccaaaaaagcttctccaacctagcttttggcttaggccctctttgtttaggcttaggcttattggcctagacttttaagtcagcttattggcttatatgatttataagccagtggatttaatgtcctaagtttagtggtggagtcatacatatatctcatataagccaaaaaagcttctccaacctagcttttggcttaatagtgttagagtggcttatggcttcaaaaaaagccaaatgaaaaagctgcttgtttgttttgacttagacttttcgacttataagtaggcttataagcctaaacaaagagggccttaatagtgttagagtggcttatggcttcaaaaaagccaaacggaaaagctgtttgtttgtttaggcttatacttttcgacttaaagttggcttataagcctaaacaaagagggcctaaaataagtgcagtcatggatatccatgtccaatatttgaccgtccgtcttatttaaaaaatttatataaaattaaaaaaaatagtcacacataaagtactattcatgttttatcatccaataacaataaaaatactaatcataaaaaattcaaataagat

SEQ ID NO: 81008 - DNA, 79138 bp, Oryza sativa
aacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgccccatatgagtgtcctatatatatatatatatatatatatatatatatatatatatatatatatatatatatatatatatatatatatatatatatatatatatatatatatatatatatatatatatgtatatgtgtgtatatatatatatatatatatatatatatatatttcaatgcataaaaaatatatacacatatacacaaagtttatatacgcataaaatataaaaataaataaaaaaatacatcatgaatagaaagtttgtatacgcgtatatacaagtttatatacacatatagaaagtttgtatacgcgtatagaaaagtttgtatacgcgtatagaaagtttatatacgcgtatacaaacattctatatgtacgaatacaaacttggtatacatacgaatacaaacttgatatttatacatctcgaaaaaaaaaggaaaaaaagccgaacagaagagaaaccggaaaaataacaaaccgaacggaaaaaaaaccagaggaaaaaaccaaacagaaacgaaaaaaccggtgaaaaaaaccaaccgaacataaacgaaaaaaagggaaaaaaacaaaaaaaacgaaaaactcgctcctcatccctgttagagtttgtgtcgaatatgtgtacatagtcggttacagtttaggactaggagttgtaataggtattaggactagagtatgagtcggactctatccaaggttctctcataaatagagaggcatgcctgttgtaaccgcatggcgacttagcatagcgagagggagcgactgaactccgttaacaaatatcgtgtctcggtgtcgtcatcgttttggatctcctatgacgttttcttccgcgtttagctaacgatgttgatttcggggctggttttataacaagtggtatcagagcctacatgaggtccatggtagaggcgcgatggaggtgctccacaccgcgtagcctgctgtaatgcccacggaggggcattggcgcaaggtgaagcatggcggagatcaacggagtcttgatcggtggatcgaacacttctggcagcggccggaaccgtcgatggctgctttcaacagggagatgactagacgtggtgctcgggttgatggcggcggaagcgattggcgatccaatcggtgggtcagacacttcgggcgggtggctcggactttccggtgagctactctcgacagggagacgtgcggccgcacgctcgggttgattgaagctggaggcgatcggcgttctcgatcggtggattcgaacgctctgggcggggtggcccgggcctttcgatgagctacgttcgacagggagacggctagacgtagcgctcgggtcgttcggcggctgggaagacggcatgcgacttgtcggcttcagctcgcgactagattgatggcgtttcaatcggaagtcggagcgggtggatcctataggctgttttggaggtgttgacgaggtatttgcacgatggaattgcttcaaaggcggcgtattttgtggcatatggctgaacaaagcctagggcgaatagagcagcatctagtagcggttcaaccctggagaggttttggttcaacctgtttttccctctagcagacaagaagtaaaccacgtgggctgtagatcaatgacaacagttgttggtggagtcgtcggtggtgcttggcattggtgctagatgttgtcagagatacgaagaagcccaggaggtcagggtcgcggcggtgtgcgcgtcctgcgtcgaagccgagccggcgacggagatcagggcgatgccgagaaggagctggctagggttttagctaggtcgtgcagggttcggtcttgagggtttgtggtgtggaagacacggacatggagtcgtctccggttcggtcacggcgcggacacaattgaagacaaacagtggataccaagtttcaacacgaaggggaatcggacgaggactacgattagttcatgaatcggactcgattttttcccaaataaaagcagcagaggaccacgggattgcaacaacgcaatcgaaacaaatcacctagcagagggcgagattcgtacccgattttcgcaaaggcggaggtggtttgggcggcgaggtcacgggtggctggaggcgcatccttgcaggcggtgtgtggcggcgtggtactcggcggcgtccgtcggagctcgagcgagagcttgcggcggcggctgcggcggttcccgacgaagaaccggcgtaggtcttcggtggcggtgctcccaaggcggcgcggcagcctcttgcggggccggcggctccccaaggtccggcggcgcggcggctcctcgtgggtcggcacaggcactagacggcggcgggaggcgatggtggtgtgcggcggcgcaaggcagcggtgtgcggcagcttcggcaacgaggcggcggcgcatcgggtagggcggcagcgtgcgcaggagggaggagcgaggaagccgaagagaaaaggggatcggctcgatctgagccggtctttgaccgctgttgtctggtggttgaccgagtaaaggagaccgagtccggttttttggagaaagagaaaaaaaactgattcggtccggctggtactgttcgagttagtcggtggggtcgattgaaccagggcagatcaatttaacagggcaacagctattgagttgattatcgtcgatggcggcaacggtggtttccaaatttgaggtggtgaagttcgatggcaccgggaatttcgttctctggcagatgaggctgaaggatctgttggctcaacagaggatatccaaggctcttgaggagacgatgctggaaaagatggatgctggcaagtgggaggagatgaagacgcaggcagctgcaacaatatgcttgagtctctcggattctgtcatgtaccaggtcatggatgaaaaaacgccgaaggaaatttgggacaagttggcaagcctgtatatgtccaagtcgctgacaagtaagttgtatctcaaacaacagttgtatggtttgcagatgcaagaggagtcagatcttaggaagcatgtggacgtcttcaatcaattggttgtggatctaagtaagttagatgtgaaactggatgatgaagacaaggccataattcttctgtgctcgcttccaccgtcttatgaacatgtggtgactaccctaacgcacggcaaggatactgtcaaaactgagataatttcgtcgttgcttgcacgagacttgagaagatcaaagaaaaacgaggcaatggaggcttctcaggctgagagtttgctggtcaaggcaaagcatgatcatgaagcgggggtgtcgaagagcaaggagaagggggcacggtgctataaatgtcatgagtttggacatataaggaggaattgtccgttactgaagaagaggaaaggtggcattgcaagtttagcagctcatggtgatgattcagatagcagcagtcatgagattctcacagtgtctaacgagaagtctggagaagcgtggatgttggactcagctagttcctatcacgtgacatcgaagcgggagtggttctcttcatacaaatctggtgattttggtgttgtttacttgggcgatgacacgagttatcgtttgttggagtgggcgatgtcaagttcaagatgtatgatggaaacgaggtgctactttcagatgtgagacacgtgccgggactaaggaagagtttgatttcgcttgggagcctacatgagacaggttggttgtatcaggtggattctaataggaagaccatgaatatcatgaaggacggcaagactgttatgactggtgagaggacaagctcatgtttgtacaagttacaaggaactgctgttgtaggtggagtcatggaagatgggcatgctggtgttgctgtgcacgatcctgaaggcggcgagtctagcgtaggctcgtcaggcggcttggcgtgagctgcggcagaaccaactcaagtcctggtacacggaggttcgagcaagtaacagattcggattggcgtggcatattcgccaaggtggagtttgttagagtttgtgtcaaatatgtgtacgtagtcggttacagtttaggacttggagttgtaataggtattaggactagagtatgagtcggactctatcctaggttctctcataaatagagaggcgtgcctgttgtaaccgcatggcgacttagcatagcgagagggagcggctgccggcgtcgaccggccgtgagtcgttgtaactctgatacgctgtatatgctggatcggggaggagcacccgtaatcagtgccccagagatgtaggctacggctgaactccgttaccaaatatcgtgtctcggtgtcgtcatcgttttggatctcctatgacgttttcttccgcgtttagctaccgatgttgatttcggggttggttttataacactccctccggcgcgtcgccgccccctccccgcgcgcgacacgtgtccagtcgcgcggggagggaggcgcgcgactgatcgcccaatagcaatctcggccccgcccggcacagcggccgtgcctaggccaaggtcagtcgggccagcatgggcctgacttacacgtcaggccatgccgggctgacccaaaggcatgatattctatcgtgcttctctacagaataagtctatttttcctatcttaactctttgggctttgtctatatggctggaaatacatctattttgtatttctcttctctttgggtcttaccttatatggttgattaagcctattttgcgtccctctactatttttcttccattgtactgggccgtgccgacccaacgtgccgaggtagcagcccagacacggcacggctgttgggtcggggcggcacaggcacaaccccagtcaggccgtgccgtgcttgggtcgggctaaattgctgccttgggctgggccgtcaagcctcgggccatatggccatctataggtgaagcaacaaatgtcagtgatggcaaagcttgacgccttgtaacttaaacgccgtgattaggggctctactaagtcaaagctaaagctaaagttaaaatataaatttttaattttaattttaaagttaattttaagatattttcaacgtagtttttttaatattagcttttaagtcgctaagagcatcactaaccgcaatcctatttccttactaaaactaattttgagggtttttagtgaaaaaattggatccaacagattcccaaaagcactgcaatagttttggagttcccatccccatatatttcgctctatggatttgagggcgagagagtgactcccaatctctcgttcgcgtgtttctcctctcctttatgcacgagcagtgaaaatttctaaatttctgtcggtgatcgcgatctctttctgcgcgcatggaaggaaaaaaagggaatttctgttggttgtttaacagaagggcccagtttttgggattgaatatcttttggaggcaggagtattttcacttcctattttcagttttggaaaaaattttgggatagattattgctaatctgttggtgatgctatacatatacaagatttttacatatagattaattttttataccttaataagccgtttagggaatgtgagcaaccgacaggggcggagccaggcaaaaatggcatcggggtcactatagttcttattctttactacttacgtacaacatgtactatctccgtttcatattacaagtcgtttttttcttaatcaaacttgtttaagtttgactatgtttatagaaaaatatagtaacatttctaatagagaataaacattttatttaaaatatgtggtatactctctccggcccattttaagcgcaatcataaatttatgtgtccattttttatcgttagtcttatttgaaattttttttatgattagtatttgtattgttattagatgatacaacatgaattgtactttatacgtgacttatatctttttatttttttcaaaaagaatgaaataagatggatgactaaatttagacacggaaactcatgagcttaaaatgagatgaagggagtatttaagtccagatggggataatttgttttagttttcacgagggcatgatagaggaaagaagttgaagatggggataatttgttttagttttcacgagggcatgatagaggaaagaagttgaagagtgtctgcttaaagaaaactagggtttttgttaggaggcttggctcaagggatctgagccttcgttcctttttctctgattcaacggtggtggaagggtcggcacacagggccacatggatggttggatcaagcctcgtatcagatagtacggtccacgtgaattcgaacgtgtttgctatttcaccagatgatgaggggttttctaaaaaatcgctgacgtggcgctctcccagcaatcccacggcttttaagtaaacctatattacgtgggcagccagctctgtactacttctagttagtaatataggcttgtaggccttttatgatacacgtcattacctgaaaacaggcttgaaaagctagccttctaatccccaaaacttaatggccgagctagtggaacgagatggcaaaaagaaacggggtcagatcaaaattttcaccggggtctttctagcattactaaggtggtaaggtggtgtttgggaaggaggaactaaactcacaaaaattttagtccctatagaaggggtttatgtttttgtaaaagggactaaagttcagtggtggagccaggatttcaaagttgggtatttctgtctaacaaaaaaaaagttcatagtagaaaaaaaatcaatggttcacactatgtcaatactgataatctaaaaaataaaactacaaattattacatggtacctctaattttctacctcaggcacaacctcaactgcagtaatctgaatctgaactggactctcatttgcatatgtaatcggctgaacaaaaggaacagcaacttcgctatcaattctaacgggctgtgctgttgatccagaaccagaacctgaccctaccttcctagactttgaatgtctatcccacaaagtcttcaaatcaatcgatttcttcttcattttgagagctctttaatctacagaactacagaagtacagaacaaaaaaaaaaaactactcagagactaaggtaaaaagacatggacacatgatgagtggatttaggctgattgaatcttgaactcttgattgctcacctgaagttgtgcttgccgccgggcgctgtcccgttgagccgcagccgctggccgccgcgcccttgcccctcgcggcctcgctcccgctgtcgctggtcgcccgtcagttgccgcctcgaggcctcgccgcgccgccgccgaacgcctcactgcgccgccgctggtctagctcccgtcgccaatcctgtcgccgcccaccggaagccggttgccgctcccgccggtcgccgcgccgccgccgaacgccaccacctagggtttggaaatggggaattggggagcgggcgagcagcgcgtgactgcgtgaggcgtgagcgcgagccgagccagggactcaggaggagtggggacaactactacgtgtacatgtgtatatactgatgttaggtattccggggaatacacaggaatcactgtagctccgcccctgctaaagtttagtccctccttctcaaataccacctaagggtattaccccagtgagagtatggtagctccacccctggcaaccgaggaagctacgagatcaccatgcaggtggaggtcgtccctgatctttctttagcacctcaattaatagggttttatgggttcttttggaccggagatgacatcgagagagctctcgtacgaggtttaatcctcttatagtgctaaaggagatatgaacaatttaatttatttgaattaactgcgcaatccgatcaatgcacaagtttaagaaacgtgtgcatgagctcgagaacaatagtcagcatgtcggtgacccttcttcttacggactatccgtaaataagaagtcgtcacctcgccaatcctcttatagtgctacaggagacatgaacgatttaatttatttgaattagctgcgcaatccgatcaatgcacaagtttaggaaacatgtgcatgaactcgagaacaatagtcagtatgtcggtgaccctcctccttatgaactatcctattaccatacataagaagtcgccacctcgctggagatcacaaggaaggtggtctagaggagggtgttggtgtggactgtatagagggtgataacctctgcttccgtcatgagtgggaaaacttctcaagtgcttagtttttctttaaaaaaagtatgcactggatttggcttgaaaagtgttgttataatatcataaaacttaaattatatatatatttatcttcgttagatagttgaagttttaaaagtttggctcctaaatgctagtaaatatttatgaccaagcacatgtttagtgcgtttgtatattgaaagaccaccacataacaacgagccatgtgtttatcgactcaaataacgattagctagagtattatagttcgagttcgtcaaattgttaaagtgccgtaggctcacctgtctcttgaaccgttgacgtcagtttttttttttttttggcatattgtcctaaattgaaacgtctcgaatacgtcttgttgcttattatttttaatctcactctttaaccgtcgatctggttaggtttactttggaatgcaggatatgaggtttactttgcaaaacaggataaataaaacataggaataggaaagttatagaaatataataggattgtatatgtatatataggattatcactaatctcagtactttatagcatgctaagccattgctaatggaccacgcaggaagtaaaaaattaagtagcaaaataactgagtgttgtttctgttcctagcatataggaaaataaaaagaaagaggtttgactggacggtttttttccccgtaattttcctttgagttcttcctatgtcccaaaggtaggaatagtgcctaaatcctttataatgtgaatactgagtttttccttaaaaaaactgcaatccaaagtaccctaattgtgtttctcattttccatctaatatttccatgttatatctactcactcttacacgaatgtatacaacatactaccgctaattacaaatggttctgttacactgtttttcccaaaaagatatacgagttctaaatgactttttaaaatttagaattgagttaaagggattaaattactccatccattccataatataaggcacaaccactttttttaaatgttccataatgcatgcaattaactatgacatattctccattaaattattccttttttaaatcatccactctcatgttatctaattttattggatacatgagagtatcatgcagatttttgagccaggggatcaacaccaaacaactcagatttttcagcagaaaaacaattacaaaaaaatatataaaaagaaaaaatagggatagcaagcctgccttttaccgagcccaaccacccgaggcccattaacagacccaaaaccaaacttttaccaagacccattaacaggcccaaatatcatctgagccacattgaacaaacaattttgctatatatttgtcgacaaattttctcccaaaaatttgacagatataattacagtacaatcgtagtgtaattacattgtaacttacatataattacactgtaactataatgtaacttgtatgtaactttcaaaaatctctttgtaacatgttatttcggtaaatgaaggtcatgggaacaaatcctttcagtaaaatggaggttatgggaacaaatcctttcacatatgtatgtgctgcgattttttttcttcctcaccagaacaaatcttgtaatagatctaatgattcaaaattacgtgaaacttatatacaagttacaatgtaattgcatacaagttacagtgtaattacactacgattatactataattaaatctattaaatttttaggagaaaatttgtcgacaaatgtatatgtggtcatgcaagcccaaagcacgcataccgaacttaaagaaggcctataagcgtgaacgaatctcaaataaatcaaacggtctaaaaaacgaatgattcagcgctcagaaatcattcgactgctgtatagtctttccgttattaggatgatctaaactacaagatcataataattattttttagtctttagattaagagtggttgtgtcttatattttggaatggagggagtcctatatttaaaatcggagatagcaattactccgaattccgaaagctcagtttgacatctccaggagctcatcagcaaaatcctggacatacgtaacgcacggaaaaaaattaaaaatacacctctttttcattggttttatataaatatacacgtttacgaagattttgcacaaatataccactgtcgtgaaatgaaagtgcgagatcgagctaattacttgatctcgtgcggcaggtgtgcgagaccgtctcgcgcgagaccgctccttcgcttccctaaccaccgtattcgcgtgagtaataaattaattagtgtcattagcagttaattaattaattaatatttatttaattaacatcattagtaattaattaatcgttaattatacgctaatcatgagccatgtcaggccatctcgcacgctgctcaagcgagatcgcttcttgtcttgccgtcacgccggtctcgcgtcctggtcttgcgagaccgtgcggtatcgcttaaccatcctggcctatcgtcacgctatcgttactttcgctgaataaatcagcgatattgtttcgcttttgcactttcaatcaacgacgatagtatatttgtataaacaaaattacatctcgaatattaatgagaaaaaaataaaaaacggtatattttcatatttaattccgtaacgcactgcctagcgagggttggccaagtttcgcttgggggagtagaattctaggtagacacagatatttccaaagcaaacgaaacgtgtcgccttccctccttcccaacggggagggttccgcacgcctcctctctctctcacacacacacacagccagccgggtcatagggcacgtggggcccacctgtcagctgccgatcgacaaggacgagtagatgatcttctgcgacgtgtacgtgagctcactggcgttcctgcttttattaacgccgaaagagacgacgacgactttttgtgcttttatttactaacccttgttgttgttgtttttttcagaaacgtcctccataaatcgtacagttgtttcgttggttgctgttatcgttactgacttcctgtgcgctgaaagataccttcggccaagcgggctaattgtagcgtgtgtagcttgggaataaagtagcagaattaatttttgaaataatattatttttgaaaaattgtaaaagtagaggttgatgttgaaacaacaatttagcaatagtaaaatggatagcgaacaagcaggaaagtggatgggttatgagacaaatgatttatacaagttcaggccttctcaataagaataagaagtaataacatatttctgtttgaggatttgattcacttattttggtattgatctaaagatctcaagtgtggttatgttcacaaggggccctgccttccttagatagtcggaggagataagattacaagatagagactttatcccttacagtctaaatccctataactactttacaatcgtaactgactaagactacatgatatttccttgatatgcaggttaatacaatatccgagtcttagcctatacatattctaatcatatgatatatcccctataatcagttggatagtctagccttgtgggtatatgatacccataatttccacagtagcccctgagaccttcacagtctgaaacaaaacccttctctcaaactacattatataacagccgaatgcttcaattcttcctcctgcaatctcccgagtgcttttatccctagtaggttgtgaagggctgaaaaataaaaattaggtgcatcgactagatacacctaattaggtgtagcccccgactatgagattagttgaataaactaaacatatagtcaaggataaaataaaataaccaaccgagtggtttataacaattatagtcatcaaaatgacttaatattatacaacacatattgtgtaaatccttgaataatataactcaagtgatatatcgactgctttttattaaaaaatattccaaacatatattcaacctaagccataaggttgattaataaaaatatgcacttacgtgacaataagcaatgatattgtatccaatcaattgctaatataacctaagcagtgtgttgacttataatcatataaaaaagtcagcaggacagttatgaaaaacttcattgctaggcaccttttaaaatacattgtatcaactcctaaaacattgtatatctgcggtatataaaaaaggattttaaggtattaggtacttgatcatgcgtatttttgtctaagaaaaaaacacctaagtctctaggagaatgtgacagaccacacctgaaattatgggtcgaaaacacttcaagggcctcggcccaaatgaacagtgttctccgatatcctaattataaaaaatttggtttttggtatttcaaccattcgcccttctctggtaggcttggttcttgtattcgatcctacacatcactcgtcttgataatatggtattcctagactctaaccaaagacttatttaaatttggattattttttgtcttttttaattttcaagatcaccaatcgtcattaatttcttcatggaactaatacactttcaatctttcgtacaaacattaaacacaatagatacgttttgttttatcatcaattcgccaaaacccacgggggatctaaatgcactttcaacacgtttattagtagggtttcaataatgccttgttggtacttttgcaatacataaactcaaataattgtttgttcaaaagcatagtaacaacaataatagaatgcctaaggctgtgttcgaactataaggaaggttggggatcttctagttcgtgcacataaaaatggagtagcttattaaagcacgattaatttaagtattactatcttcgtcctaaaataagtacagccgtgggtatccgtgtccaacatttgaccgttcgtcttatttgaaaaatttataaaaaaattaaaaaaatagtcacacataaagtactattcatgttttatcatctaataataataaaaatactaatcataaaaaaatttcaaataagacaaacggttaaacgttggacgtgaacagtgtaaaacattacttattttgggacggagggagtagttgtaaaaaacttaaaaaataaatcaatataatttttaaccaactttttatatagatttttttttcaaaaagattcgggaagcatgcatgcaaaagagagagagaaagcagaagtcgggttttatctttgatttgactgtgcttgcattttatttttctctcttaggatggctaggccttctctccattctatcataactatcctcccaatctcgacattacatcatctaaaaggagcactattttttccttaaactataatctgtgttaaataacctagaaagcaactactatactctatattataagatgtaagcatttttataatttttcacggaaattaaagaaataggtgaaattgaacggtggaatgttgtaattactccctcagtcttaatatgtagcaacctcggataggtcctatccgagcttgctacgtattgaaaatgagagggtaggggtgtaggtaagaagaattaggaggagaaactaaatgagatatggttgtgcttgtttgggatgagaaaaatgtagagaaatagttatatcttgggataaattcaaaactaaaaaaggatatattttggaacgatggagtagtactttaggagggaaggagtagtgtatttagcaaactaactacccctggtaattggcaggtgtacgttcgtgttcatatagaatagagatgagtgtgtgagctttgtgagcgcatatatttgtagtgctgtgttttaacaaaatatccacatccttctacttcaatataaccaatctatagaggaccattttgtaattaccacaacacccagaagtctaaacagatagagtactggaggagtagtactactgcaaatccccaccccaaaaaaataaaaaaaaaatctgctcttaacaactccctataaagctaccactacgcccccctaccgcggagaagcaaccaatccaattccgaacaagcaaggcaccaaatccccccaccatggatcaccgcctcctcctcctcggcctcctcctcctctccccggcggtggccgccgcctcagtccccggcgaggaggagccgctgatccggcaggtggtcggcggcggcgacgacaacgagctggagctgaacgcggagcgccacttcgccagcttcgtccagaggttcgggaagtcctaccgtgacgccgacgagcacgcgtaccggctctccgtgttcaaggccaacctccgccgcgcgcgccgccaccagctgctcgacccctccgcggagcacggcgtcaccaagttctccgacctcaccccggccgagttccgccgggcctacctcggcctccgcacgtcgcgccgcgccttcctgcgggggctcggcgggtccgcccacgaggcgcccgtcctccccaccgacggcctccccgacgacttcgactggagagaccacggcgccgtcggccccgtcaagaaccaggttcccctctcgtctcccgtcgatttttcccccaaaccaaggactcctcctttgatttctcgattgaatcagccgtcttatcgtttcttgattttttttaatttttttgcttttgcagggatcgtgcgggtcgtgctggtcgttcagcgcgtcgggggcgctagagggagcgaactacctggcgacgggcaagatggacgtgctctccgagcagcagatggtcgattgcgaccatgaggtgagaggcgtttgcttcccctttcttgtttttgcgtactggtatattattatccttttattaggagcaagttttatttgtaattttgtgattggtctgtgcttctatgggtgttataagagaggttggatgggtgctataagagaggttggatttttctggctttccgccaatgttttgtcagctgctgcgctgtccttttcctatctattttcttggtttgtgattgggcagcgcacccaaatgagaaggggaaagggaaattggggcaaatgaatgggaaagggaaatttgggaaaggagttgcatgattccttggctaactttgaaagggaaattatgaggaaaaaagagtggcttgtggtattatcagtgcttaagaagtcaaaccaaagtggtgaacttagcaagcaaatttgtcgtggtcgattttatagtggtgaagtaggtgaataaaacaaaagatgatgaatgcaaggctgagtggataaaatctccaattgatactggcacatgtcgctctggaagatcggtctaggtaggcgtctctctgggtctaccgcaggtggataaaactaagatgagatctaggtaagcgtctctctgggagttcatggtgaccttgtgcattgataggtctatgaaataagagagttcatgcacccttgtgtgttggtacgtgcctatggtatggtaacgaacaagcgtatacaattgggcacaaagggttgtttgagtgggcacttaatgaactgaaaagtgctgaacttgggaaccctatgattagttaaattttagagaaagggagttaagaaagtacccgatgttctggggttgtcatgtattccagcaattttagtttttaggtactagtgaagctaccatgaagaagttgtaaattactcaaatctcaaccattaagttcacttgagtgaaaaatataaatggagtcgatatcggccgcaggttgtttctgtcattgcttcatttcttattttactgtctcacttgatggatagacagccaaacgtttgtgtgcactggcttgatgtactctttcgttttggtaactgggccccaggtgagaccccatcttggtgatattgttgtacaactgaataactactgtaccttttatatcattatatcggttaagaaaaaaataatcaaatttcctcttttcttttggatgtgtcatcatattttaggggcaaatttccggtttcctctttcatttggttgtgtccatcatattttaggggcttgctcttgacctatttctttccatatttacttcttgaagcttcactcctaaatcctaattaatgaaaaagttagtgcttctctgttctgttcaaaaataaaacaaatcttatttccataataacacaattcactaaaccatccttacaaagtctgcaccaccgttttaatttccgcctatagcatgggtgattctcttcctagttgaaaattctatgtaggattttttggtagtaagatgtaagtggctctcattctagaaggcttttcattactaagcttctacattaggaaatgcgagaaatatttgttcagaaaaaacaattttctcatatatttaaaagataatcaacagtgattcctatggtaattttacaaagtagcaccaggctaatgtcttgcacaacctctacaatttgtcgtaaccagcttaagtgattttcacattgctttcatcgcaaagtacacatgtaaagcttacccgagtcgtgctcaaataatttttagccttcctggtattataatactttttttgacttgacagtgggatatgtactgttgttatttgttttctactgttacctgtttcaactgaatggggtatctcaacttactgggcttcattgttatctaattttgcagtgtgattcatcagaacctgattcatgtgatgctggatgcaatggtggattgatgactaacgccttcagctatcttttgaaatccggtggccttgagagtgagaaggattacccctacactgggagggatggcacctgcaaatttgacaagtcgaagattgttacttcagttcagaacttcagtgttgtctctgtcgatgaggatcagattgctgccaaccttgtcaaacatgggccacttgcaagtaagtactataaccatctctcggaatgatgcatttgcaggtctgactgttatatgtaaatacatgaatatattgtgcaattgctgatgaatgacttcacattttcctgcagttggcatcaatgctgcgtacatgcaaacatacattggtggtgtttcgtgcccgtacatctgtggcaggcaccttgatcacggtgttcttctcgttggctacggcgcatctggttttgctccaatccgcctaaaggataaggcctactggatcatcaagaactcctggggcgagaactggggagagcatgggtactacaagatctgcaggggctccaacgtccgcaacaaatgtggcgtggattctatggtctccaccgtgtctgccatccacacctcaaaggagtagattctgatcagtagtcccccgaccatcctgtggatggttcacagttggtgattctgatattatatataagctagaactacgaaatatacttagtttatgctccatctgcgctgttattgcagttatgataagcagcgatgatgtgaagctgcaactgaatgtttgtcctaagttatatgcttggtttgctacgcaatgctacacgctatttggaggtagctttaagtattatcgccattcacgaacttgtatttttactattaccaatcttttgaatggtctgtattatatgcatgtggtctgtttacatggaataactctgtctattgctacgaatttgcgtcttgcacattctccattttaagggactctggtattgatatttcagtatttgaatctgtacaagctgcaagatggttgggttattaccatacgagttataactacttatgcttaacaaattatggacgatagcaaaatcttggtataatccctcgagtggaactttctctctttaaatttaatgtaaatggttgtaaaaaatatttagcaatatagcgtatagtaacatctaccactgtaccaaaagtcattcaaaatgaatgttgttaatttttttagaacttttagcaactatttagatagcgtttgaataaatgaggggatatctcctcgagagtttaaaatactttctcattgtccgtggcattctcatgttagtaagactacaatctctacttatatgatcatatcaacacattttattcatattatggaaattgcaagatttgccattcatccattgggtaggggaggcgggaagagaggggaggaagagagatgacaaggactctgtggctatggtagcgatggtacaaagttgtttctcttccctagcaagaaggggcatgtagcttagtggttgtagtagccttagtagcatcccaggtcctgagttcaaagctctattagtggcgaatctaagaagaaaatagagggggtgttttattcgaatgagagtttcaggcgagtagtcgtctagcttatcacgtcagtggcgaatccaagaagaaaatagagggggtgctttgttcgaatgagagtttcgggcgagtagtcgtctagcttatcagacaagctattgacgtatgattacttaagcgctgactattataaactttaaaatttgatttatttgaattttgatgaaatttctttataagatcttttttcaaaattaagaaagtctagtggtttgacaagcacgcccacaaaaagtaccttaaaaaaactctaaatcccaaacaacagggcctaaagctagtaaactatactaccccatccaaaaaagactatcctaacaacgaatctggacacacatgtatccagattcgtacttaaaattggtttttttatgggacggagggatacacgccaatctattgtcaatcaaatttctgatttgtacgagaaagaactcaaaataaagaataaaaatatactaggtatgatagctatagttggctgtaaatatatatatgaaaaacggttcgatgttcttttttcattttttttatttggttgcacttataataaaggaaccagttagataaatatatatgaccaaaggcaggtagtactgcttccctagctagccagctactagtttgtttcttgctgtgatgacttcactagagcacgtactggatgtatgtggatagatacttgttacatatgggctatggccggccggagctggggctggagccctaaccagccccaacgatgaatccgccgctgagccccgtgggagcgaattttaggctaggtaaaaaaggtcactcgctagggaccaactagtgatgatgagcattattggtgacgacttgacagattagggtttagggttgggttgagggtggtaggaggggttaaggggaggtggccagccaacaataggctgtggatagtggacaagggtgcgtgacaaggtggcgatgaaggtagagtttgtgtgatttggtaggacaggtctcatcagcaacaacaaagcaggaggggggggggggggcgacccatgtggaatcggttagggaaagagcgagaagggaggttgaaggcatccagtaggatcagggacaaccctaggctccgagcaccctgggccatgatccagggcctaggattaagaggcaatgggccaagataaattttcaccacattgggccaaccttgtgaaaatccagtataggtcataccgaagggggggggggattaagggtaatgttgtcgacacacgaaggatgagggagtgcatgtatcgtggagaaggatacaaggggaagataaggcttctatttaagcataacgaatcttggcgtgagctagaccattcaaaatgactaaactttgcaggtaattgaggtgaccgaggaagatggaatatgttgttgggtgcaatgtactagctgtagaaagggtgaaagagctgcccctagtggattttggtttattgatgacaaacgattaagggactaatgcacttattgagtgtataagcaagtgattagtccgatgaagaagctaggaaatggacttatcgatggatgagaattaaagagaagatattgaagatgcgggtatgaagtgactacctatggcaagatggtgaagcgcaagcgacgctcagctgcgatggaccatgcagtggtgaagggcaagcaaggggcttggcgccgatgaaccgaaaccggtggtgaagggcgagtgaagactgtgtcgtgatgaaccgtgcgaggccatttgaagccatagattatccacatcaatcatttgagaaatagaagatgaaatgccaaagatcaagaagatgagatcttcccgatgatcaaatgaccttgacgttggtaaccctccaagtgaagaaacaatatggtgtgaaggtactcctattggtataactttgctttttaaatttgagtttaggatgccgtactattaagagggatactacatgcatataattggttgaatactagtgctcaaaatgcttcatctttgtgtgagttgaaaaacctaagccaaaatttcaatcccgagttgtttcacttgtcacaacacttacatcgggtttctttgcaagtttttcataatctcttgaaggttttggaccatgttttatgttgggtttgatagcccacgaaactagctttccataaagtccaagatcttcgaaatcggagttcagagtaaaaagttattgcatttttacttgagcaacatcagactatccgatttgaaatcggactatccgatgtatcggactatccgatttttcacagaacttcactctctgcctttgtttgaaaaatcctttcgagtgagtttttctaagtgtcggagtatccgatgttggatcagatagtccaatgatacagagactccgaaatttcatggaacttgagtctctgttggaggatgaagtttttgcttctaaaatatcggatactccgatttaacattagattgtccgatgtctcggaaagtccgaaatttcatggaacttcattctctgtttcttgttgccttggaggtttaaaatatcggactatccgatcttgtatcggactatccaacgtgggctgaaagattcccctccaacggtcacattttggggggatctatataaatcccccaccaacccttttctagggttgcctaaactgatttcattccaatcttgctttgggttgagctttgtgctaagtgctttggatctttgagctctctccctctctatctcaaatcccccttgttctttgtgacttggatctttgtgtgtggatttggactttgggagcctagtgtgtgtttcttttgatcttgagcactaggatttgtccaagagttgtgtggtgtttattactcttggaggttgaggactcctagacggctaggtgtcgttcttgggccaccgatctacgtggggttggccaagagaagtttgtgaaggtcggatctcgcctccgcaaggaaagagatacccttagtggaaggaggagtgcatttgtgcaacctcacgaggatagggttgaaaaagacccggctctttgcgagcccctcaacgaagactagaatcccctcaaggatttgaactccgggaaatacatcggcgcataaatctcggtgatatcctcactctctttaccttcttgttccattgctttgtgctatgctaatattatttttggtcgagctcacctctttgcttgtggattgaatctagatctcttaggttgttctcttatttgtattgttgttgtgcagttcagatagtctgatctcagttcagactatctgatcacataggactatccgacctgatatcggacaatccgaccctgttttgttttagcttccgcctttatttttaaaaccgcctattcaccccccctctaggcgacatcaaggtcctttcaaaggggttggagcatccgccgctaatgcgtggcggcagacatcgaggtggcagtgatactgctgttgtggcggcgccactgccccgcccttgttggctagtcttactgcgtcttagatccactgcttcctcttccttccactcacccctactagagcaggccaccgaatttgcccgcgtgagcaagaccttaacgagcaccaaggaggcggaagatgagggagttgagccacctttgatttttcccatatccgtgtcgagtacgccgtggatggggacactgttgagctcggtgcctcggtgggtgcccttcctctcttcctcatctcaccgcggtttgagcttcttcccctcgatgcttgagttctcccccctcatcgcctcagcctcccggatccttcctcttcgccccagccttagccggctccacgagctttgcccttcccttcacccgtctggcagtcgagtgtgtatcactggaggagaggagatcgacatctgcaccatcacactactgagtgctgacttgctaatggcggcttcattggtagagaggagaacgggttcgtggagaaccgttgcgtggatgcatggaggctcacaacaatgtctcggattctgccgtggcgtcatccaccgccacctgcctcctttgcattaccgctcgctgacatcttgccctcgctctattgccctttggtaggagatacggagaaaaaaagggaaagagagagagagagagagaggaggaggaggaggaggaggaggaggaggagggaagtagagagaggatgacacgtgggtcctactaatttttttgggttaatgggatctatgccattgcaaatttgcctattcagaaaaataccattataattcgtctattcatagttgtgccattgaaattttagaaaatttgaaccgtgacactgctgtcatgttttccatccaactccttcctttttccatcttcttccttccatagggaggggcaaaggccggagcatgcgccatcattgtagaagagctcaacgctggtggctgcggcgagggagtcgccgttgccggcggcaatggcagcgggggagcagtgcaagacaatgacagagttgaacggcaagcggtcgccggccaccgccaccgtcacgacaacccggcatgtgggtctcaggtcgttggtgatggcaggccgagtgcggcggggttacgtgccagccagtccttgagaaggccaccgccgtcgttggcagcggcgaggagggatgaggtttcttctccttattgctgggtggcagggccaacagtagtgcgtcgttggcgtgtaggggcgatgggggaggaccatcctgcagcggcgtatgtccccccaccaggcacgacgtaggcaagccaagccggcaggctggactgatgatacctcgccaagtcgccatgtgggtcccacatgttgacttagcgagttaacaacggtcaactaccatattagtaaaccactttccaaaccaccaaagatttgcactggttttcgaagattgggaaagcattagggcatgtacaatggtgtctaataacgggctctcttcgttgtcatgcaggtaaatttggtgacgtggaagaaagagagggaaggaaggagaaacatcattgttatgcatgacagcggctcagagtcaactcttagcgtttattaacggaaagtttgttgcatgagggtggagaaaaggaaagaagtataataaaaaaatatttagtgtattaatggtttagaaatcttattgtctctactattgtagaaggatagtctctaatgtcattaattaatatagagagctcatattagactctacctttgtatatgcccttatacccggttttgtggtcgagggagaaaattcagtaaggagcaagagttgagggttgcaaataaacttattccatatatggtaggtgttctgggccttaagcgattatgcccaacccatgtgaggcccagtcctccaggcaccttgacacaggctattattttctgcgaatattagcaagtagcaaccatacgatcgtcaattccactactagaaaactcattttcggcgtcgtaggggatcgattttcacaagcgggcatgtaattcggtgccaaaacccggccggaaaaaaagtacccggggtggagggggcagtccgcctgcaaagatcaatcctcgcaggcgccgcttatatggcccgcctgaaaagatgcccctatatagtcttcttcctccccgagccctgttcattctccccgaagtttctctctcctaaagtgacttaaatataggggggggggaggttttgaacttcaaatctttgagggatttttctacggtgcttagatctactcatttccacactaggtatgcaattttttaagcttttagaccttaatttgtgatggatttatgcatgcaaaattgtgaaggaagagctccatgttttttaattttatttcttttgatatgttgatgttagatgtatgtgtaatacttgatgcctcttgttgtagtggtttaatgtggtaacataaattctcaattttttttatttttgctatcacatccacctcctacttctagatctagatctagatcttgtcatatatatagagagaataaaatttttaatgtctatttattcggtgcaataaaaaaaagttatagtattttgtaatatgccgatgatatgattttgttagattttcctaatgtactaatttggcatgtctgtgtaaaaaaaattgaaataaactttgattttttattaatttacacttaacttttagttaattagttttgaatagcgataagttttttcaataaaccctacaaatttggtattaattgtgcaaatattttatgtgtattttttttagagatatggaaagtcgggaatggatgtatcattggccgaggtttttgtctccatatagaaacgaagtgtctaaatttattggtattgccaaggcacacgctgagaagaacaatatgaggaagataatttgtccatgtgctgactgtaagaatgaaatagcctgggacttcgacgatgcttttaaagtgaaggagcacttagtaactcgtagatttatggacaagtatgaaatatggacacgtcatggcgaagaacaagtggacgggcctgaaattaatgtagttccgacacaagttgaagacatggtgcatgacaatggttctgttgaggacaaaatcgacctagaggaaatgttatgtcatgcagaacccgaggtgctgatggggtcggctagagggttaaataactttgaagctttacagaaggcagcaaaggaagttttgtacgatgagtcgaagggctgtgacagtgagttcacaacactctggtcagttcttgaacttatgaggttaaaggcgagacatggatggtctgataccagtttcgacagtttgttagaacttctgcagaaaatgctcccgaggcctaactcactaccatccagcacatatcaagcaaagaaactcatatgccctctttcacttggtgtggaaaagattcatgcgtgtgtaaatcactgcatactgtacaggaaagagtacgcttctttagatgaatgtccaacatgcggtgctagccggtacaaatcgaatagcaatactggcctagaaccgtctgacacaactgagggacgacagagaaaaatcccacagcttgtgatgtggtaccttcctgtcaaagaccgcattaaacggatatactcaaacccgcgagatgcggaactagtgtgctggcatgaagaagggcgcaagaaggatgggatgattcgacacccggcagatgctcgtcagtggataaactttgatgctcagtacagagagtttgctaaagacccatggaacattagatttgccctgagtactgatagagttaatccttttggagacatgagcagctcacatagtacttggccagtgcttctcaccatgtataatcttcctacctggctttgtcaaaagcgaaaatacgtactactctgtatcctcatacagggaccccgttagcctggtattgatattgacgtatttcttgaaccattgttggaagatatggctgatttatggaaagagtgattgaaagtgtgggacgagtacttaagggaatacttcacagtgaaggccatcatcttcgtgaccattaacgattatccagcaatgtttttagtttcaggtcaaattaaaggtaaaacaggatgtgtgatctgcttgaatggaacgtactatatgtatctcccgggttccaacaagcttgtgtacatgcggcaccagcggttcctatgcacaaatcacaagtaccgcaagatgaaggcggagttcgatggcactgaagagacagatcctgcacccaaaccaacctcgggagaaaaggtgtgtgcaatgacagagaaaattgtttgcgagtttggaaaagtgactaagaaaccatcgaaggggacaaagcgcaagaaactcgagaagaatacgaaacaaggggatagtaaaaagcaagatgatagttcgaagccagatgataaactccctcccccattcaagaagcattccatattttttaagtacctcccgtactggaaagatctggaggttcgacatgccatagacgtcatgcatctagagaagaatgtgtttgacaacatagttggaacattgttggacatgccgaacaagactaaagatggtttgcaattaaggatggacctagtcgagatgggaatcagggaagagttacaccctcaagaaggagaaaaaaaatggcaaagtatatcttccaccagcctgtttcacactgacacctgaggagaagaagtcattttgcaactcactccatgatgtcaaagtgcccataggtttctcatcaaacatcagtcgactagtttcaatgaaagatttgtcggtatctggttataattcacacgattgtcatgtcttgctcaccgtgtttcttgcaattgcaataagggccataaaaccggagcatttaaaggttgctatcacaaggttgtgctactttttcaacgcagtgtcacagaaggtcattagtctcgaagagttaggaaatctccgtacattcgcacaggagacacagtgccaacttgagatgtgtttccctccgtcattttttgatatgatagagcacctcattgttcacatagtgccgcagatggttgcgcttggcccattgtacctccatcaaatgtggtcatacgagcgttacatggcggttttgaagggttacgtctgaaatcgtgcacatccagagggatcaatggttgagggttatagtactgaagaggttgtcgagtgctgtatcgattacctcaaagatggatatgcaattggagtacctgtgccccgacacgagggcagattgagtggcaggggaacgataggaaagaagagattcgtcacccatgatcacaaatcattccaagaagctcacttcagcgtgcttcatcagtttgctatcgttgagccgtacatcgatcaacatatcgaactaatacaccaccgagtggataatgaaagaacacaagcgtctcttcgtagattggttgcgagacctagacttacctgagggacaaactaccgataaaataactatgaagcggttggcttgtggtccatcaactacagtaaattcttggcagggatatgacattaatggatactcgtttagtacaagagcccgagataataagacctatacgcaaaacagcggtgtccgtgtggaggcaattgatgaagccggggaaaaacaatcatacttcgggtttattgaagaaatatgggaaatcgactatgggcacacaatgcaattccccatatttaagtgctagtgggtaaaatacccgaacgggatcaatgttgataagttcggtcttaatgttgttgacctggcgagtgtgggtcacaaggatgacccttgggtactcgcaatcgcgtggcacaagtgttttacgtgaaagacccatcaaatttgaagaaagatatagtgctacccgggaaacaaaagatattgggagtggatggggttgaagatgtcgaagattacaatcaatacgatagtataccactttatagtcagtttgtacagaagattaagaatgtcgagacatctactcagaagatcgtgaagcctcacatgcacacggacggtgtgggaaaaaatgttaaagggtaatgattgttgagtcgcatttaagcatctaagaagttagtagttatataattaaatttttagaattgatagtgtgctcaaaattttttaattaattacacattagtaatacactaaatattaaatttgagtggggtcctaggaccccactccacatactgtggatccgcccctgcaacccgacatgtgggtcgcaggtcgttggcaatggcgggccgagtgcggcggggttaagtgccagccagtccttgagaaggccaccgtagttgttggcagcggcgaggagggatgaggtttcttctccccgttgctgggtggtagggccaacagcagtgcgtcgtcggcgtgtaggggcgatgggggaggaccatcctacagcggcgtatgtccccccgctaggcacgacgcaggcaagccaagccggcaggctggactgatgatacctcgccagtcaccatgtgggtcccacatgttgacttagtgagtcaacaacggtcaactaccatattagtagaaaccattttccaaaccaccgaagatttgcactggttttcgaagattggaaaagcattatacccggttttgtggttgagggagaaaattcagtaaggagcaagaattgagggttgcaaataaacttactccatatatggtaggtgttctgggccttaagcgattatgcccaacccatgcgaggccaggcaccttgacacatgctattattttctgcgaatattagcaagtagcaaccattcggtcgtcaattcgtcattcctgcagttttctgaatcaactcctcattcgttttgtctaaagaaaacaaaaaagaaaggtaccaatagttggcctacctcgaatcaccaagagccacaagtgtcaatttacctgaaatgatggtgaaccaagcaatcgttgaaaattgcaatacatagatatagagcagccaaaaaacttggcctttcgttttcacatcttaaattttcttgcacataagtggcactttgccaaccatatatatataatatcacataactttatcaaccatatatacggtatcacatggttccgttttctttgtataaatgtgcatgcgaggatcatatgtgcgtgtatggcgaccttcccaccatattcatcaataactttgccttgcctttcctgatttcaattcaacgccacgcaaatcaccttcatttctactcatctggttatcaaatacatgtcgaattggtacgtgagcttttcaaatttcacttctacttggttacattaaaaaaacattagagtatttttgttatgaaaattcctttatactatgatttgttatacaaataaatgtacaatggagacacgaattttaagcggaaaaccctttgcgggaaaaaaccacaaacgccgaccattaatgatcactattgaggagttggatacaaacgcaaggaatacattgggttgtcgcaccctcgccgtgcggatctaggagttctagtgggcaagacttaagactcacgctaggaaactaatcctaatagtcaagttctatttgaaaacttatctgaatatattacatgcctaaaattcggatcacatatttaacatgattaattatatttttacactatatactaacgacgatgcctcttaaactaatctacataaaatgcagatccatgtccgttccatgcgtgctggtgcgatatgggggccaaatcagctgtaatactaacagttcttctagcccatatattagtgatcttaaatgtctctcagtattacagagaatttatatcctatcacacgacatcaataaaccacactataaatcttgcaaatcacccctttgaacttcatggtaaaaagaaattcaaatctaaatggatagccacatataaaaccaattaaggtgaatatttcctatataaaaagatggtaacacatttaatagaaaatatatatttttatttattttaaataatattattttttattcgtagtaactagtaaagaatggagattgagctagttttctataaaattattgttgcctatggttgtgtacagggatgaaactggtacggatacttttggtacgtccgaacgttttttcgaaatcggataggtttgttcggatagtttcggatatttttggattcagaaacaaattcggattttttttctccgtaacataaacgaatacagtaagggaaatatccgtcggaattgcaaaacggttatccgtgaatatttttcgaatatccacaaacaaggatcaaatttcagaacaaacatgtacatatacataacttttccatacgaagtcagatgaagacaaactttatatcaaaattgtagagctcaacgagatatacaactttattgttaactattttattatctgagatcatttaagggtctaaatattcattataaaatatcatatctatttttacaaaatctcatatctgtaattcaaacgatatcctatagagacgtgttccatatcaaagttgtagagctcaatggaatctaccactttgtagtttataacatttgtatttgaaaatatttaaactataaaacaaacattacaagtttcgaagatgtgaaataaaataaatagcatcttcaatttataaaacaagaccttgataagtgatatggtaagtaagctatacatgaagtaaaaggtatttggactggaaagtgaataaccatattacatgttggtctttttggggaacggttatgaaaatcgattttcacatacggttatgagaccgcctacaaaattaacgatagacatttaaatatgttgacctaaaataacaagcgatatctcttcattgattaaggaagctcaatttgaggagtttttatatcccggcaaatattcgttaccgtatttgtttcgtttcgtatcgctccgtatttgtatttgataatattcaatttaatttccatatccgggtttttgattccgattacgattccggaaataaaaaaatatgaaaatgaatatattaaagctagtttccgatccgttttcatccctagttgtgtacatttaccatgtgcttgtgtttggtgcttccttcatttaaaaatcagtgaaaccctcacacaaacaaacaaaaatgcattgatagatgattttgtgtcaatgctacaaaatatgctccatggtcctatgattaattccactatatttaaatcagggtgatgtcgttatacatgattccctgcatgttctaattcaaggtgagtactaaatgtggtgcattcacacattttaaggagtaattaattgttacattgttgggaggagcagtagttgagagtataataggaaaaaattgaatgaaaggtgataaatggtactccctctgtactcgtaaaggaaggaagtcgttttggacagcgacacaatctccaaaacacaactttgacttcttgtttctataaaaacatttattgaaaactgatatatgtatacttttatgaaagcatttttcaagacaaatctatttatataatttttatattttcaaactcaacaacttgagagttattcatgatttatattcccaaggcttaacttaaacattgtcctaaacgactttctttacaagtaaggagggagtacaagtagtatattagagtgacaagtattttgggacaaatttcaaattctagaaagataactattttaagacggagatagtactctatacttttattttttttaaataaaaactccaatgaaggtgacagtctgccaccccatctacttatattgtagttttacatattatctattgaaattcttaatattacataacacttaaatttaaatggatatatagttacaaataaaattaaactaaagtaactatttattcatttcagttaatatcatggttttttttcttttagctgtagcaattaactgagtaatatgtaacagctatatccatgccaaatgcaaaacggtgacattttgtacataaaaaagacccattagaaaaggaaccgccatccctcatttctggggaataattaattatttgtcacttttacgagtagtgataaaggatttgccactaaacctatatgttacagatagatgagattctacatatcatagataatgagtggtaaataattaattgccacatattaaaagtggcaaaaagttaaattttcctttttcttgaggttcacatctgagccgtccatctgtcaccccagctaagcgaacacaaccttgttttgttgtgttgtgcaactcagttcaaaacaatccaaaaaagctttattggaggtgtttgggggaagagaccactataatgccacgtcactaaatcccatccaacatcaacggcatttgtgtaagtacgtttagcaaattaagatcatctcatctctatccatgtattcattaacactgatgctacatctcaactcctttgatatccctattgttagataaccaattaatcaattttaatgcaataacaaaaccttccgactaacgtttcgcgtatggataataacgatgacaatattatatccaacgtcaacaccagactatatcaatgacttactattatattaataaacacaccatcgtacaccatattttactggctatcatttaccactgcggctaccggtcaccctaaatatatattcgtatgccatatgctagtctctctcggttatttattatttcggagagagttggtaccaatttttatgtagagatctatttatttttccgagagagtttgacaccccccaatttctctctggagatagataatcccacccttctatatccatctatatctatctattactatctatatcttctttatatttgacggtaacacatatggctgtgcgtggctccaccattggaaagaataaatacagcaagctaaccttgggggtttataattataacgcttccttggcccccttcgtctccatcttcttttttttttttctctctcccttctctctctctacaaatctggggctcccagtatagcttaggttgatttaattatggttaacctctcacagtaatccgggtgagaggtgggaagccaaagtgggagaagcaaaaatattctcagggcaggtaaggtaagcgaaggcgagaagagaagagacgagaagagaagagagagaaggtaaactagtctctcttgtacatggtggcttcccttcccttcccttctcttcccatctctctctcctctggttttctcctaccttttcttttgggggaaaaaataatattaattaaggcgcgcgtgcgcggcggcgcggcggcggcggcggcggcggtggaggaggattcagggtggtggtggtggtgatgatgggtttcttctcgtcgtggggtgtgcgcaggggggatgagcgcggcggcggaggaggcggctgcggcggcggcggcggaggaggtggagggggtggaggcggggaagaagggcgtggcggatgcgaaggggaaggggaaggagaaggtggtggtggcggaggaggattctgcggtggcggcgggctccgggggaagcggaggcgggaggaggacgttggtggcgtacccggcgcgggttgcggggtacaaggacgtggtggcggacgcggcggtcttcaggagggcgctcgaggggttgcacgcccagatggggacaaagctcaagtaagggatcccctctctctctctctctcacacacacacacacacacacgcaccaatctgtatctggcatcgccgatccttgcaccatgcagctgccttacgatatagcatttgatgccgttgcgcgcttagaacagttgctgtttgttttgtttctttcaatgcgcaagaattgcaacttgggagataaagtttggggagaaagagaagttttggggagagatagcgaacctaataataatggacgatgcaaatacaggcatttatatatttatatttatttatttggaatccggatacgtccggttttgactaatcaaccccatataaatgttaccctcgaaattatgtggcctatatctgccattgagtcaccgaatttatggatcgaccacatttctggtttcttatctttttgttttccccttcgtttgtgcaaattttgtccacagattgtgatagttggcttgggcctttgttgctgttgctttgcgtagttatccttgttttatgcctcgttcaatggtcaattacttatatgttgttaatgctgaggagcagccctagttgatgatgttatgttcaacacttatgttattgctcatttgtagtttgtagttgccttagaccctagtctaattgagtgtgtgagcctgtcccttgcaaatcaatgtacttgctatagctgtattatatggagagaatgacaggtatgtttgtcaatgttgcttgaatcactactgttaatattatatataagtttaagttgatgaatgatttgcattgcaacatgtttgtgtactgtggtaattagttgatctactctaccaagttatcattgagcatgcttcattttggtgcatttctaacatcatttttgttttcagggtgccaattattggtggaaaagaccttgatcttcatcagctgtttaaggaggtcacttcacgaggtggcattgataaggtgggaattcaataaaatcattcatatttcaattgtcaaatgttccttaagaaagtcttttagccagcgacagtcatgtaagactggccatatatagtaaagcaaatttttattatgcttagaagtttgccaaagaaaagcaaactaaaggcatggcacttgaaatttttgttgttttcatgatcttattattagttgttacctgtcagaatagcaggcaaataactgaaatttatttcacaggtgaagtccgataatagatggagggaagtaacagcatcatttattttccctgctactgcgacaaatgcttcttttatgttgaagaaatactacatgtcactattataccattttgagaggctatacttgtttgaggcacaaggctggtatcaagaaactggtcagtgggatttatagaaattcagtcttctagtttgtctgttgctgtattactagctcataccattttgtttcagcagattccagaagcatttcctgtatagaaatgaaagctgaaggtcaagcttcccggaaaaggaaaagaggaagcaattcttgttcttcaggtcagtttcagttcacttatcttctgtagcagtttgttttgtttaggacttcttctgtggcaggctagcagctcattacaagagaaggaaagattgtaaatgttactcaaaagtttaagtaatagtatgattgtgttaagtgttgtaactgtcaacttacaagatgtcgtaacatttcttcagtcgaagcttgtgagtttgcagcattttgtacattttggcccttgtattcttattctacaaatagaccctccaattaacttagagtggaccctttgttcaacaccattgatgaaggtgccgaggtacaacatcttggcgccaaccatacacttcggttctgagaaaggccaagctggcatgaagtccacatggtccgcgcagaaggtgttggcgctaatgtaatatccaggatgacaagctaacagttttaattaaacaatcgtagaaaaattgtgtggtgataagatgtcccccgtgccatgtcggcgagccgagtttgatccttggctggtctaacttgttttattttcttttttagtggccaaaaggtaccatatatattttttaaaagcaaacattcctcgagtcatgtatgcacgcatacagctgaccattaaaataagagaaataaaagggaaaaactcacagcttgaacactcgaacccaggatgtcgaggaaatcatgaggccatcaaaccactagaccacttatcagcttgttacctattgtaccccacaagccttttaagcttcctatatggtcagcgccaagaggtttgctactggccaactgctcacgtgtacttcatgccagcgtagcaaagttctcagcggcaacagttttttattattttcttttttttagtgaccaacaagcactcctcgattcatgtctgtatatgtagagctgaccattaaaaagagaaaaagagagggggggagggggggttaaggttgaacactcgaacccaggacgttgaggaaagcatgaggccgccaaaccactacaccacttatcagcttgttgcctattatatcccacatttaagcttcatatgtgatcagcgccaagagctttggtgatgaccacctgctcacgtgttcttcgtgcagctcgccaaagttctcagcgccaatgtgtatggcgcttagatattgtaccttggcaccttcatgatggtgttgagcaaagggtccattctcgaaataagtttattggagggtctatttgcatgtatatcaatatataagcccatttataaattcagtaaaaagcgagcatgttctataatggtgctaagataaatggagaacatttataggaagcattattgctgttctcaagcatattctatacggtgttaaactaaatggaaaacatttttatggaaattataattggtgttctttttatacatttaggtaaagttgtttaaatttatatgactaacagttagttcctttgactttgtcagacctagctgcttctttggataatgatgtacaagtgataattgatggtaagtttgaacatggctacatagttaccgttatcatgggctcaaaatcaacgaaagcggtactctataattgcaccgaagaacctgcagtgccaactgcggtgcctcatgttgcaattgacagcgctgagggcatacgtcctcgccgccgccgccgtaggaagaagttaagtacaacagaccccaaccatcctaaaccaaacaggagcggctacaatttcttcttccaagatcagcacaggaagctcaagccagaatatcctggacaagacaggcttatcagcaagatgattggtgaacgatggaacaatttaggccctgaagataaagcagtaagagtagacacggtcttttgaatttcattacttcaaattgataaagtaatcatgcaatatatgtgctttgtaacacttatacatattgtaggtatatcaagaaaaaggtgtagaggacaaggcaaggtaccagagacagttagctctttacagagaacagagaacaggccagccaatcagcaacgcggtgcctatccagcagagacttcctcagaaagaagtgacgattgatgaggtggactctaaagtcagtgaaggtgatatcctgctgtccaaccaaggatacagcagcagtaccagtagcagtgatgaaaccgctgattcgggagaaaaaaatgtggaagatgatgaagagtttaacacagagacatctcctgagccgagcatggaaacaacagattctcatggacagcctgatccttctgctgatggggagcgctttgaactgcgccgcagggagaaccctaagattgatgagaaacgtgacatgccacctaattaacgcttgtgccgagttgaagggaaaatttctgaaggatttttgttgtaggatcagattgctgttttgtttcactttacctttgcatcgtctctagagactgatgcgctatgctagcgcattgaatatcttctttttttatactgttagcaatttgaattgctctttcttaggtgaagtgatcacgggtcacttccgggcatccttgatgtccgataaattagagaaatgatattattttattattcactgtcgtcataggagtactgagtacaccagtttgttgctcacattagaacccattacaactgtaaagactggagtaatatttttaatagttggtagaattggttatatggcatcgaaagttggttatacatgtgaatgacaattctttgatggcggttttgatgacagccactgtcatcccatgataatgacacgtgtgacctattaagtcgatgatatgcgcctaggatggcaatgtctggtctaaagagtggtaaatcatcaaatcccaaagttagttatatgtaattgaacatgagagctatttaaccaagttgagaaacctattactgctgtccaacctaatactaatttatgatgtagtctcattggtatcggttagttgatagttgattataaatcgtaatgcttattagcgtgtaaaaactaatttgtaaataaatttttatatatgttcttaaggtacttaaattccaatgttgaaaaataaatcatgatgaaaaaaccattaatactaactctaaaattaagttttaaaatttaaaatttagttacggttgataagctaaagagcaaacaaaattaaagcggtacagcccgagacataagcaagcaaaacccactcctgcctgtcgaattccttttagacttgatcatatttcttggctgtataaacttacattaggttgcatatggctaaaaattaagtagacattattctgtgtatatatgatttctagaagccagctgttacaaaattaagtttatttaccagggttcgagtttcttgatgtggatcgggggaatttgaaggccacatcaggattaaccgaacaggctcttattgtttctcattaactgatgaggtcgttggcacaccttgatcttactaccggctggttaatgaactgctaccaagtgaaagttgagattgatactgagtgctccattgtcatacccatgaccatgacaagttcatacacaaaaaatctgcacaataaagtagaaacaagtaaaaacaaatccagaattatgcgtcgtagcttaataaacattgactgctggatattatgagaagataaaaaggaatgtgcatttgatttattgatacttcagcaaagagttagagcaaagcgcgcgcacacaccagagcacagcgtacaggtggcactggcaacataattctagatagcattaaaaatgtaaatgaactgggagtgagcaagtattggagaaacacctcttttttcagatatttaggtgtattggctcaaaaggtcccatgtttcttaccaagggaaataacaatactacatattttccgttcctgcatgcaatagtcaatactcaatagacacagttacaccatttatctttatctaacaaaggcgttaattataacagcaaaaccgagtcattatttattggaataaactgtgtcccgtactcaaatacttagagcaaaagagtgagccaaaatgctacacgttatattctgagttgaatcaatgctaaaaaactaagataagcaagaaaaagcggtgattgttctgcaacagtatcggacaacatatacctctggatttttctccaaacttgtaatgagaagttgataacattcattgaagacttgaacatttgaagttctgacagattgacaaaacctaagatcttgcatgttgcactcatattaaggtattcttgtcaagcaacaaaccaaggaactgcaagtctgcaacagcaacaccacggttcccaaatttagcacatggcatttagtaagatagagcacaaatgctatatatatgaaaacaacattcgatcaattcaaatgtgtaatgaaaagcagaagtcaaaacttacatggcatgtgtctcagcccaaaatgggctaaaatatgcttggtctttgtcctacggctgaactatgcactgtaccaagacaatatatggcgtggtactagaaatattagccaaataatttaacaacaaagtactgaaatggaactgtttttcccgaaattagaatattccttgaatgatatacaaaatgctggacaagatctttgctttcatactgctctctaggaatcctgagaagaacaaaaatttaacttgttttgaccaaaacaattcctcaacatgattcctccgaaaatcatttgcagtcattatcatccttcaggaaaccgttttcaatcacccctttcatcccttatcaaaattataagctctcaaattcctcttgcttatttttaaacaaagccttcaatgcggcgtaatagcagaatctgtcagtactgtacagctgtgctgcttcagacttcaggaaatagtccacaaccataggaaaatgtcattggtgagaccagtgtaccactccacgtggaagaagtgttacatacattttacagtcaaccagccctgttaggcataagtaaatgattagcatacttgaatgttacttcatttggagtgcacttattcctaagcatctcagctacaagctcctctgcatcctgccaccgctcagctctacacaaacccttcaatgtagagttataagaaatagcatcaggcttacatgacatggtgctcaataacttgagggcatcgtccaaacggccttgttcagaaaagccattgataagggcgttatatgtaaaaatatcaggtgtacttccatagtttggcatttgctcaagaacctcaattgcacgatcaaccagccctttttggcacaaggaattgattaatatattgaacgttacttcatttgggggacaatcctttccaaccatctcagctataagctccccagcatcttcccatcgtgcagctctgcacaaacccttcaacacagcattgtagctaaagatatcaggcttgcacggcatgcttctaaataactgaatggcaacctctacaagaccttgttcagaaaagccattaagaagactgctgtatgtgacaatgtcaggcgtacatctgtaccttggcatttgctcaaacacttgggttgcatagttgaccagaccattttggcaaagcatgtcaatcagtatattaaaggtcatttcaattagagggcaatcatccctaaacatctgagcaataagctcactagcatcatgccatcgttcagctctacaaaagcccttcaacacagcattaaaaccaagggcatcaggcttacacaccatgctgttcagcaacctgagggcatcatccacgcgccctcgttcagacaaggaattgatgattatattgtaattgacggtgtcaggctcacacccgtacttctccatttgctcaagaacttcgactgcgctgtccactaaattattttggcacaaggaactgatcagcatgctgaatgtagcttcgtttggcgagcaacccttcctaaccatctcagccatcagctcaccgatatcctcccatcgctcggcgatgcataaacccttcaacgcagcattgtagcaaacggtgttgggcttgcatagcatagtgttgagaaggtcgagggcttggtcgacatgcccttgctctgagaatccattgataagggtgctgtaaatgacaacgtcaggagtgcatccgtacctaggcatttggtcgagcagttggacggcgcggtcgagcaacccgttctggcagaaagaacggatctgcgtggcgaatgtcacctcgttgggagggcaacggttcctgatcatctctgccatgagctcctcggcctcctcccacttcttggcgatgcacaagcccttgagcacggtgttgtaggtgtaggtgtcgggcgccacgggcatggaggcgatgaggcggagcgcgtcgtcgaggcggccggagcggcagtacccgtcgatgagcgcggtgtaggtgacgacgttggccgcgccggtcgccctggccgcgccgagcacgcgctccgcgtcggcgaggcggccgtcgcggcagtagcccgcgacgagggtgttgtgcgagacggcgtccgcggcggcggccgccttgagcgcgtcgagcacgcgctccgcgtcggcgaggcggcgggtggcgcagagcttcttgatgagtatgttgcaggagatgagggcggcggcgggggcgggcagcgcgccggggaggaggaggaggcggagcgcggcgtcgaggtccccgagctggacgaggcggcgcagcgtctggccagggcggggcggcgcggccgggttgacccatatggaggagctggccctgcggttcgcccacctggaggaggcggcggcgaggcgggggcgcccgtgttgcttggcgcggcgagggaaagagaaggggtggtgggcggcgggcggcgaggaggaggaggaggtgatggccatggtcgtcggggtggtgaaggatggagaaggcggaggcgataggattcgtgggatggatgaggtggtgcggcggggccgcgggagtgagagtgacgaccaaatgcccgccaattctacttcattccaaccggacttcctcttttttttttcccaagtcctctcttcagtatggtgatgaaattcactgttaactcattctactgcctccaagtctccaaccaaaaaaggttcattttctatagacgaatctagactacgttttgagaagtacatatagaggtttttccctgtgtggtattaaaaaaagatggtgtctgcctctatgccactaaaaagtttgagcctctctctctgccatcgtcgaactttatcgcgccctccatgccatttcatccgttttgggttgtaacggtgggtaacggcagtgcgaaatgacctagttgcccttaggcttgaaatgccatttgatgaagtttgtttccttatgtgccattcggaggcaggcacatgcatgtattttttggcaccaaaggctgtgatgttggtggcaaaggcagggctgttggcgtgtcacgccctggagttccctttccttgtttaaaaaaatcattaaataaatcgaccaaagaaattgtttattttagctcaactaccatgtgcttgcaaaccggctcatctcgacaacagaaaagaacagcaaccgtgcctttcacaagtgcccttattttgcagtttgtgtttcattctctgctcacatattatgtttgggtttttcttttgttgtttgctcacaatgtgttgatggtttggcattcagattggaggatgtcagtattatcagtgggaggatgaaatggtggacactggagtgcaaacacctcatgcccctgctccaattcatacagttcccctacaagcagtggcaccacctggtggtttccctactactccactgcctatcaggcaagatcaagctactggagtggacattagggtgatgcagcagcttaagtggcttgaaaagatggtctatgtttgcatttttcttactttgtatgctattttcaagaagtagttgggtgtgtgtatgagtagtcatggataaatggatgtatggaaggatgaatgaattttcaatcaagaatggtgaaagtataaatggccaggttgaaacaacaccaaatgttagcacataacaacatcaaatgaaacaacataacataactagctatttcatcctttaattagctgtttcatcacataacagcactacatgatagtaccagatgttagcaacagacatgacttagcaaaatacattacttgtttgcatccacataccaacatggcaaagtaagagaccaaaaaaagagtgttttcatcacatggcagatgtttttcactatcatagaacaaaataaaagttttgccatggattaaaagaaccatagaccaaaagaagcacattttactacacctggagcttcttgctcctggtatttctagcagggctgtctgggcttgatgtagtggctgcagcttggggctttctttgggtaagcttccttggggtaagtttcctgctgatgcatatcttcattcttagtgaagcctacggcagtacaatctgcagtggccgggtctcctaggtctcctgttgagtggtctcatcagggcaaggttctaggaacacagattgtagtggtactggatcattggaaccagttgcagaccttgtgctaaaacaaaaacatggtgcattaggtggcatgaagtttttgatgatttgaaggcttgtggtaaagaaaaacatacctgttactcacactgactggttctgagattgtagtagtagtagtagtaatggcatatgccccctttttcttcttgttggcaccagaagaggaagatttcttccttttttttttgtgggatgcattggccattgcttcattggctgggaagaccatctgggagggattagccactaaactggtctctgtgttacatggtacaactttcttcaacctcttctttggtagacccctacatatcaaatgtgttttagttaactaagttattggtgatgtacatgtatatgcaaactaagttatgtacaaagtatacctttccgcctccattgtagctatatcttctaggttgccattcttacatgtataccagtgatggtctaacagatggtagatcgggcactcatgtttctttgacgttttctggctgctacctccctcaagtgatgacttcatcttattcttgtgcctacctccagctatggacttaagcaagggagggcgcatgaagaagtcatgggtagccttgggccacatggtcttgtctggtatggaaggaatataaccctcatatgcagcgctgaatttgttgacagagaagtactcatccacatggttctcaagcttttctccaggaatggatgtaatgtatgctattgcatgcttgcatgggatgtctgagccctgccaacccctacaagaacaggttctatcctttaggctgaccacaaacctgaacccagagccattagtagctttagcgcacagttctgccacaccttctggaggggctgttatcacctcaatatccaggttgtagctctcttctgatccttaagcctctgcaggatgtgaggtagaatttttccattaaacttcttggctaccttcttcctttggttccatttgatcaatattttctgccttatagtgtccagcaagtcatccaagtgctttcccttctctgcctttgtccagttattgaatgactcagccagattgttagtcacataatccatctttgatgcagtcctgtacttgctcctagtccacaacttcttgtgagtttttttgcaaatactttattgcttctggtttggctgcagccattgcttggtagtgcttctcaaatatgtatgggctccatgaatatgaagaagcccataaatgctcatcaaataccttcccactgtacctcttcttgaaattatgtactagatggtacatacattctctatgttcagcagttggaaaaacatcactaacccctttcatgactacctgtccacaatctgtgttgaatgtcaagccatctggggtacctattgcttccttcaatctctccataaaccagaaccagttctcattggtctctgagtcaatcacaccaacagctactggatacatccagttgcgcccatctactacacaagctatgcacaactgtcccctaaacctccctgtcaaaaaagtactatctactgcaagatatggtctacatcctctatgaaatacatcatgctttcagtacgaagaatagcctatgaaatcagatcttcttgtttatggtgtgatgatcaataacaagaaataatccggatttctaagttgaagctactatctgggtccatcctacatatgaacaaggagcacgtaatcattaaaccctaacacggattagtagcaatgggcactaaacatcagtacatcaagggaggcaataaatgtggcctaagacagcgaaatcaaagggggcagcataaaattcacccgtctagaaaccaatccgggcgctcgctggcgccgttccacaccatggctgctcctccccgttcctctcgatgcacggttagatccacgctcccatgctcctccccgccgccgctaggtttcgccaccgtcgccaccgccgctgctagggttttgtcgccatggagagcagggaatcgagagagaagagagtgacacttagggggatgacggtaagcatcggtcaacagacggtccaatatgctagcaattgaaagggaaagagcgacattttccctatccgggcccatatgtgacatgtcagagctgccaaacggttatccccaaatagaatagcgatggaatgatgtggagggcatgataaagttcgacaatggcagagagggaggctcgaactttttagtggcaaagaggcagacagcatcttttttaatgtcacaagaggaaaaacctcacatatagataagtaaccttaaattattgagttattactgttcatccataagatatggaagatcaaaattcctttagagattgtccggcagatgcgcaatagaatttaagcaaattttgctacaggatctcgtgggaatgcggtttcaattgttggacacaggcgtagtaaaatgttgaataaaatcactatgtaaatatggtaatttgctcatggaacccgcttatattattttaatatttttggccatgtgtacaactgaagagaccaaaacactcatccaaccaggttccaaccaaaccaacaacactatcgaaccccatggcagtcgccgccgcaacggtgacgtcgacgatggtgaggaaggcactattcacagcaacttcctctcctcctctgcctctcgtagctggtgtagcctctcccgctccatgcccagtgcttctgccatgccgcacatcgcgctttatccatcggacctactctgatgggtgccccactggcacagacacaatgctcattttgctaccagaagttgtgctaatggctttctcaatcctggttcaattttgggttaattggatccatgccattacaaatatgccgattcagataaataactttataattcgtctattcatatacatgtcattcgaattcgaacaaaattaaaaccatgccatcgccatcgtgttttccatcaccatatagatcaaaatacccctaaacgtgggacccacatgtcagttccatcctcttcctccatcctccctctcttctttcttccccatctctctccatcttgtttcaaatgtgcagccagcaagaagggcacgcctctcatcaccgtcggcatagtcattagcgacgacagcggtagcggggtcattgccgccaccgtcctctcagtccccatgccctcccccctctcattgccactgaggatatgcaagagcgacagacttgctcttaccgactagacacagctgcctgagtgcgcggtggatgcagagccccacctcccagtgccgtcgagctccatggggcatttaaactttttgccactttcagatatggcaattatgaatttgccactcacagtctatgacatgtgggccctcatgtgcatatgacatgtgggtccagtggtaaatccttaattgtcacttgtaatactggcaaatagttaaatatctccctcattgtggctaacacccaccttgcatcctagcacttgctcccctccggctgcaacccaacccaacccagattcaattgaagttgcgcggcatggagcggcggatatagtatataggtatatacagcatataggtagagggagaccccaacaaaattggattggaccccagcctgtctccaaccaaataacttattaaagcccaactaaagaaacaatacatcaaagcttaggttagcccaactagagcccagctattcgtgggaaggtgaaaggaaaaaagtacaccgaaaaaccagatatatgacatccctcaatttacaaaaaccattcactttaggtccttcggtagttttgaccccggttttatcctacgtggcggctgagtcagtgtgagatccacgtggtcaccacatgtcatcgtggccacgtttggcctcctatatctttcccctattctcttcttcctcctctgtctctctctctctcactcttctcttctcttctctaggcaagccggccggcggttggggcggaggccgcccgggcgaggtgggagaggaggaggcggcggcggcggctgcgacgcgggagaaggcgagggctgcggccggtcgcgaatggcatcgacggcgctgcgtcgccgcggtggtgggcacggaggcggaggcagggtcggatgccgcggcggtgggcacagaggtggaggcgtggctgccaggcggagatgccgcagtttcagaatgcgtcggagccggcgaaatggaggtggcgcgcgacggctcccgtggccacgacgaccgtgtcggcgtgcaaggattcggagttcaacgccgacgatgaagattggcgatgctgaaggggcacgaggaggggtcgacggcggtgacagtctcggagaggatcctggtcccgaagcgtacagactgtgcgcagctgtcgctgactggcagcgactgcgggcacgaactggcgggcagttccctccccggccgtcccctcctctccctgcctcttctctctccctctctcacttctctcctcttgggcaggccggccggcgggtggggaggagccgaggagatcctgcgtaacaacgcctagcacgaggcggatgacggtcagcctgatggcgccgtcgttcttggcgaggcggcacgcgaagttgccgacgaaggagacagtgacgagcagcagcactagccatcgaccttgtcgccggcaacaacctcaccgtcccgcgccgctgcgccagcccctcgctgcctcaggtcactgtggtggtggccgcggcgctcgacgcgtgtcacggtatggcctgcctaagaggatagaagtgatagagggagagagaggaggaagggagagagatgacgtggcatcctgatatgtggggcccacatgggtcccacgccgacttagctgccacgtaggataaccggggtcaaaaccactgaaggacctattatgaccggttttgattagttaaggaacgctggatatctgggtttgcggttgggggacaattttgtaactcgatgaccagggaccttccatgtactttttccaaggtgaaacgatgctctgaagtccaaaccgtgtatctcaagactgaattaactgcgtctccggctctccgctccttttcctcgtcagtcgtcggtactcttgacttgagacactgaatcgctgctcttgctcgatccttctccttcgctcaatcactcctctactcagatcaagatcaagtgctgcgcacccgcgcggccgactacacgctgcgtgtaggccacggcgagcgggcattcgcgtacgctcgacttccagtcttccacaagttgcaacttgcaaggtttgtttcctgccattagtccagaattcagattattggattaggccattagttcattcaatattctttagtgctgtcagagtaggagcatcaaatcattttgatttattcaatcattttttttttggttgtccacatgctgcatcgctgcttactgcttgcactagaataactggttggcagtgaccagtgagaagtggttagctaacgttggtgatattgatagtgttcataaccaagcaatgagggattgtgatgctttattgaaaaaagagcagcacattgatgtttctttgaacagccaaagtaatgctgagaaaattgcttattatactcgattaaatggctcaattgatgttactagactcttactgaagcaaggtatgccttttcggggccatgatgagagtgaggaggtctctcaataaaggaaatttcaaggaatttcatgcttataccgcagagcaaaatccagctttacacaattttttttggggaagctttacacaaggttgcaggtaaaaatgctcctggtaatagtaatagtcagtatacatcttcatagattcaaaataacatcatatgttgctttccaaaagaggtactgtgttctattcttgaagaagttgggaatgatgttttctgtttgctggttgattagtcaagggatgtgtcttagaaggaacaaatggcagtggtcctgccttatgttggtaaatgtggcagtgttaaagacagactagttggccttgttcatgttaaggagacgacatctatgtaccttaagtctgctattgatgatttatttgcggagcataagctaagtttgaaacaagtgagagggcaaggatacgatggtgctagcaacatgagaggggagttcaatggtttgcaatcactaattatgagagaaaatagctcagcatattacgttcactgctttgcacaccagcttcagctagtagttgtgaccattgtaaagaagcataaaggaatcgggaactttttttgatatgatttctcttttattaaatgtggttggtggatctttcaaaagaagggatatgattcgagatatatatgcagaacatgtgcatgatgctttagaatgtgggttacttataactagttcagaggtctggagatactcattggagctctcactatgagacactaaagagtttggttcaattgttccctacaatagttaaagttctagagtatatggaagagaatgacagggatgacaaaaaattgtgttttatttgcagcttatgttgaatatcttggcaatcgcaaacaccttgtctgtaactttacaaagaaaggatcaagacattgtcaatgctattaattgtgtaaaatcaactagaaatcgcttggatgagtttaggagttagaggacgattccaactcatcctcccgcctttatatttcccttggccaccatagaacaactcgggttttgtttagatcaaaatttagctttggtatttttccgtgtaatcctgtcatcgattagaacaactcgggtttgcttgttacggaaccccatctgtgatatttttgctgattcaatcctacatctttatttgcaaatcgagttgcctgttcatctttttcttactagttctcgattgcttgcaggaacaaatgccctcgtggttgggctaaccatgcatccgtcgagattcatgactgcctctagagttggtgtaacgattgcaaaggtgtaacgtctctagatagttatagtcggatctccaacgtcgctccattcaatcaaattgtcctctcatcgaaagatcgggacaccctcgtgcgcatcaccttaagttgcattgtgcaaccagcccattaaggcctaatagaggagaaaatatctcatgggcccgaaattctgtgttttacatccaaaagttaggtttacaagtatcctatatattcttctaattatccctaatatctacactaaatgttttatttcatttcttaatgttgttctgtttagctacacaactcacggtcaccgcacaaatatcacggttaccgcatcaaaccgtgcggtaaccgcgaccaaaccatgaaactgcaaaatttggaattcaagtatttgctgatgaaattcacacggttttcggcggttaccttgtgcgataacccccctccaaatggtaagggaaaccctgctcatcactagcaaggcgagagccgcaagacagaatattatagtaggattcagaatttgattacaaataaaacaacaaagggcttgttggcttcattaccaaaaaaacattactaccatttttttaatgctaaagtttagtagtgttttgtttgaggtctttctaaattctaaattctagtataagttttgttagagttgcgttggtaattatatgtttagttgttaccttataattttggtattaacaaaatttaaaatggttgaaaatcattataaggtgaacatgaccgacatgatctacttcatatgtcccaaattaagttaatccaatatggtacgtgatatatctagtactacgaatttagtactagaatatgtcacatttcatacgagattaatttaatttgagacagaattcgaagcaatagcatacgtactatctagctggggcatgttgggctgctcagctcaaacctgggccaactaaaaagcttccatttgcagttgtacgaatttaggaagaagtttatttaggtccctcgtctaaggatcaagtttagaccacatctctaaacagagaaattgggtagaacacattcctcatcttccaaaaccagtgtcgatatagtcccacaggtagtttcggctgacgtagcacccgttgtgcaatcatgaagaccaagtcaacatgtcaagtgggtgccacgttagttgaaattgccatccaaaccgcctttgggctatatttgcactaattttgaaagataagagatgtgttgtatcccttttgcgattaagggacgtgatctgaacttaaaccttacgagagacctaaaatgaactttcttatggatttaaaccaaacacctcatgtgcggatagtgggctgcagtgagaaatgctccaatgtgtaagatttatgataggttaaaattcaaaataggcatcttattatctatataccactttaaaagcttagctattgtcacccacaactgctttcatcgtaaacttttcttagtattaaaaacaactaaatataagtggatagttacatgtaaaatcgaaataaggcaaatatgtcccacaacaaacaatgggcaacacacttcgtgaaaaatacatttatccataccaaagtacgggtagctagtcataattaaaacaagggaaaattccctacgtatccttaaaattttccacaatctcttctatacctctaaattttgcctcatctcctacatgctatgaagttttcattttgatcccctctatccctattatgttagttggccattagtttttcaaaatgacgatattgcccctttgccatacttatttgctactacttcatcataaatctcatgtgaaaatttgcaatttacaataacatcaaattgagacaaaattatttgatgtaaaagttgaaaaaaattcaaacttttgaaaagaatttttttttaattcccatttcttggttctgctggtttgctcattcatttcgaatccgtataagagtttcatctagaaattgaaaaccgaaattattaattttggggttttaaattttagtgaaatgctctacgaattccatgagtcaatttgaaatttattaattttttttaatttatttctaaaatttgtggtgaaataattaattattccgtttgtgttcttacaaataaattctttaacatgagaattgtgttttgtgattaaactagaacataagtttgagagaagggcaatatagtcaatatgaaaaatatttaacggtgaactcatggcaactaacgagatggatataaagaggagattaaaatgaaaacttagaagcaagggatacgagaaatttttgtggacacatagggaatttcctataaaaatatgtaggaagtataaaccaaaaactaggtgtaaacatgaccaaacgtacttctttctaattgtacaatttccattaactatgtgcatgcttagttgatgtagaggttggatatatgtttatagtctactgaatattaaaaaaaatatatgcatttccatcttttaaaatattttggcccaacagttggcaaactatagatgatatgtcaatttttatggactacgttgcgagattttgtgtaaaaactaattacaattgaaaaggagtgcaaattgcactctgggacaaatttcaaaagattttgctttcaaagagtcagcaaacattttttgggatatatagaaaccgcgccaaacgattttcttgcaaacatttgaagacctctcaaatccttgcttggggtaaagaaatggccttgctggccatgtaaattggaccgcccacttgcattatacatatataaaatatatctacaaataaagctcttgttgcattatgactaagactgctatatcccaaaatttcacatataacacaaaaatttacaacaccgaattgggtccgcctaaaaagttatatatgcaatgcactggtatgtgccttcacgttctgaaatatccatacaaacaaatcggctctcttgactgccaactagtcaaggtgagcatgaacctgacaacacctgcaaaacgtaagccaaatgaacaattgtccaatcaatcaatatctattactctccgcgtcccataatataagtgattttgacttgtttgcttcaactgtttgaccattcgtcttattaaaaaaatttaaaattattatttattttatttctgacttactttattatccaaagtactttaagcacaacttctcgttttttatatttgcataatttttttaaataagatgagtggtcaaacaatacaagcaaaaagtcaaaatcccttatattatgggacggagggagtagcagcaaaaaatgagttgcaaatcatttaaagacctctcaaatccttactcttttgggggaaaatttgttaaaccaagaacaaatcccaccagaataaggccaaaaacaaatatcgcaccagaggctcagctcagctgctcttaacgtttggtatatgtccctcttataacattttccttagctttaagagaataatgataggtgtgcccatacctctgcagtcgaagagtagcacggcattgcttgtatcatgctcaagcgcaaatattaattcaaaaataattttctgagacatcatcatgcaagtgtatctagtgtcgatcctttgatgagagcatttgtcatctaaccatatgataagtcctgaacggtacgaccactagtgttgcgaggggcatatggtcttggtaccttccatctcagcaattcctgaagaatgttgacagaacccttcatattaaccaaacgagactagaaaacttgctcaatactgtaacaagtagttagctgaacatgtatacatatccggatgactaaaagaacaaaatgccattcctctgtacaacacggagaccttgataacacaaagctaagccatgttgcacgtgataaaagaacagtacgcatgacatgttattatatgtagaacagtacaagttgccattcacacgctcctactcacaagaagtccatttacctttgttgattttggaccataggccttatacgctccgtcaattgatgagtaaatcagtgtagcttgatcagacccacgattacacttgaccaaccgaacacctccctagaatttgtgggcttagctttcaggtacaaaataagctttgaaggtaaggatcctggagcatcctttttcccatgggtcatttctacagtcaccaaatcatcccacaatacatcccagattacaagcacggatcctttgcaggactgaactttctctgggtcatcattgggacctgaaatacaatcatatgataaatagaatgaacagtacaaaccgtaatgtaactagaatctacgtttgtcttacctgaagcagtagtactcttctgtgagtaattaaaagaattttacccttaggtagcataaaatgatcctcataagcatcagtagatgcaaactttccccggactttgaaaaggtcaacttggccaagaaatgtagcatattcagctaattgtaagatagcctaaaaagcaccgccaaaaaggattaagaataccatttgaaacaaatgagatcgccaccggcttgagggagagaatgctagttacctggccagctgctttatggtcgtcataaggatagagcaagctatcaccaccaatggctcgagggagacgcctacgagccaactgctcctcagccattatagctgatgatattttcattttcacagcatttgcaccttctgtagttttcgacaaaagatcaagaactccactcactggctgagcggctgcaccaattaaaccttttccgacaccttgcacaaagccctcaacaccagaagattttgcaccctcaatgggctttgtcaatatgcctgtaacacctctgaagatgccctttgcgagagccccacctccatctcgtatgacatcaccaaagtcttccactcctttgctatcctggagaaacattacgaaccacaaagtacatgttatcataacatactacttttatacagttcaatacatgcatacgtagaaagaaatgaacctgtctcattcggccctgaatgaatttcttgtccatggataatgctgctatacccttactcatattactcaaagcgctacttgcattgccaagaatgtcaacacccgaaagtaattgaagaggttggctgagaatatctttctgaatgttagacatagcagaactcattagtgcactttgtctcatgcacaattcttcccgatacctttgagctatgcggaccttcattgttaagataaaggaatcagtgcttaaaataattagagtagcgtacatcagcgtatagggacaataatgtaccatggcatgaaagtttttctcaaacatgcataacggtatgaaagtttgcagaagataattgtaatggaaaccaaagagagggagggagatattataaaaaagaaagactagttaacaacatttaactgattccctaccggcatgtgctccatgtttcccagtgccgtcattaaggaagaccagaacccaagaacccctctcggcctctgggtaggggacattgccattgagactctaaatcgtatttcagaaatattaagaagcctgcaacaaaagatttagtaccaacaacagggaaaaaatataagaaaaaaacacaacatgcaatagtgtgcgtacccaatcttcagtatagggtcaactgagacagcagaagactctgaactggatatcctatcaaattttaggttctgaatcatctcatggaggcgccaaataattggctcatggatattaacaaaaaacacacagttctcaggaacctacaagcattacataattattatcgcaacaaatatttaaagacatactccctccgtttcaaaatgtttgacaccattgactttttagcacatgtttaaccgttcgtcttattcaaaaaaaattaatgaaatatgtaaaattatgtgtacatgaaagtatatttaacaatgaatcaaatgatatgaaaagaataaataattacttaaattttttgaataagacgaatggtcaaacacgtactaaaaagtcaacggtgtcaaacattttgaaatggagggaatatatgataacttcatgtacaactaggaaactgtcatgaataaaacccaagcaagaccaagtaaaaaaaaacttactcacacggctgtttgataaagctatgctactcaaaagacaatctcataaggaaaaaacatctatgtgaaaatatctatgttaaaataagatttattaataacccatgtagacagatcacctgcacaccaagatatggataaacacaaaattcgagagaattattggtctgcaatgtcatagagaacttgatgatgtagtctgattgattctccatcctttgaggacaaaaaaggacaggcataagaacgaaaggtaactgattgtccacttgaatccaatgcatctgcattttgagcctgccattaaaagaagcaacaaattgaagtacggaaaaaagtagaaaattttgagcggaaaacagcaacctagcaaataaccaaaaacacatgattgtcacctattgattccagagcccattccagatgagtaggctagtaatagttgctgcactgagaggaaaagaatttcctcaggcatatggtcaattatggaaagtccaaactctgttagctccaaagtaacatgaaattcactatccagatctggagatgactgcccactgtcgacctctgatggctgaaatattggtgataatagcctttctgttgtctgttcccgagttctattatcaggcagccaatcattaatttgggtaacatgaaactttccctccttaagaacagtgacacgcaaagccttcttcaccctgcttgatgcagctagcggttggtgatccatgacaacatcaatgtcatatgtcatggaggttgtagggtcacttccatctactaatacttccaaaagacgccttctgccaatatcctcccaaaagaaggaagccgatgaatttggaggcagactacgccatgaataatcatcaccaccaacctgccgaaaccgtacaggcaagaacatggagcggttctctaccctgcatgtattgtttatattttattttagatatgtacgatttatgataaaataaatttcgtgtaagtatgcttacctgtaagggctggaccagcaagcgagctgaaatacaacttcataacgtgaacattttgttccacttctaacgtttactctcaccaaagcttgatcatttcctgtagtgttgttcatgagcacacacataaccccattagcatcaatgctaaaaggtgtactccatttgtatccctccaaccgcaactgcaagcgtaaagaattgtgaggttgagaagtagaaaagttaataaccaaaaccatttatatgtatgcaggaagtagcagttcagagtataaaagttaacctttaaaagttcgttcccaaattctgatcgccattgaaacgcttgaggaggactacttggatgtaaatgctcttcagtctcactatgatactcagataggataatacttcttccaattctattgataaaaagtgctcgtgggagaaaatttataacctgcattatcagtcaacatttttctgaaaaccttttatgttattacataatttaactaaacatagtgaacaaggacagaatactctttaacaaacaattcgaggtgttgcatattgcattcccttgagcagtaaatgaaaaacttgaaaaatcatatatgtaaaaatttaattgttgtaaatcatatatgtaaaaaatttaattgttgtttcctatctctgaacatgtcctaacacaatattaggattaattgctttacttgcttccattgcaacttgctggaactttgtcaacatgctaagtaatatggtgttttaatctttcaaatactccatagcacagtagtatggtaaatgacctagtttccatctagtaaattcttttgagacaacattcaattgctgaacaactttaattgcgaaaaataatcatgctgaaccaaagtatgaagcaatgaagatgtgaagacacagaatcaaaccttagttctgtctgaagtcatcttcagctgagccgagaaccagtaatatgacccatcagaagtaaatgctttgacatcaacatgctcctgcaccagatgaatgacacttgaagagaagataagcaatagttcaaacgtgtgtaaaaccacaaactataccttgttctcaagatcaaaaagggacactcctatactgtattgtttgcaactgccaacagccacacaaatcgcaactcgtgctgggctggaattgttatcccgagattcaaagcgcacacctgcagagcggttcatgtaatcctgtggcgacaacattacatagtctgtactacaatcttctataacctccaatatgtgcatatttctctgtgccactgggcctcttctgataagagattttgaagaatatctgagggaaaattttgaagatttagctgctctgcttagtgagtctggtctgctaagtgactctgcatctgagttttctgttggttccacctcaacgatgcgatatgatagtggaattgaagaaatattttttatccaatatggaacaaataatctcagtgtcttcggtgcagcatcacttgctcccagatcatgttcaacactaacacgaagtctcctaatatttgacacaagtaaaatgactagaaattatgacatatcaactaacaagaaaacatgaaacagtagatcaactgcactaacactcttttttcaaattgtgtcttaagaaatatatgagattaccatcaataagcctattaaaaccgtatctttcacaaaggcataagtagctaatgaacaagagaattttggaaaaggacccatttttaaattggaataataattaattataacagtagtccctagggccctccttcacctgacgcttttctactacaatcattttgtatgacccctgtaataaatgtatacacttgctcttaactaacattcaccaaaaaaaaaaggtattagagcaactaattttgacccgatcatgcatagagaagaccatgactaggagaggaaagtcctaatagtgaagatcctgaaggtgacaagtcaacagaactacagatagagtgcagtgaaagaaaaaagtagttcagaaaaaatggtggctaaatactagataccaccaatggttcaaatcaaatttgcatagtagtattgtatatgttacagattagaaaatgcagtagggtctattccaaatatgctggtaaaatgagatgggcaaatatgttggacatgactatgttgtttgtttgcactgttctggctgtgtttagaaacttctgtgttgaattgaaattcatatcaattgtttagataaccacactaagcaaatgaaacactaggggtactgttaaagcttacaaacctctggctcctattttgaaccatccagaatgaagtaacatgttccagggacattaagtccagtattaatacagtgtcctaaaatgaaaatgagaaacaaaaggttagagaattaaaacatcattttgtgcgttgagcaactttatgtgagccaaggcaaacatgttcagtcttgccatatagataaagcactctttaattccataagtaatttatgggaacaacacttttcctcagaagataaaacaactagtgatgactatcaaagcagggaagcacaatgtgcattccagcagattcatcacatacgtgtagtctagaactctaggcacattatgataacaggcaccatggttaggcttccaatgtttaagttatattaccttctctataatccagccattttggacaaacatagttaggtaaattggtttccggatatctgctgaatagataaatgcacttccaccagacgagacaataccatgctgcctttcaaccatactaccttccgtggacttctcccagatagcatactcggcttcatatggaagcttattttcgagtctaagaattgagttgaaacaaattttccagtcataaataggcatatttaagtctgtgtgaagaatggaagcatcaattccaacactaagccagaaattttgtttaatgccaacaggaggacagcaatatgaaagcatatcctttttctcaagatcagccagtctaagaactgaattctttgagggcacagatgactgctttaaggtgctttgccttgaaagtgaagattgttgttgcttgggaatgctctcagaacctagtgaaagaacctgactccaactatatgattcctgtgatttttcagaaaaagggcgaacttgcaagcacaaatccatatccttgatcatcgctgtccaaggcaatgcagtagatgcatgaggctccataacagcaattattttcctaggaatttctgcactttgttcttgcattgactgccgtgaacgcacccaccgccttcgcctaacaaagtcatgtggtgatttggaagatttccaggaagatggccagttcaaattttgaaaattggcagcatacgcccatccatcactatccacggaactagatatttcaattttccatggtgacgtccatttccagccaggtggaagacgaggttcaaagaatgccttcaaaataaatcacacatttctctttaggaggcaaccatttatgatatatttaaggatattttgcatcacaaaaagccaaagatatcagcagaaccttttattaatcaagcaaaaagaatttcagtggccaattagtctgaaagaagttaccttagatgagtaagagccgtcctttgtgctccatggccctacatcacaaccctgatcactagcagggttacttccccaccctgaagttggtcggtaccactgattttcaaatacttcatcaataatgcttgtggaactggtggaaccagcatttgacacagagctactatgcatggttacaggacagacagatacttcaagctttatgtcaaaaccatttgcaataatagcaagagcccttaagcttgcatgtttctttccattcctcatggtgacctcaagtgcaaaatggctgttgttaagtgatttggggatggttgacaatggcaaagctgcagtaaaacattcccatggaccatctgggccaagccctatccagaaaccactctttgcattgcttaagctgtctttccagctctggaagttcgtctgcgtagatctttctacgtaacaacttgaaagtactaacataccacagtgtttcacattttcatgattgagtgcttggccctagaagttgaagcaaggagctcagcatatgaagtgacaagcagaattaacccaaagttcagcaatgctatttgctcacaacattgcctatataaattagcagtttaaagaacaaaattaataccttccttgtaagaggacatgttagcacacgcttgacatcagcagcttgctgaatgatcctcatagaagcagctcgtttcaatattgttgcaccccgtccaataggaattgacaatgaaccaagtacttcaccttatgcattgatggaagatgttaagaaaccctaatactattggatcaacaattacaggagataacttaaatactactatattacagtaggtgtatccttcaaataattcaggttctaataactcaagaagttacctttcccagcctttgatgcaagatttgttacctcaatctctaaatgagcggatgcctgcaaagtaaagaaaatgaataatgcaatgctgctaacaattttgcaaaaaaaaaaaacatagagtaaactggaatggtactatgagacgtgaataaaaatggcaggtcaaattacctgctctggcacttcaaatataaaatgttcattccacttagcatgatgtgtctgtgattcacaagttttcaaaggttttacacatcttgtcctggcactctgagggaatatcttgtactggtcagaaacatcacttccaacaagcaagcgcaaagcacagaagtagctgtgatcattgccatcatccataataggcaaaccctacatgagaagaaagcagttagttcatatcaaaagcattgtatttgaaaagcaaaacgcgtatctgagtatgaccttggattcaaagatctgtatgataacataatatcttgattccgtagaattggacagtacacttagtttatcagaaaacctgggaggtggcataaacaatgagacttgattctcatgctgtagcagctcaataatgtcttcattgtcttcaagtttcttaacataaatatcacatcctaatttgttctcaaaaactattctctgaaaatcatcttcatccaaagcagagcaggacaaatcatcagcatttttcacactgtcaactgtatcctgtcaaaagggtacacatgctatcaaccatgaatcatgctgtcaaaaagcacagaaacagaatcatgaataaactggagggataagttgaaacctcattctttattgatgattttttttccagatcgatttgtcttttccatgaaattaaagtttctataagcaaatcaagatttgcagaactcaggttgacatttagaggacttgtggcagcaacacgaatcctcttaccgacttttgaaggagggtgtttactggtatcatatgtctcaaaccttcaattatgattaaacaatgttaagttagtggcataaaaatctagaagataatgcaactttaagttaaaataagcacaacttacttgaatatcccatcaaatggctcaacaaaaggttcccatgcttccaggtgtctattgaatgttgatgcagaaatcgaacagatcaatacagcattcattgtctcaaattttccatgtgttgcaagatttatatttgcgattgtagtgtcaaaaattggcgtgacctaaaattttggaaatatagttggcatgtagatagaaatatttgaatgatatatattctcagtccaaaaaagaataaaatttagcatgcgtacacaccattccacaggaactgtcaagaatgctgactgacaagcatccaaacttcagctcagcagtaatattttcccgcacctttggtttagcatggtctgctattctgtatgccatttgagctggtggttttttcgtatcagatgttgccaggaaagtgcagccctaaaaacacagcaaattgattgggttcctataattacataagttagaatgatgcaggtataatggattacctggtttgaaactttccaaatgctccagcagttaggtcccttcgagctagaggacctggatataggatcctctaagatatttgcatgattcaccagacccatcttcggacagcaaacggaatcattgcttggcatttcatctgtttttgttgcaacacatccaagagaagcatatccaggaggcggcactggataccagaagaataatatttcatcagaaccctttctatcaatctgggctacttttttaaactgagtaggcctttcagaaacaattgcgctgtcgcacttaaaaagaataccaagagtaggtggttcaaacctgaaagaagcatcaagcatattaacaacgtaccacaaagaagtacctatgtgtgtatataaagaaatcattacccttcagttatacaatcaccaactgaggaaaacccaaaacgaggtattggccgccatatagaaaatggtctttttgtatctccacctttgtcccaccatattctttcaaagtgtggagtagacatgcaatagctgcttggccttgacaaatttctaacagcatcccaaccagaagtactcttgcgatgagttaactgatcagcaggctggttactccgaacagaagaatctgcattcaaatctttaacaatatagcagttgggattccggagaagaacatggtgcaaatcaagagcttcaactctagtgggttgttcaatagaattgtgtgcatggaaggaagcaatcacattgtcgacacgccagatgctaaatccaggagttactctgcacaaagaatataaacacgatgaccaactacatgttctcagtgttcataattaaataataactaggcactcgacactttccagggaaagaaaataagaaaaaaaaatattgcacaacaaaacaataaaaggatgttgccatacccaggagtaggtgagagagtgtggatacaatcagaaaaagctgtagaagtcacaagatctgagcgaaggcagtacactacgtgatttgaaggtggttgtcttccaatattgaccacacaccctagagctatgtatccaggtggtggaacaggaatccagatagaacactcattgtcctcagctgcctgagatgaattcatttgctctagagatacaggtaatacatgaacaagcctaaatccaagaggtttccgtacacggccataggtattacttacagcaaccacaacctgagaaggtggcacacacctgacaaggtaaagtatcagctttggcaggacaaaaggatctccgtaaaagagaaacatagttcagcgtatggaaggcggtattaaaaactattcgcattcaattagacgcaagccctagtattcacctgggattccgaacattatacacatgactacatataactgttgcagtagctttaataatactcaaataacagttgacgatataggttctcaagtggcaaaaattaccttgaggacacacaatcacccaaaataacataatttgaaggagcttgtggcctccaaaaggtgagattgtacccaggcaactcacctgtggaatttcatcaaagaaggtaaaaattggtgtacccagaagagcaaacagaaaactactataatacaaaagcagctaagctaagttgcagaaaccatgaaaaatagtaagagttagaggaagtagcacacaagtaccattaggtgatgtccaaactcgcttaaagttaatacaagaaaccaatgggttattattgccaaactgcaatgcagcaagagtttgattttgcagtttgagcaagagagaagccacactcagagaaagatgaatgtatacatcagtagatgcaagtactatgtttgtcttttcactgacagaagtatatttccatgaaacatcaacaggttcaagaacaagaagaccagagccagcttcgatcgtaaggtctttaacaactgatcgagcccatatgtctttttcctttgaggcatacctgttaaaatgcacaacgattttatcaatcaacagagaaaactgacatgtatacaacaataaatcgacatattgatggcttagcagaggtaatgtaatgaagacaaacatgaaactgaaatccatcttggcgcgaagaagcttctcgatgtgcaaggaatcatcaattgataactttgaactgtcgtaaaaggtaaattctggggatacaacctgaatattccagaaatgagaaatgtgagacattcaacaccataaatgtgcataagtccagaatcaatacacttacaattcaacttaataagagcaaccggatgtttgtttttaagtaaagaagaaatgcacataatgtgagtagggaatttattccatgaacaaaacagttggtgaggagaaagaaacttgttaatgcctgtttgtagactaaggaagcaacttggtacactacgggtaattgtccaatttataattatttaactaccttttcttatactcttcctttttcataaaatttccagaagcaaacagtgctaacaaataatgaattaggagttaacgcaacaaacattacacgctttcccaaaacctactgtggtgacataccacaaatcctacaactctgggcactcttccagatagttcatgcaccatgctagttcaccacactcggtcactcaggcttatatccaaggtttcaattgctaaactttttgcaggcttgtaagttttaccgtcttaagaaaaagaacagaaaaaaggtcctaaaattacagaaatttaagcagtatatactatttagcaactctcaaaaatacattagaggagcttgcgtaaaatctaattatgtacctgagcctcaaatgtaaaattcagcatttgggccgagggggtatctgcaccaggctgaagagcattaattctcttatattcttcattttgcgtattatcatcttcattatcatttagagaactttctaatactgaaacttcaacgccatcttcagcagaaattgagtagctgcttccagcattcaaatatacacacctccgcagtaatgcaccgttcttttatgaaacaaatagccaagagatgtgtaagtttggccaaagaataatagtgagactggcaacaggacataaaaccataaaaaaaaatcactgagcagatacctcaatcttaacatttttgaatctaagttttttgccccgccccaaaataattatagtccctgagtataactggcccttcttgtcatattcgtcacataaagatatggtgcctccacagccatcgtaagtgaaatcatcaatatcgcaaccatcaactattagctgcctcccaggagatagttgaataaaattctctctctgaagaaaacaggctcacaaagtatgatgtcatctgacttaataagaggatcattctttggatctagactttcctcccggccggttattgtgcctagatttggaacaaaaaactcaacaacaggcagcagaaaatccaggacaacaagtacacgaggttcctgaattcttataacaaatgactgaaaggaagaacgccatcgataatccaatatcaccatggtgaggttggaaacccccacatcagatgaagggtcctgagtactcagcttagaagtctcagaataagatccaagcataaggcgcatctcggactttgtatctggcggatatcatggatcaagaattttagtatagacaaataaaggtccatctcaaatagtgaagttgtcctataagaaacccataaaccttccagctattaaaaaatgaataaaaaagtgtcagtaataaccaacatgatattaacacacaaaaaaaaaggcacacaaaaagtagtacaaaaatgcagatgacaaaggaatgatatatttatagtaccaaaaataaaaatttgcagaaacatttccctctgcaacagcacaagataactcaccacaagctctgctagaggtgactcagcatctggaccattgcgaagctcaaacaatgcatactggacatccacagtcattactacaacagtacgcgatagtaacaaatggttgttgagattaactttatctgcaagtagacgaattgaatcttttgtccgatttacattatcacggaaacctggggggaggttgggcgcttctgataggtttgtcgaaatgcaacttgtgatgacattgtattccttatctgacatgataccatggagcaaccctatctgcataagaaaaaaaatgataatcatataaaacacttgttttttttgcatttttccactatatatgaagtttatcagcccagttcttttctgacgaatggattaatgggcatgcttcccgagctcctaaacagtgcgaatttttgcaaaaactctctgaatttcttagaagactgttttaaatccattttcaatttttaacagttaattcattcaggtgtactcaatagaagagcttacatttcagatctaatgcaaaaatgaaactgataaactgagtaaatcaaattatttagagtaaattccagaaaaaaaatctgtgttttatgttcaaagttgcacttgcagaaaagcacatatattagaacttgtggcacataatatactcattttttacactgaaccagtaacaaaacctttctggagattgatgctacacagtaaagctattctccacttttaatagagcttttaaatcatggcctttgaagtgaatcattccacagataactaagtccaatctaaagtatgaaacaatggtgataaaaaagtgagataatcagcaatataaaagtactgtcacgtcacaagaaaacacttttaagtataaaaacaaattaatcacctgaaatttcatgcagagcatcgggacccttttgaaaacatcccgcaagctacgtcgcacttctatattgatgccatgaccttctctaatcatactctttcctagaataccattgactccaaccgccatgttgattccattaatctatttcagtatcattgaagcagaagaataagaaaactagataagcatactgagattagtaaagtgaccaattttccattccaatacatacctctgcttgaagaatatcaaggcgtacagcagaaggatcactctcttcacctccacgccagcaaaaaccattcctaactttcagttgtcccagatccagttgtatatagctgcagcatgatatgaaggtgatgtcaagctttctaagtattattaaatcaccattatgcttcactaaacttgcccacaatcaaaataaaaaagtgcggactaaaatgaacaaattagtatatgtagacacaggtataagaaatgtgcacacaaaatgcaaaaccatgtgcctttctccactatgattcagaattgcacacctacaatatatggtgtagatttagactacaaacaggaaatttcttatctacctgatcctaaagaactaaatcaactaataaaaccaaaaccaaacacatgtactggaaaattgaaataagggcatactctttgctctgggagttctttggaacaataattatgggtgtgtcaagtgaaagatccagctttatagcagaagcaccatctatttcatatttctgaatcaaccactcgaaacctccaactttgtcgatgaacttgattgcttcttcagtgtgaggggtggcaagctccatgaagtaagaggtgaactgcaaaatagaaggcactttcagaaagatgtacatggtcatggataacaagaacaaacagcttgcaagtgtaacacatacctcctgaacaaaacgataaaggaatacaattcgcacagcagaaagttgcccaatcagactatagttgtaaccttcatagtcatcatcgtcaacgctgtaagactggaacgcaaactgcaacagagaggaaacattaagatttcagtattttgtcggccacaacacaagatagtcttgtttagtttgactgccacaaccaaataaattatagttagctcttaagaagattaaaatggtaaattagtttgcatagagtacaaagtttgagatggaaatctgatgcactgtcgataaagagagaatcaaggttaaaacagaggataatcaaccattctaggcagattcactgatgaggtaaaaacccaggtacttgaacagatgatggaacacgagtagggataggtgacgaaatcaatgtgctattaaacaattaaatatatatggtcatgttggaaaactattttaatacgaagttagttaattggttgaaagcctttctttttcaatatcaatggacaaaagctctttgataatctagtcaaatctactatttgaatctcaaggcagcaaatatgattatacatgtccgcatcatactcttcatcttgctaacctttacaaaacaaaaagtaagcatcaatatacatatttgatagtaaaatggcatacctgacagcctacaatgtactaaagtattgaagagatgaactatgactactctattggtgcagctgtctgggaatgaacaactgacacctgtataaaggattgcaaaccaatgtcaataatacctttataagagattcaacacctggtttccgtatatcacatagccaaccccaacgatgttctggcccaagagacatgtcacaaaatctcatattacccagcataccatcaattgaaaatgaacctggatgaacctgatatataaaaaatcagaagaaacaatataaaaacacatatgcatgcagcttaacaatgaataaaaagaaaagacgcacaataaaattctaacaggcaagtaatcaacctaaaattttaaatgcaacaacatagcgatcttgtcctagattgctgccttcatggatgattttggggggaacatcatagttttaattactttagtaataatttataaattgaacctttcatcaactaattacatatgctatcaccatatcctagataatgtcctagattgccacgttcatggaaggttttctagggaatttcatagttcttgaattactttaataatattgtatacattacacctttcattaactaattacatattccatcaccagatagatgttctagtatattactttgataatttcattatttagtccaaatacattaacctcaccttcagatcaaacagaaatttctcctgcacaaacatcgcaagctgagaaccatcttccttgttaagaaacatagatacccgatccacatccatcttcatgttgaagatagttcggcgttttccatagcctagcaaacctttaacaaaattgcgagcattatcttccatccctgtaggtttgacgttgcgtactgcaggtgttgtatcagagtcaccctttggggcagaattaaccatgctaagatcaaatccaaactcaatcagagcaacaagagttggtctgttacagtagaattccagtgcagacatacggatacacatctgtaaaaagcaagatacaaaaataatcaaacttcacagagagatttacaatctaggaagttaaacatatcaacaagatgtacattttgtgattttaggactagatatattgcttctatagttctcgcttggaataaatctatgtaacagtaaaagatgaatatattaaattacctgcgaatctataccatcataaagacaagaatcaggagtcctggtcaaaaatgtaaggacaacaaaatcgttaatattattgtcttgtgcctcgtaaaatacttccgtaggcttcactttctgctgatccccatcaaagcttaaaccatctttcgaacttaattgagtatgcccatctggatcaaatattgagttggaaggaatttccaaatcttgaagatttggactttggtcaggagtgaaatctgtcagcgcatccatgaaagaatcttcctcaacagagaaggattttcgatgatcctcctcatcaggtgaactagaatctacagtttccaaattgtcattgataacagagcatgctagataatttgaagacatagagagacgaccctgaagctcatcctttatcttcaaagaatgcagttttgtttttacactcaaaccacgagaagattgaacaacattaacctgcaacattatatgaaatataagtgatggataaaaagaaatgaagacaagacccagtaatctagatctataacaagcactgaaacaaaaagctgtgaaataaaatctatcatcaatgcacagatctagaaaacaagcatcacattcatttgatagaaggaaaataactctgctcttgtatctgttgaattgcatgtgccagcccagtggtcccagccagttcaacccaaaagcttaagctgatgagcaaaggtgcgattcacttatacttcaacactccccacgtggaagctccctcaggcctcagacatgcaatagaagtggactacattttttttatttaattgtgtcatccaacattcaaactcgagacctctagctctgataccatattgagttgcaagccagttcaacccacaagcttaagttgatgagtgatgaagcacgcaggcaatcacctatacctcaatataagcatatgaaggcacaccagactgaagttaacgagaagagcaagcaggcaggactatgttgtgagtctgccacaacaagaaggcgagaaggcgaaagaaggcgaaacatcagtccacctatacagaaggcgaaagaagactcacaagaaatgcagcatgccaatctagcagcaataaagaagtctgtctgaaaggcaatgtcacaactaaacactaactgcaagagatgaaaaacaccgaattatggcaaaccgtctggcgcctttgctccctggtatggtttctgtgaaccaaagcgcttttgttaagcgtagaagcatacatgacaattttttgcttgtccaacaaatggctagaaggctgtacagtaagaaagaagcccatgttatgcttaaacttgatatttcgaaggcttttgattcggtcgactggtcctttcttcttgaagttttgtgccatttgggttttgggagacgatggtgtaatttgctttgccttttgctgtcaacctcctccacaagagttttggtgaatggagagcccggcaaggatattgctctttgtagaggcctccggcaaggtgaccccttgtctcctttgctttttatcttggttatggacgtgctgaactcagttgtagtgcatgcggatcatggaaatctactagaacctcttgctgtcccgcagacagcacaccgggtttctctgtatgcggatgatgtggtcatgttcttgcgtcctacaagcggggacctatctcttatcaagcagattttggaggtttttggtcaaatttctggactaagaaccaatatgacaaagagctcatgcactcctattcactgcttggaagatgatctagaagtgatttctaatgagttgtcttgtgaagtgaagaatttcccttgctcttatctcggacttcctcttacagtccgaaaaccaaccaagacagatttgttgccccttgtggacaaagtggcagataatttaccgggttggaaagcctctttaatgaacaaggcaggtcggcttataacagttagggtggtcctcttggctattcctatttatgcaatgatttcgttggatcttcctaagtgggtggtcaaggctatagataaaaggcgccgcggcttcttatggaagggaagagaaaatactaatggaggaaattgcttgatatcttgggaccgtgtgtgtcggcctttgtcctatggaggccttggtatccttaaccttgaaaagatgggatgggcactacgcatgagatggttatggcttcaaaaaactgattttgctaggccttgggccagtttgtctattcatgtgcctcagaatgtccattctcttttcaatgtggctgtcaaaactgtggttggaaatggagaaaataccatgttttggagtgataggtggctgcaaggtaaaacagtagcagagctggcccctaatctctttgcctcgatctccaagagggcaaggaagcaatgtactgtggcgcaggctttggaaaacagaagatgggtggctgacatacatgggggactatctgttcaggtcctttatgagtacttgaccatttggtctttggtagacacaggtggttctgctacaagatgtacaagaccagcatgtttggaagctaaccgccgatgggatgtatacttgtaaatctacctatgaagcttatatttcctgggatcgatcaagtttgctccttggaaacgcatttggaagagttgggctcctcttcgctgtaagttcctctggttggccatcaataatagatgttggacagccgacaggcttgcgaagtgcagactgcagcaccccgcggccggtcccctttgtgatcaaagtgaagaatccatccaacacattttgatctcttgtgtcttttcccgccaagtgtggacacctctgttcttgaagctagggatctctggtatagtgcctcaaccttcatccgattgttttttgaggtggtggagccaatctacaaaataccggccaaaggacgtgcgaaaagggctcaactccttggttatcttagtggcttgggagatttggaagcatcgcaatgactgtgttttcaatggcactaagtcctaatgttgcgacggtcttgcaggtggtcgagaacgagggtaatctttggtgtttagcgtgggcgtctgccctccaaagtttcttagtggttcagcaaacctaggcacctaattggccggggttggccggggcgtgggtgtgtaggaaggttttggtatctcctactttttttttcctttatttttcttccccttaatgaaatgaaatgaaatgcaattctcttgcgttttcgagaaaaaaaacaaatattaacaactccatagttttcgagaatgctttggcacactaggccactatccattgacaagagagtaaactgggctgcaggtacttattcttggtgactgggtatgatatatacaatgcaaattgcaaactgggctggtggagaaacttgacaagtgtgtttttagccacatgatgtgtcatcagaaattatgggctacattaactgaccacctgggcaagaggcacacgtgaagcttgccttgtccacatcgcaaatactcagctattgcagcaaacctagcacaacccactgacttgctttgcaacttcttgtactaaattgcaccaactagcttggcaaattattggaccaaatcacacatactcagctcataaactgtcttatccaccacaacgctaaccaatttgccattaacatggaaaaataaagaggaaaaaaaacacctatcaaacaagatcaaaatgttattcagaacttagcaagagtgagtaattcataactagatacaagcgcaaaaatatctacgaagtacacatactagatatctatctatctatactttcaataaagttacaacccacttgatggaataagtcttagtctagtctttgcattccttttttgctttttccagcttttaggatgtcatagcttttcagcttttagtcggtgttagaggacagcatcctcactttctgttttagaggacagcatcttcactttctgttttagaggacaacatcttgactggatgccctagactagctgcagccagctagctactactataaatatgtatccaagaaaatagacagaaaattgccccaactctcctagtgccatcctctcaatgagagtaaagattttgctactaacaccactaactctaaagctacatgcaaacatgccacatcatcacccactagcagtaattacatatttaacttcatgcaagcatgcaacatcatctacaatctatttaattctacaaatcaacatgcaagcacatccaatcatcacccctcacatcatttccataatattttaacaaatctatctatcatttttataatatttaacatatacttatcaatatgttccacattacagcacgggtatcatttgtttatttcatgataagtactaatgaactctaatgtttcattattatttttctatttactcctagctcgattgtcgaaaaaaagtatatagaaaattgcttagtaattcctgtagcaaagcacagggaatcacctaaatggaaaagatgtacggataagtttaggatagtgagatgcataaagccttccgttactttttgctataaaaaagaaacaaaagaaagtgaatagaaactctacttttggaggggaagttggggggagggcagagtttcatttcaacaaaggtgtggcaaacattgtttcaacccagtctggtatcttaaccaataccacatcaaaacttgtgctgggtcaacctgttttgggaacctgacctactcttccaagcctagggtggattgcaactgacgaatatcccaacatctcacgatatagaaccatttcctagggaactacagtttcaccaagtaagtttattcaggaatcaggtttagttaccaagtgttcccctcgtttgtctatgcacatgttagcttttgaacttatagtgcaaaatggaggtgtaatgttcaattccttttctgtttttttgttgaatgcaaacaaaaatagaattgaagcaaatcaccttgcctccacttccaaggagctctaacattacaacctcttctggatctttcttcttcctgtccaactgaaagaaatgcatagataacaagaagtcaatgaaacaataagcattagaatgactagaacatgacaagtccagtaagaacaaactatctcatgaacaaataagatgtcaagatggcaattcaaaacaaattagaagtatacctttgcatacagcgaaagcttcgtttcaaccacagaaccattcacaagaagatccactgatcccaagctgctcagccttggagtgcttggttctgttgtactgacagggtctcctagtatgttcacttcaggaggggcctacaagaaagtggagaaataccatcagacaaactatatacaaacttcaggtcctatgttaaacattataaagtaaaggaacgcttacagaagcttgatatgttgcttggacaagcgctttcatccaattggccttctcgatttcattatggtattcaattatcagtgtgctagttgattccagcgcctgcaaatggaacaatgctcagatcaaaaagggaataaaaaacaagttatacggcaacacttcaaaagaactaagtattccttcagtagattttgtcaagacaatggtaccccaacccgagcttttgactgttaaacttccttaggtgtagcgctagctataacatggcccacctgatccaactcatcatcttcttcttgctactaaaactgatataccatggtgagaacgtcttctttgactgattttgttgtttctgcttcctcgtctccattgttggcacatggcctacttgactcataattgccaggatcagatgtgcacttctctgcacgatggtttatcaacttcttcctggcacttcagttctacattccactgctcggcactacagggatctccagatgggcgtgactcatcactgtatgacatcgttgttaaatctggcagttttagaacttgatcaagaactagtaggaagtagctattgattttaccatcttctctcgtttactagttcattggatctcattgtacccaccacccagacaagaggagagaacggacaggtcgctagacttaatcactaacattactacatactccatccgaccgaaaatataaggacttttggagttagacgcaagttaaggagaaagataaaacaaaatgaggtgagatgagaaagtaatgaaggagaaagataaaataaaatgaggtgagatgagaaagtaagtggagaaattaaatgagaaatggttgtgattagttgagatgaggaagtaggtggagaagtactccctctgtcccaaaatataacaactttgccctcaggatttgtcccaaa

SEQ ID NO: 81009 - DNA, 1399 bp, Oryza sativa
gccgacatgtgagacccctgcaccgacgtcccccgccgaacagccttagtgcgccgaagaccgcgccacactcaccgacagcacctcctcacacctagatcgcctcctccaccgccggccgcgcctctctgcaccaagccggcctccttcaccggacgcgcctctcgcgccaatccggcctccctccatcggccgcgcctctcgtgccaagccggcctccatctctaccgcccgcgcctctcgcgccgagccggcctctgctgccatcggctgcgcttctctgcgccaagctggtctccgacccctccaccgaacgatgccgcgccggccagatgcagctgtctcccacgtcctcggctagtcaaccgaggccgccatgcctccggtgaccgcaaacatggtcaccaccaccacagccgccgctgcctaacacccaaccacctcgccgtcgtcatcctcacctcgcacccgactccttccctgccgccgacgtagccaccacctcagagtcgcagccgccgtcgccgctgccgccgtcgccgctgcctccgcaaactgccgctgcgccgtcgtccttcaccaccgagcagctagctgcccgacgccatgtctttcgccaccgccgccagttgacacggcagccaccacagccaggaccgccgccgccgttgccaactgtcgccgctgccgccatcaccacaccacggctgtcatcgccaactgctgccggcgtccagatccggccgagaccgccgttgccaactgctgccggccaactgccgccaccaccgtcgccacaccaccaccgctgtcaccaactgccgccaccctcaagatccggtcgagaggcgcggatctgtggagcaccgccaacgccgccgccaggcaccgcgccgtcacagccacgggacaaccgccgccgcctcagcgccctcggccagctccgtccccgccgccttcagccactgccgcccagcgctgcgcgcccccttcgcctcgctgcctggggtcggagctcggcctcccgtgccggatccagacaagagggggccggatccggccaccccgccgcctccacgctcatcaccgccgccggcaactcaggatccatccccccgcactagatccacgcaggagagcataggagccaacaccgccgcctcgtcgtcgtcggcccggccgcccacctcttcaaccgtcgtcggcaccgccacctcgccgacgccatgcgcaaccgtcgagctcgacgtcgcagccgccgaagtcgctgccccagagctaggtcggggtcgtgggctccgaacactgtgaccttggggggggagaaggccccaccgccgccgtccttgcggccgcgtggtttccggcggcccgctcgggcagcggcgaggtggaagga

SEQ ID NO: 81010 - DNA, 4586 bp, Oryza sativa
cgtcgcagccgccgaagtcgctgccccagagctaggtcgggagtcgtgggctccgaacactgtgaccttggggggggaggaggccccaccgccgccgtccttgcggccgcgtggtttcaggcggcccgctcgggcagcggcgaggtggaaggagggcggtgggggtggtgcggtggtggcggctgggtcgcctcccgtgtcgcccctaccctgggagtgacgcgggggcaaagggtttggcctagcccccgagagaggttttcgcagtgaggcttccttgacgacatctccagtgagaaaaacgatgatgaacaccgacatcgccatccgtcgagatctcaaggagaaccaagacaataggttttctcctggtagcccacctgaggaagaggggtggctcgacaatgccccaaagatggaaaacaatgcctaaaacaccattgttgtcgacctggcaagaccaagctgggctttactatgtcgctcggtccatgaagacctgaagaaaaagctccaaagctccaccacctaccatcctctatcggtacatggtcaccactgtactgacgccctccaccagatagcctcaccgacctctctttcgtcggccctccgcgccatcgaccggggcggcctccctgccatcgcccgaaccaacctcctggagcaaccagcatcagccttcctgaaccactgacgccacctgcgtcgtgctagcctcccttcgttccccgccggatgcccctcgtcagtcagcctcagcccacccatggcatcatcggccacctccacgcatccttcttctcgctgcctccggcaccactcgctaccatcaagacgggcctcactagccaactcgtcaactctcatccacacgcgtgtgacaccatcgccgtggggcacctccaccgcctgccccttcaccgcatgccaccgcctccctgtcacagggagccattgcaggggagtcggcgtccctcgcctaagaagcctgatccattaggggggtttgccgtatctagcgaaggggagccagatccggcgacgcggtgcacagacaagcctatagccttgccgccatggcctctaccctgtcagtcagcggcagcggcatggagtgttcgacggcctcccggagctcctacttctgcgcctcacaaccattatattgatgggtagcacatggagtgttccatgtgttcttgcacggggtagatttaattttcaacatgattttcatgagattcacataattacctctactgtgcatccatgcactatgtatgctctaatatttgtataccgaagcgtaaatcatgtaatcccccaaaaaagacattgttaatggcaatgatagaaactatttatttccttccttttgtttcggcaatgataaaatcatcatgaccttgctcatctgctcacattgcttaggtacagtcatcttatcttatcttatctctcgatcctgctcttaattctctattgttccatttcatctacctctgccttagttggttaactagctagtgcaaatcctagtaggtttaggatgcaacaggaacaaggaattcacccattgtagggcagtggattaatttgtcactacatgatgccacagtttagcaggcagtgacggcggcaataaatcctggcactagggaacggagtggaaaacggcgctaggtgtatggaatagacagaggtgtcaattgcatctattgaaaccatttattttcttcctctgctttgccctacatataaggcatgtgccattgctcacacagtcatctacacatctaattggtcttgctctaagcctattagaatttttgtgcagtcctcctgcccaagttgttccctgggtgcatgcatgaagtgcagtaggcttaggaggcaatgggaatacaggcttcatagcatgaccacattcaagtatcaaattgctatatagttgttctagtgattctgaagagggtacagtactgtctgacgatgcgtgctagaattgatattctcacacacactcagagaccagagtgttgtgtaatatggtgaagagagaaatgataagaggatggtactgcaaattggtgttcgttgtcgtctcgtcaaagtcaaggtagatatagacaatcacactggaagaatatgtgagctatggcctagcaggaaaagtgtttgcccgatgggctcatgggggaagagatggatggtttttatataccggcctgaataatttgaaatgcttcttctagtatgtgttagtcatacttgcaatgagccgaattagattatcgcacagttttatatctagtatattcactggctctaaaagtagttggcattgacatttggagttcaaagttgaaatttcttgatcaacagccgatcagaaaacagcaggggctcccttgctgttaagaactcttgttaataagaaaaaaacaaaaaacaattacagcagtataattcagttctgtactacattctaatctctctcattaagtctgaaaagaagcagcaagaggtctcacttgaaaaggtgtgtccaagaaagcaacgtaggtgaattatgattgaagatcgaaccattacttaggcactgtttgaaagattagcccagggctaattttgagaactaattaatgtttagtcataaattggtaggctaaatattagtctagggtggtatgtttggatccattggctaattcaaggctaaaaggtggagagagagtagaaagagaggagagaggaagagaaagagctgctttttgatggtccctacacaaaattatccccattagcaccccatagaggggttaatgttttgaggagggctaattcactttaacctcaaattagccctcctgtttggatccttgagggctaattcagggctaaaaggtgagggctaataattagcccatagaaccaaacagggccttagcttccaaatgttccacgcaaccaacaataatttctccatacttaaggatgtgtcctaagttattatttccacaatattccagcaagcaactgaaaaagggtattggaagaacaaccaaaaattagtgtctctagagcttgatgactacagaaaacacatgccaaatcacaatctggtggagcaaagttcttatgatccaacatgacatgggctggggttcagtctatccatcaaaaggagtcataaaaaaaccttcaattttaagttacacttactcttccttatccatataaggtgttgtggtggttgactgttctgaaattgagggcatagaatttatgagaagtgtatttcatgcctccgcgtactgttctgaaattgagggcatagaatttctgagaagtgtatttcatgcctccgcgtatataactacattggtcattatcttgggacaaatataattcattaaccatgtctttcataaccagaaattcatcatagctaggcatgctgtgataaatgcaaccgaaatctatcctgaagttgttgattcatgaagctttgaactgaggaatttgtgttaatggcaaaggtaaacactcaaagcctcgctacagtacgctctactagtagtagagaggtagagagtaaccaatcatggttcatcgttcctctttcatctcaactaatgtttagggcccgtttagttccaaaaagtttttcccaaaaacatcacatcgaatctttagacacatgcatgagtattaaatatagataaaaagaaaaactaattgtacagttatgggggaaatcgcgagacgaatcttttaatcctaattagtccgtgattagtcataagtgctacagtaacccacatgtgctaatgacggcttaattagtcttaatagattcgtctcgcggtttcccggcgagttctgaaattagttttttcattcgtgtccaaaaaccccttccgacatccggtcaaacgtccgatgtgacacccaaaaattttcttttccccaactaaacagggcctaacacttcacgttgtttggagcttgtctagtagtggtgtaaatggaggtgcatgtggcccatgtggtgtaaattgggctgtgttcgttattgggggttgggaacccatctcctaaaaacggagcaatccattagcgtctgattaattaagtattagctatttttaaaaaaaatagattaatttgatttttttaagcaactttcgtttagaaactttttgcaaaaaaatatattatttagcagtttgaaaagcgtgcgtgtgaagaactatagagaggggttgggaagtggctgaaacgaacgaagccaggtgatggagttcatatatagtacctatgcaatatgctatgtgtgtatgcagatcctactccttggaacagttgagttaatgtgcacttttgaggcgtgtctttcatacaaagtcatttatgcgagtctacttagggtgtgttcggatgcccccttttcctaaccctctttcttgttttccacgcgcacgttttttaaactgctaaacggtgtgttttgtgcaaaaagtttctataagaaagttgtttaaaaaaattaaattaatccatttaaaaacggggatcca

SEQ ID NO: 81011 - DNA, 9533 bp, Oryza sativa
ctaacgatactccctccgttccataatataagacacaaccacttttcttagatgttacataataaaaggcatgcatgcaagcatgcaattaactatagcatcttctccattaaattattacttttttaaatcctccactctcatgttatctaattctattggatacatgcattatatttattaggatgatccaaactacaagatgataataattatttcttagtctttggattaagagtggttgtgccttatattttggaatggagggagtaatatatattttttttaaaaaaatgaactttcttcatcaacatttcttatatacatgtatatgtatttacaggtatatgtatatacatgtatatgtatatatatactttttttaaaaaaaatcaacttatcaactttctgatatttaaatatttatttgtgttctcaaataattataatccaaagctatttttaatttttttaggactcaacaaagaaatatacagcttgagacaagtcaaatatgttccccgcaaaaaaaaagacaagtcaaatatgtatgtctaaattatatcttgaattgctaaagctgttattgccttttgactagatggttttctattttgcttcaagaaaatggctgcctgttgagaggcaactttacttgctcatggcgaacacaatacacttcagaatttaaaaaatgtagaaattaacattagccttatgaggtattttatggtccttaaaggaagataccaagagatgccacacttatttgtgttaagctatggtgcttcttggtatgtcaaacactagaagacacactaccgtaaatctaacaataaaatcacagaaagattcataaaatagctctgtaacttgtaaagcaaacataaaactttcgaaccatccaccacactgcaatacagagagccctgaatccacatggttaattcaaagatttttcccatcaaactattgcataacacggtcatgatctgcattttgcaactccatgatgttcaggcaaatatgatgcaatctaactcaacttctaaactgaaatcttacattaccaagacttctctaatctctcctgaaaaaagggaaaaccacctatcttagcatcacaagctagcagggttaacagtcgataaagaacaaaatgaatgtgaaccttacaagttacaacaacacatctggaccggccaaaagatttgaggcagctttaaccatcgatctcctcatccagaggagagaaccatttggtaccagactaatcatccagtaaaaggcatactgttttttacacaatagcccatacaacgaaccactcaagctcgacggcatgcctaggggcatagccgtgtaggagctccttgaccttgatgaaagcggtgaggtcgaaccatatttgctaatggctcggttttgcacgtttcatgccaccattgctgaaaggggagacgcttcctggatgaggactgtcctctctcagagtagagttcagcattgccagttccctcagctgttgtcttttatagtaatcttgcgactcatcctgcaaagacgaacaaaagaggtcagctatgaacggcggtcatagctgtaagcaacctacagaacatggttcacagaaaaacactgcaggaataactatcatagaatgacaacttagggaaagaataagtgagggggagaagaaacattgtatatgaaataaaaataaattactactcaagaagagctgttggaaaatatctcaaataaatagcaaagctacaatgtgagacaacatgagaaaggctagttctgtggcatcatatgcataagcttcgaaacacaaacaaaaaaatggtccaggggtatgaaacggaaagcagccaagtctgtaggttagcaggattcgggctggcacccaaaacttaaacccttgccttctcatcacctttgggcccttcatcataaacttaacattgcagatccactgcaatttgggacgatgagtaccacagtgccagatgtatagacataccgcatccacttaacaatgatttgcagcaacaaaatattcattatggacaacaatgaagcatggaatggaagtaatgacttgggatttatggaagaaactttgttttgtacttaattttaattttatgatttgatacaacatgattcatttctgtgctttcttggcaagtaccaaagacctatttctttctctctttttgtggggaaacagacattttcccgcatagatcactgctcattttcccaggaaaataaccaaacatgcccttagctgaggaaagctgcaggtctgactagtactcttttggccctcaagttgcatctgttttgttactatggtgaatgttatattcctgaaagggtagatttactaagtttgtactgcaacactctagatatagtattggcagtagactaagtttacaatttagatcatcattgaatatcttaagggtcattaactccaattaatattactggatatcagttttatttcattatatatggccctcttgatgcccacagggtcacatgcagaaccacaatcagagaaaggaaactattcctgtcctagcgactagcgctgaggactgtctccagcctagatctgcacccataccacactaaccagttgcaacaatgaggacatcaggaccaatgaaaagtgctgccactgggctgcgaatgagagggagaggtgaagttaccatgacttgtatggggtggtacctctaaattttatgtcaacaaaaccacagagatgcaaatagctgtaactactccaataagcatggagatgtaaaattccttttcagttcagtcatgcaaaaaaaaaaaagataaaaaaacataaccggtgaaaagtttgtgccattagcctgtatggtagactttatggtagcacatttctaaattctaaattgtgaagtggtattatccaaatttcagaataaattaatacataaagtcatataaattaataccactggttttagcagttcatccattatttcttgtgcctgcctcaatcttgtatcaatgatattggctggcaactcagcttcaatcaagatatgcagtggatcattgaggtgctcatagccaggttttcctttcagcttctcctcctataaaatagaaaacaaagatgtgtaactgtgtatatttggaggatatatgaggggaaaaaatatggacaaggagcaatctggaatctttcagcaatcaagattaatatatgagacagagtactatcacattattgatgtaacatgttaatgggtttaaggggcaagacagattcccagaagacaagatagaaacccatatgggaatatagtagtacaaaatactaacatatgttctacaaagatgcaataaaactcaccaccatatatcatgaacccaaaaaataaatagaaaattgaaatactagaacaatacatttgtccaatacatgtaagcaaatacgttactcaatgttactaacttattattgttacaaggtttatatggtaagcaaactgatgagcaggcaatataaaatctgccttgaggcacacaatactccataaaaacaattttttaaacagttctttttgtgtgtttcccatgtttcttcgtgtttcagatcaatttaggacgaagtttgaagaccagaattcagaaatactatagaccatggcagaaatggtcacaccaataatggatagttaggatttactaatcagggaagagtacaatgaaggatttccaagatttctacaaaggatattaaattaaacataacaaagaagtttatcatcctagctagctgtaatacttagttttaatttatataacgcatgttatatgagtatataaatgtaaagtaattaacatttacaaacgtttgttaccttatcagcatctttgatagaacccttccctctaatgaaaacacgacaaccagttgatgcttcaacccgctttagagaattacccctcggtcctagaatacgtcccacgaaattgaactggagcaaagcgaaaatagcagacattaaaaacaagacattttatctgctggatgataaatcgcataagaggaacacatacattagggtaagcatcaactggaacctccatgcgtacaatcttcttgacaatataagagccatgacttggcggtgcgccttgccagtccatacttgtcccaggaggaggaggaggaggaaagcctaatctctgtcatataaacaaatcttattagtattgctcacaaagacacaacctaatgtacgccagccaaagaacataagaatcaatggtacagagttttgatgaccttctatatacaattgaagaaaatttcttcagaatcagaagttgaaaacaatgagtaaatgtatagacaagaagattcttgtagtaattaaaagcttgttttccttttgcacttttcagtaattaattcattatacatacctcttggtgtatgccattccaaggcccaaatccattgccatgtaggttgggtctcataattggcgaagacatgggactcggacttctataacgacgcctgtcaaaatcgttgaatccatggtcgttgaccatgcttgatacccgcatgatttctaaacaacacaaagattggaaaaggaggaataaataaggttattacttagaagtaggagtttatacttttttggaatgcaagagttagatgatagctatgatcaaatcataacttccctatgagaagcatttaaggtagaagtgaaatcaagaagcacatcaagataaatagatattacatggtgcaaatatatgctacaattagaagcaggtttgaatccatagcataattcataacaacaaatatattacttacatatttcagtttgaattctcgaaaatggtcagttaaagggttaaaccaggaaagagtgtccttatcgatagttatccaacccatttacttgggttgaaccgtggagtgggttttagataaacagagagacatgctctcagtatatgacaaaaaaaggatgtatttatttgtggatacttgctctattttccagcctatagtaaacataaattaaatgcccgccttgctcatctataaaagaaaaattgcaaatctaaattacatgtagtaaatccatgaaaacaggccgtagaccactttataaacactaaaaggtgcagtgagaaattgaggcaaaaaatttgacttcccactaatgcagctaaaaatagaacctgatcaaatgcagtctgaagctattcactaaaaataaaggcaacatactcaacatccgaagttcccagcccacaagaagaatgcaaatttctccaatatgagctaactattcatgcaattcttacacattcaaaacatcttcatatattaaattcaacagtttcttttatcaagtaagcctatcaacagcacacggtgaagcgcaaaaatttgctgatgcattcacgcccactgttctagaagagaggcagccacctatagctcacttaggtgcccaccttgcctgcctgggtagcgacatagcagccaggacatcttgttggctacttgctgctagccgcacctaacagatcagtaatcatcctgtatccacaatgcgcataccattgtctgctgctgatgcaatggacaaatgattgcaactctacacataaatcttgacaactactagttctcatcaccactttatttttcatcattgatcttcagttctcaacaagtctcaatacatcgaaacatctacattatttgaaggcaaaaattcaatggcaatcaccaaaacagcgcaacaagccttgattcgcatgctgtattataccattacactcggtcatctctgttgtgttgtgcatataacccccaaaatattctaacaatctcatctcgattggcaacgaaaaattcccgagaaagaacaagagggcaactcggcaactctatccaaacataagctgcaggcaaaatcagcagcatcattccacgcattggagccacccgattcccaaatcccgattgcaaaactaacaccacaaatcccccctcttcctcacacgaaacaaacacaacccccaccaatccgtgacaaacagtaagcgagagatcaatcaatcaatcaatcaaaaaaaagaaaagatctcaccttggttgagcagccggctgcatatcggcagcacctgcatgaaaggccccagcttgtgatgctccgcgagcagctcgctcaagtactggctgcaaaaagaaacaaaacccaagaaatcgcacaaccaatcacctaaacaaatcgaaaaaagggcacgcaaccaagagcaagaagcaatccttggatcaaagaatcagcaagaaacacagtagcaatccacggcggcggcggaagcgggcgaggccgtacctatcggcctcggggttgctcctaatctggggcgagagggttcttgccggggagaaaccctggtggttgtagaggccgcctgacatggtggcggccacgagcgaggagaggaggaggaggagaagagaggagagggtttcttggtttcttttccttcctagcgaagaggttgatgatagagattagagagaggaaaaaaaatatgaagatggtggaaactggaaaggttttgatggttccaaaaagaattaaagaaaaactaaaaaggagaggtttttctgctttaggttacactacctgccaggttctgttggataaaggggaattgctggctgctcaggtgaaaattaaaaggagggcaggtgataggagaaaatcccttacctcacatcacctaaatggctatttcatagacggtataaattattactgagtgaaattacgtgtgtgtatatatatatatatatatatatatatatatatatatatatatatatatgtaaagagaagtaatgtgataataaattaaacggtacaattaaataaagtaacccattatatccaatgctcttgttgagggtagctaactctctccaaattttaagtgcataataatggctttgttgctctagggttttagtgtaatagatttttggagcaatattgttacgggcttatttaagtaaggatgtgtcaatagtgctggtttataactcattctcccccataaaaatacgaggtagcttattaacgcatgattaattaagtattagctaaaaaaacttgaaaaattgtattgatatgatattttaaagcaatttttccatagaaaatctttacaaaacttacatcatttagcagtcaaggaaacgtgtgcgcagaaaacgaaggtgtagaggttgggaaagggtaatgccgaagtcatataatggtattgtatggttattttatattttgactggtttatcgttaatgtgtttttcatatggtcttttacaacaaactggagtaaaaataatttgaagacataaccaattgtttggcttatattaatatccatccacatcttggacaagcaacagtcttgatcagaagatgttcttttcatatagcaaatgctcttcatatgcaatcatgcgagctaagaataaggcttctcccttccgtagcatttaatcaagtctgcttacttgttatcattgttccctctatcattttcctcacaattatgagcccttttcgttttttttttctaatatcaatggttcgatatgacgagactagctagccataatttttttttatagattgtgggttctcaccacagaggctatatacctgatttaagtcgacctcatcattaattaatcatgccaatatttggcaaaatagagttatttatgaggggatcaagccaaataattttcattgccacaatagttagcataaaaaatgttgtaggcgatacatgaaatattagaggaacatagtaaatgggatggaataatggtaattttagtttggattgtaaggatgactaggcagccattccctacgattgtgcagcatgcattaccttggctgatcgtgcagaccaaataacctgatttattgggcccttttgaattgcatgaaagaaaaaaaaagaaggaatagaacatatgattgcaaaacataggaataattgtttgattggaccgtaggaaaaactcattggaaatttttcaagagctcttgctaagttttctccaaaatatctataggattgtccattattctatatgaatatcaaaggattggatcaatttcaaaggattggaaatgatccaatcctttgattcaaagacattcataagaatttttctataggattggaatcctccaaaattcctatgtttttcctccaaattaaatggacccttaaattcttcttaatttttgtgttatccttatggttcaatcaaacaatatttttgtgtttttgttgtattttacaattctatattttacgcttatatttctgttaaaatcctaccttttttcctttcatgttcttaatcatgcatttacatgtcccgtagcccaaaactatttttgcttttgcagcagctgacgttgctgtctagctcactgcagtttctcttactagcgagccggaacatttgtcataagaaaaagaaagacctcactgcgtttacaaatgtcttttaatatcaagagactctaattgttgaccgcaattgtggtctaccgagataagtatcatgcaaatcatatcatggataaactgaacatttataagtatcttacaccaaagatgaaggtaaacaaccatcacaatctagtccttgaatagatgggaaatatactcatttatttaattaacctactcacttgatactctaacctctcaaaagcaccatcatagctaatgatcaccgtaacaagatgttgatggtcgatatatctaccaatacatcataaacctagcaaggtggtgggccattgaagatgttgggctggccagcccaaaccttttaagctccttttttgcatgttagctcagcccagagttctagtttccattcctccttttccttttctttcacttttctggaaaaataaacaatcaagtttgatatttatttaattagaagaaagaggcacccgatccaattcaagttgaagatgacttgagctttgaattcagtggtgggaattattgttttaattaactcttactctggtaaaaaaaatatttattgttttgaacaatattcttacgaacttgtaaaattcaactatcaataatttctcaaatactttgtttaacaaataaaataatatatgtagattttcatagaaaattattataatcagaaacttattataacataaaattggttatcagaattttaaaattttaactcctaaacgttaaatatttttgaccggaggaagtatcgttccaatatttattgtttataaaataactcggagttttggtaaaaaaataattagggaatattatatacaattattatttatagaaatcaacatcggtgtgcatcctcagtgtttagtttt

SEQ ID NO: 81012 - DNA, 13175 bp, Oryza sativa
aacattcaagatatcatgtgagataagtagtatttaatttaagtatgaaaaagtggtgtttgtattgtaagagtagtgtctaatactaatttcttgatgatgtggagtttatgaaaattatgtctaatgtcttgggttgggactggccttatcatgctctataaatcttttcctctcatctctcttcttttaaaattttgcaacacggctaggcttttgagcatgtatgcctcttgtgtttctctggcagtactctttgttattaggtgtgcatactactagcgcaggctgtgcagtgggattaggcggtgtcaggattgcaagagtgaactccacactcacagcggatccacactgcatgtgtacataaacatgaagacttcatgctgagatctgtatgattgtaggattggctccagggatcaatcttacgaatccaacagctgcacacacgacttgtgaatacgtcagttcctccggttccaaggttgcagcgcataaagtaaaataagccccatttgtttttggttttcatatgtaatttgagtttcattaatcacaactctatcaagagcaccccttttcagttgggttaatttgaaccgtgccattgcaaatatgtctattcagataaatgttattacaatttatctattcgtaatcgtgccacttaaattttcaaaatggaaccatgccatcgccgtcacgttttctatctttttttccccatcgacacgtggggcccacctgtcagattcatcttcttcagctccatcctcccatcttctctttttttcttcccactagttaagtgcccgtgcgttgcaacgggaaaaaaataatacatcaatttcaaattatagagtaaaattgtgctgaatagttattgagtgtttcttaataaaaagtagtaatgcaataaaatcctaattcagtctggggatatacgtattcagctgtatttacactcatgacatcaaatcaggtaactaatcgcaacaagtatatacatacagatggcattgtgtatttcgtaacatggcaagtgaatgcaagagaagtaattttgcgagtataggggacaaaaccaaacaatacagcataggaccacacgtccgcaattcaaacccagagcaataccataatgtttgcactgctaggatatgatagcgtcaacgattgattgagaacacgcacaagtatcttctgtcatgaggcacatattctctatgcctgcaatatattcaatataaaaatctaatgaaccacaatacataaagcatcaatatgtcctctagaatcacacaccacaggtgcaccacaagctagcttgtttggtcatattcatagcaggtgatattccaatgggagaggaatggaggaaggttgtacacttgctggagatcagagagtgacttagtttggtttgcctggataagaggaaaatgggtcagtccttatttgccagtatatagtaatagttatatatgtatgtcataccattcccgtataactattttctctatatgataatactatgtgtttgcttctaatatatactggagcataacatgtaatttgtgcaaagatgaaaacatcagtcacagcaaaatctttaaaaaagaagaagggaaaatagttgcataaaagagaagctttgaaatctggatcaagaaatgacattgtcccatgaactatttctcaaaaggacaaatccacattcttaaaagtattagtatttcttaattttctccacaagttcttcaacaacaaagacatttcatgggtcaattacagaaaatacagacctaaaaacaaaggatagagcctcttctttataagagagaagagggggaactttttggtggatattttagaacagtcgctatggttcaaggaaatagctaatcctcaagtgggtaatggacaatcaattctatggttggatgatacataagccaaaaaaattgaattgaattgcatatgagcacagaggtagccattcagggctcctggacccactaaattgatactttgctgaaaaaagggaacaaatcaatccaaaagtcagctctaaacaaatgacattgatctgttgatgtagcataagcagtgcaattaaaagccatggaatatgagtaaacggatggaaggtttcgtacagaaaaccccaatttttgatagcctaacaagaaccaatttagggagcctcataaataggggtggaaaaaaagctcgggctcgtgagcttagctcgggcttggctcgagcttggttggcttggctcggctcgtaagccaaacgagccaacccaagccttctttttagctcgttgctgaaatgagccaagccgagctagctcgcgagccgcttgttttggctcgcgagcctaggccatcgtgtgtttatatcgattattttactttatatggcgttattatttgtcaacttgaaatttatcattaagattttgaactattgaatatataaacttatttaaattttacatgttgatgatttgttctttgctttttttaataattacaaaatatatatgaagaggtgttttaacaggaaggcttgcaaaccagctcgagctggctcgagccaggaaacaagccaagccgagctcaagttttagtttgtttcccaaaccaagccgagccaagccaagcctagtttattgcgagccactgcaagccaagccgagctaggctcggctcaactcgtttccagccctactcataaagctttctacaaaatgcaggccatacaaaatgcaggccacacaagaaatgctatctacttacatcaaaagaaatctagctttgttcttctgaaaacagatttgtaggcagtcctagcagcctatgtactcctatttgtaagttaaatatttcttaacttattgttaaaaaaaacatgtccagcatccttgagtctagcttgcatcaacactggctacttcaatcccatgtaaacatatgaatatgacaggcaacaggataaagtttaagagaaaaatatagagcaaaaggtttgtagttgcagcctcaatcccatataaatgtttaaaagcttgacagcctgatgtaagattttttttcattttccaccgctggttgtacgattttgggtagcaatcgattgggtgggctggacaggtgcagccaaaaacgccgcaacaatcagaactgatcagtctcaatatgctgtgacttgagaatttaatgcgttaagaaaaatagagcagcacttaatcagaagttatgtgcaattgatctgaagatagcattatatagtttagaaaggatatggcatcgaggtggggaacaaaagtgtgaaaatccccaatgatggagcagaactcgatagtgaagcattacctagtcatcgaacatcagtttcttatgccaacaagatctcaactaaattgcaagctcaataaacaaaagaatcaatatcctctcttgttctttacactatacaaagaccatttcgtttgacctaacccatccatcctgcccaagtttttcaagtctaagccattggggggagttcctttagttggtttgctcagtgtttcacaaccactattttcgcaaatttgcatttgaactgtaatggttgaaagaacgagatctagcgatgcttaccttgtccacagcatggtggagagagttctggtggcatcggaaaggagagcgtgtctgttaggtagcctcctagtccttgctcacgaggaaaagcagataaatcaaccataggagatggtggaatatcattcccgttgtgtttcaaagccctagaataacaggtaatcaagcatgcatatcacacattttatcctataaatgatggacctcaagcatgatttcaagatagagtgaattcacattgaaaacctaaaaacgggctagtgcaatttacggatactaaaaaaagtaggaatgtccactcttacgtgagtgaaaatgtcaccaaatggatgactcccagagaagtcatctgggccaccacctgacgcttggcgctcagaaaatccagtagaacaatcgatcgcaaatcgaaaatgacaaatcacatattcactatttatgtcagtagtaaggaaggcaccatttggcattgagacagattatcatagtcctgtttggtgcaactgcttttaaatattattttgttgtttggataactgtttcccttagtttgatttataaaacaaactaccaggaagatagatctatatctctacggaaacttaaaaagcacatgcacagtcacagaaaatagttaataacctggtcgtatgtttcacgcttatcttcatgcttcaaaacctgagataagcatgacaaaacacaccctttagaataagaatgtccaatggttaatgtaggacaagctaagatggtgcccaaacaaagaaaccaaaaacatgttcaatgtaggacaaactaaaaatactctgttacttccttgtttcaggcttccattttaatttatgagtttccagatggatgttacatgcagcttgcactcatgcggttaggtctgcctagcgatggaactccgcccaccagatctatgctgagatgacagcgaggaaagaagccgctgaggcgctgacatggcccattctcctcccgcatacggcccctggtcatgggcgtggaccgtggggaagggatcccgaagacgaagataggagcgtggaatgttggaggtgaggaaatattgcaaaattagcatgcaaaaaacatcttaatggactgaataatatgcacataaataaaccgatgaaaaaaactcacatgatcttgttaacgatgttggtgtgatgcccccaatattgttatccatatcttaatttagtgttagccagctgaacaatcctaacagcatgcttcacatcgagagttaaaacttgtttctgtaaatcagaagaaaaattcaaaagtaaactaatgagagtgaaaataaattattctgaacttaactctgaaaacagcttagaaaagctgatgatattcgcaacatcatgttccttttgaataaaaagtatgaactccaagcagctattatatctgtttattccatcgattaaagatactttccattaggaaaaagatatattagctgcacatttcgtagaacacatgaatgcttgcaggtatatattagctgcacatttcgtagaactcatgaatgcttggaggtactctccatgcattggttatgtatatgtgtgtttctggtgataacctaaattagttacagattacaccttcagccaacatttagcttgtacaagtccaactcaagatcaacttctatattgaggcataaataaggaactctcaatttattgaggataaattatgaatacactgtgagaggtctttcttgaaaggaagattactatgatctcattaagaacaacaatagtagtgcggcatacacattttttctcaagtttctagtttgcatgaaataaatatcagttatcaatgttgataattcgaaaccacaaacaaaactatatacttattaagccgtaaggctgcactatcaggtcacttattgctattttttgggtttttaaaaaaaaatcatcatacacatggagggtctatatccttataactatgtgaatttggaatgtgagtcttatcctacaaattattggaagcatacactaataaaccattttatttgcactgtgcctcaactctgtagccaagttaaacacagaagtatttaatacagtaatgaccttttcaattcagagctttgaggcaaccttctgccacggcggggtgatcggttgctgctcggcgcggggtcgtgtcgtcgggggccagctcccatgatccagtggcgactgcagagggcgaggagggaggagaggcagtgtggggtcgcgttgttgggggccagctgccgcgatccggtggtgggcgaggagggagggaggcgcaggcggagatgggggtgggggcacggtcggagaggggcggcagcggggtgaccgtctgctgctcggcgcagggtcgcgtcgtcgggtgctagctcccgcaatccggcggtggttgcggatggcgaggagtgaggggaggcagacgcgtcgtcgggggccggtgtcgcgatccggtggtacacgaggagggagggaggcgtcggcggcgctggggtcgcgggcggaggggcggcgcaaggggtgggtgcgcgggcgcgattgcgctggggaatcgggagcgagcgggggcagcggcgaagggagcggggagagcagttgggaagaggggcgcgatagagggagccgaaaggggagagggcgcgcgtctgaagcgttgattttgcaggaggatcctagaagcaatcttagcccttgaattatccaggactcaccaccaccactagagaatttttaagtagtagagatatgtctccaccacttcttagtttcctttctgccaacccatcctgacccaccacttctcagtcggcccgccactattgcgtccacctcgtcgatgaagacgatggctgtgtcctgtccctggcgagccggaactagccagtcaggcaccatactcggcccattgtaccatgcaagcctggtgctgttcatgccgaagaatgcctaccgaggtctcgcacacgatgaccttggcccgcatgctcttcccggcgcctggtggtccatgcaggagcactgggtgtgtcagcggcagcttgacgccctcccggagctcctgcttctgcgcctcgcaaccattgatgtcgtcgtacatgacgcccggcttgtcggtgtccgccatgatcggaaccgtggtgccgagcagccggcgatgtcggagggaaccacgccgacgagtgcgagcgatagacggtgcagcttgacattcaccgagggcttgaggaggtcgtggtggagagaaatgggaaaaaaagagaagacgatgaatctgacaggtgggcccacgtgcagatgaggaagaagactgaaaacatgacgtcgatagtatggttcccattttgtaaaatttaagtggcacggttacgaataaatgaattataatgatatttatctgaatagacacatttgtaatgacacggatcaaattaacccttttcagtttgagctagagactcaagtctttttttctcaaaaattatgtgtattattccatgtaggtcctttttccacatgagttttgttgtgcgtcctctgttttgcctatacaaattaggcattacttttgcactttttaaaaccgagacttttaagcacatataggggccagttttagacaaaaactggtacatatagtattagtatttttttaaaaataatacctataatatattatagctggtgttttttttaaaaaaaataaccaacatatgtaccactacgagccaagcttgccacgtggggagcaaaaaaaaaatgttgtgttgtgtgcgagccaaatatctcagcttctccctcacctaattcgctccctctctataggtctccctctccctctcccgatccccacttttccagctctccctctccaccgatgcctctcattggcagccaacggttcgccttggccccctccctggtgcaaggcggccagtggcccatctctccccagccccctaatttagatttggggattttaatttggatttgggacagcgaggagcaattcgatccatcggtttgattcgagccgatttttttttacctcgcgtgcatcacaaaggtgtcgatggtggaactgacattaatgacttggagtcatctgttccacctctgtggtgccggttgggaaatccggcacctacgaaggtgtcccaaccatcaccgatggcactttctgtggtagtagtgtggctatttgggaaatcatgatgttatatcatgcaagtatttacaatttacatggtgaacacgcattgaaatgcgttcaccccagttcattcatcagtcgggagaaaataacttcaagcattcatgcatgtagaaaataactgccatatactcgagacatatctacatcagtatgcacctttcactttacatagctaggcttagtgcttttttagcatttttcattgttttttattagaaaacagtttcgaatatgcgtaatttactagtcttaggaagcatcgggaatataaggtcaacgatcatcgtcctcatgatagaaattatggtagacacgtgtaaaaaaatatacatgtcggaacatgagagtttggttgttctgtgggacaggacacatcagcaccttatgtttagattcttgacttacacctgccggtggaatattggtggtaccttccaccatggtgcatcaagatgcaagatgtggacaaatatggcatttgcatagtttgcttaagaaccagaggcagatttaaaagtcactaggaatatggtagatgtgcttcctttattagtccttccttgaatactagctttactttgtggtttcttctcttttcttcgaccatcacatttgtttctctatgacatgattagtaagcatcaggaacgaaaggtcaaccttctcagtgaacgctcgatatcaatcattgcacacatattggagatgaccaggatttccttaggtgaattctggcaaggaggaatgatcacacacataaccccagcttcaaccgatggaagaagacccgaaacacaaccaatgtaaatactaatgtaaatcaaccgtgtgtacatttaatcatactactagaatactaacactacgtgcaggggttgaggcaagatttcaccgagagtaggaccaagctatgctgtttcaaaattttcaccgagtttctatctaaattttggtatatattttgccattgaaattctttgtcacgtgtggggcccaagcccaagctgcctcacacgtggcttcgtccctgactacttagtggaatgtactgtaaaagctcccacaatccttaaaacaagagataataccttctaatagcttagagcttcagtgtacaactcgaggttgggctgtggcggtgcagttgggctagtagcaaagcaaggtcgagggttgggtgaagcatcgctcgcacaaacgcatctagctagctaccgttccgacaccacttgtggaaggagctcatgtgcatagggatcccacatgcatgcctttcactttttctgtgatattttcattcccgagtaagatgtgttcgctcttcaagctcacgccacgcatttttggcccaactaattaagcagcgtattgcccccaaaaaactggattgttctcctgtctaaacctgcgttgaatcaatataccaaaatgagtagggcactacgttcgcttgctagatggtgcaaagacagaatcgaaggtgaaattgttaagaaaaaatggagagagatgagtagaaataaccaccgagagaaagtcttcctaaaagctggtaacaaatacttcctctgttttaacatttgagcaaatttatagaaaaatataataaaatttgcaacacaaaacacacattgtcacttatatgggcctgggggtacctggctagggaaaagggaagcccttcctgtgcgacgcgcccagcaggcccaacgcccctcggaggaacgcgcgttcggccacgaagcggccgccctccccccccccccccccccgcggggggcttggggtaccttgtcatacccctcgggcccgaggggctgaaccgcccccaaggccctcgctcggccgccacgtggcagccatgtggggacttgagcgggcgagagcgccgtccaccaggcgcatttatgggcagcgctccaaccgccccagtcgcatttaatgcaacgtggcaggtcgtgcgccgcccactgatggacgtgcgccgggcgaccactttttgactggtccgtgacccggcgatggatggatgggacaggcggcagcacacccacgtcccacttcatgtcagacggcgtgggggccggtatgtcccgtcccatcatgtgcagggaaaggacgtgcaggtcgccacctcccacgcgtgtgtgcccacgaagtcgccaagcatttaatagggaatgacgggggacgtcccccgtgtcaggcgaaagacttcggtgggggccacccaaaggtagcatggatcgcttccagcccaaggcatgggacgcttttttgtataggcagtgtgggcccctcttttaagaggagagcgtaggggcagtgtatatggtatcccctttatctataaaaggaggatctcgccctgcgagcaaggggacgactcctggtagactagattttggttagaagctgtccaagccctaatttgtacgcccaggatccgaactctctgtaaccacgcgaagatcattacacacacaaaagtagggtattatgctccatagcggcctaaacctgtataatctccctctctcatttcctcgccatccacctcgcaagcctaatccccgcggatccgcctcgctttcgcgaggatacgtccctaagcattgtgcctggtcccctagccgaactcacaaaggggggcctcacaatctcccgctagacagtatcaccctctgacacacatgttatcaaaatacattcactgttcaatttaataaaactaatttggtgtgtgtatgttgctattttttttttataaaccttgtcaaacctaaagatgtttcaacaaaaaaaaggtaaaaacgacttgtaatatgaaactgagaaagtaacaacaacattatccattaaaaaatgtattgaatgtgagtatcaattatgaggagattactatggggttaaatacactaggattcaatttgtgaaactcaataggaggctgcgatagttaaactaggtgaaaccccgcccattgctatgggagtttactatgataataataaatagaaataatgtgtaagatagctagacgacagaaacttgcatatagtgatgtggtttatgataatttaaataatatagaatgatgatccaaatgtaaaagtaatatcatgtgactttatgatagaagaaaatgagggagaatataattccgaccatagattaatcatttgatggctaaaaacaatttgaggtgatatggcttaatgagagaagagagaaataacattgactaagtgaggatgaattgtataggtatatagatattaaacaaaatgatggagagatatattgaaatattttgagaattatttggaatgatgatttgacatgcttggattttaaaagctctaaaatttaagtgagggtgaactgtataggcatatagaatattataaaaagtgatggagagatatattgaaatattatgtgaattatgcgtaatgataattcaattaacatgcttgcaatttaaagctctaaaacttaataaattagcatgcttgcatgaggtttgagatgcaataattgttaatggatgatgtggcatctttgcatgttgaagtttaggatttagtgtaccttaacattatagaaagataggatatgtgaaccagcatgtacgtaaacatggacatgatagaaatgtcactggtgcatactgcctcaaattagattttcgcgagattcacatatttatctctatatgcatccatgttttatgcttatgtgtaagttaaatttatgccccatccatgtaatcctaaaaataattatatatgtgcctatgcaaatggcattacgtacggggattcccattagctagaaaaatgtaaatgggatggcaataatcatagaaaccatttactatatttcctttgtttccacctacatatataaagtcatcatcttgactgtactcatctcctcacagtggttacatatagtcatcttattgggcgcccttctctatatcgtatggattgatgttccatccaccagccagtattgtttcttaggtgcataaagcctagcaagtaggtttaggaggcgatgggaacttacgattcggttcgtgaggcaaatggagtacttttgcaccttatgttcagattgtagactattggtatattggtaccttcctccatagtgcatcaagatgtgtacaagtatggcatttgcatttcgagcataggagcaaaagctaggcaagatgatagctggataggaaaatgggtctggagtggatatcttaatcaagggctatggttacatatcgtttaacgcggaacaatattatgttgctttacggagcattatgtgcatgctattattttttagataaccgcatgttattaaattgtgtgactgtgtacattttgttttgagcctgaactatcccatcttcagtacattcatctgacaaaaaaaaaagaaaagaggagcggatcggacaataaatttatccagcactagtattacagaaaactagaagaaaacatattacaatacaacatgcaaagcactaggaaccattttgggagtataagatttactctgtgcgcaccactatacacatgcagtgtcctgcgcaaaaccttgttcctcttctaccggtgttcagtaatcagtaggcttgtttaagttgtttatttgcttagtactgtacaccctattttttatgtgatacgtggtaagtttagatagtattcagaatacatggaagacttaaatctcagtgcagagaatcaggtgcatgtgcacagtctttaaaagaaagtgtgagtttcataaaacctattaggctgtgctcgggaggtgaggttgggaactcacctctcgcgcacgcaaaatagagtgacgtattttcttgtgattaattaagtacttttttgaaaaatagattaatatggttttttataaaacaacattcgtatagaatttttttttgaaaaaaaacgtatcgtttagtagtttgaaaagcgtacgcacggaaaacgagggaagtgatctagattgaaaagttggggaaagaactcagtctcagtccttttatgaagtatgaacgctagctcactttgtagtttcttcttccttggatcatcagatttctttaattttatggggtatccgctctgtcagagaaaatggaaggagaaactaatgagcagaaataacaaggaaaagatagcctatgtaaagcctggcaacaagcactactaaaaaaaggggcataggtgccggttggaa

SEQ ID NO: 81013 - DNA, 24872 bp, Oryza sativa
cttgttttgactctacggaggagggaaaagcattataggtgccagtttagctgttccggcacctatagtgccgatctctatgaggttttttttttactagtgaagagcattatccataaaaaaaaatctgtattgagtagttcaaaataaacttttattccaatgattacatggctatggggttaaacacaccgggcttcaatttgtgaaactcaatcagtagaggacatggttaaatatgtgaattatacttgattccaatacttgaagtgccaatgtcactggtgcgtactgattcaaactggatttttctgagattcacatatttatctatggcatccaagttttatttatgtcttacatgcctatcatcctaaaagttgttatcatatataaaaaccatttagtacttcctttgtttcagcctgcatatatgaagtcatcacgacattggtcatcatgacattaattcactactggagaaaccatctttggtcgatcagccaaatttcacaatagttccggttctaataaaaaccgggactaaaaaatatctttaggaccggtttaaaagctcaggagtacttctgatctttagtcctggttcaaaaaatggtaggcagtgtcagacccctatattttctttaatcccggttggtgatctatttttagtcctgcttagtaacaccacccgggaaaaagatcagcatacacggagatcgaggcttgtgcgtggatcgaatcgagataactatctcctcctccctcccagctctacttctatctcctttcctcctctcctcacttacaccctatctcttcctctccttctcctcccccctcccccctcctccccacttctggcacgcggcggcggccgggtggcggagggccgggcggccggcgcggagggcagcgcagctggcggcggccggcagccggcggaaagcagtggcctgcacggcagggcgcggccggttgcgccttgtgttgttttttttctagaatttgtggtttggatctgagatatatttgatttgtgtgtgatgtgaatatgtgacgtttttgtaatgaattttgtagaacttgtgatgtatctttttaagattttgtgatgtacctggagatgaacgatttgaggatttggaggtgattatcgatttgggattttactattcggggaggattgatttgggatttcacgatttggggacgggggatggagtgaaatcaatatactaaaaacaatgaagaaaataaaaaaaataaaggactaactagaccttgcctgggactaaatctttagtcccgggactaaaaatggatttttactccgggttatttcaaccagtctttagtcctagatttgtagtcccgattggaaatccaggactatatagggttatcaaccgggagtaaaaagcatttctccacaagtgattgcttacatatagtcattggcactactacgaaaaccatttttcgtggcggccattttggatttttgttggcggaatttgcagccaccacaaagcaaaggccagtgaatatcaagatcttcgctagcggttattgacagccagcaaaaattcattttcgctggcggtcatcttaagccagccgccagcaaaaatacattttcgctggcgttggcttaagacggccggcagcgaaaatccattttcgctggcggctgtgttaaatcagccgcctgcgaaaatggattttgggaaaaaaaaaacacgcatgcagctgccagccgtcagcgaaaatacccatgctgccgcccattgattcattaatttcaaatttcaaatccacatctagattcgctgctcatttccaaattcaaacacgaaatacaaaatcatcattagcacagatcaaacatcatttacacaatcaaacatgatttacacagatccaaacatgtgcatcatctggaacaacatgcaaaaagaaaaagaaaaaaaatcaaatctagctgaaggcggagcaaggtcgacggtggcggatccggcctccccgctgcccagcggcggcggatcccgccaccccacggcctggcggcggcggatccgcctcctagcggcctggccgctgcggatcctgcctccccgcagtccgccggactccccgcgggctgccgcccgctcctgagcgccgccgcgcccgcgcccgagctcgccgcgccacctcccgccaccgtcgcccacccgcctaccgtcgccgccgcgcacccgcctcgcgtcgtcgtcggtggagaagagagggaggagagagggagagaagggaggggagctggagagagggggcgggtgggtggtggactggtggtggtggtggtgggccgcgtggtcaatattaatagatggtggtccatctatgcaagcggtccttctaccgccagcgaaaatctggcggttgcttaagtgggccgccagaaaaaataattgtattttccctaccggtctgtatgacacaaccgccagcgaaaattatctatctttgctggcggcgcacctaagtgaccatcagcgaaaatagacatatcttcgctggcggctggtataatgcgaccgccagcgaagatccattttcgctggcggtcggtgtcctttaccccctcgttacaattttgctggtagttttggcatttctccgccagcgaaaattataaaccaatgccatgaaaaatcgtttttctagtagtgtggtctttctctacgtctacaagtatggatgttgcatccacctgctagagttggttcctaggtgcataaagcctagcatgtaggtgatgagaacttaggattcagtaactgtcacatcggattgttgaatactttctctgaccagtagagcactgtgtgggagtgcatgcgagaggtgacggcttagtatgacataattcagatgacaacgcttcggcaagcaacgatggctctaacttatagagaaaggggtatcagcgtacaactgcagttggctgtgatgcaaagatagatccttgcatcctaatgtggctgtgttttttttttcttttgcacctatgtatcggacaacaataaggttatagcgataatcagataaaaatttctccaaccttcacatacaaaacttgtgactagtatataaccactctgttaagtgatctctaaaagcaacctattgataaaaaaaccggctgatgctaaattgaacatttgtactgtgaatgccattgaaactatctaggaacatgatattagatgatcacaggcaaggaaacaagttgcaaccgcaacaccaatcacagcagaatattcatggccatcataaaatttgttcaacttgtgtgtcatttatttgagcctttataagctaccgacgattcacctaccactaataatagtctcatttgtccgaccatactccctacatttacataacatacattatttcttttatttttcctataatgtttatagtgtaagattttaataatttatatcattccttttagaaaatgatttttaactcgaggtgaatttatcggggcgtgacagaactcacctatatgttctctcttttttgcatgagtgatctgctaccctgctcccaatactaatatatgcatgcatctcagtattcttgatccaaatccatctcacaatgtcttttgctaatatggataagtaaatttacaactataggctgttgtccgtgcatttgtttgcaagtcttgtttcttagtcgtatacatatagtaaagtatccaaacataagttctagaccaaagataatattttgtctttgacctttatgtatggagagtgggttcgtagagatgtcttccaaattctgctagccaggtgaggagcacaatatatgtcagatttcaacccttggagatactgcacacttagggttctacaatggaatttgaaattccttaattagtgcaaaactgtgaattactacattattccagtgatatcttagttagacattggagatggatatcttaggggctggaggagtaacgtgggatagactgtatagtaggtaagaatactacatgcatgatgtggcacttcaaagcagaaacactactagaaaaggcattttctccgacattggatctttttctttttgcgggcgggtatggccatcggagcgaaaaccccgccggcgaaaatgagtatagggaggagttggaagtccgcctgcaaagataggttatcgcaggcggaccacataaggcaccacctgcgaaaatgatctgacggtctgactgggtgactctgtgagatagtcggtttcgtgttgttttcttgaaatttctagattgcttcatgtttacgacttctagatggtttctatccgtatgtgatactattgtgtgctgatttgagtcaagttcgtgcgaacttgtacttagatatggagtttctttgttgttaatgtgcaggtgttattttaggccatgggagtatagccggtgatggatctaggctaggctttattcttgtgtttgatcctattaaatggtattagagccatgcttgctctttttaatcttttccgattacgagattttgtgacaagcctactagtatgtctccttcgtcgtcttgtggttgtttgggtgataataataggaaccctaaacttctgaagaacaaaaagtattcatcgatcaagcatgctctaattcacgaggtgttggataattttgataatgacaatgatcatatacttttagttgattttctctcaaatcaaggtaagtcttgtgacatttgtgatttattgcttgaggagaataagtggttgaagaatgtagtaaaatgtttagaatatcaagttgaattcttatcaaaacattgttcacatttcaagaattcttgtgttgatttgaccgttcagaataatttcaattattgctttaaatgatgaactataatattctatttcatgtttaacttttgaaattgatgttttaaagtgcaatgcttctatgccatgtgaatcttgtgttgctttgcaagatgagctattgagcttgctagtgctagaagtaagataagtgatctcaagtctttagatgaaatacactctgattcttgcactaacttggctgttgaaaatgagaagataaatttggcttatgcttcatattttgatcaattagaaaagattagagctgaaattgatgagtttaaagcgtagctttgctgcagattatgatacaaagatagtttgattttcattgtagaacttctaagaacaatttcaagtatattttaaatttatcttcatgatagctaggtgccaggagtgatgaagagaagcactaaattaaattacataatcaaattctaaattttggaatcggctttatagattataatccaaacttacctcattagagcgtataaagtctggatgacatcttgtctcaaactctcaatggcatttgatcagtacatatgtatgacacaaagtctttcaatttacacagtcttctagtatttgtattagccattggttttggatgtcataacgtagtcttaggaggcatagggaatgtaaggtgaacaatattgggattgtcatgatagaatctgtcagaagaatgtacaaaacaatacatctaatctagtgagactcgagagctttggatattcggcatatatatgatgcgataaaattggcatctgtcatatgtatgtttagcattagaactagaggcagatcatggaaggttagagagcacaagagacgatggtgcaggtcaggatattggccgatgaaggcgatgtttttggctggatcaagctagtttatgttacattgttcaacggggaatatgaggtgatggacttgacaaatagcggtgaaaaaactcacctcgattggtgacggtgttacatttgaagtaaaaaaacagagaggtcggatgtggaaccaataatcattttgattcaactggcagccaacgccataacatttgtatctgattctagttatttgattttcaagccattactttggacaaaaatggagtgttaaataaaaccttggatggccattcaatccaaacatcaacaattctcttttggaatataatgttgctttactgagcattatattcatgtgattcgtttgtctgtgtgtacattttgctttgagccacaattcttcctttttcagttcattcatgaacccaaaaaaagagagcagctagtggacaattaatttatctggtactagtatttctgaaaactgtgtttttccataagaaacatattactgtacaccatgcaaagcatacgtgactctgttatacttgagttgaaattttgtgatgttcatagatctatctcccttctcttatgtccatgtgtgttatgcctatttaagaggaatgactcacagaagtttagatgtgggataatgtgtatgtgcttatgcgtcttctctctaatctcaaaaaatagctacattgatggcaaatattgaaaccatttattttatttttctattttggcctacatagagccagcaagactttgctcgtcttctcccattgctcacaaagtcatctcattgctctactctaagcctacaagaatgtctgttctatttaggcttaggcttaggaggcaacggggatttagatatcagagaatgaagaagataaagtattgaactgttatgtattttctctccatgccaatggtggcaatgtgtgagaggcatgaaaaattggcatttgcgcaaataagaaagcctccgtggacaatatcggctatatcagtcaagtgttgcccgatgggagcagacaaacacatcatttttttaaataaattgtcctttaattcctaattcaatctaaatgtgtgcatcacacggtgcagaggcttcatatattcatatatatgaacttagtgcgcgtaggaggcatcagagaaatttagattagaggggtatgttagtatcagattatagcatttgctacagatgccccccaactctcctacagctatggggcagtggatgatggttcacctgaccagaagcaaagtaggagaaggatggaaagctagttatcaaagatagttgtgttttggggtacaacgatgaaatatcagttctccggtagtgctagcacggagtcctttacggttcttgcctgctattagggtacttccaacaaatgtaagaaagtaactattttcctcctaaaatttgatggtaaaatgtaagaaaggttggattattctctcaaatgaagaattccgctccaatctgctgttttattgtgggacaaaccatcttcatgtctcttatgtgtggaggcaaatttccaaggttccgatattaggaacaaagtcagaagacgactgagacgtactggccatttgggaaatcacgatgttatatcatgatgttatatcatgcaagtatttacatggtgaacatgcattttgttatgttgaataactgtaatacgtttcattgatcaagtttcttgctagtttgttcatcacgtactggaaagaaaacagaaattcagtcatttactttggccagtactaagtccaaactcaagaatcgttatcttttgttgtgacatctcatacattagttagagattgatatctttgcaaaacttaggtgtattggcaggaatcttatacgttgtgtgcactatgatgcagaaaaaatagttgtaaaacatttttctattataacaactaggaagatagcccacgcttagcgcgggcatgggtcgtatgctaagattgagacgcttataagatgaaaatattaaccggtgaacatctaccacgatttctccgtaaattcttttcatcaacattaatttcttttataattttctaacctattagctttatattatatcatatttaagtaatatcaataaacaattatttataatcttcttcatcatttgaaaagaaggtagacttattttccctagaaaacatgtcaacgaagagtaagtgcaaagtaaaactaaggtatttttctttttttaattgcatatatattatcatggtttcttcgaggattaattgggtgggacatgaagctccactaaatatatgggtttatatagcctaatatgattgatgtgatttgagagccgatccatctatgaacatttaatgtagagtgggtcagaagtaccacgcaagctaatgtgaaagccaaatataattgcacaataatattttaaatgtgatgtaccatgtatacacatttgtttttcttatataagatagctctaactgttagaaataatgattccaccggtttaaagggcataggagtattccagaaatgtagtttaaaaattatggttgttttaatattcaacattactacgaagtaaacgttggttgtgatggaattttcccactcgtgttcatgtcccagaattaaaattctttcagtagtaggtgacgtacccgtcgaaagcgagacgtacgtagtgacttcgtccatctcaaaatatgtcatcctagtctatcagaagtactcatgggggtatgtgcatgtgtgtgttcacataggtgagtgcgcgcacgttgtaagcactcgcgtttgtactttgtttctaaaataatatcaaacatattttttgtttctcttttaatttaataaataaaacaatagggagggggtgacagggttgtgtagatgtgagagtgaggaggaggtggagattttatttttctaatttttctaaatgatttaagtgagagccgatgacagggtgtttcattttttctaagaatttccaaggtcatttatccgttttttataggacgtgagacatgataacttaagattttatttttaaaaaatagatctaatagataaaatattggatacgtcaatttaattgatcaaatttaatctagcacctcgtatgtccagccacgtgtcgctcggtgatttgtagtcagtgttcgttatgttctttttttttctattcgtgggaaaaaggctgttggttactccctgtgtcaaaaaatttagatataaatatggacaaattcacatttatccatatcttaactacttataaaaaatagtaactttccaatcgtcacaatatttttttgtccgtcaatccgaccaagcggtaccctctatccacacacacgcaattacatcccatacgatatccaaagaaaaaaaaagagtttgattcaaaatcagctaaaaattaaaccaacagactctgaatcgaacttaataaaatcagctgggatgatccacaggagtgaaagctggaaaccaacggaatcgagcaaatcacaaagcaatacgtaatatctgaccggcgacaagctcatcgtccgaagagagatggcaggtgacggacgaagatggagaggagagacaagctccagcggctcaagacacgccgtcgccgagggcgctccgtcaacccgcaggacatttctgcagccggatccacccatcggaagtagcggatggcgccgctgcggcggattgcggtggggtaggccacaaccgccgccgctcacggtgggcgaggcggcggcgacgctctgtgttaggggcaatctcaccatttcaaaaaatttctcacctgttttgactcgaaatataaaatattgcctccggtgtcctatagccaattacataatttttatagtttccattagccatgtcacgtttttacggtgtctcccagccaattacacatttttgggtgtcctgtatcaaattttgcttttttttcttataattttaggacatattatatggtgatttatgagcgctctagagcgttttaattgatttttgttaggtatagtgatttagtatcgcataatacatattatgttcgattaatttttcgttgttatttagttgccattcaaacgatagggtctaccatcaaataatgtattttaactttttatagtaaaatatagctaatgttatcttgatttatttatttaattataaataaaacaatagttatattatgttagttaaaaaaaagaagaggagataattgaattggtgaggagaggatggatgagtcatctttttttttgctttatcatcttttatcgttagtagatgtttttttttcttccgcctaacagtgggaagctttatttgtttttttttcaattatacttacgtacggacatttagttttatttccttttcccagccaccagttgcatattttttaggaaaaactatcacctttttaataatagatctaatctaatgttctaaattaacgggtccatcaatttaagtgaaaatcgacggtgagattagatagtgccacatggcaatccacatggcggtccaggagtgtttgtagaagcgccacttggcgactcgagagcgtttataggaagtttaatgtacttttagtatataatagaatagaatggatagataagtaagagcaatggcttgcagatcactctaaaaatactaataacctggactagaaacaatagagcaatggccgcagccacaactacaaactctgcgtgtcctgtggaaattatttcctaaattataacctggacctcattagagtgatatttattaaggttaattggattcatgccactgcaaatatgccgattcacaaagatgccaataaaattcgtctattcatatctatgccattgaaattcacataaaattagaaccatgccatcaccgtcacattttccgtcactgccgtctagttttccgtcacattttctttcttcaattccttcttcccttttcttcccctatttggtgggtggcagggacagaagtggtgcgtggtcgacggggaggaccatcctgcagcggtgtctgtcgccccaccaagcacgacgcgggcaagccaagccggcatgctggactgacgatatcatgctgtgagcattggccatgccgtgcaggtgcactgggctgagccaatccggccacgccaaagccgcggaagcgcctcgccggctccggcgtgtgggcacagcagccaaataagaacagaagaaaaatagaaaaaaggaagcaaacagcatcgcctgtgtctcaccgcctgcgctacgtcaacggcaaacaaggaagagcaagaagaagaagaagaagaagagaaaaaggaaagcagcgacggccgtgcctgtggaagccgcaacgacgacgccgagctcgcccaccaagcaatgcccgaacctccgagcagctcgcattttggtccgcaccggctgcatgctcggtcacgccatcccgcaccgggatatatgcccgttgctccgtcgtcggttcccatcttagatgggtcatgccaccgccggtgttgagtgaggggatggcatgggcggcggcgaggggtggtgagcggcaggacgacaaggccgtacctggggggtcaatgaggatgctgcccactctggtggtggattggaaggagagagaagagagagaacgtcaataagagagagaaaggggataataagatagaaattgacagtgatgacagaaaactgtacagcagtgccatgtttatgatttcataaaattttactaacatctagccgatatcgcgaatagtaatggtatttttctaatatggtaaatttgtaatagcatgtataaagtctgaatgacatctattctcaatctctcaattgtatatgctctagacattaagacatatgtacaacacagagtctttcactttacatggctacgcctggagcctttgtgaattttccattatttctatcagacaccggtcttggatgtgcataacatagtcttaggaggcatagggaatgtaagctcaacgatcttgggattgccataataaaacctaccaaggggatgtacaaaacaattatctagtgagactacttgagagtttggatgtccagcatgtgataatgcaacaatagtgagttttatgtgtgtttagcataagaactatatgcaaattttggaaggttggagagcacaagcgataagcagggagggcaggatatataggctgatgtgggtgaaatttgtcgctagatgaaggctttaggttacattgttcaacgagagtaggaggtggtggaggtgacctgatatgaatagtggtgagaaagctcaatttgattgtcaaatgtggtatgtggagtaagcaaaatagaggttggttgtgcaaccgcgatcattttggctcaaccgccaaccaaatgcaacagtaacatttgtgtcgatctgattctagttatgtgattttggagccaatactttggagaaaagatgagtattaaaaaaaactttgcatgcacattcaatctgacgtcaacatttcgcttttggaatataatgttgctttactgagcattatatttgtgtgaatcgtttgtgttattgtgtacattttgctttgagcctaaattcttccgttttagttcattgatgaaccccaaaaaagagagcagctactggacaattaatttatcaagtactagtattacggaactgctattttcaaacatattactgtataccatgctaagcatacgtgcctctgttatactagagttgaaagtttgtgatgttcatagatctacctcccatctctgatgtccatgtaaaccgggactaacgtggttttgcaccacccagcaaagatcagttctccggtagcgatgtgtgttatacctattttaagagggatgactcacagaagtttagatgtgtgataatgtatgagcttatgcgtcttccctgtaatctcaaaaaaacagctatattgatggcaaatattgaaaccatttattttatttttctattttggcctacgtaaagccaacaagactttgctcgtcttctcccgttgctcacaatgtctgttctatttagccttaggcttaggaggcaacgggaatttaggcatcatagaaggaaaaagatgagaacttaactgtaatgtattttctcttcatatccttatggaccttatccctgtcaaacaatggtggcaatgtgtgagaggcacgaaataattggcacttacacaaataagaaagctgccgtggataacataacacctcgatcactagaagaaagtattggctatatctgtcaagtgttgcccgacgggaacaagacaaacacattatttttttaaaataaattgtactctaattcataattcaatcaaaatgtgtgcatcaaatggtgcagaggcttgatataaacttagtgcgcctaggaggcatcacagagatttccattagattagaggggtctgttagtatcagattacaacatttgctgcagatgcccccaccagtacaaaaagggtttttctagacggacctaaacctatgtttgcatgtggaagcctggcctgtcaggccaaaatggtctgcgaaaatccaatttttacgtacgggtaacgcacctgcacacgaaaatcagattttcgcgtgcgggttatgtcaacggcacaaaaaaataaaatttcaaaaaattcaaaaccctagcaatcctagcggtggcgacggcggataggtccatcgtggggccggcggcgccactcccagccgcctcgtcgtccttgtccgatattctattcaagttgatacaagctttgcctatcatatatattgattctatctttaattgcatcattgtttagagtcgtatgggctaagttagaactttttcagttaggttgatattctaactaagttggtatttctctactgttgttttagattgatcaatatatccatcacgtctatgtagatatatcggctaaatatgtttttctcattatcgtcaatttttcgtttaggtccgatctattagattattgctaataagttttatattagtaagccgataggtttttctgcaatgtttcatcgttcatcgggatgtatcagctaactaggcaatatatatgtgaatctacttgcatcagatctctagcaaatgtatgcttttaccttcggacttacacttaccacactatatcagtattagctaactagtttattggttcagttctttctattattcttgttagtagcaggatcaaactaactggcacgtccaaacctcatcaagatttagggcctatactggagctaagcagatgtctcgggccttcgattgttgtgacgcattgtccatcaacgatacgaaagggggtgtggagttggtagctatatcaaggttttttttttagaatttgatcaagggttattgttacattgtttaaggacggataactttatgttgcttttcctgagcattacgcatatttgtgtgattgtgtacattttgtttcgtgcctgaactgttccatcttcagctcattcatcagcaaaaaaaaaaagagcaaacaatagatttatgaaggatcaatattacagaagattaatttccaaaaaaaaaaatcaactgtacactacgcaaagaactagttaccagtgtgtgcattgagggtggggggttacaagatacactctctataaaaaaaatcaacttcttaggattaacctagaaatatacttgtcgagatttgttcctagaaattctttttttttaagacagagggggtgactttatgtgcacatagccttttaatgaaagtgcgagttctataaaacctgttgacatcactaacacataacctcaacccttttttttacaggatgggatgttctttgtctttagcaacacaacaatttattgtgtgcttgtgtatatatgcatatctctgctggttgctacaactacaatgtccatggccagattagtccttcctcgaagactagcctagtttgtactttcttctcttttcttagaccattagatttctttgatttatggggtatcctctctatgataggtttagtaggcatcaggaacgctgggttgagctcggaagtgaatgcttgatatcaatcattcctcacaggttggagatgactataatttctttaggtgaattctgacgaggcgaatgatcacatatcaccctcgcttcaaccgatggaaagaagagctgaagctaaaccaacacgaaaaaatggggccttcaatatttcagcggaaccccaaccaacacgatgggtgtggatcccctggagttacatccaaatccactgggtggatttcactaaacccaagccgtccctttaatttcgatggctttgtttaagccatctcttcttccaccatagttatcttgtagagtctattttcttttaaaaaaaatattgtacagcttataaaaaacattatctcgtagagaacatgttatcttcgaattttctaacatcaattagagaagaacaaacaagacacgaacattgcaccgacaaaagcttgaggatgaattagttcaatgagggcctcgatgccgttaatttcataatagctcggttaagaaaagtttacagataatttcctatccagaatgctcttccgagacgctagatccaaatggacagacttcgcaagaaaaaataaaaagagaaaagaactggctatttctgtcgtaaatgtgtaactaggaagaggtgacatggccacatctagcttgtagaaacaaagtaaggggtcagatcggcccaaatccaccagggtggagttggaaggcaactccagggggtctacgccccaacgtacctattgtttacacttctgtctacattttttttcttttgatgtgcacaataaagtagtaggaacttagacttgagggcatcgagaatttaatgttgagtttatcctctccatcgctatatataagattttggtacaaatatgctaggccatttatctggttaagtatgtattatcctaatgagaataatggaccattaagaactgatggggcagagtcagagtcaatgctacttgaatcaccagagcggagtatgaccttgcattttattcccctaaatgaaatccgcacagtggaaatctaaggcctttcacagtgctcctacgtggagcattacctccttgtgtcagctaggaaagcgccgacgtgtcgagccggaccacgtcctacctgagtcgcttgcccccacacaagcagacgcgattctcgctcgcgcgagatcacacgcggcggagagaacacctggatcctgcgctgtagagggcatgcctccgacttgccgtcccttcgggccctcccgctcctgtgccgctaacctcatcaccgtctctcgctccgcgtcaccaacctcgtcgtcgtccccgcgctccgaagacaccgctgccatggccccgaagatgccgctgtttgccagagacggccccaaggacgtcgccgccactcggcgttggggcgggcggcgcttcccggagacgagcacggggatgccgtcgccgcttcactccggatccacgcaccgccgccgtcgacggtcagtcttctcatcaccggccaagagaggagggacgaggcggattggggaagaagtgccgcggcggatttgggggagaagcggcgcagtggatggcgaggagaagcggccggcggatttggggggagaagcgcgcggtggatggggaggagaagtagcagattttttttttcatttgtgcgtgaggataaaaacgaaggggtaggtggctgtggggtcaaggattcttttgttgggtcacgagcacagtgaggtgcgtggctttcgggccaatttcatcgcagaaatgggccagaggcacgcatagcatgccttgcactgccactgccctaagcatgacttaacataaccaactgagaaatgttagtgccaagagtgtcgaggaattaatggtgagaagaaagtacacaacataaagcggttctttagaatgactctgcttcttctacttattgagaatggtgccaagactatgcatgactctgttggtctctagttctaaaatgttcatggcctctttatccctttcaaggctacttagctacattgtttcgtctattttctcttttcttggatgaatctattggcatttgagcatgtctcatggcctattagatttctttcttaagtgctatcatagtattataataggcttagtaggtatcaggaatagaagaccgagcacattcaggcatggtaggatcaaactctggtacaattgttcaacatggaaaccactgtctcaggcaaagtctatatgtttctccagaagacgagaatgggtattagaagatgttcaacagctaaagaacttaagaacacaaagacaggacagtattgagggattaattgggcaggttttttttactgtattgtacagcaacaatgcagctaagtatgctgatggtagtcctgccagtaagagttagcagccttttttatggccatcatggaactcacctatacatttggcttgagcgatctcccaccctgctcctgatactaacatgcgtctcagtgttcttgatttaaatccatttcactgtgtatttttacgcacatgtgcacaaaaatttcaattttacatgtataggctattattcgggcatttgtttacaagtcttgtttcttagttgtacatatagtataagtaggcttgggatgtcttggatacaaacataaattatattcaaagacaatatttgggtttacactcttatacaatatttgagagatttgaatgctggaataacgtgtgataggctgataggtagcaattctacataatatggcacttcaatgcagaaaactcacatagacaacagtaatgctaaaatattttcctgttattaaacaaaagaatcttatgcacaacgaatactcacatagacaacagcaatagttgtaagagaataacaattcaatgtgattatcaagatgccaaagccttttgtttgttgcttgagagaaaaaaggtccagactctcaattgatcgcagcagaaaacaatattaggacgaggtagtgagattttatttaagataatagattgaaaccaagcctctacgttaacaagggtgtatacagccacaagtattcccaagcacaagaactcggtccttaccctcatgttcagagccgaaaggcacacaaagggtcaagcatcttacaaagtactgaaaggagcacaaaggctccaatacctttcaaggcaaacagatgaaccaaactaaaaccgcgaccaaatacaaattacttttttctcctctttcctagattgcaaccaactttagcaaacaattgcataaccaccatctccaacaatttgcaatcttccatcatcacaacaccatcctcttcttttaacaacagtacagattaagacagtcatttttctttcaaatcttcgtgttactttatatattacatcattgatgaagcaaattgtgtcagttctagttacagatgaatgtgttgcaacaataaaaataatcgtcatttattatattttctagtgcaatactcctatcacgctaaatattgattaggtcaaggattcacttacagaagtgttcatatatagctgtcatgtacccctgcttagctttgctgctgattataatccaaaaatattattctgattttcacagcttgctttgaagaataactttaggtagtttttttttactttccttcgtggaaagagaaccggtcaaagaaagtaatgaagaaagagctcaaattaaattatggatataactaaattataaatttgaaaatgagcttcgaattatgatctggatctcactcgagctatctattgtttacatatatatagtctggatgacatcaagtctggagctctcaattgtcatatgctctgaacacatgtatgacagagttagtctctcactttacttgctttggcctagagcctcttagagtttccttgtttctattagacattagccattggaggcatcaggaatgtaatgtctccaataccttgggttcctcgagatagaaactatggaactcatgtgcaaaataatatacctatattgagacttgagagttggattttgtgggcacaccgtacctgcacatcatgttgagattcctgacttgcatcggcgagatcgttagcacctttcaccatggtgcatctagatgtgacaaaagtggcaattgcgtgtttagcttgagaattggaggcagatcttggatggatggagagctagatcatgggttatggttgaagtgaccagatgggagaggggagctgcaggccaacagcgaagaagcacaaatcgagttggtgattgtgacgatccacctgaaatatttggatctaacaggggagaaagaggaagaacaaggaagaacagagacagagttggcttgggagagagacagatagtttctgtgcgtgatggattagttcccaccccacactaacgaacactggagtttttccctgggtgcatgcatcaagtttagtaggcttaggaggctatgggaattcagcctttacattatggatgctttcgagtttcgaattgtcatatactttccctagaaatgattggtcaggaggagcggtgagtataaggcatgtgaggtacggtatgaccggcagtcacgcagacaagtaagttgtcgagtagtaaatgggaaaggataggattaaggtattgcaaatttgttgttgaaagtgaaacacatgcaactcatcttaagaacgtgtggtctatactagacaagtgttccacaatgggaatatgagaagcatgatatttttttaaaaaactatctttaagttctaatttcatagacatatgttcaattgaagtaaattttacagtttgaatccagcccaaatctgaccatatactttattgagaattacaatgacacaaaaagtgttcttgtttggatttgttagttttgtttataacgtaatgttgtagtctttcagttaattcatcgaccacaaagagaaatgctttatgagatgttggcatagattttgcactatggtttatatatatcagcctcacgcatgcacgttcatatcgtttcgtactataatacggggaaatttgcgtagacatgtgttctattgagatgcgtttgtggttgtaatgatcaggttgatgaggattccattaactgcatcatgtgaaatcggttggataagcatctgcatttgcggctacagagaagtgttcgcaattttgtcaattcttttctctcaattcaatccctgaatttcattcagttacatacctagcaaggcgtataatactgcgaatgcatttcatctcgagtgtaaaagtagtaggcttaaaaaaaacccagaattgatgtatgatacattgtctgaaagacagaaagttgccttgaattagattactcaactcatatatattcagaaccagactatgaaatcttggcgataaccggccatttaccattcctaagagagagtgaccggtaaccattaccagcccgaataatttaaatatagcttgatagaatgtctcagggactcaaaggtcccctttttttctccaacgagagttggatcaagattaacattttcgtggcacgtttttcaaactgctaaacggtgcgttttgtgtaaaaactttctatataaaagttgctctaaaatatcatattaatctatttttcaagtttgtaataattaaaactcaatcaatataatcatacgttaataccacctcgttttgtgtaaaaaacttaatcttcatcttcatcttcaggagaaaagaacaccacctttgacggcgtagtattagtatattgattgcctctacaggtaatcgccaatgattaggataaatttaaaatttcatgatcaacagctgatcataaatattcactaggtgattccccgtactttgctgcgggaattactaagcgattcttttttctgatagtcaagctagaagtaaaaaggacaaaaataacgaaacatcagggtttatcagtacttatcgtgaaacaaacaaattttaccatactttaatgtgaaacatattgataagaatatgctaaatattataaaataatagatagatttgttaaaatattgtgcaaatgatgtgaggggtgatgattggatatgcttgcatgttgattcatagaattaagtaaattgtagatgatgttgtatgcttgcatgaggttaaatacgtaatttattctaatggatgattatgtggcatggttgcaggttgagtttttttagttagtgggttataacttaaaatataggtactcaccatcaatatttactgttcctattcattcatcctatccgatgatccctatttataaactcttttgcttttctctttaatttcacctttcaatttttcagctcgattaagatttttagcatatatgtgccttgtgtttctctgacaactatagtgcaatgggcgtaggagttgtcgggattgcaacattcacctctgcgctctatccttcttctgcttgacagtacaaagcataaatatttgacggcatgcatgaaacataattccttgctagtttgcccaccttctccgaacgagttagtattatgtataaattgtctgattaactgacatgccatttaatctctaagttaattaatagttggacaacgtacattaattagtatctttttatgggtaccttatgttgacataattagaggcatgtacaaacgtacagtctgatatggtctcttagttaatacatatcacttagagatcatacttatacaatagttgagacaacaaaacatttgagccattaatgcactaacataattttttattacccttattttcttatattatcaccatacaacaaattttttctttaataaatgctaagagccgactctgagccgttgtcatgcctaacaaaaatgtttcccttttcaccctcttctcttttccatgttatcaagtttatacttgaatgccaacggaaatagcacgttaattaacaccgttgtacatgccctaagcaatcaaccgatggtgtgcctgatcccaaggaccctagaaagcttcgttgcaatgagattcttgtccagctgttgggtggtggggatggtagtggtacatatgtcactgtgtaaagctgtagagatgagaatgctaaggtttttgacctgaaggatgggaggaaggaagaaagtcgttattgtttttgccaagagacccatgttttaatagacgattttgtaaaatcaaaggtgtttttgattattattttctgatgaacaattgggcattgtagattattggttttgttatttggaatttattcacgaagtggtttcggagatgattgggtttcacaggtgaatctacaggttatcattttatgtggtccggtcagactgggctctggtagccggtcagaccggcgcagtccgcggtctgactggccgacactgtgtcggtttcggtttcgggttgtttatttggatatccgagtttatttcatgattatggtttctagatggatactatacgtatgtaatactattgtttgctgctaatgagtcaagttggagatagcttggtctcggaatatggtttctttgtttgttccatgtgtaggtaactcgatgtctcgggagagtatttgcggtgatggaccgggagtcggcttggggataagacgacgtccggggtggtcagagatcatgcgggatacttatgctagagttgatgcacatggttaatggagattccatatggcatacgatggagctattgtgtgcacatgggatgcggagtcaaatttggaaggagtccaaatttggtatgtttggttatgtaaagtttctttcttgtactagagggtttcctaaggtgtttaggactcctagtatgagtttggttcatggctttagactgcctacctcatgtataaatagagggggagcgtgaggcttcccggtatcgcttttcagagcaatagagttgagttttgagttagggttttgagtttagtcgaaatttttgtaaggagtgctgttggtgcactttgtaaacacagagagaatcaataaagtcgtcatccactttaagagttcttcgatttgtgtttcactgggtttcgacggtctaaccggcaactcaccggcggtcagaccggcggcggcgacaggcgcggcaggcgatctcggcggtcagaccggagattcaacaccggtcagaccggcggcatccactcggtcagaccggcagatcaatctcggtcagaccgcgatccgtcaattttgagggtaacatttatttccgctaaaagttttcagtttttgggtataccaaccattcaccccccctctggttggcttagttcttgtgattcgatcctacaagtggtatcagagccttgttttcttctttggatttttattgatctagagtttttgccatggctactcccgctaggttttcaactaagccccatgttttcgatggaacggatttttctcattggtgtagtaggatgcaatcttatattatggctgaagattatgatatttggagaaaagtttctcatgcttatgtgattcttgaagctattaatactgctgctgaaaaaactgtttttgaacaaaattgcaaagctcgcaacattcttttgagtggtatttctcgttcggattctgatcgtgttgctcatcttcaaactactcatgagatttgggttgctttgagcaattttcatcaaggaacaaataacattaaagagcttcgtcgagatctttttaaaaaggagtacattaaatttgagatgaaacctggagaagctttgaatgactatctttctcggtttaataaaattttgattgatcttagatctgttgattcttcttatgatgctaattatccacaatctgagatttctcgtcactttttgaatggtcttgacatgtctatttgggagatgaaagttatatctattcaggagtctgttaacatgtctactttgactttggattcactttatacaaaattgaaaacacatgagatgaatgttctttctcgaaaagctgattctaagtctagtgctttggtttcttcttcctcgtctttggatgttgatgcttcttcatctaagtcttcttttcttgctgtttttaatgccacatccgatgatcaactcgaacagatcgaggaggaggatttggctttggttgctaaccgtattgctcgagctatgaataatgccaggaacaggaaaagaggtggtccaaatcgttgctttgaatgtggttcaattgatcatcttcgttcgcattgtcctaagcttggggaggcaaaagagaagacaaagatggtgagaagacaaacaacaacaagcccaacaacaacaagtcgaagggttcttaccaagggaggaagatggagaatcttaggaaggcttttcaacaagtttgcgccgccttcgagccactaagtgatgtagatggtgaaagtggagatgatgacaagggaaagaacgtctccgatgtttgcttcatggcgcatggtgaatctgacacagagtatgaagataatgaggtgagtacttttgaggaagctattaatattttgagtgcaaaaaataagaagtgtgagaagatgtatagaaaacaggaatttatcattgaatctcttaaatctgaaattgataggttaaaatctcttattcctaatgatgatgattgtgaaaattgtgaggttttaatgaatgagatttcaaaaattagagatgttaatgctgcacatgatttgaaaaatagatcttctcttgcttgtagttttgctttgcacacactcactttggatgagttgtgtttaactaaaaagttgttgcaaaaat

SEQ ID NO: 81014 - DNA, 28043 bp, Oryza sativa
ctttgaaggtttatttgtctctagcatagcttgtatgtattctgatctttacatgagatttagattttgcttttaagggagatgatgcatgacacttaaattctatacttgaattaagaaaatatgcaatgttgatgctagcatatggtttgatttgtaaatgctctatatatatgctttattgacttgttattcctcaaatagctttaattgctcattgtgaaaaagagaataaaaatatgaaaaaaatgaataccgaatccttggaaacagtcttgacgacaaggacgtattcgatgtgagcaaaataatgggtgccaaatccctagaaacaatcttgacgacagggacgtacccggaataaaagagaaaaatatgagcacaaaggctcaagaaaagaaaaggttataaaaaaaattctcttggttattttgtgctaaagtttatttgagaaagagtgataaatgcaataggtatatgtgtttagtgtttattcttcaacctatgtgcttgttaagatgttgcattctaaatcgtatgaaatcatgaattttgattgttgattcaaacttaattgtaaaatctttggttcatggttatactttaatgcatgcttcttttgttatagatgggttcatcttctttttattgcaacacatgacttgatatgctatatgtatgctaagctcttgaacattaatgaacataattcctatgcttgatgaaatcattgtcaaaatggggagaagtaatgtgaaaatttttggatttttggagaagcaaggtgaatttttggaaagttgttgagtagagcatgtttttggttcaattgggaatttctttcttttaaaaagggggggaagttttcttttggatttttcgaacacttgtacgaagtgtgctttttaccacttttgtttttatttttccaaacaccaaaacattttttatgagtttgccaatgtgttcatcaagggggagattgtaaaatcaaaggtgtttttgattattatttgtgatgaacaattaggcattggagattattggttttgttatttagaatttattcacgaagtggttttggagatgattgggtttcacaggtgaatctacaggttatcattttatgtggtccggtcagactgggctctggtagccagtcagaccggcgcagcccgcggtccgaccggccgacactgtgtcggtttcggtttcgggttgtttatttggatatccgagtttatttcatgattttggtttctacatggatactacacgtatgaaatactattgtttgcctgctatgaatccagttggagatagcttggtctcggaaatggtttctttgtttgttccatgtgtaggtaactcgatgtctcgggagagtatttgcggtgatggaccgggagtcggcttggggataagacgacgtccgtggtggtcagagatcatgcgggatacttaggctagagttgatgcacgtagttgatggagattccatatggcatacaatgaagttattgtgtgcgtatgggattaggagtcaaatttggaaggagtccaaatttggtacgtttggttatgtaaagtttctttcttgtactaaagggtttcctaaggtgtttagaactcctagtatgagtttggttcatggctttatgctgcctacctcatgtataaatagagagggagcgtgaggcttcccggtatcgcttttcagagcaatagagttgagttttgagttagggtttcaagtttagtcgaaatttttgtaaggagcgctgttggtacactttgtaaacacagagagaatcaataaagtcgtcatccactttaagagttcttcgatttgtgtttcaccgggtttcggcggtcttaccggcaactcaccggcggtcagaccggcggcatagcggcggtcagactggtgggagcacagcggtcagaccggcggcggcgacaggcgcgacaggcgatctcggcggtcagaccggagattcaacatcggtcagaccggcggcatccactcggtcagaccggtagatcaatctcggtcagaccgcgatccgtcgatttcgagggtaacttttatttccgctaaaagttttcggtttttgggtataccaaccattcaccccccctctggttggcttagttcttgtgattcgatcctacagatttatcttgcatcagaatgagctgtccattagaccacagaatgtaagaaaatattgtatcagtgtgcttggccacaactgggtcattcaagagggaatgggtcaggtctggacggaagtagtagagaaatcccacaaaaattatcttcactggttttttttgtgagattcattgatttatcactgacattatatatgcatgtgttaattcttctgtctataatgttacatcttccatgaaatccatagaaaccatttatttatccctcaatccagtggaattggcatctggtgatgcgtgaaaggtggagcaatgtggctcaggagggacgtggaaatatattgaagaaaggtattgcacatatggctgtattattgttaagggatcatgagttcaaaagcgacattactatttattatgtttccatgtgaatcagggaatggggttaaggataatcgtatatacctttctccactctccatatacaaaattaacaaattacaagcatataaccagctcgatatatattggacagaaggcactgtgctcatgaggacgatgatctgctttgtgtgatggcccaagagaaactttactggatctgttcttttcgtgtccgtttagcaggagctgctgggatcgtcttcgaattagatggaattcaaatttgggaatttatcaaatgttggtactggcaaagattgcagtttagaaggaagggtttccttgagatcgtgtcctttgcttgctattgttggtaaattgtaagatcaaagtgtgttttgattcttattctgtgatgaacaattggcgtctgtgattattggttttgatatttggagattatcgtcgaactggttttgaagataatcaattttcaggtgatgaacagggtttgctgttttgtcgggaccggtcagaccgggcggaggttgccggtcagaccggcgctatgtgtgcggtcagaccggccaggcccgcggtctgaccggccgacgctgtgtcggtttcggtttcgggtagtttctttggatatccatgattgtttcatggttatggcttctagatggatactatacgtatgtaatactgttgtttgctaacaatgagttaagttggggatagcttggtctcggaatatggtttctttatttgtttcatgtgtaggtgactcgatgcctcgggagagtatttgcggtgatggaccgggagtcggcttggtggtaagacgatgtccgtggtggtcagatatcatgcgggatactaaggctagagttgatgcacgtggttgatggagattccatatcgcatacgatgaagttattgtgtgcgtatgggatgcggagtcaaatttggaaggagtccaaatttggtacgattggttatgtaaagtttctttcttgtactagagggtttcctaaagtgtttaggactcttagtatgagtttggttcgtggctttaggctgcctacctcatgtataaatagagggggagcgtgaggcttcccggtatcgctttgtatcgcttttgtatagcttttgagagctagtttagttagggtttcgagtttagtcgagatttttgtaaggagtgctattggcgcactttgtaaacacagatagaagcaataaagttgtaatctactttgagagttcttcgatttgtgtttcaccgggtttcggcagtctaaccggcatctcagcggcggtcagaccggcggcatcgcagcggtccgaccggcggcgtaagggcggtcagactgacggcggcaacagcaagcgggagctgatcaggcggtcagaccggagttccaatctcggtcagaccagtggctttcagacggtcagaccggcacgactacctcggtcagaccgcgatccatcgaattcgagggtaacttttatttccgctaaaagttttggtttttgggtatatcaaccattcaccccccttctggttggcttagttcttgtgattcgatcctacagtaaaggcatatatggaggcaaagaaatacgaaggtttttgataatgtgctaccaagtgaagatagttgatttgttgcttttaaaaatgagattctcttacatgtttgtgggatgaatgaagtccttagctcttctgtcctcagctggttacaacttcttgtaatttaaggctttctttctttgttctcctgtacaatgttgtaaatactctttcttttgatatataacttctaggctaggcctggtagtattttaaataaaaaagaaccttcaaaataatattaacccccattagtagatctgacttaatgatgagaccatgcatttttatagacaggatgcaaccctttctcaatcaagtacggccaaagtaacgtgctttattcatgagaggatgcatttttatagacataatgcaaccctttatcaatcaagaacgccagaacaaatcatcttcaaattaatctcgtcgcgccaccgggcagccattctgtcccatcgctgcaccaacgacaaaaatatccgtggccattcaacttgtcaccgatggcctatcgatctgccgcgtcgaattggctgagaagggaaggattcgtcgacttttttgtgcccgagttccattgaacgtcctggaatggaggtgatttggatgggtatctgggagctgcagatcgctgctattaggggtggcggatggagtttatgtgtgtagtgacgaaattgctaatgcgcaaccactcccccccccccccggtggacacgtggcgcgtgcagagagggccccgcggagaggtgaggggctgacacgtcgctggattttccttttttttttgttttctcttttcccttttttgcggttttctgtttcgtttttttctttctggttttttacacttcgggtacgtatacaaagtttgtatacgtgtataaaactttatatacatgtattttttttgtttttaaatgtacatataccaattttatacatatatacaaagtttgtatacacatatataaagtttgtatacgtgtatacaaagtttgtatacgcgtatgtaaagtttgtatacgcatatatatacatatgtagactagtaatagtaatacatactactagtagtagtagtactagtactagtagtagtactagtactactagtagtagtactgtagctgaggcgccgcgcgcaccgggggacgcgcgactggtcgcgcattagcggccaccgtgtagtgatttgggctcctcatgtgcttctttcacaattgttgtattagagcaggtacaatagcaagctataagcctgatataaccacatatcgagaagaaaagaaaagagagataagaaaacggactacagatttatagtcggctgcaacatggactctaagacgttatgtgtgtatgagaggtgggaccgtgtattaatggtgtagtatatttttataggtaactattgtattaatggactattagattagctatagatgatttggagctagcagttggctatgctattgaacttgctcttaagagcaggtataatagcagactataagccagctataaacacatatcgaggagataaaagaggagagagaagagcagcgggctacagatttgtagctagctacagcacggactccaagagataatgtgtgtatgacaggtgagaccatatattaatagtgtagtatatgtttataagtaaatattatatgaattggctattaagttgactataggtgatttggaactagtagttagctatactactaaacttgctctaagagcgagtacaatagcaggctacaagtcagctgtaagcacacgtggaggagagaagagaagagaagagagagaaggaaagggggctatagatttgtagccagctgcagcacggactccaatacgttatgtgtgtatgagaggtgggaccatatattaataatttatatataactattgtataaatgagctattagattggctatagatgaattagagttagtacttggctatactattaaacttgctctaggtagtttccgccgtgattatcgaaggggcagctctttgccttctcaacgcatggagtgatctggaaagttcacacggccttctgggttttaggaaatatttctgctcgcgcgaccatgaatggaatgatgctccatcctctctaccacatggcagattttcagatgagtacacttgatttctaggatgccacgtgggccaatcaggtaccagggatggtaccctgaaatcggtatttgagaagctctacacacggtgccatgtgccccaatcaaaaatcggggtttaaaccctgaaatcggtattagagatttaccctgtttcgaaaaaaataactaaaaaattataaggcgcgcatgtgtttttatgcatccatatgttacgggcaaagattatgtggagaagaatcaacatgaatagggatagattggatttagtagatgaaataagaacgtgactataacacgcacggtatcgcgttagcgctaaccagcgatgccctcaatttccaaaaatggaaccgcgttcttttccccacgcgcgcttagaatttccgaaaaaggtactgcagcccacaacaacaccttcgcccctgaacccgtggacagcataatgaagaatcaaacggaaaaaactcacgaacagctgaaggtggagagaaaaatcaagaacaagttgagaagaactaggtcccatgccctaatccaatgtagaaaacaaacccagacctatccaaatcacaaactttgtaagaagtttacatcccacaaatttataatgctatgtcaaattcataaaataaaaagagcacaaacaagcatatcaacttggaattcatgcactaatctgcagttcttttctctcagaccccaaaatccaacaagttactttgaaacatataaaaatgaaatacatgtaaaagttgtaaaagttacttcctactaacatgcaagttacttttaaaatttgtgcgctcattttggatctcttacatgatatattttgttaagcgattttaggtccattgctgccgtcactgcagcggcggcctgatagaacggacccttttggaactttaccatcgacagcgacagatgaaatgagacacattcttcatttaatcaaacaagttcaggctttcagagattctttctttcataaggaaatggatgaatcatcatttgcagaaaagctaaatacaaccatgaatcagttctgaatccatccatccattcacacgtgcatgatcgatgcagaattggattatacagggacacagattgcgcatgcatggagaagatagacatatattactaacattactgcatatacatattccttcttctagctagtgaaggagagggggccaaatgaacaacatgaggagaggaggcattgctaatgctaatagtgtctcatggcattattgaaatatgccaaaacaataaattgacagaccctccctaggggccacttttggctagctttcagttagtagatgttactttccctagctgagaaacaaacttacatgatcatatttggcttcttggttatatgtaagttacttttgaaacatatagaagttacttttaaaatataaaagttgcttcccagtaatacttaagtttcttttagttttattgatcactttttcatacttgcaggggcatatctaaagtgggtacttttagtaataatttggataaaattaagcttccatacccaaatccttttaattagaaagttatgtataatccatcgcaaagcttagtacctgaaatagttatacagaaagttacttttaaaatatataaaagttacttcctagtaatacgtaagttacttttagttttgttgatcacttgtttatacttgcaggcacatatctaaagtgggtacttttagtaataatttggataaaattaagcttccatacccaaatccttttagtaagaaagttgagtataatccatcacaaagcttagtacttgaaacagctatacaagctatacagaaatttacttttaaaacatatgaaagttacttcctattaacacgtaagttactttttaaaatatgttgaatttatgctcatttttcatcttttaattgattacctgtttatactagcaaacacaaattggaaccttaagtttcccaaaggatcattgtttttgttgtggatatacgttggtctgtacagaaccaataatatcccctagaccaaacaacaaagaaaaactaattgctctagtgagtcagccgtgctcatcatgttcaatcatactaatgtcaggttcgaaactgatgagttaggacagatagattaaactagtgttgcatgcctgcatatagttagtaaaaacagtaatctatcattctatcctgaatcaattgatgaacatggatgaagagtgatcgagccttggagaacgagatgacagtgaaataatcaaagttaattaggaaaaagggaagaaaattaccagtcaacaaatgaattggaaatcactgtactactgatcccgtttccatccatgacagtatgacacatgtattttttttttcgagcaaccgacgacaggagtttctcctgccggaatttatagaagaagagaattgacctagttaataagggaaacagggcccgaaaaccgaacaagcacggttaattagacaggaaaccggcaaaacctatacataaaaggaaaagaaagcaactattgagacctcacagaagtcgtcattgccgagcttaccaaaggcaagcagctttgacaacataacacgaggtctccagaactaccaaacgtctactagtggagcagaaaccttctaagcagagcctctaacaagggaacaacatcaaggatgctatcaatgctcattccgaaaggaaccgggttttcacctgaaggaagagagagctagcatgacgatacctccaaggagaaaacggtgcccacaggcgtcgatatcgtcagcctaggaaagcactaggcaaggttttcacccgaggctctctcaaaatgctccacctccaacccctcgcctcgttgccgggacgtttgttgagggtcatcgttgccgagcttgcaacgacaagcagctccgactccgcctcaatagacaatcccactgcagctcgaccagagaccacctcacatccagtaacccagctgcaacaaaacctatggcacggccgatgaccagagagaagatgtcagaaaacaactccgcacgccacccctaacgagccaaggagctacccggcatcgactggaagcagcctagcctaagaagggaggagcgcctaagaagaggggagcggtcgccgcaccgccagtgagcacaggaagaacaaccactgaagaaggggagaaccggatctgagaaagaaacaggagggagggagatggatgcgccatcttcgttgccagcaaccgcaccagaccggctgcccccggctagcagatgcaaccgccgccgccagacgaccaccggggtgccgccgccgccattccccagcacaccgggtgccgcccgccggggcgccaccgccagatccaggcgcggatctggcggcctcttcctctgccaccagcgcctccaagctctgccgcctgttaacgatgaaatttggtaaatcatgcatcggatttggagttaaggccgaagcggatctgagaggaaatcgataatggaaacaaggtatgaatcggcttcagaaccgcatcgactacagtgtgcattggcagttaccgaatcggacaaggcaagccgttgtaaccgattccggcaaggtggtaatggagtcattgtcagattgagttgacgtgcttcatgatgattgccacgtacggatcgagtccgaagaaggcagttgtaactattaattaggaatagtttgttagtttcctttttatccttaggaaagtgtgtttagtgtccgattatgactttatgttttccttttatctttaggaaagtttctttcttgtcctacaaggactagtatctacccatgggtataaatatgtacacccgtggtcattgtaatctatcgctacgatcaatacaattcggcgcatcgccaccctttttacttctacttttgtttttacgttccggcagaacttggcacccgacgcggggctgcatcgtcttcgatctccggcgaagggataagtctaatgttccaccggtccaggcaattgtatcgtctacgtcggcatcgttcaaggctgcatcagtacattcgacctcttggattactctggtttggataatatatttgcctagctatttatcatatgtctatgttaatctagtcctagcatctcaatttagctctatcggctgtctctcgctttagggtttctgccggtatcggctaaatcgccttgctagattagattagcctaggcatctaccaccctgaaaatcagtcaacggcttgattgtctagatattgtgtttcttttcatacttagtgctgcatcagttaagtttgatctactaagtcgtgcttagaaccataatctctagcctgcttcttgattgccaataagggtttcatcggggtttcagctaatgagttatctggacgttgtatcggcttacaaggattgcatacatattggatttagccgatcgcaacaaaggttttactgtttaatctaatcttgtggattttatgatatcggaccaccagccgatgtatgctttaaccttcagatcagtgcttattatatcttgtttctagccaattggtttctactcgactatattgttattacatcatcaacagccgattgcatttatatcattatctacattggacatatagccgattgcttaaaccctatcactatcggctggtatcggcgtcggctggaatcactacatcggcttgtcagccgatcggctgttttatctgttgtttacatatattgtcagttgcaggatcaaactgactggcacacccgcatctcatcaatctttggacctgcacaggagttaagcagatctcccaggctggtgttttcgatttttttcgtcaacaccgccaccgccgccatccccgccactcccatcagaacgccgccgccccaatgcacaaccctgccgccagcttcctcccctccggccagccagagcggatctgggcggccgccgcctcccgtcgccgagcagcccgcgaagcgtagccccgccgccgctatccttgtggccgtgcggctttgccgacggctgctcgggcggcggcgaggcggaggaggaggaagggagaggcgggcgatggcgggctggttgcctcccgtgtcgcccgagggtaggcgacacggagggaatacataatgaagttatgacacatgtatgcatcgatcgggcatcgcttcaactattgacacgaataggtgcccattttgctgcttacctgcctactcccactgcaaattagcatccaccgcccagatggggattgggaacaagaaggatctactattgacgtcgtcctcagactcgaacaactcctcttcctcatcatcttctctgtccttgtcgctgatgcagatggcttcatcgaacaactagagaaccccacaccggaattgctgccgccattaaggagaacgagggcctcgccaccacgtcgctggagcacttccgccacttggcaccaggggcgccggataggatggcgggcaccttgcacttccccttcaccgccatggggagggaattgggaaagcgagtgaattgggaggagtggagaatggagatggagaagagagagaggagagggccacgctagcccaatcgcatcggcaatcagacaggcgtgttgtcgatcacatggatcaccatctatcggacggccccgtacagcgtcgcgcgaaagcgcaaaaacgagagcgatctcgatttagattttgcgatgaaataacaaggaacggtcctgaacctaaacaacgcgacgctctccgtcgcactgagaaggcaggctgatgggcactaagataaatctttatctaatgcctaactgacctaggatagtatccctccttatatagatggatgactccttaatctaatcctaacaaaccttatctaatcgtaacaaaccctaatcctatccaatgggcctaggacgtccgacccaaagcccatggcattactcccccccccctttttgagaaggtcgtcctcgagctgcaccacaccctgctagacttcaaacgaaacaccataacctaaactaaaactcttaagccttttgcatctcggcttttatgaaaaaacagaaataaaaaacaatttatgcataggaggaccttagcctaaggcactgaaggagaggaaaagcccattccatgatccaaatcgaaaggcccagaccaaaattgcttggctcaaaatatgagaatgatccacctttgcgtcataggccaacgtggaaaccacccagcccaactgagagagggtagaaaccctatctcctttcctttcaggagaccacgccgctaggagcgacgcagccgtggttgatccgccaacttcgcaaaccagtgtgtggggccggtgcgatctgcgccatagcgacgcgtgaatgccacgcccacctgtcgcacctacgaattacaccacacgcacgccgccaagctctgatccaaccatcaccggtatgtgcgcctccacctgtggaaacaaagccgcatcgctggaaaatagcgcctgaaaatcagatgcctgtaccgagttgtatcgctgtcgaagtggaaatcgccatcgtcttctccgccaccgttgagggcgccaatggcaacggcgccatcgccagtcccagcggcgaggtcgaagatgcactgccactcccggacttggcaccgccggaagaggaaacatgagcgcctcgccacgagtcacgccgtccccgcgtggttgcagcgtcaccactgaatgttgcccccatccgtgctgcttgaagacacgccctcgcggacgcaaggtcaccgcatgccggtataatggttcggcctcctcaaggaaagccgttggatcggctaactgagccgccaaggcccggagttgcgccgccaagtccatcatcttctttgagatctcggcaaggccttcactgatgttgggaaccgcagcgatctcagcacccatgggcacggaaccgaagctctgataccaagttgtcacaggcaaggattatgtggagaagaatcgggatgaatggggatagattggattatagtagataaaataacaaggaacggtcctaaacctaaacggcgcgacgctctccgttgcactgagaaggcacgccgatggacactaagataaatcttgatctaatgcctaactgacctgggatagtatccctccttatatagatagaggactccttaatctaatcctaacaaaccatgatcctatccaatgggcctaggacgcccgacccaaagcccatgacaccatgcatgtattgtgtatgtcatatgcctcccttctaattaaaatagaagttcacttttggtctcagcaatgggtagttacaaacatgcagccgatttatctatgctacgtgttgtgatagtaaatttctcaggtaccattattatacaccaaccatgcatgcaaataacttctttgcaaccgatttataggaagctcaagtgagcacttccattttccatcgcacactcactagtctggtgctaataaatttctttttttttttgagaaacacagtacaaacgcaggcgctcacaacgtgcgcacactcacccctatatttacatgaatttgcacattttcatatttacaaccttttatgttaattatatagtaggcttatgaggtatctggaatacaacagaagcatgaagccaatatgattgataggccaagcaggcgagaagttctgggagacgggcaagcccttacaaggaaatccaagaccctgtaattaacagcccactaatacatataccaaaggtgctagtgaggggccgtttggtagaaatgcatctagagttctctagaggtgtttatatcaccacccaataccctggtttccacccaaatccagctaattaacatcaagtccatgttttatctgttcttcatggagcaaacaacttttttttactgagatggagcaaacaactttgttgttgctgtccagaatgttaattttcatgctgcctcaagaggctttctgcatcattgctattgcttgtacttactatgtgttatcttaatgcatatgtgaatagtacaatgttttagtttgaagcaagtttgctccttggctttgtcaagcttcgacatcgttctttcatcgatgtaacttgcaacctcttattcccttcaatcttaatgaaattgtttggcctccttcgatagtcctggcaataatcagaatgtatataatatactccttgcttcacaagtacggattgaattttatgttcttatgtcatctatgccacaagacttgaacttctaccaacttgatgcactcactactaaagaaacacacaaaagagatgacactataggtgatggaaatgctaaaattggtacatgtaatgcttttcccacctacaaaagatgaaaatatagaacaggcacctttaagcaactatagatgtcggttttagagaaaaactggcatcaatactataggctaggcggcagaacgagcagcggcggcctccccttcctctcttgtgcattctttgatttggtttttgaataaacttattgatgaatgcttggttctatgatgcgaacttatcgatgaatatttgattctacgatctatgaactagatgattctctgatatgaacaagaacttgtctcattttttgtggctttgaggcatcggcttgaagtcaccagagtcaagtcgcctttttttcaaaccatatacctcaaaagtgtcggttcttaaaccagcaccattgatgaatcctcattagtgccgcctgctagttgctggttgccaaatccggcacccatgtggggttggcaaccggcatctaaagggtttttttagtagtgagtaatcttaaagtaattgggcaaattaagctaacattacatttattgctctcatgaatgccaatttagtcaatttagtcaactccaacagggataaaatactagcaataactcttaacagtgttatatgttttgcagtacgtataaatcgatggacatcaagcgcatttgtggtgtgctgtactagtaatagacgaacattatgtatgaatatgtagctaataataaaaatcttattagattgaatgttttttatcaccatctctattgtacatatcccaaatgtttttctacatcgatgtatttcacagttgtgtgttccataataggattaaagcatcctgtagagaaattccctctggactattttggctgccaaccttttcaaaactactagctactgtttggatttttcgtgtggaggtaacatttctagatttgtcaccaaaagtactttcatgtaattatgtttttcatatttatactgaagtaaatttgaaatagtgatgatcaaagcattgactggaaaatgtctcaatgtctaaaataactacagatgtaattatcaatttgttgtcccatgggctctactttcagtggtttcttcagcccatgctcaattttgctagagtctctcaggaacctgcgtagatgcatcttgtatagtgtcaagaagttcatatatgaaatgaattttgcataacgttttctgcaagaccgcaagttcctgacattttctatatatgtgtcatattcatggatcaaacgaatgattctggttgagaactctcttgttgattccatttatttgtaaagttctagaccaaacgcatcatgtttgcatgacccatctcatttcaaatttaattatggataattttaaactatatatattcatacataagcattgtacagcacactgagtacactgaaaattcatttaattttcattaatttaaaatattattgacattgatcacaattcctccttgctaattactttcaaacagcagagaagtggttgagatatgaatttatacaaaatcatacaacctatgcatgtgatttggttgtgcaacaattgtcaatcatcaaatcaacatcgccggctttaggctccatattgtcaacttgtttggtggcaccggtttattgttttaccggatgaatgaaattggtggctgatactcactcattttaatgtgctagggttgatcagtgttgtggttgcgctcctctgctagaatctcttgtggtaattgaagatatggaacccttttgttttcacttatataacaacagggatctagtttcttttattttttaatatattctaccctttttcacaaaaataaaaaacttatatgtgggtgcatgtgttttcccttgtgtataagttcggcctcataattgaaacaaaagttcactatgggtcacaactcacaataatgggcagtgacaaccaatttatctcatacaatggggctggcataacgaatttctctcaggtaccgttattgtaaaccaaccacgcatgcaaaattgcttctctacaagtaccattgtaggatattaaaaagggggggtgctggtgtggtcggccacatttgcggagataaaataaggggtttaacaactcaagtgaacacctcgattgatctgtagctctgctcccaatgcaaacacactatatttgtgctaattttatttcaagtagctatgaatttacacctagtcgtgcaccttttcgggtgcatgagatatgataggtttaggaggcatcaggattaatacatcaggaggcatagggactaatacatcagaagttggattagcatgtacaacagttatgtgtttcctctgtttcggactacataaagttagcatgagactttgcacatgttctcctacttctctcaatatctcattggtctttctttaacctatagggcatgcctttcgcatctaccagagagatttgtttcttaggttcatcttagcttacattgcttatatacattcatcttaattacagtctacaagcatgcatggctgttccatccacctgccatagttggttcctaggtgatataaagcctagtaagcttaggaggcaaacggaccttagaattgagcttttgcgaaagtgtggaagttgtcaccatagcttataggagtttatggtgtcagaggaatgatctaattttcagcaatgttaatccaaatttcattttaaggagaaatttgctatacatttgtatagagcaagaggagataaaacagcctggacattatggtttgatgacaacctttcatagatttttttaaaaaaaaagtattttttccttgtatgtatttataacttgtaaatattattcttttttaatataagcatctcctactattttcgggtaaataagttattgaatactttctttagctagtacttcctctgtttcacaatgtaagttattctagcattttccgcatttatattgatgttataaatgcggaaaatgctagaatgacttatattgtgaaacggaggaagtagaacattgtgtggcagtgcgtgcaagaggtgattgttaagcatgcatgactcatttctgcgattagaacgctagcgatgatgagaaaacgtgtatcgaatgcacatgtgaagttcattggcttgtgtggatatcccttgcatccaaaagtggctgcaatttcttttgcacatgtatggatctagctatggtgttatagatcatagatggtcagataaagatttctccgacctctacagacaaaagtcttgactagaagccattgccactacataacatcgtatagttacatgacatcaaagaaaacaaccctaatgagactaagtatggtagtgcacctcaatatagttttcctctgatattgtcggtatgtcaatgatgtctatgcagttgtactatttgttggccacaaacacatggatgtgtattatcttaagacaattaatgcgataacattatccttgtctctacacgccatgctcttcctaactactacaattttgtagcatttctatgttataggttatgaaacgatatcggattcataaaaataaaaaatatcacaagcctaagatatagattacaatttacattaacacttgtttgtaatgtacatggtttttccgtgtgtatgtctcccttataatcaaaataaaacttcactatttttcacagcaatgtgccctgacactgaatttatccaggactacagggttgagatactgaatttcttcaggcagtattattgtaaaccaaccattcattaaaatagctagcttctttgcaagtaccattgcggcctatatgagtatcagtgcactcatcctcatttgtgctgaacaaactgaatcatgcatggttcagcggaccccttccagtgaacacctctcctcttcaaattgctcactcacttagagtctctagactcatgctattttcttttcctgaacctctgaactcacacctagttaatacatttccgggtttaggctgtgttctccccccaccccccccccccaaaaaaaaaaaatcccaatccacctctctcgttttctacacgcatgctttttcaaactgttaaacggtgtgatttatgcaaaaaatgaaagttgttttaaaaaatcatattaatctattttttaaaaaaaaataagttaatacttaattaatcatacaataatacgagcttcgttttacgtgccggggaggaggggttcccaatccatcctctcgaacacagcctaaggctatgaaaaaactttctatatgaaagttgtttaggaggcatcacgattaatacatcataagcataaattcaatgcggttagaaaattgaaggctatggactggattcggtggacaaggatgatctcttggttgtagtgggctgtcttttgtatctagtcgtggtgtactgtgtcccagagcatatcatgcctcagattgcactgtgagaacaagaagaatagattcctctggcctatgagggtgcagccgactacggatccggcggggcgacgacagcgggtgcctcggggggggggcggcgacggcgtgcggcgtggatgcgggcggcagtggcgggctagggtttgggattttttggattttatttttcttcgtttgctgaatttattttcgcatgcggccggtataagcgaccgcttgtgaaaatcccatcttcacatgcggatgcgtcggccgcatgcaaaaagggtgtttttacagacgatttcgtccatgcggttggggcaatcgtatgaaaaatgcatcccaaatacatggaaagacccttttttagtagtgcgttgcacccgtcgtcatcgtggtgcccggcaactccgccagaaacgagaggcaccagatcagatcattaattagtgagtaatgcaaatgtgctagtatcaattactactagagttttctgcagtgaggcattactgtgcaattgaggtatatatatgctcccacatctacaaatgatcagttccacgaactagaaaagttagagaatttagatccaagagcttggattagcactagcaaatcctagcgacgaatgattcgtgctgcagggtggtggcgatgcagagggtatagacaccctccctcgacacgattgaggtcgaggggttgccaacatccgcactaacagttgagaattgagattggtttttgagttttggggcactggtgtgaacaagctgagcgaatacagtactacggtagaacctggctgaggtggtgtttggatccagagacttaactttagtgtctatatttagacattaatttagagtattaaatatagactatttataaaactaattacataaataaaagctaattcgcaagacaaattttttaagcctaattaatccataattagagaatgtttactgtagcatcacataagctaatcatggattaattaggctcaatagattcgtctcacgtattattccaaaattatggatgggttttattaatagtctacgtttaatatttataattagtgtcaaacatccaatgtgatagggtcttaaaagttttagtcccatctaaacagggtccaggtctgaggacggacttgtcgggcgggccatcgtggttgtaactagaggacatacgggcagccctagcaggtggggatgtcgagatggagagtttgcttgccatcgtcaaccatgtatatacagtggaaactacggtatcatcaatagtatatacgtatgagatttagctatatcatcaatagtaaatgttttagtcccagattcaattgtaaaacttttaatatcaatgatgtgatcaaatatcatgtgtccttttttttaatccaacaatatttctatgtttttattatatatatggtttgcgctatatatattcccactttagagtcactaacatgtaagtccacagcaaaaggagcccatatgtttagtgactcaaagtcatgtgagtcgcaatcttgcaatccaatgtgggggatagaagagatgaagagagagatacagaggaggggacactgacatctgctgagtcagccactgacatctgctgagtcagccagttggaccatatcaataagcctcgtcaacaattaccgttgtaattactgtcttggaagtcaaattagactggttttaatagttttagggtattacggttaaggtatataaattatatcgaacataaatttgagcgactcaagttggacttatttcttcagaaatttggttcataaatgtaaaagaaatgtgtaatgaggcccattgctgcagcccaagcatgaacaagcccaacaaatcagtgccatccattccatccaaattggacatctactatacataagaatggtttagctagaactattattaaaacgggcttcactagaataccattgtcaacagagtgcagtttgatattttgctatttttatcattttgggttaatgatgaaaaagattttgctctcttttagaaccttttgtgccgaaactgcccctagttttttctttcgtcctctctctatccaaaccgagcggcatctttttttaacgcacgttttttctctcgcgtctcttctgtcgacggtcgaccacctgtttttgtcgctcgctgaaggactgagccgaccgagtggcgctggaggcggaggtgcgagcaccaggcgctcgcagtggctacgagcgcaggtggcagcgggatcgggggtggcagggagcggcgaggttgggggtggcggtgaggaatggggagatgtggcgcgccggccgacaaagcggtggtgggcggtgaggttgggggtgagcgccgaggataggagtggcggtggggagaggtggcgcacaggccggcagagtggtggtgagcggcagcggcgtcgccgcgccccttctctcgcctattatgtttcctctctcacgattcaacaagttgacctagggatataatcatctgagaaaatgtgtaatttacaaaaaaaaaatgaaataccatcgacaagcaccctaatcctaaaaatgtcattgacaaaggcaactttctataaataccattgcacaagtctctttctcccaaaaataccattaccgtcaactccacaccattacaaccgttaatttttttatagtgaccattttgcccacagtgcaaaatatacccaattttcactgtcaaagaaaaagatagatgaaacaaaatttataaccctaaccctaccaatcctgatcctagcgaggaggtccatggcggcggcgcggtagggtgtggcggtggagcggcaacacgcgacgaggaggtccgcggtaaaggtggcacggggcgcggcgaggaggccgcaagcgacggcacggcggttgcaggctgcggtgcgggggctgtaggcgccggcgaggagaggcccgcaggcgtcggtgatgagggggaggagaggcccacagccgcagtcgcgaggtcgccgtgcaggaggaggctgcagtcctaacacgtggcgcaattttttcccttttgtttgttttcattcggcgtcgccgaaggggtggaacaagccatggcgatggccgccgaggtaggcgtcccagaggtggtcggcgacgttcttggccgacctgggcatggggagggagtactggtcaccttcaccaccaatggagaggagcacggtgacattcttggcgtgctggtagtgcttgatgtcggcgccgacgctggcgacggggtggccggagaggtcggcccagtagcggccatggccgaagacgctgaggaaggagatgatgacaatgttgtggaagctgttccacgcaccatttgttcaagaggatgaggagcactataacaacaaatgagagcagcagacatttttaatttagttatgtgtcgatcgttatctgcaccgcagacattttttgttgactaaagacaaatgttgtgtacgcgtaagtatacagaagttgcttgcaatgacaaaaccgaaagatgtctcctgatgaacaaatggttgtctagggataagattgtcttttcatataacttaacggagagatgttttttttttaggtttaacagagagatgttaatagcagtttgatggtgatagtatttttgagagaaagaggcttgtacaatggtatttctaaaaagttatctttatcgatgatatttctcggattagtatgcttatcgatggaattttatggattttcttttttataatggtattctatcgaagcgatgcttataccatgctagaaatgccattttctaattcacgaggctccaaccgcgagaaaggcgagacagaatgaatcctcgccggcgacgaggcgccgacacctccctccggcgactgggtctccgacctcgtcgccggtggccggacggggcagcctcgccgcacggggagccccatcgcctccgactccgtctcggagtcggattcccgccctccttatgggaaaaagaaaatatctcaccccgattcgatcgcgacgaaccctcgcactccgactccgattccaattccaactccaatgtcggtggattttatccctcgacgataaaaagggcgccacatcctccacccgagatcaccaaatctctcaattcccaaaatcaattcgcgcaccaaacctcccaaatccctctcccaccagttcttggattcgccgaggagctcttgtccttccatccatggcggcggggtggcgcgagacgcccgccgcctccgcggccttcccggtggcctacaccgccgtcctcgcgctctacctcctcctcggcgtcttcccgcgcccgcgtggcgccccgccgtgcgaggcgctgctgtgggagctcgccgactgggcggccgtggccgtctgcctcgccgccgacgcctacttcatctactgcatcgcctcctcccgccgccgccccgacgtcccacccgcggctgccgccccctcccccgcagatggatctctgctagggtttagggcagggcctcgccgtctcgacatcgtcagggagtgtccttaacccttcttttctcatcatgctgctactgttattttcttcagttaattaggaaggtttctttctggtgtagtttagttgttagcaacagcccttgaactgaaaccatggttagaatttggaagattaatgctgtagtctagtgtcaacaacgcttccttgtgctgctttaatgagcttctgcatcacaattgctacttctgctactagtcattgtgtgattaccttttgtcttgcaagtttctacacttattaggaagaattctgatgctcttagaatattgattagtcattagaatctagttttgttagatgtgtcgatgtagaaatagtcgattgcgttcgtgttcctttgataagccttctttccaaacttcaatcttgtttttgtaatgcatatgatcctccacatataaggatcaaatagtatattctattgtcatctgctctgcaagtcttgaactttggtttttatcatactgcaaaacacccctaatagtactttctgcagttactttttgtcacctgttctgctagtattactttctgcagttaggatgatttctgttgtactgtagttgttagcaacagtcttgaactgaaaccttggttagctagctgtgaaagtgtctcagccaattttctctcctttcttaatgaaacaacagagttcctgctttagtataaaaaaataccaaaaaaaaatggttagaattaggaagatttccaatgtagtgtagtgtccacaatgttcttcatgctgcttcaaaatcgctacttttactacagtcattatgtgattaccttttgtcttgcaagtttctgcacttaagtaggaagatttctgatgatattagtcattagaatctagttctattacatatatcaatgtcggaatagcatgtgccatgtttgtgttcatatgctcctacacatatagatcaaattgtatattctactatcatctgttctgcaagtcttgaacttcggtttttatcatagagcaaaacaccccaataatttccttttgggaaaacggttgagtgatcatgaggtcgagagttcgagcctctgtcaccccaaatattgagtgatgaggaaatgctcctgtgacaatcgggttcgtcacattcatctgaccatcagatattaagagctagtctgaactcaattaacttgaatcttctttttgtaatgcatatactgtactccacacatgtcgatcaaattgtatattctattttcatctgtgctgcaagtcttaaactttggtttttatcatagtgaaaataccccaataatttccttctgggaaaacctaactgccaactagatgcactagtctaaatatacagttaagggctggatatcaccattgacttggtctcttggttgatttattgctctgatgactaccaattcaggtcgcattattttgcacttgtgcctgcccccacatatttattggtcaatttagttggctccaaaagggtataaaatactagcagttactctaacatagttctgtgttttgcagtataaatccaggcacaccaagtggacacaaatatatagaatacatcatgacttttcaccatatcattcagtatgaatatgtaactagtaataaaaatgttattgatttgaatgttttcaatcaccatctatattttacctatctcagtaaacttcttagttgtatttgaccccatgtcctttagaattgcatattccttaacaaagggagcagttgatgagtgatcctttctaaaacagttatttggatttgtcttattgtagtaatattacttgatttgtcaccaaaagcacttccatgtgtaatatctttatactgaataaaatcgaaatagtaatgatcaaagcatttactgaagattgtgtcaatggtctaagacgacaatagatgtaattcaattaggtatgcctgcattctattttcaatggtttcttaatcttgtgcttaactttgctgcagccaaacactgtcgtagatgaagtggtcaagattgtctggaaggagcaaaacatgaagtcaattgctctccagaagacaaggtcaatcactgctgtgctgccaaacaaatcagttgttctccagagcgccaggtcaatcactgttgagttcgagaacttgagcgaaaactgaagttcgtgtatgcttggagctgcagtgttgagagcttactaacttcgtggctcactcatctgaactgagaagttacaaaacccagtggtggaaaccaaactacacaggtgtaaacctggagtagcagtagcactaaagtaattctggtctaacataagttacttgtatcattagctgtactgaatcattgtagagctaatactaatatatgaatggtatatataaactaatacgtgtactaagctgtaccaaacgatgcacctatactgttgagaagttcatatatgcaatgaatgttggttgacattgcttaatgttatctgcaaattcttggctttctctatgtaccatacacatggatcgaacgagtgattcaggtcgagaattcccttcttgattcgttctgtttgtagttctgaaccaaatgaaccgtattggaaacttggaatgtgaatatcacatcccatttcaaaattaattatggacaaactgtcacaactataatcaacctccatttctcttatcagatggacagtagtcaaccacaaattcattcatgaatatgtgcaccggactaagtacaccgaaaattttcaggtagttttcatcaataaaagagggcattgactttgatctcaagaactcctcactaatcactttcaaacagcaggggaaggaagtagttgagatatggatttgtacaaaaaaaattatccaacttgtgcatttggtttgattcgacttgccggtgagggccgtccaagtgacatgtgggagtttcgcctttactgcaatcgggccctaccccgccaggtgttcgaccagtgccccgaccgccgcggcgccacgagcctaactgtcgcgccgcggcggcgtggccatcgcttcggtgttcgccacggatgacgatgtcgatgggagcgacgccaggtccggggtggcggtggatgatgacgtcgaggcctctgatcggtcggcgccgccgcctcgtgcggtatagtcggcgagcatggccttgagctcggcgagcacctcgcccatcgcggggcgctcgtgcttgtatgggcgcacgcaccggcacgcgagcgcgaacacggcgcgcacggtgggcctgtcccagtcggcgccgaggcgctcgtccaccatggactccgcggcggcgccggcctcgccgccggcctgggcgacggcccagtgcgcggcgtgcacgatggactcggcgccgcccgacggcgtgggcacgacggcgcgcatccccgtggcgagctcgagcagcacgacgccgaagctgtagacgtcgccggcctccgagacgtgccccgccgagaagctctccgggtcgacgtacccgcgcgtgccgcgcacctccgtcgacacgtgcgtcccgccctcgggcacgatccgcgacaccccgaagtccgacagcttcgccgcgccggactccgacagcagcacgttcgtcggcttcacgtcgcggtgcaccacggcgccctcccggaacccgtgcaggtaggccagcccctccgcgacgtccaccgccacctccagccgccgccgccacgccagctcgccctggaacagcgcgcgccacaggttgccgccgccgaggtactcgtacaccagcgcgtggtggtcgccgccgaggcagtagcccaccagcgtcgtcaggttccggtgccggagcttggcgagcacggccacctccgcgtagaactccgacaccttcttcgacctgtagatcttcttgatggccactcgctgccccgacgggagccgccccaggtacaccttgccggcgccgccgctgcccagcagaagcttctcgtcgtagccattggtggcctgcttcagctccgacttggtgaagatgtacaggccctcgcgcggcagcggcggcagcgacgccaccgactcgtcgtcgctgacgtcacctgccgtcgtcgtcgacctacgccggcgacggattgttacgattgccagcgcggcggaggcgaccgccacgacggcc

SEQ ID NO: 81015 - DNA, 713 bp, Oryza sativa
tatggataccccagacccacacggcatgtgtatccgactgggtatgggatgccatgtatagatagaatatctttaaagggactcgggttaaattctaaacttgtatgacaaggaaatacccgggatcctagtcgtttacgattgtatccaatctgtaactaccaattccgttagagatatgggctttattttgtaatacggaccccttcccttatataaggaggggtccgggtgcctcaaggggcacgattttgctcccagatcatacgatcaataatacactcgacggatcaatcgttgtacaggagtagggtattacttcttattaagaaggtctgaacctgtataaaatttcttgtctctaaacccatccacttttctagcttgatagccactccttttagtattgccgaaatcttgtttcgacaccgttcaaccttcctaaagatatctgagttgggcagtagcgacgttaatgtcctaggggaaatcgttttgtgcctgtgatatgtaatggaagctagtgtccctagcgcaaacatggatgtttagtttctgctgttatgtgttttttttttctgttttttctgtatcagactatgtttctgttctgggcctgtgtttcagactgggtgagtaaaattacctgctgtcaaaaaaaaaatccatctgcagactccactgaaaacgttaatccacagggctgcaggaat

SEQ ID NO: 81016 - DNA, 2789 bp, Oryza sativa
catcgcccgagagcgaacggccgtctgccatgtcactttcgccgccctctgggatggcgatttttaaaaatcgccctcccagagggcggtaggcgaccacttctgtcaattttcaaaatgaaaaattatttttataaaacttttaataaaaaaattaaaaataaaaaaaattcgagaatatacggtattgggctgcgaggctttccggctgttttggtgtccttggcccatgtactaacactggcaggctaccagcccacgtggtagctgcacctgcacgtcagcttcgctttttatttaggagtatttgtttatttttggaatggctaagatttcagttacctgaaattcttaaaatttcagctgaacttacttgctgtcttgtccacattaagattcatgctccggcgatggcaatagagtctttctctaggtttagaatttaggtttcaaggtgagggttgagatgggagggggagagaaggggggatggttttggtgttagagcgatggctatggacggaggccaaaccaacgatgtgtggcgaacaatgcgagcagcaaggtcgatgccgctgacgaatcaaatgtataatgtatatataagagaaacgactagtgatgtcttggcggcgcaagccactgaaggtgaaaaagacagatggtgctaaggtatctcaccatcgctcaagcatagaaaagagaactagtgaacaggagggggagggagggaggaggccggtctagtagagaacacacataacttttacttagggatagcgtctaaaggcatcaaactaggtttagactgagtttgacagcgtcggttgggagcctgtggttgtggttggtagcaagtgcgcactgttcatgtactgttcatagaaatcgtgggcctcccaaacggcgtcgtgcgcggctttacttccgtccaacatctacagtatgtcaaaagcacgtgagcaatccgaacggattaccaacctcaccatcccgctcccaacgggcgctgtcgaactcagatttattccatactagcttgtagaaaggaaagtacactagtacagtactattgtacagaatatacccttgaaatacattgatattctttattttcgcagacaaagatgtaagtgctttttttccataccatcaataatagctaggcaagtcagggtgtgtttagttctttggatgtaaagtttttgaagtatacggacatatatttgaagtattaaatgtaaaacgtagactaataacaaaacaaattacagattccaactgtaaattgcgagacgaatttattaagcctaattaatccgttattggcaaatgtttattgtagcatcacattgtcaaatcatggcgtaattaggctcaaaagattcgtctcgcaatttatatgcaaactgtacaattggtttttttcccacatttagagtctcatgcatgtgtccaaacatttgatatgatgtttttgaccaatattttttgaaatctaaataaggcctcggtaggaaaaatgaaatgtcgcctacgagttttcgcagaaaaaggacagaccacaatatcttatgtgtcctcgaggtccatacagcagcagcagtgaaaaggatttggagaatctgccccatgtggtgcgtgttgtgttgtccacactccccttggacctcactccttgctgaaattgttctgcacaaatggtacacatgaacccaagctgtccaccacccaaaacacacggctagtttgcctgagatatcgacacacaaagatgtacctcggaaatggcatatttttgtttctccatctgaagaacggatcatcgtatcatgggcttgttgttcatatctttagtcctttttttcctattaattttatgtataaacgtgtgatgtaaacttgcgaacaattaagagatcaactaaaaaaacttcgaaatatcacccacggctttgaactctcagaggtctcgctgagacaatcgagttgtcaaatttagatgatttctcatgtaaaaaaactgcgaaatattttttaaaaatgaaaaatagagtttaagctatcagccacacaagatttaggatctattcagattacttttaaaataaacctttttaggcccctttgattcaaaggaaattcatagaaatttttagaggatttcattcctataggaatttttcctacgaagccctttgaatcaaaggaatgaaccctatggaatcttatgaaattcctataaaatgcctcttcccatacaagttttggaggaattttaacaagagctagaacctcatggaagaaatcctttgagggccactttgaatcacatgaatggaaaaacagaggaataggaaaaacatagaattctgacaggaatgtaagtgtaaaacagatgattgcaaaacacaggaaaaacgtagaaatgatcatttgattggaccacaggaaaaacacaagaatttgaggagagataaagactcaaaagattttttttccatgaggttttacctcttgttaaaattcctccaaaacttgtatgggaagaggcattccatattaattttataggattccatagggttcattcctttgattcaaaaggctttgtaggaaaaattcctatatgaatgaaatactctaaaattcccatgaatttcctttgaatcaaatagggcctgagtctttatctctccttaaattcctgtgtttttcctgtggtccaatcaaatgatcatttctacgtttttcctgtgttttgcaatcatctgttttacacttacatt

SEQ ID NO: 81017 - DNA, 3923 bp, Oryza sativa
tgcaagttcagattacctccaaggtagttctgaggaggatgttgtatgttatatatctgctgtacagaaacaaactgggctccaacctaactgggctccaaccggctgatgttgttgattaactggtgttctctacccagtcagtatcggctgaactatttgctgcccaatcggctggaccacatgctgcctgattggtgtatgctgaattggttcaacaatctgctgagttggcccaaacattgccgcaatctgctcttgagtcagcctattaatattctgcccagcatgctgaggctgctctctagtcaagacatgaggattaaccacctgtctttgtgccgatgatgaagcaccaggtgctggagccgaaactgatgccatcggctagaccagtggtgcattggatacgggttgctggttaccagtcaccaaactcctatactgtggaaatacgccatttggtagaaagactggtaccgtgttttgatgctcaactatcgtgccatcaaccacagacttaaccatattcgttaaagtattgacaaggacccctgattggttgatcaaagcatgttgaaagcatagtcaacatgatcttggaaattattgaatttcaagggctcttgctcctcatcaccatcttcatccacatcctcaacctcaccatctcgaggttcctcaccttttcacctgagccatctgcagcacctttagtccctttagctttaccacctttggatgagcttgttccaggttcatcggcagcaaccaccttcaccttgtacttttgaataacttttccctggcggtttccccgaatgaattcatgaattgctcctaagcactcttcatcatttgttcaaactccttcctttgttctagtgataatttgtctatagtgaccgggacgatgttcccttcattaacctcagacggttgctcgggcggtggcttagtgaacggaggtttagttttgcctcccgttgctggtgactgtggtggattctctgccatgaggaaacgttgtcgcaacttgagtcccaccggacgtgccaaaagcgtgttgatgcgaaaaacgcacactggcctggaagatctgcttaacttctgtgcaggtccaaaatcttgcttttaggttcgtgagcgtgccagttgatttgatcctacaatcaacaagaaagaaaaacaagaaaaaccgtggttaaattcataaatgatagctgatcggctagttgccgatgacatatcatttatctttgagccgatgtcatattggaatcgatcggtagtcatgaataaataaaataaaactaaatctactcaatcggctgtagatattaatgacatataatccttccttcgatatatatttaaactaagtgattgggatagatcggtcgctatgccgagacagtataaatcacttaagtcgaaatatatattaaagcaatgattatatagacgtttatagcatagccgattaaatagatccagtatgtatcggctaatactctgataccactttaaactaggatattagaacaggcagaatatatcaaacaggagcctaatatacttgatgcatagacttattaaagcaattagttataatcaagctgtgagaataaagaacagatcaggtagatcggtgaaaccccatctatatcttcgatgatataaacagccagatttatagtatagattactaatagatcgactcaaccgatgcacattaagcgtaatataaatataggatctaggcagagatgaaacctataagagatggtagatacacgatataatctaaataataacaaaacataactctatcggtactttctaaccgatgacaagttatagatcgcaactagcggagattacaacgtgtatatgataacttgacgaatcacataaacaagattagagtgtcataaagatggaagcactaatcccgagaacgcaaggcgccatgacaagtttacctctagttgaagatcgtaatcgatgcagctcaacccgaaagtaagaactcgtcgaaatagaacgaaagtaaaaagggtggtgatgcactgaaagtgttactgaactgttgttgttgattacattgagttcgggtcatatttatacccaagatacaaaatatgtccttgccggacacgactcttatctctaacaaactctaagatatcataagtctttgcggcagacttttgcccaaacatatctctaagaaaattacacgaaatatcctaattaatagatacaattgccttgttcagagctctatctctatcgtggcaatcctcatgaagcacattgatcgattctagaaacagccccgaagccatctttatcagaatcggctgtaccgaccccatcggctttatcagttatcctctgtccgatccatctctgccgatgcaaacgccaacaaatgccttcgcaaccgatgcatactctgttcttcgagtctatttcttcgccgaatccgcttcgattccaatgtcgaacctggttcatatcttaccaaatttggtcgttaacacggaggtattaaagatgtgggcgaagtgctcgcaccacagtgctccgggcgttttcggggcgacgtgctcaattccgctgatgtccacatcatccggcgctggtcctggaaattttgcaaaaacgtcctcgcttaacttgacaatctttcttaagtccctcaatgtaagtttactgtcttatgtattcttacgtaacggccatctgtgtcctagtatatcctacgtgaaggagacgaaattcctaatataggaccgcactctcagaaaatgaaaagaaagggttttttttttgaaaaagataacatccctatcccctcggttcgccgaaccctagccgccactgttccccaccctattctctcctccttccccttgcatgacggcgccacatcgtcttccctccttcctcgcttctcctcgccaacgacggtctccaatcgcgctctccccgcccccccatcttctacccctcttccgaatcaagcaggggaaagagaacccacacactcctcttctcagcttctcttaccttaagagcagtggcatgagcgagtcaacttaatctcaagagggaggcaagcaatctgtgctagggagtggatcaaagagggagaccgtcagtgggcagggaggggcgacgaagtcgcgagccgccataacggggacatggagggaagggtgctagtatgctacagagctcgcctatgtcactctttcatccttttcttgtcaaacatttgtagactaaaaaataaaaaaaacactgcattatttttacgtctaatatatacgaatctttggatcacctctagatcgaacaattatttaggcacaccatggataacaatcataaaagaaaaggcagaactcatagaagtttaaaataaaatgcaattcttcaaattttgtatattatgttaagtgcctcttgagaaaaataaaagacgagcctaaatacctgcagttaaagtaaataggacagcattgttttgcattcctatcagatgcatgataatacgttatgtatatgtgtcttagtttggccatatcacctaaaggatcctcgtttagcttatcttactagaaataagcaaatcctataccctacagttttataagtagtggacttagaatacatcgcaatatagtcatctagtttacttcaacatctaattaatggatggcttaatctggcacatactctggtaactggtaagtacagtatacttccttgattatataaaggttgttccattatgcaagaaaggaggcaaaacaaataaatacatagacttgcaattcctaaatatagttgaacaaatcaaagtgccttcataaaaggcagaaacatccaagacaacttcctatttgtaa

SEQ ID NO: 81018 - DNA, 960 bp, Oryza sativa
ccaaaggataaagcatacatcggctagaggtccgatgtcataaaatccataagattagattgaacagtgaaatctttattgcaatcggctaaatccaaattgtatgtaatccttgtaagccgatacaacgtccagatacctcatcggctaaagccccgatgaaacccttattggcagtcaacaagcatgctagatattacgattctaagcatgacttaatagatcaaatttagttgatgcaacactaaatatgaaaagaaacataatatctggacaatcaagcctatggctgattttaagggtggtagatgtctaagttaatctaatctagcaacacaatttagccgatgccggcagaaaccctaaaacgagaagcagccaatagagctaaattgatatgctaagactagattaacagagacatctgataaataggtaggcaaatatatcatccaaactagagcaattcaagaggtcgaatgtactgatgcagccttgaacgatgccgacgtagacgagacaattgcctaggccggtggaacgttggacttatcccttcgctagagatcgaactgaactaatgcagccccgtgtcaggtgccaaattccactggaggataagtaaaaacctcggtaaagagggtggcgatgcgcttagagtagtattattgatcgtggagataatttacaatgacctgggtgtacatatttatacccatggggagtgttcgcggtatgtcatgagtcccttcgaccagacctaccgaaaccatgcaaccagcgaggattcaggcccaggacgctaagatcatttgggcgaagtcccatggcgaagactatgaagtagaaatcgcgaaggccgaagaatcgcgctggtatccggcaagaccaaatgcatcattgggcgaagggtgtatgccggaagatggggtcttcgccataacaagcccaactttgaag

SEQ ID NO: 81019 - DNA, 2302 bp, Oryza sativa
ctgaagttgtgctactatctttgtggtcttgtgtgaagcttcctatgtggagctatgtgattggtggaaaattaatacttctggtgaattgaggtccctttggtgagattaattctttatttgagatgtgtggcttctttgtgttaattagccggatgacgaacccgacttaagtgaggggtgccagacggtattagccgatctaggtatctcggtgaacggttgaatatacaccactttgtgtatgggtctgacggcaacatttatttacatattaccttttgtgtataaaaggggtcaagctatgtatgtcctgtgcaaccgtatatttaaatatatgcggctgtgttctttgccgtgagtcctcaacacatctccctcgttttccgtgtgcacgcttttcaaactgctaaacggtgtgtgttttgcaaaaagtttctataggaaagttgctttaaaaaatcatattaatccattttttaaattttttatagttaatacttaattaataattcgttaatctatctctccgttttgcgtgtggagaggaggggttcccaacccctccaaaagaacacagccagtgtacgtttatgtatacatgctgactgtttatagtgatgtttgttcgtataatatttccatgttattattattagtatattgtggtggtatattggacattatttatttgttttacttcaacagatgtgaatgttataaattttgagtggcttattcttgtttccaaaaattttgctagttaactgattaattaatgatatatgtcacataatttttaatttttttaaatagcttaaaattccgggttgtttcaccattgaaaaatctttggattaaaacactatattacgtacaagtcaaatagaaaattgagaaagcatctaaatttatctatgaataaaacaaaaaacagggaactagatgagcagaagtaagggcaacaccaatgtatcttgtttaactaggtaataagtagcagggctaagtagtaggtctttgtaaagtgggtcccatgaggaaaaaaatattgctttttagttgctttttgtccaactcagcatgcagtagtagcacatcttgtgttggaaggagagagtgagagagattttaatgtttttttattcttatgagtgggtcataagcttactatctagcattagttactacccacttccacaatgcttattactagatcatagaaatattatattgcttaatacctgctttttcctaacattgtggatgccctaagtagtaacttgtaatttcactggaaaatgatagatagaaattggcaatcgaagacatatttgttttaggatatgtatttccacctgattacacagattctattctgcacatctgaaactatctatataatggaaacagcactaactttttagatgccattttcccgtaatattgtcttccgcaatttcttgaagttaaatgatctatctagcagactagcacgtaaacccactaatcacgatatattcttattaattgaacgtttgtggataaaccttttatatctatggtattagcggtttaaaatccaatgttgaaaaaaatctatgaaaaaaaaactaaaatcaacttaaaattaagttttaaaattcaatttgctaaataataagcacaggctataaagtggttggcgcgccaacatgcgtgctcattttctactaatagactaaatccatcttatctgtagcgctcattgtctactaatagactaaatccatcttatctgtagctgtgttgcccgccctgtgtttgaggtggatttaaaaagtgtggaactagctggtgtgttattccgggaggagctctctctgaaacataacatcaatggtggcttcattgttgaacgcattgctgatgattctgctcttgagcatcttggtgttagacggggtgacgtgatcttttttgaggacgagtgtgggactactttgcctgaggtgaaatgaattctggtctcaagtaatagtttaatataaatcaacatttgttaagaataatacaaattctggaacagattgaagattatctcctttctcttggttggagatacctgcaggggatgaagtcgatggttcaaggtctgatattacacaataacaaatgcatgtaaatgtttttttctctttttgaaacaatgggaaaaaataattaacagaactgcctttcttgtgtagttgctagtacatgacattgaaggtccatgtaaggagacaattaccttgcccttagagttttctgtcgattcagg

SEQ ID NO: 81020 - DNA, 592 bp, Oryza sativa
acgggtttgttgagatcgactcttcagaccccgtccatgatgttctccattgattttctcgatcagctgtacgttttggtgtgtttggactatgagaagcatcggatctactatccttggtggaggtgacttgtgatggctttaaaccacctcgaacagttcctgtgccctctgatctgtctggaagattccagccagcagctttcctaacagttccttgactaaaatagaatcccaaaaaaataataataataaggcacaggaagacaaacacgataacgcttacaagttattttctaaattcaccttgaaggagagactacatcccttgtagccctctcaaccttgatagtaccagtaccatcatcttcttcaacatgtgttcgaccattttgtgtggcatccgcactgctttttactggaaacttcggtcgctctctgccaataacagcaattgaggaacaagggaatcagataggtgttgagatgtctcaattatcagcaaaagactgcttttaactcttctctctgttatgaacagaagtactataccacataccttattctatccagaagctttggagattttcta

SEQ ID NO: 81021 - DNA, 580 bp, Oryza sativa
ctgcagccctgctagtgcttcatgagctatggccatggtcaagtcttcgatgacttacatgtctgccttgcaggctgtgatcggaggagctgacaactacgggctctgaacattcagacgctgtcgggattgacgaatgtggattaccagacatcgcttgcttagaaattggcacttaactggttttgtactggtaaggagggagaattgctaatagcttagcatacatacctatttaatatgatcagctggcagcgaatcaatcttggattcatgtcattgatatattgctggcggatttcatttgacatgtttgatatattacgatcattgcacaatgttcttcagacattgatacctaagagaatatttgcatgagatgcgagaaatactttccaacaattccattgtcagttattaaactcagtgcgagcatatatgctaacaggatttccataacgacattatgcaaacgggtgaacgttaggcagctattgcaatcacgcatgaccaagtggatatgtggttcatgccttccatcctctgccagcgtattatgccatgtggagatttgcatgct

SEQ ID NO: 81022 - DNA, 672 bp, Oryza sativa
cccgtagctgttaataaggatatctcatgtaaattctttagagatatgtttgggcaaaagtctgccgcaaagacttatggtatcttagagtttgttagagataagaatcgtgtccggcaaggacatatcttgtaatctcggatataaatatgacccgagcctatgtaatcaaataacacacattcaataacactttcggcgcatcgccacccttttattctatttcgacgagttcttgctttcgggttgagctgcattgattcgatcttcaactagaggtaaacttgtcaaggcggtttgcgttctcgggattagtgcttccatctttatgacactctaatcttgtttatgtaattcgtcgagttatcatatatactttacaatctttgttagttgtgctatataacttgtcatcggctagttcttgctgttaagaagtaaccgatagggctatgttttgttgttaacttggattgtatcgggtatctaccatctcttagaagttttcatcatcttgtttagatcctacagttatctttatgcttaatgctgcatcggttaagtttgagttcgatctattaagttctatctataattgtgatatctagcctgttttataataattaatagagatagtatcggggttcagccgatcttacctgatttagctac

SEQ ID NO: 81023 - DNA, 1740 bp, Oryza sativa
cgcgtgcccgagccgcgccgctcaaatcgccgcgccgcccattgcttcccgcgcgcgcgtgccgtggtggccgaccgcctggtcgctgccgccgtcagcctctgtcgcgcctgtcgcttgtgtcgccgctccgctccacaccgccccgccgtcatcgccgtcgtcatcgcctccggccctggcctctccgcgcgcaaagccgccaaggggacagagagcagagccctcctcctctcttgccgcgacagcccccgctccccttcctccttttcccaaagaagcaaggggcgagccccctttctctccccctttttcctcctttttccctctcgccggcgtcatcctcctgccgccgttttggctgctagccggagcgccagctcgcgccttgaccgttcaatgtcggtttccctcgcccaaaccgacattgccgcccatttaagcccaagccctccccctccaaactctctcattttcgcctccgcgccattgccgccctctgtttcgccgtcgccgatcgtcgttgcgcgtgtcggaggagccggcacgagcaaggacgcggaagaggacttcggccgcgccctcttcttcctcttccccggcccgaggccggagagattactcccgcgccgtcggcctctcgtcacagcgccccgtcccgcacggtagtgcctccctccgttcttcctcctcgctccatctcctccccttagatttcggtagtagctcgagtagcctccccgtagttagccggcgccgccctggccgttgccgtcgctcgccgtgtgctcgccgccgtcgccgcccgagctcggaagcgcgtcgtcgccggcctcgctcggcgtagttccgcccaattcgacgctagcatcggattcccgtagccacgtagatgctctcgccgccgggaatcggcccctcgtgacctcgtcgtcgtttcccccttctcccgccgccggttgccgccgccgcgattcgccgccgtcaagctccctccggcgaatccgagccgttggctcgtctcccctcgtcacgtgcaaccacccggtgtgctcgcttttgcctgtatcgccgtggttcgctccgccgctcgccgccgtcgtccgccgtccgttcaggccggcgtcgtcgtctacctcccgccggcccgcgtggcagccacttaggcgccacgtcggcgccagctcagccaagactgggtcgagccgaccccggtcagcccctccccgtgcgcgcgttccaccgcgaggcgtgaggctgcgcgtgggcccgccgcatccgcatccaccgcgaaccgcgcgcgtgcaccgcgtccctcccccaccctagcgccgcgccgcgtgctccctccgcacggtgagccgagccgctgacaagcgggtcccacccgggaccgcgcgtggtgagcccggtccaccggctctctctctcctccctcccgcgcgcgcgcgtcttgggccgctctgggccgccttcttgggccggccggcccgttaagctcggccgacccgccctttctctcgggccgcgccctagccacccgagaaaagtctatattccctccctcctttcttttctttttcttttccaaaaaggatttaattaaatcctttttccgttagaccaaaaatccaataatcttagaaattcaatatcttcccaaccgtaaatcgtttgactccgttcaacttccaaaattcctcaaatctcgagatccatctaatggcatgcttagaggtc

SEQ ID NO: 81024 - DNA, 11512 bp, Oryza sativa
tccatttttacctgatttttccatagcaggcagcatctattatatatattcttttgctgagatacctagcagtatttaagtataacgaaaaaaaaagtattcgtagttgggaatgaaatggctagatacaatctgaatccatatttcttaaattgatgttgataaatttaaagtaaaatctagtgaaaggtggtgcaacatatctacagctctcctgtgtattattttgttggaaactctgaatagatccaagggacaccgacataacgttatagactctacagtcggagcagattgatatcggctttaaacttctttttcttattgtaaaacaataaaagtttagcttaattggatccaagagatgtaccaacatatgcctaaagtccatgcatcttgttagaatggatttaagagatatcattactgattgaataactcctcaatttataccatgtcagagcggattgatattgttttaaagctttccttttcttattgtaaaagaataaaagtttagcttaattggatccaagggatgtactgacataccgttatagagactaaagtctgtgcatcttgtcgaaatgtatttaagagatatcgttactgatcgaataactccttaatttatatcatgtcggagcggattgatatcattgtaaaaaaatgtctccttttattattgtaaaacaataaaagcttagctttattggatcaaaaggatgtatcgacataccgttataaaatctaaagtttacacattttttacgaaatggatataagagataccgttactaatcgaataactcctcaatttatatcacggcggagcggattgatatcattttaaagatttccttttcttattgtaaaacaataaaagttttagcttaactagatccaagggatgtaccaacataccattatagactaaattttgtgcgtcttgttggactgcatttaagagatatcgttactgatcgaataactccccaacttatgtcatgtcggagcgaattgatatagtttttttttaaaaaaaaacctttccttttttattgtgaaacaataaaagtttagctttattggatccaaggaatgtaccgacatactgttatagtctaaaatccgcgcaatttgatggaacggatttaagagacacaattatcgatcgaataactcagtttatgtcatgtcggagtagattgatatcgttttaatgctttccttatttattgtaaaacaataaaagtttagtttatttggacccaagggatataccgacataccattatagactaaagtcggcacatcttgtcgaaatggatttaagagatatcgttactgatcgaataactcctcaatttatatcatgtcggagcggattgatattgttttaaaaaacctttccttttttattgtaaaacaataaaagtttaacattattggatccaagggatgtatcgacatatcgttatagagtttaaagtccacgcattttgacggaatagatttaagagacagttctcgatcgagtaactcctcaatttatatcatgtcagagtggatagatatggtttcaaagctttccttttcttattgtaaaccaataaaagtttacctttatatattttttccaactagctgctgcattttatcaataaatgtaaatttatttgtataatcagctgccagtacatactgggaagtggacaacgaacttaagcacccattccttcgttttaggcggagcaagaatttaaattatggctttagtgccacgctgtactgtagtaggacactaggacagaactactgacagaatcgctctagaaccaaaatgcatggtttggtggcctactgttaattctagctgtagctagccttgcataattcaaccttattgatcgtccatgttttccggtgaattaaacccacatgcaaacgtagtaggttttttatctctctcggttcacaaatttggacccctgaattccgatcctctgtaataagctgagtagtttgtgcaaattacgtgaaagcctgtcgtttccgtggcccacatgaactggcccccatgcttgctgactcagactccgatcacttcgcccggccaatgctccgctataaaaccctccctttttttggcaaggagttcccaccgtgagatcgagatcgcctcctctctccgtttccttttatttcccgattcgctcggcgtctcggcggcgaccttgcgcgagcgcgcgatgcggtgaaaaaaaaatcatcgcccgcgacagagtacatctgtcccttccgcataaggcaacgtcgctataaatactgccagcctcttcgttcgtttccatttttcctcgtccgctcgctctcgttcatgtacaaataggagggcgcatgcaccttgtttgccattagctctcgacgtagcctagagcgcaagcagcagcagcagctagattggttggttgccaatgatcccggccatctccccgatgatggacggcgccgcgcctctgcttcccgagacgagccccgagagccgccagcaacgtgatccggagagggggaagaggcggacgccggtcctcccggccgtcgtcgcgtccgccgtggtccttctcggcctcgcggcgctcttcctggtgtatggatttcacgacggtggagacgggagggcggccgtactcgcgcccggcaccgtggaggtcgcggcctcgtcgtcccgcggcgtcgtggagggcgtctcggagaagtccaccaccccggcgctgcgcctcggcggcggcgcggtccgggactacgcctggaccaactcgatgctgtcctggcagcgcacggcgttccacttccagccccccaacaattggatgaacggtatgtatacacgttgccatcgttcccgtggtttcatctaggccgttggatctgtaatcgcacggctccgattcaccggttatacaatgttttctcgtttctaatcttgttccctttccgtttcttttccacggacgtctcgtgcgcatggccgtgctgctcgtctttttctcggcatctacagatccgaacggtaagttgctggcgctgattgtcaatgcacggcgcaatcttgtacttgtcacgcattgacatcgatgtcgcgagacgtgacactttttttttgcacgcactgaccgggccgtcgatggatcgatctgcaggtccactgtactacaagggatggtaccatctgttctaccaatggaacccggactcggccgtgtgggggaacatcacctggggccatgccgtgtcgcgcgatctcatccactggctgcacctgccgctcgccatggtgcccgaccactggtacgacatcaacggcgtctggaccggctcggcgacgcagctgcccgacggccggatcgtcatgctctacaccggcgccacggaggagtcggtgcaggtgcagaacctggccgagccggccgacccgaacgacccgctgctgcgggaatggagcaaggcggaggcgaacccggtgctggtgccgccgccgggcatcgggctgacggacttccgcgacccgacgacggcgtggcgcaacccggccgactcggcgtggcggatcaccatcgggtccaaggaccgcgaccacgcggggctggcgctcgtgtacaagacggaggacttcctgcactacgacctgctgcccacgctgctgcacgtcgtcaagggcaccggcatgtgggagtgcgtggacttgtacccggtgtccacctcgccggccgtcgaggacgggctcgagacgtccaccccgccggggcccggcgtgaagcacgtactcaaggccagcctcgacgacgacagaaacgactactacgccatcggcacctacgacggcgagaccgatacctggacgccggacaacgccgacatcgacgtcgggatcgggctccggtacgactacggcaagttctacgcgtccaagacgttctacgaccccgtcgggcggcgtcgcgtgctatgggggtggatcggcgagaccgacagcgagcgggctgacatactcaagggctgggcctcccttcaggtaacgtacattgatcgacaacccccataaccttggtttcatatttctgataggctatagaattagtagtagttacgtataaacaaactttttttatttaattttgacaatggattgaacgagacacggatagagatacgaacccgtcaaatttctttgtgaagcatcataactgaacataattacaaaaatataaaaataacaagttatattaatctcaaatgacgtaggaaaactattataaagctgtctgaaaagccatattgatctgtgatataattcattgcaaaactaattagtcttttttttttgcgatgacatgaacaagatacttaattaagatttttaggtaactgggtatgtactatctcaattggcacagaacgagttactattaaaatctgaaaagccgtactgatttggtataattcatatatattgtaattaatttaacttgccgtatacatccctttttcccaatcatgtactgtactccattaattactgtgtcaaaaacatttagctcatactatttgaatcgctagagcaaaaaagtaaagtgactaggacgatataaactcatggaaatccattaaaaccttatgaaaataacgcccctagctaagccagctagctgctagccagctggatatgatgatcatgctgatctggctagttaaccatggatggctagctaggacccggtcattatgtagttatacacttgcatataccatttctagaccacaattccgcccactaagatataatgcaaaacgtctttacctgtgcaccacgagaggcatgcaggcgtgcggctttcttgttgcgccggccggtcgatccagaagaaaacgtgcatgaacatagttggaccagtagtatatgcagtagtccaggtctgggcgggccccacggggatcacgtccttttttttattattttttgaaaaccggatcacgtccttctaccggtctacccaaacgagttgcacgatgccgacttgattaatcggtccgagtcacgcccgcccaaccaccagaggtagccgggcccggcgagatttgcaggctgccaatagactcgcggggatttgcatgcagcagcggcgccatgacatcggactggatcggccggcgttttctggtgcccgaccgtgacttgtctccggttggccgcgagagcacgagagccgtacgtctaagcaaactagttgtcaccacgtcttagtgtggagaagtattagtactctattaattagctaaggctagagttagattaatcctcaaattgcgaagggttttttttatgcgtccataacgtgtcttgcattggcgcatagctagagattagctaggacatttacttgacgaaagggggatttgagtaaatttctgatttgctagagtttggaattccaaacaggactattcaaaggggttgttccaacgaagcagcacgtggataatgacttgcttagcatcaggaaatttaataccctgacctgtcgctgcaatcgtgttgtttttttaataatccgtaatcatttgaataacttagtaatttcgcggtatatgtacatgtcattcttgtggcaagcgtgaaagtgagttcttgagtggccggttcgactcctaggggaattaacttcgtttttgagaaatttgttttacgttatttttggaactaaaatgtttggcaatttattttaatcgatgatgaaatcaatggtttttgtgaaatgaaaaaaaaaatccactcatagttattctaaagatgaaattgaggagttttcgatatttgtactatactataatataaaaaaggaaatcaacaaacgtctcctttctcagttggttaggcaagttgttgtgatgctaataggctacacaagtctaaccgtgttatctaagttgtaaagatacttgagatgtattttaaaaaatatatggaaatggtaattgagtgagtgtgttcaaacttgaacgcggtccactaggtttctaattctaaactttaccaactgcgcaaggtggagttatcgaaattaggtgatagattaataagtaaatgcactttcttggtggtaaagatacttgagatgtattttaaaaaatatatggaaagggtaattgagtgagtgtgttcaaactcgaacgcggtccactaggtttctaattctaaactttaccaactgcgctaggtggagttatcgaaattaggtgatagattaataagtaaatgcactttcttggtggccagttaagttgtaaaaatacttgagatgcatttgaaaaaaaaagcaccatggtggaaagggtggctgttggcgagtgttttaaaactcgaacgcggcccgctaggttcctaattctaacctttgccaactgcgctaggtggagttatcaaaattaggtgatacacaaatttataaatgcactttcttggtgaccagttatgcaaatacactagacttctattaaaaaattatggtggaaaaaggtgagcatgataatttttatattaaacgcaaacgaaaacaagggtgaaaaggtgagtgtgctaaaactcaaacacaataaacaagggtgaaaaggtgagctgctaaaactcgaacacggtccgctagtctgtctaactatagactttgccaactacactaggcagggcttcttaaaaaagcagtggactttgagtaaatatacttccttggttagatggccgggtatgaaaatatcctagaattgtatcaaaaagaatttgggtgggaagtgagcgtgttaagactcgaacccgggctgttatattttacaactctactatttgccattggcgctaggcgagtttatcagaattaggtgataggttaaccaataaatgcattggccttttgttaaattgcgaactatacaaacttactaaaattgcatctttttttaatcatgctaaaattatgtatttttatctgaatgactgtaaaaacttgctaaaattgtatatttttaaaatcatgctacaattttgtattttgtctgaatgactataaaaaaaactaaactgctactaccatctctaaataaatgtaattttaggtgatccactagaccattttaatactagtttatcttttttttttcgttttctccaccacaaggacatcgtagttttttaatctcttgcttaataatatatctttaactagttaaaactatacatttttagagtcggagggagtagatccttaactgtctctccttcaatcattcatgtcattgtccctttttctttaaatcttatttttttcctgttttaaattgttgttgaattcaatgtgcccttgatgggccttgaccgaggcccatccaaacaaggcatttccctttatttaaattaaccttttattattattattatttgcagtcaattccgaggacagttatgctggacacgaagactggcagcaacctgctccagtggccggtggtggaggtggagaacctccgtatgcgcggcaagagcttcgacggcctcgacgtctctcccggctccgtcgtgccgttggacgtcggcaaagcaacacaggtacgtacgcgtgattttgacacatgaacacaaaatgtgtcatacatttataaaaaaaaagtgtgccatacacatacacaacaactgctatatatccgacccgagaaactgacgtgcaagtgtggttctggtgtgcgtgcggttgtacagctggacatcgaggccgtgttcgaggtggacacttcggcagccgacggtgtcgtcacggaggctggagcagcagcatacagctgcggcacgggcgacggtgcggttggccgtggcttgatgggcccgttcgggcttctcgtgctggccgatgatcagttgtcggagcggacggctgtcttcttctacctggtcaagggagtcgacggcaaccttacaaccttcttctgccaagacgagctcaggtgtgtgtggtacacattttccagtatatgcgtgcatgtcttcctctgtgtgcacatatttttgcaaccaaatattcacacttgatcttgttattagaggatgtattttttttcgatacttcaatttgtggacagaggatgtgtgctgtcgtgtgtagaactccttgtgtatatataaaggaggcttaaattttgctttaatcgagtcaagatgtaaattttaatgcattttaaatcttgtttttttttcaggtcatcaaaagcaaacgatctagttaagagagtctatggcagcttggtacctgtgctagatggcgaaaacctgtcaataaggattttggtaagtctttctagcaaatgttgagtacatgcatattcatatgccacaacgcatatattttaatacgtcgtaacctacctttttgtgtgaattttctttcaataggttgatcactccatagttgagggcttcgctcaaggagggaggacatgcattacctggcgtgtgtatcccaccaaacccatctacgagtaggccaaaatctttcttttcaccaatcccacaaatgtgaaagtcactgccaaatcgataaaaatttgggagctgaactctgcttacatccgtccatatgtagactagatcatttttaatgtaatgggaatgaatgatttgtatacatttgttagttatgtttttatagactaatttatcttttttgcttccttctttatgtcaaactacaactatgacatattactagcagttgaaataaaacataatcaatcatattgttttgcctcaattttgttattgtgtgtgcgcatgcgcacacgtacgtgcacatgtgcgtatgctatcactctacccctgatgttattattagccatcaccgtaatgttgtcgtaagccaattgtgtcatgtttatcctacataaacaatatacgactttgcgaacattcctcttcaacaatgccacaaatttagggcccctagaaaatcactcaagattttggagctaaactctacttaagttcatcaatatataaactacatccttttaaatgcaatggtagtgtggtatgtttagattcattagttgtatctctatagtcaaatttgtttgtcttcatctttctacctatcaaaccacaactgaaaatttttagtcaaatatgtttgtttgctttcttcttcttatcaaaccacaattgtaaaatgtaactacaccttgaaagacacaaaattaatcacatatttctattttgtaatctaatttgtttgtttgctcttctctttctatcaaactccaactagaaattgttagtacacaatttaaagacactaaaaccaatcacatttttgccacagtatttataattgtgtgtgttacatttgtgtgtgtgtgtgtgttacatttttgtgcatgtgcattatatttgtgtgtctctgtgtgtgtgcgcgcgcccgcacccctactctggctatgttatcctcactcctcaccaatagccataaataaagtagtacaagtcatgccattcaaccagtcaatcgcgagacttcatctatacctaacatctacctagtggttgttagcaagtggggaaatgggtgagctcgtagcctcgtcatctccggttcaactatggacttattcggctaacagtttctgtggctgcatggcagctagctgtaggagcaaaaggcaaaactgtcctcgcacaacacaagcgctgcaaatcgcaggaatgacttccgaacgtgtcctatgtcttctaggacctctaaaaagtccttcccactttgatgtttgtttggatggccttattttcaattggaatcatttgatataaccaaaataataatcctttatatatggtttctctctaccatgtatcttgtttgaatccaatttatcactagattttaagaatcgttgacatcattatactagataatgattattaggagaagattcttacagcctgaccaacattaatcatgccatatacatacaacttgaaactatcaaaaccaatattatgacaccatacttcataacttgaagacaaattaacaacaatcacaatgatgccaattacctatcacactccatagagcctatagtcatgcgcaaaaactcacaccaaggcttcataaggtgtttgttccaatcagatgagactatatcagatatggcatgttaactgtcttttcctccccataccatcattttttgtaaaattatccatgaacaaattagtttgtgaaatttgaactatagtcagctgttgccggggtattatttttttatataagaacaagaagaagatgccttatttcaaggaaaaatgagaccaaaatttgcggtgcataattaattatacaaaactaagcaaaaaccgcaactacaacacattcgtagccaactaacctaaactaccacaactagaagtaagacaactaagctcaacactcaaactctgttggccacaaggcattattgccacacgttgttgatataggtgttgtagctacgagaaacaaactgaaagcatagacccccacacgttggcaatgacatgtcactgtcatcataccatcgcccacacgatcaagtgacccctaattcgctaggaagcaccatagcaagaactatacaacttgctactctacaccgaagtgaaacacgattgacaggtccgacatgagtcgtcattgccgagttcacatccacgcagcagcttcaactttcctaggagacaacagccaaacgcctctcccaacttgtcatggttacggataagacataccttctatcctacgacttataaaatatacggatatgtcatacttttgtatgtacgatacgtttttgtgtatgataaggaaatcgacaagagattatggaaataaacctcacgggcaagtaacgtggtagagttctactcagagaaggttgggattataccatatcgtgtaggatacagagtctcccagtagacgttctacttggagacaaaggggtccaaggtataaatagccaccccctggccgggggggggggggagccaacaccaccaccatagcctacaatctggaggacttgaagcctactcgttgggagatctcgtcgaaaccatctcgacaaggatctcgctagtaatctcgggattgactgttctctattgtaacatgtgattttctatatcaatctcatataaactggattagggctattaccttacgagctaggggcctgaaccagttgtagcgcccgttccgtcgtggcgcctagcggaaaaattatctcttaaaaaccctaattgcgaaatttgtttcttcgcttgttgtctagtgtccgtgccatctcaagatctcaaatccccgatctatcgtcaagttcaattccgaatccaaatccttccaaatcatatccatccccaaaagtctattttgcc

SEQ ID NO: 81025 - DNA, 20622 bp, Oryza sativa
tagtttatatataaaatagtatatcttgtcaaatacaaagtacattgataatataaagcaattgtctaacttgacagctattaagacatattgggcatcctatttcaaagggtaggtagtggattacgtaaataaatggttaaagttaaacacgtcctgcaaccaaataataaattgggtttttctcctagtgttattgtagtccgatagaacacaagtagttaactcaactcggttttagaccaaggtttagatctgacaaacacaacttaaaatgtgagagtggaacaattgttcaccccgtatatttataatagcaaagaccatttgcaaatacccctaaaaaaagagctgcccaaggttcggcataggcttttccccaaataagtcacgcatattaccaagattgggacttaaatctctcaaagtgaaggtcagaaaggatttcaagagggtaacagcatgcagaacaagaacatgggtattttatagagtagagctggcgaacaagagactctgcatatgttcttctcccatgcatattgcaacagaaagtctcaaatccaccaagtatgaaatgaatatcagaaaaagaatacacaagggcaacagaaaagaattgcaagttagcgctagaccgcttcttattcatatcagtaaattactagaaatcgattgcaactccaatcaaccacagatgaagaatagcataaacgaattaaaaagggcagttgcatacaccgtccgtccccaaaaaagaaaaattacttctggctatgtatctagacatagcctaaataggtaggcaaaagttttttttttttggaacggagggagtagatcaagaacaaaaatcccccttttgcacgcatgggaaatagaataaggatacatgaaagaaagggggaaaatcaataggcgtaacaaatgttaaactactgataataaactatgggtaaacaaaagaccaaactttatggctattacagattactttcatctcaaacccactaaatctcaaaagctggaatcattcttgcaagttagaaggaaaagagttcagccagctgtttgggacaggagaagggaagaaagaaggcggtttcgtgagatttcgtccagcgtgcaatgtgttactctcgagattccatgagatttcttccatagttcaatgttttaggttagaagcacaagaaaagctaacatacaagccttttcaccaacagccatcacatatggacatttcactcccgaaatctcaaaatgtgttactaatatacctagcaacccaagtaaccttgtgagagaatgggaatacccacaagcaagccaaaggtttctaaagagtctacagaaatgaaagaaatatgctctaccaagccaaagcatgttgacacaggttgtatcatttgtccaaatcttactattaagataagtccattctcatcctatccctttcctctattggcccagctaatcccttctctccttgcaactcttggttctttttctagactcgataaaccatagccatcattgacaacaaaatatatgatgcagccccataatcaaaagccttgtcctgttgtccatctataatgctacaatttgatgcataatcaggtctaccacattcacacacatacatggacagagataagtaccaaaagccatcaaatttgtataaagtgaattatccttctttcctcatcgaacttagacttttggattgaactggtcggtgcatgtaactcaatatggtatcaaagaagaggccttgagttcaaatcctgactggcatgcaattaaataaaaaaatacagcccacttctaaatattccacgctagagacttgaggttgtctcgtgtgaaggggagtattggaatacaaagtgaattatccatcttttctcatcatttagtttttgagttgaactggtcggtgcatgcaactcattacatcaaatctaaatgagttcatccatgaacaacataatctgagattaggagtatacctcagttttgggaggcgttggggaggggaaatcgatgtcgatgcaaacttgtgcgccgaatctagctgtcctatcctcgccgccacctactcgctgcgtgagccaacctgtgctcgtttgtcgaccggccgccgcctccctgctcgccgcacccgtcaatcgcttgccgcctacctgctcgccccttgtgctagcctgtgctcgctcttctgccggccgtcgaccccctgctcgcccttgcgtcggcctgagttcgctctggcttccgccccctgctcgctgcaaccgtcaaccgaacggcgtgattttttaatattttctaaaccttttgaatatataatattttaataatagatcctattagattttattgtcacatctgaatttggaccacgtcgagaatacttgcgttaccaaataaccgtaccacatcacatgcataggcatggcagaacacgccacagccacgtggaagagtgtgataccaaaatgccctacctcatcggcttcgttgccatcggctagtgggatgccgtggcacgggggcggccactggacgctgatgtggtgtgggcttgagcggtgctagaagctcctgatcgtcaggtgatgcaacaatcttgcaatgcttccacccatgcagcaccaccgccccgcagcgccaccgcctcctcctctgccttcaaccgcaccagcatcaccgcccccttctatcccttcccttccctcacccccttctcgtccagcttcctcttcacagaccgccggcacatcacgaccgcgcacatcatcaagcaacacgagcacgagctaccctctgccatcgccattgtcacgcccgaaaattcacaagtaatttccgaactaatttgtgcattaaaccctcgtccagaaatcagccaaagtacacaaactgacaatttaaaatgcagattcatcataataactaaagcgcttaaatacttacataagagacacttagtcatcaccacgaagaaaactgcagcggaaaaacttacataagagacacttagtcctcaccacgaagaaaactgcagcggaaaagaaaatctagcaaagcttcagctccactcccacaggtagctcaattgggatataagccaaagatcttctccttatggatcctttttctccaactgagatttgatgattattgcaaggcgattatatggaataatccgcaagccacacaacaagtatgcaagtgcacagggataacataggatggcataatgttgggttcatttgcgaaagcagcatatggcaaagagttgtgaatttgtaaaatagtagagtaattaattaaacagtattaatgcaacactatacaacatactcgttgcataggcccaaccatatctgtacaaccatgcccggttgaacagacccaatcttcaaccaggaattaaccatttcaaaccaggagctaaaccaaagtatcatcatttatcacaaaaaaattgctatgctcgtccatgaccgcgggcacggctattcgaatagttttacacaacaagtatgtaagtgcacagggataacataggatggcataatgttgggttcatttgcgaaaacagcatatggcaaagagttgtgaatttgtaaaattgtagagtaattaattaaacagtattaatgcaacactatacaacatactcgttgcataggcccaaccatatctgtacaaccatgcccggttgaacagacccaatcttcaaaccaggaattaaccattccaaaccaggagctaaaccaaagtatcatcatttatcacaaaaaaattgctatgctcgtccatgaccgcgggcacggctattcgaatattttaatatggccagaggtgtaccactgtacccacaagacacaaccccataacatgttaacatgccctcagtaccaccatggtacctcgaaacgggactatgacaaggcacctcgcataaagcaattcaaagcaatgcaccattcccagatcatagtcaccccctttagagcaaggtatagactccccagcgacccccatgggattatctccgccacttctcagtctagcactccacaatgaaccatgctatacatcgcatccagttgctgcccatgctggcttatggttagtacggttaatgcttcacaacagtagctcgccaaccggttcttaattatcatgagtacgaccttcaaaaccatgtactcataacccaccattatcaggttttagttggcaaattaattaattaaccaatcacgattaaccattatgagctatcactaaatattcatcattaagtaatagtgaaacattagttatgccaatactatgctaatgtttctaaacatggctaagcaattatatcaaatatctaatataacgcccaagctagtcaaataataacccatagaataataaagtcatcttcggccataatataaggaaaaggctcacaacagctaatgacatttgaaaataaatgtatatttgaatgaaatagagaatttaaacataggttcaacatgctcagaggaattatgtttgggatctgtatgacttgccttgcaatcaaacatcttcaatccatcttcaggagcttatccaacgaacgaacggtcctccaaaacgacagaaaactaaacctggaacacaaaatgaggaaaaacactaataaaaaccaaataaacaatacaattaaagttcataaatgggtagagattgaatttatatgaattacgagacttgaacgacctcattccaagtttgtatgaattagttatgaattaatgaagttttaattgattaaaacctataaagaaaacaacctaaatgatttattgcatcatatttaattattttataactgaaaaggaggaatatgacatcagcactaggatagaagagtgaaaggactggggacgagtgggacccacttgtcatagagacaagcggtagaccgggtctaccatgacccaactccacaaaggtggtccacgggtccacgggatggacggctcagatcgagttgaccaagatccaacggacgagattagttctggtctaggttttgaggtggatgccatgcggatagaggtgtgacatacaataaggccatggcctacgctccagcgtggagcgtggtctcaccccgcccgaggggaatattcccgccagctcagacgggaccacacctcagcagaggtgcgcgaccccagcagaggtttgcgtggatttgtcagagtggggcgaggaacgggcgaggagccatgttgagaggcctcgtcccgtaacgtcaccccggacgctgcggacaactacctctcgcgccaaggacgaagatggcgccgccgcggcccaatctgccaccgacgcctccatccgtcgccgttgccactcgatccggcgccgctgcatcgatccgcccccgccgccgcttgatacgccgttgccgcctccatccgacaccgccgccgccggggaggagagcgccggggaagggagaggtggagagaaaggaggcacagagagatatggtgatgagaggaggggtcggtgtttatatatgtttgtgatttttagggggtatactgcaaatattggacttatatgcgaataaaactaatctaagggtttaatgcaaaatgtgaccgacagataggtattgaattgcaaaaataagatggaggcatggcttacactatgaggcatatccctagccgggtctttattcacttttgctcacgtggatgttgggggtgctccctgcgttggcgatggcctaaggtgtcagctgacgtggacgcacgcgggatagacgtcgacggcatggtacgacaaccacgacggcaaacggcggcggaaaccgagagcacggggaggaagaggagaccgaggccatccttaccagtacttacaagacgacagacggtgaacggagacggccggctgcgagctcgggtcggcggctttctggcgacgacgggcggcggcaacggaggggtagacgggcttctcctcggcgctggcgatgccgaggatggcgatggggggaacaacggtgggtcacggctggaggtcgatgggaggcagaggcgctcgggttcgcatcagcgagcagcttcctgcggtcttcggtacaagcgaaccggcggccgaggtagccctcgcccttgtggagccgaaggaggcaacggcgcaaggcggcgtcgaccagagaggcggcgcgacgcggccggagttggcggcggtggcggacagagaggaaactcgcgggaagaggtggctaggccacggcggctcggggacaggaggggaaaccgaagaggagacccgggcatcatttatataggcggaggaggaagagatccatgcggatttggggtttcggcggtgggaaataagggttcccgagttcatcgggataagaatggggccgaaatccagcgcgaatttgttgggggctttcttgtggcgaacgtagaggtgatcgagggaattccgtttccgcggagcaacgacgaggccgaatttggtggaggtggcggcgttgatgtgcacgggcacggccgcacgggagaggcggctgggggaggaagacggcagtcacggcactgtagccgggtgggccctaggcgtcaggagaatgaaggaagagggacgcacagaggacttcggacgagaaagacgggcgcgggctgcgggctgaggaaggagagaggagattagtgggatggattcgttccaaaactcagggaaggaattttagttgattttctatttcaagtaattactgacatgttatttcatttattaaaaatacttaccatactcaaataattccaaaaaaatcctgaaaatacttaggatactcaaagtatttaataaatttttatctagctcaatttaatgttcgaattttttatagattttattcaaacacttactttcattattaaataatttctgaaattttctttttcaccacaatttataatttagctattgttagggtgtgacagctgtcactgctgctccagccagtgggttgtggtcctcgtccatggccgctcctagcgcgtttggggcatttttgttccatcaccattagagatggcaatggggacccgatcactgattccctacggtgaattcacatattaggggatggttaatatctattctccatggggaatcaaatggtcccaaactaatcaccatcggtgaggacggtgaaccattcgccgtccccgcctcccgcggtgacacttcttcagacgtttcgacccataatattgaagcccaattaacatgtatatgtacatctaaccctaatcaactagtcaacctccacatcttccagatccacacttccacaaactccacaccaggcgcgcgcgcgccgccacctcctattgcgcgggctctgtctagccccagctgtcgacgcgggcgcacgtctgcagccgtcgcatcgcccgaagccgctgctcgaagccgtcgccgccgtcgccccgcccggagcccgctgtcatcgtcgcgctgttcgtctgccatccgtcaccagcgccctctgtcccagtcgtcgacgcaggcgcgcgcttgtagccgtcatgccgctcgaagctaccgccatcgcaccgctcgaagccgccgcccggagcccgccgtcgtcgtcgcgctgtccatccgccatcctccaccagcgccctccgtcgctagcacaccgtccgtcgccaacgcccttcgtcgccagtatgctgtccgctgccaccgtttctctgccggctgctgagtgctgactaccgcaggacgggggtaaccgtgggggaaattcaccgcgtggggatcgaggctggagaaaatgtagccccgttatggttgacgggggcgaggacggtgaaattttatcaccgtggggacggggacgcggatgtgacccccgacggtgaattcaccgttgccatctctaatcaccatgtagaattgcgaaaaataatttaaaaatcaatggaaccaaaaaataattactgttttgatactgttcatgggttgattccgcacaatggaaccgcgtgactaccgcgtgaacagtattaaatcgctggctgcgggaccgttgcagtgccatgcgaccatcccgtgggccgttggtcccgcgttttggagctacgagatcatcgcggtcatgcgttttcaccccgcaggatgggtttatttatacaaatccttcccatgcaggtatataaacgtaaattacagaaaaaaataagtatattttgcaattttttattacagaaaaaaaataagtatattttgcaattttttttcttggtcttctttttttttgtgaactaggagagcaggagctcccccatttccattaagaggaatgatagaattatagtatccggttctaggcagcagatcaactttcttcgctcaccaggcgcgccatcccaccatggctaagaaagtaagaagagaggctaacaaaaagaataagacatacttgcacaccaggtgctcggtggcactgtggcagtgttcaggttggctacaaagttttaatttctcccacaaggaaaatccccagggttaatcaaagctgcgctaagaaattgctcgactcatttaccaccatggttatcttcctgtcttggagccccaaccatgcctggtgctataaacctcatttaccactcgttttagcagtctgcccccctcctgcagtcttcttgtttcttcctccttgttttgtaaaattgcccaatcaaagatacaatgagctacctgaaagattacatctacgagatcattaggaagaatattctcaaagcaggccattttccaaattgcccataaagcagccgcaataccaacagccactagctttgttataaaaataaatgcacaacagagatataatttttatggggaaaaccctttcgagaaaaaaccacggtaccgaccggtagcgatcactattaaggagttgattacaagcgtagtggatacattggactgtcgcaccctccccatccggcttacaagggatatatatagcaaagatctaggagtactagtggggaaagacttaagagtcatactaggaaactaatcggaaaatgcttacgatcggcatgccgatttggagagaaaaatcgggcgctctcctcttactataatgtgcacgcagataagtgctaggtagtttctcttctttcttctcctcactttaaatgttttttttctcttaaaccatttgtccgatttacgatccgatcacactgttatatttattataattaaatctttacaataagatattgcataattatattctgataaaagaagaatatatgtttcaaaccgttataactcaatgtttcatacgtgatagtgacatgtttcatcatgtgcttttgctatgtttcacaaaattcatttaactacttgcacatactctatctctctccactccttgcatgcatgcatgcatgtatttagctatctttaaaatgatttttctcctgaactacttattcgatctacgatctgatcacaccattctatttattgtaattaaatatttaaaataagatatcacatgattatgttttgatgaaagaaaaacatatgtttcaatctgttcatatttgatatttagtttcaatatgttaatatttgatgtttcatacacgataacaatatgtttcaaggtgtgttttcactgtgtttcacacactttttaaatgttttaatgactgatttttttttcaccatgtataacttaatgtttcacaagcggttaactgaaacatttgaccgtccggttttttgagagaggatcggatgtccgattggaaatttcctcccacttcttcaaatattttttcttctaaactaattatccattctacgatttgattacaccgttgtgttcgtcacaactaaatctttataaccagatgttacttgtttctattttgataaaaaatcaaataatgttgcaacacttaaaataaattgtttcattacttggtcaaatgttctatttctatgtataaaatgttttaaaatgtttcaaggagatacagcattcataatttgttattgcaaccctgacaaccgctccactaaaaatttttctatcatgtaatgaaacatcgatataaatcatatgaaacacaatttttttttacaaatacttgaaaatgttgaaacattattatatcatgtaaggaaacattaacttgtgactactaaaacatcataaaatatttgatgaagcattcgaagaacaccacctgcagcattttaagatcaactagtgaatcatcctaaaatactacctgaaacactcaaatataaccaagtgcaacatataggcctgtttggtacagctccaactcctaaatttagctccaggagttgggtctggagtggagttgtggagctgccctctagttcattttgtaagagagctccacccagctccactcctagttttggtggagttgaaactgtttggctgagctccaactctaggaggtaggggtgaaaacggtacggaaacgtacggaaacaacctttatcgttttcgttttcatatttttttttggaatcggaatcgaaatcggaaaccccaaaaacgaaaacggaaacgaatattattgaaaccgaaaacggaaacgaatattattgaaaccgaaaacggagcgaaaacgaaccgccgcggatacggtaacgaaaattcatcagaatacataaacccctcaaactgagcctcacagcaaaaacatattcttctataacttcatataatttgcataacaaatattctaaaaaaaattatagcaagatactatggtataataatgtatagagtatatatagcctattattcagtgctttcactccataatcagtacatactacatagttctcttctacaaaattaacagaagatatcattcatttacacagtataaccaagctccttagtacaaacaaatcaatcatttacacagtataaccaagcttcttagtacaaacaaatcgatcatttacacagtaacaactaacaaagagtgatagatagagctggaggttgaggaacacctgcttactgttgccgctaggctgctggaggcgttggcgtcggctcggcatcgatggcggtgaggaagccagtggggcttgagatgtcgtcggtgtggtgtggctgtggcctgtggtctcgtcgtcgatgtcgcgtcgtcgtcggtatggccggcgtcggtggtgtggctgtggcgtcgtcgtcgcctcgtcggtggtggtggcagcggcgaaaaggcgagaggcggcgggacggcgccgcgagatggtgggggcgaggacggagcgaagaggaagggcggcgcgagatgcgagacggcgggggcgaggtcgcggggagccaaggaagcgaggacggcaggccggcggtgggtggtggcgcgctctggatgcgccgctccgccgccgcctctggatggcgatgcgccgctcccggcctccctcccgatctgtctgacttctctctctccactctcttctcttgggttagcagcttgggttgggccggctggggacttggggagggattatggactattgattggatgggcctttttaacttcggaaatttcgacaaattttccggaatgtttccgaccgattccgagttccgacgcaaactgcgattatcatatttgattccgtttccgagaaaatatttccgttttcgattccgtttctgagaaattctgaaaattttccgaccggctgattccgtttctgaaaataggtacggaatccggaaaaattccttaccgttttcacccctaccaggaggggtggagctggagctgtgccaaacaggcccaaaatatctattgaaaaaagagctaaatattttttttccgttggaatataatcatgtctgatcttgttgtaaagatttaattacaacgaatataacagtgaaatcgaattataaattgaagaagtaatttaggtgaaaaaaatagtttcaaatttgctaaaaagacttaaaacaacctaactaaccctacagaaatctcatgcatgctcctacaacactgctatgtgaagggtcaacgtgagagaaaggggtctgaccaatttacatgtaaaggagtggagtggagtgtgcgtgtgttgaggagcgcacgattttttagccagttatcgggcgcccgatccgtagtcgtatcaaactaatcctaatagttaagttagtattagaaagacttatccaaatacattgcagatctaaaattcgaatcacatatttaacaagctttattgtcttttgggtaaatttcttcatccaaggtcccattaaattctgcatcccatttggcatttcacaatcaaacacacattttactgtactccaaacgaatttggcaatattttcaatcttattagatatcggaattgctgtcatgtacagattatttcagccaggcgcccaagctagctattggtctccatgtgttctgcgacgacgatggctgcattttccccgaaaatatgttcagactgaagagagagacgaagaaaaaagagaacttggttgaaataaacggaagattgctacgttctcttctttcatgtgccgatgtgcctcaagtgtcggtttccaaatccaatcaaccccttgagtaaagtagtacgtactgtatgaggaattgacgattgatcttaagaacagactcatcgatcatgaaagattggttgggattgccagtgagctgttcagtacagtatgcgtcgatctatgcgactatacaccaacggtatctcgactgtaaaatttgctacagaagcagagttcagtgcctggcaaaatcattatgatgtaacaaggccgaagagcgtgcgaaaaatagagttggaacagctcacgacggccagttcctgtaccagccggcccacgccgagacgagcccactgatccccaacgtgacagcgtggttgcagaacgggttgggctcgatgtccgcgatgccgatgacgaggtcggcgacgttggcggccgtcgccatgagccgcatcaccctgtccatccggatcttcttcacctccttgtccttgtccttcccgccctccctgagcagcttcctctcctgcctgaggcccctcctgatcatgatgaggtccatggcgatgaagaacacgtagccgacggactcgccgaaggcggagatgaagctcatgcgtcgcgcgagccaggcgtcgaggacgccgacgcgggagagccacgtgaagtggtcgaagaagaagtagaccatctcgccggcgttggcgagcacggcgagcgcgccgaactcccccggcgcgcggcgcagcccgttgagccccgtgaggaagcggcccgtgcggaaggccttgcggctgagccccgcggacgtctcccagttcttggcgcgcccggcgaggcccgggctggacgactccgccgcccagtgcgcgagcttggacacgtactggaacgtcttgaccagcttgtcgatgccatcgcgcttcgcgaggaagaccacgagcttgtcgagcgtgtcgccggcgctcatggctgcggctgcggtggcttggaaggctcagtgggagagcgcgcgtgcatgggagggagagagggcgccctctggcttgggaagtgagaagcggacgcggcgtgtgtggtttggtttgggataaagcggccgtggcgggtacttggctgggatgcgtttgtcctctgcgccagaagtgattttctggtggtggtgaggattgagatcgagggctcggtgagagttctacccatctttgtttgcttgcttgattggtcccttgtcttgttattagtcttttttatttttgcaacttgggctctcttatctttatttctccgcacaatgcatccgtaacctatgaattgttggggggaaacactaggcaaaatcatgtcaagtagcaacaccatacaaggctgaaagtgaacaactaggcaaacactctacctccctctttcaaaaaaagagaaaactgaaaaagtagtagtagaagaagaagaaatacacatatttttgaaaaaaagagagagagagagacaaacactattgtacagttcaaggcttcaagcccatagattctctaccaaaaaaggttcaaagcccacaggtgaaattccgtatcccacacggcccatcaaatctcattgttgcttattgggccagttacctctcctccgtcttcccccttagatgaagctgcagtgcaggttcagggggcagccgcgacctgcgtccgggactccggcgctgcgacgacgacacgttcagagactccgggctcccgccggcgagaggccgagggaagtccaatccggttagctctcgctctctcctgcctattcctcgctcatacgcatatgcgtgccttagcggaattggagtagtgcttgaaaccttgtgtttctctttagtacctctggatctgatcaaattggaggcttaggtgtgtgcaaggttttgccgatgtttccaaatgatatctgtattccgcgtgtttgcatacgcggttatattttcagcaggaatcgtccatggaggggcggaaatcaacttgccttcgataagggcaaagcctcgtttgataaaatggacagttaaggatttgcttgtggtaaatatgtttggattttagagaaatatttttttaaccagctgatgatttggctaaggaatttgaactcttgcgcacttctattggtcgtagatttgggtggtcagtattgcttgatgtactaaccggatagtctgttattatggcaattatgttgttatcatccttctgtgatttgtctgacattcagagcgaagcttaattctcaattatgctcactgtatctttggttggccctttaatattttcctagtcttaggctcttagcactaaggatttcaaccgcaatgatcgtttttacctgattgtgcctcacaatgaccatgtctagttcgatgcaaaatacagttttgtacgtttctttttacatctattcatgccatgtactcccttagttttctgtatgttttgaccagctatagtttgggacagaggaagtagttccgtaatatataatatgcaaacttttgctaggtgtagcttgaagttaggatgagtgtgaccacagaaatacataattgcaaagcatttggaaagctgtgttccattatattttttcgggaatacgcaaggagcacatttttgtattaagagaaataaaagttatttacatggaaatacaaaaacagcaggggactgaaaccggaatgaaacacaacattcattagcctaaatcttgcactagttttggcgaccttgatccctccggagaaccagggaggggatagccgagtttgcttgacgccaaagtgtcttctcctccgccattccccttgccacttcaacccaggtcctgcgttgctggttgaacacccggccatttcgttctttccagattctccggaggaaaaaaaacatttagaagattcaaacacacaaacctcagctgattcctgtttcagccaagccagctgtgttccattataaacaagtggcaaagagcagaaaacacacaaatagatgtacatggagttgtgatcttgattcttgaaactcagttgaatgagtatcataaaacacttagtgaagttaactgatccttgagttcctattgtattgtcttctttgttgcgcaactagtctctgtgatgtaactctttcatacatatggtattcatcacttggattgattgatatctttggttcagagctatccgtcaaatggctgtgttatatgggaaaaacaaaactaagccaattgtagatctatatgccgtcttttgtttcgttgttgttaacctgatatcatactggataacattccattgtttctgtctttttcgtgatactgttgagtttttgtttaccaatatgctatgtatagtaccatagttgaggcacttgataactagtttgttttgttccctttgcagtgttgaaggcacagatgtcatcctgtaccatggcctctttaatttgttcacagataaaattaagcaaagcacatattaggaacaggagacagattcatgagaatggacaaatcagattgcctaaatctctttattggaaacctctacactctggccattttgaaaatattgtcttgcgatgcactcaaaatttgtcttgggaggcctcccttccatatgcctctgcagaagatggtgccaacattattaagggaactgaagttgttgaacctattgatacagaagaagcaccagaaattccgatcctccagagtgaccaggattttgtggaggtgataaaagaaccttccatgcagctgacaacttttaaactgccaatttggcttttagggccttcaattctgttggttacgagtatagttccaactttatggctaccattgtcttcagtgtttcttggtcccaacattgccggccttctatccctagtgggacttgacttcatttttaacatgggagcaatgctgtttttccttatggctgatgcttgtgggcgtccggaggccaattcatccgaactgataaagcagatcccaacttcttacaggttctggaatctggctgccagcatagtaggctttcttgttcctttggccctgtttttcgcatctcataagggtactctgcagccacatataccattcattccgtttgcagtgctgcttggaccatatctcttgctcctttctgtacaagttttgactgagatgcttacttggcactggaaatcgccagtttggttggtggcccctgtggtttatgagggttaccgagttctacagctgatgaggggtcttcagttagccgatgagatcactgcgcctggatggatggtgcaaagtcttcgtggtttggtgtcatggtgggttctggttctaggcatccaactgatgcgcgtggcttggtttgctggactcaaatttgcaagcacttcaaggtacggagcaagtgatgataataagtaaattcggacaagaaaaaaatgttcaggtttacatgttttgctcatgcctctgccatctgcagcacgaaatgctattctgatgctactcctggcaccgtctggggttgctcacaggtgccttcttcatcaactagttcagtagatcgtatagacgaacaattatcagactgtgtgtaatcactcttgtacatacaaagtttttttttataatacagaaatatatgtctttacatttcctcggtgaaggctgaattgcattgcacatatgctattttctgtttcaaactttttttcacaaagcgcctggtggtattcatgtactacttgatactcctagtactacaaaccaagcaaacgtttgacaagcgatgtgtgtcactgtggttgtgtttagatggtggaaaagttgggaagttgagagaaaattgatagtttggagaaaaaattggtaatttatgtgtgtaggaaagttttcgatgtgatgtgatgtgatggaaagttaggaatttgggggaaattaaacactgcttatgttttcaagccaatccgacacggatataacaccaaatcacccaaacacacggatgtaagttaccgtgtctgttcacccacttgatggggagttgaaatcctcgtcccgaaatgtgacgctctgcctgcaatcatcaaatctgaatctgaaatgaagattgaagaacaccccaactgtcagaaagaaaaaaggagccacgtgagcactacttttctttctttgtttttctcaaatctaccattgccttaaccaaacaaacatgtggccttttccagaaaaaggaatgtgtagtgtagttaattactacactaggcttttgctcgtcttccgaatttccgatccacctcgcgcagccgtgctcgtgctcgtctcccccaccaaaagacccacccgaccgggggcgacaccatcacacaccaacccgacattccctcgtgctcttcccatccgcgactccaaaattcccgtccgctcctccaggcaagcaagcacggaaacccactcatcactcactcactcccccaaacccaaaccctagctactactagctccccgctccggatcaagcgcatctcgagttcgagcgagcattcccctcttcggttcgagtgggttggctggcggcagatgggctccgactccaagaagttgctcgggatcgagccgctcgagctccggttctcctgtacggtttcctcgccggaaattccctgcttgtgaaattccggagccacatgccgctggggttttgtttgtttttgctgattcttttgctgtttggattgagcagtcgagacgaagaagcagatctcatgctccatgcagctgacgaacagaacagatgactacatcgcctttaaggtaactggaatctttttcccccacgaagaaattcagcaatttggtttcacggagcatagagcttgggaattctgcaaaaaaaaaaaaagaaaaaaagttaatgagatttgacgcgctaacgctaaatttggtgaaatgttgtgctccttaggtcaagacaactagcccaaagaagtactgcgtcaggccgaacagtggcattgtgccgccacggtccaccagcgatgtcatcggttatgctcaattctcatctccttcatgcaaaacgttgggatattttcctcgtcctgttatctgtgtgcaaaaaattgacagttctctgcatttccttagtaacaatgcaagcccaacgggaggcaccagcagacatgcagtgcaaagacaagtttctagtgcagagcgttgtggtgactgaaggcacaacaaccaaggatgtcactggagagatgtagttcatgttctaatgtctatcagatggttgattcttgattatgttgcttgatgtttgtttctaacttcctagttcctatgatgccaacatgtgtaccttttctagtttaacaaaggatcaggtaatgtggtggatgagaggaagttgaaggttgtctatgtccaaccaccacgaccaccatcccccgtgcgtgagggatctgaagaaggctcgtctcctcgggcttcattatcagaagggggcaacttgaattatcaagatgtgagatgtctgattatgcattgtttcatttccttgtttttctttaattcgtgtggatatgactgattgtttttagacgcagacaactcgggaatctgatgagccaccattgctatctgttagtaccttaacttttatatgcacttccccattctgctcttttcaaagacgagttaaactgagtagtagttatttttccaggctacaagagcacacaaggatgcagaagatgtaacatctgattctgaggtgagtcactccaaataagttttctatgttcacttgtaactttacatagaagtaaaggaaacaacagtacttatgtaaataggtttcagtgatctcttagcaaacattgcatttcaatcttctattgaagtaaatatcaagtgcctttgagacttgactatttcaacaaaaacatggcatggatctgatggtcaacagtaccccaataaaacttgccaatttgttttacagctttaaatataaatgtcttttacagtcaatgattacaattaaaatttcaatgagacctgagcttggtaaagtttgcttggcacctgtaacgtagaaaacaaagtaatactgatacaagcaagatggagtagatgttgttgtgctgattgatacttgtaattgcagtatgtacttctcattgtaatgctggatatttgcacagtggtttgttatatgttaagggatcattggtcaagcccaactacgtataagttcaaaagttcatttcagttgacaccttatttgttgtcaattcgtcattttgttttgaaattggtcctttctactctctgtagcaattatttttgctctacgtgcaaatgcacataaattacctgttacagagtggaacattttttttttcgacattgattatttgttttatggcactaggctttcattacaaagcagttaatgtgttgtccttttcaacatttaacactgttcactcctcagccatattggccagcaaagtatctttcgcttgccttgtactgacacgaataatgcctcattaatttcttttatcctatgtgtagacatctgctttgatttcaagattgacagaagaaagaaactctgctattcagcagaacaataagcttctcgaggagatggttagtagatactgcccttatggaaacattttgtcgcatgctctactctttcattgtataagtaatttattcctactgtgataaaggttgatattttgtttaatttgttattatttatgtaaaaatatataattttctacttcatacttcctttttttaaaaaaatatattatgctctcacctaaatctgtactcctttttgcctctcatcattttggcgatgacaatgttgcatcacaaaaggt

SEQ ID NO: 81026 - DNA, 2687 bp, Oryza sativa
actgtacctacaagacacagccccacgacacgtttccgtgcgccgacatgtcaccacgacataccggaaagaggccgtgacaggacccttcgcataaccccctctaaccaagcacaccacacctcaggtttcacccccgtccccagcggtcaacgggcagtcccctctcgtgcctaggtgaatccggaagcgacagaggccgtcgcagggcccgccccgctccatcacgcccacccttgcctggatgcgtcggctagaggaaagctacactacaagcccagccgttgcccacgctggcttgtggtaagtacgataagttcttccagggcatcccgcgaaccggtccttaattgccatgggtgcgactagcaaaaccatgcacccacagcccaccattcagtcacattttagttggataattacgaccatgaagcatggccagatgtctcgagcacgcagctcactctgatactaaaaaggtctaatactgtaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcgaaacaatcttacggactcttttcctcgcgactgcggacttccgaaacgacggattctacacgctagcacgcaaaacaaggaaaaactctaataaaaaccaaggaaatagtacataaaaagtaaacaaacatgtagagctcaattttagatgaattttgcaagttgaacggctcaattcggagttcgaatgaattagatatgaattttagaagttttgagccatttaaatgaatttctataattattcacgaattattgcgcaattattatttattttctcaaaggaaaaggctgtgctgacgtcagcaaagggccggcgccgacaggcgggccctactcgtcagcggcacaaggggcaagcacacggtggactcgatccaccgcggccgaggcggcaccgtggacccggacctcggaagtggtccacgggaccgacggcctggatcggcccaaagccgatccaacggccacgggcggcgcggctggggcaaggcacggctcaaagctggctggccaaacgacggcgcgcggcggcgcggccacccgcggcgacggccggcgacagctcacgcgggcgaaagcggcgcacgcgagagagcagcggcgcggccggcaagggggaggcggcaaccggctgcccggcaccaccggcaacggcgcgggcacggagtgcggagcgcggcggcagcgacccggtcggacgaccaccggcggcggcagcacgtcgcgaggacgcccgggaggcggccgacgaaggggaggaaaagggagagggaggggagtgctcaccgagatgcacgacggcgaaggggcggccgacggcaaggaacggtggcgacggggctcctcaggaagacgacgcgacggagctccggcgacgggcgtcgctcgggatggggcggacgggctcggcctcgatcggcgaccgaggaaggaggagctccggcggatttccggcgaagaggggcggcggccgaggtcctcctcgtccttgtggagctgagggaggcaacggcgcgggtcggcgtcgaccgaagcggcggcgcgacgcggctagagtcggcggcggcggcggagagaggtggttcgcgtggctacggcgctacggaggtggagaggggaaatggagcggtagccgagcttgcccgggcggcggcaaagctggcggtggcggcggcgcagtgcgggggcgacggaagcggcgacggaagcggctggagggtcgtcggcgtgcggcggcacacaggagtggcgtgggaagctctaaagagcgcgcgggaggggccagtgagttggggaaacgcattagtgcaggtcagggtgcatttttataggccccggagggggagatcgtggccgtggcgggcggcaacggccggcgggtggagctccggcaacgtgggcaagtggggctcgaacggcgccgattttttgggggggggaaatgggggagaaagtggaggaaggggaggacgtggggtggaccacgtctgcacgcgcgcggaggaagcggcgtcgtggggtggctcaggcggccatggcggcagttggagctggaggaatgggatgacaggtggggtccatgggtcccacctgccggagagagagggaggaagaggccggctggggaggcagaacggacttgagggggagagagaggcgagcgggccgagggaggaggccggcccgagagggagagaaagggggcgcgtgtcacgtcctgataaattcatcccgaaataaaaatcattttctaaaaggaataatagaattaattaaaattcgaaaagaaattggcaaacactaaaatacgtgcaagaaaaattcaaatgtggcccggagaatttttgttaaattctccttggtctaaaaagagccctcaaattttagtggaattttcagagcacaaataataattattaagaaat

SEQ ID NO: 81027 - DNA, 9859 bp, Oryza sativa
atggcgcgtatcctagctaggtgatccctgcccggccggccggcgcgcgcggtcttggctttcagctgggtgatttgatagtgcggtgttcaacgaggagagggagaaggagggatgagactagtggagatgaagctagcggatggggggaggaagagggagggatcggagggggtatatatatgggtggcaccggcttatttggtccccctctggtctggatgtgatagtatttccgttgatgtgatgaggtgagggtgaggtgaggtttgaggcggtttctcttgatttgatgggtacgtgagtgagagtggctcgctgctactagctcctgatggatttgatgctttaatggaccttgcccgattcgagaaagcctcggatctgttgttgcttctgatttgaaagcccgggacgcaaataatggccggccggctggctggccggggagagaggacgagtgtgtttttttctttccctcttcgcgaccccagccgtgacagcgacaaagagagcaaggcaacgcatcagctgagcctgagctgctgctagccttggcccttgggtgaatggacgcagcaggctccactgttgatcaggccaggccacaggccactgcgccccgggggcagattgggaaacgcgaggggggcaacaaagccaagcgtccagtacacacacactctctctctctctctctctcgctctcgactgggaacagtggctgcgacagtagccggtagctagcatcttgggactgttccgtctgaaaagcgggcagaggggtgcaggacgagtggtggggatcggggtgcagacagaggctgatgccgatagagcttcgccgagcagcgggcggggacgggggatgcatatgggtgggcctcgcggctcggtgttgtgtaggccggcccacctggcgccctgttccatgatgtggtctggtcgcaattcgacgcgttcggcgcagtgccacagtgctattttcagtcgctcgcgatggggcgtaacctttgcagggatcatctcatcggttgcccatcaaacagaccatcactgtgtctaatctttgtatagctcggcgtggtcgttacattccgtccatagtcacaggcactcggattggacagatagctaaggctctaagctagctcgctggagaacacgtatatatatggatcaccttatccccttcctgaacagttagcactgttaatcacagcgttctcctttggcatttttatttttacctatctcagtgttccactcatcttctttggcaccaggtccatcacttgtaacccccagtgttccggccctcttctgttttgaaacgaggacgtgatttgtcagccgcatggtagggcttccctgtcaaaatactggctgcatcattacagcttgtccgcaggagaatgaaccaatcgagatttcgcgtgctgttttgggttattcgaggtctctggtcgatcttctgctttggtggtggggcgtacgtcgtctctagcttagcccggcctcttcagttttgttgctactttagcgcctctgcgaggcctcaggactggacgctcaggcaaaattcagcatgccataataactgaatctgcacttgtgcaggctacatagcaaagctacctggtgaattgatttccctcctccggcctccaatgtagagtaaaacatatgtgtaatccgtcgtcctttgcctgagcaagctgcacgccttggagattcgatccctgtgtcggtgtcaatgcgtgcctcgttgctcagtgtctgcccccctcctcccaaaacctaaaatacatatagtagtaaggagggaaaaaaaaaactgcgcatgcatggtcccgtaactacgcaggaagtaggacgtactactgttccgtagccggtgtaacccaaagatgaagcacagtgcgcagccgaacaggccaaagcgcaaggggagaaatgggataggcaaaggtaagcacgcacccgcccgggaccagctcatccaaatgaccaaagtgtctattgctgcatgtcgttgctcgcgtgtcagggggcacgattgcacagggggtgcttgccggtttagctagctaatcaatcatcgtggtaaaatctgcatgcagctagcggcctcgcgtccctttagctcaggtgcgagcgtgccggcatctcacgcacatggccctcccccgttacgccgatcgagctgcagcctgcaggcttgtgcagtgctgctcgctcgctttcgtctccgtttcactcttgccaattgccatgtgacatgtgagcgcggcctttggcgtcgcgaaaatacagtggctgctgcgctgccaagcttaagatcctgcgaatggaaagacggatctgagggggtggactttcggtatgtgaatatagaaattctctccctgtgtagcctatgctgcatgctccgatcgaagaatagggagtagctgcttggtttacaggccggtaacgacgctgtcgacgcatgcagtgtgcagagccgcggaactaggtatagctataggaaatgtgcgtgaggatccgctaaaaagcaagcaccaaagtgccatgcacatacttgtatgcgtagcctgccctcattatctaggtcaacttatagctagctttacgcatgattcagcggataaaaacgtacatgagtgttataatgcggttaacgtgctactagtgcgtccgaaaaatcttactttgtgcataggaaccggtctcagattgagacaaaacccagccgccagattgatccgatcgatgttgcatggctaccaactcgatcagtacacacgcctagaacacgatccgcgaaacacgaaaacagagacatgcaatatagagcctgctgtaactgtaaacgtgctgtcttacagaaggcgatggcagagaccaagctagctagaacagcggctaacagaccaagctagctagaacagcggctaacagacctacagaaggccccggagtatctagacctccttttgcaagttgtaacgtgtgcctagcctagcaactttaacagcggtaaaaaaaaaaagtcgaaggcacagagaaaaggctagcaacagtattccagcaacgttcgaaaggaagggtaaaaaaagagtgcacaaaagaataccacccacgaggtcaacggtcagaatttgtatgttcacttgaattcacaattgggacaggagtgctggacactgaactgacgaaactgtacattgcccatccacgaccaagaggtagattgttgtccaggccgatgctttggacccaaactttgcactctccttttcctgatttcaggtcctataacctaaaatttgttacaacggcccaaacttatgagccagcccaaaatcgcatttcactcgctaagcaggccacgccccagtccaacgcctgcctgggtcgtcccctttccttctccgcctaggactcctccccgtacacgggttcgaccttcgacgagctcgatcgaccgcaaggggaatgcgactcgtgagcgcggcactccgccgccgtgtgcccatccctccgcttcgccaaagataacgaagccgcgacggccgccgggctttctgatctctccgcccccgctcttcccccacggccaactcgtactgaaggctgaagcactcgacgcgtctcctgtgagaggtttagatcaaaacgctcctacacgtactgcagtttgtttttctttctttatctgtcgttatatgatttgctttatcctacattagtggattccgaggggttttagaaatctcaggtacatagttacatagacggaataataattaggtttgttcaggcgtagtagtattctttttttttcttcaggtttgtgatcaggtttaaatattttctttcttcggtatggaccgtatggtaatattctctagctcgtctctgccggtaaacttcccatcacagaaaattcaggtgcacgtgcgtatagccgtatatatcaaagagaaatagcgaattcgacatgtagtccttataactccgtaatgcggataatagactgctgtctatcaggcagccacttgttacaggcttacagctgacaatttttttcgtcatgaacctttaagtaactccttacggacttcacagttcaaacacggaagatttgatggcaaattaattaatcatgcatgcatgtataaccacttcggttatactttattagtatatatagatgggcagttggtaattaccatgacaatgctagctatttatacactgtatcaaatcacaccgcaatgttattaggctgtatacaatggcgtatatgttagtatgtgttttgcatcattcacgcggctatttccacaaatcctcctcccctccgcaggaggcagacgtggacacgtaatccaagctatcctcctgcttcccctcgacctgaaacacctgcaccggattgcagtaactgggctccttcgcagtcgagtcgccgtggccgaactgagacgccaccagcttgtcaagatccctccaatctgctgccgacgcatcggccgtcacgtagaccggctcgatctgcagctgcagctgctgcgccgtcgtgtggccgcacggctggagagcggacgacgctgcggtggcgacaatgatgtcggcggccggtagcttggggctctccagccttgggaggtgcatgaacggcgccgcctcctgaggaaggaggtggtggtgatactctacctccagcttgcaagggtggctctggcggtggccatggtacggcgagtcgaggcctggcgccggcgccatgaacgcgacgtgctcgttgaaccagaaaggtgagtcgccgccgtcgccggccgccctttgcaccgccgcgactcgcttcttgaacaccctgcagaccacccatccttcctcctgaacatggagcatgttaggtgtctgaagtctgaatcctcggtagcatgcatgcactagtacacaaacttacttggggagctccgtattcgttggtctccaagcgatactcgtgcatgatccagtccgacttctgtccgttgggagcccggcccctgtagaaaaccaacgtcttcctcatcccaacaaggcagttcttgacatagatcggcttgtccctcccggtggccttccaaaagccggcagtggtcgccctgttggtgcgtgtgcccgtcgggtacttcttgtccttgtggctgaagaagtaccactcgttctgctcctcgtttccaatcttgcattgttctgtttgagcatcattttggagatgtcgattaattagctagttatgatattacagggttagagataagcagcaagcttgtagaataagtggagtaaattgtgattaccttgtaggtcccaaggctcaattttgtacagatcaatatcttttatgacgtccaagtctatcttcttcagtgctaccttcttcctaaggtagtaatccacgagttcctcgtcagtagggtggaaacgaaaacctggcgggacatgggagaatgcgtccatcttcttccgcggatcaaagtatagctcccgaactggtagcaagttaatatgaactgcatgcacgataagaagctatatttcagttacaggctagtttgataacgatgcatatatgcatgtgtaacgaattccaaggaagaatttgaacatatagcatccaacttctcgttagctcatgtctactagtactagctagaatcaggaaatctcacaggaaatactccttttcttaattgagaaagcattcgatcggtttgcacctggtctctctaacgattctgaggagtttctttctttttgtaggaagatgaatcggaaattcatccagtgaagtttctctgaccagaggctggtctctctaacgattctgaggagtttctttctttttgtaggaagatgaatcggaaattcatccagtgaagtttctctgaccagaggctgattctcgctcttctgcactcctatagaagactagcttgatcaacaggaggtgtatccttgcttccacttccatttatgcatccatgatgaaacctttgccggtttgtgtgaaaaagaagacgagatagaggaggacaggagcatcgagttcaagttgttcagctaaacaaaccgagcgcaaactagggagagctaaagttgctcgccgtcctatccgacaaagcacactgcacacacctaggccctagggactcgcgaaccttgtacccacgaagacggaagaaaagacatcgctaatcacgcagcacgtaccccagttcagcacgcgcgcacagtgcgcggtaaacaaacaaaaggtaaaacaagctagcatcatcgatcaagcagaaaaccacgggttggaaatggacgagccgtctcttaccttgtgcgcgcgcgcctgcaattgctactgcttcgtagcttgcagcagcatgcagcgcctccctcggccagcagcagccagccttcaaacggatggagcagctatatcgatcgcatgaggagggacgaggccgcggcggggtctatatatcccgcgcgcggtggtggtgatggcctgggcgcgaccgaggtgggtggcgcgcgcggagggcaggggaaggggacgcggccggaaagcgcggacggattgcgggccaaggctggctacaatccaggagcaccgcggccggagagcgacgcggcggagccccgcgtttttctattggcctttttcgccgtaaccgccacctccccgcacccgccaacgacagcgacccctagctagctccctccgatcacgctcagcctcaccccccgaaacggagcttccactgccgcgtgcagcttatgtagcagcagagactagcagtggtggacaccggccagcgctagttgccacctttcctcatctgaaaaattcacagatagagtgggtgtaaacctttctctcgtctgaaatggtaacatttgatcgaccccaactgaaaacgagcaccggcgtgtctggcccagaaagccaggtaatcatggtgacgcatcaagcgcggtcggtcgttgcgtttttaccctcatgcatgactgtaaatgtgtgttagcttagtgtgtgtaggtttgatcatgcatgcggttaagtctgtctatatgtaaactctctttggttggtcgtgttcgctatctggctttctaaggattcggccatatgtgctcttcgcaggtagctagctagatagccgcctatagcttctagttgcgtttgtttgctcctggatggtcgctctcaagacggccacggctggaccccgtttctcgaccgacctaagtatattttcgatggcgaccctcctccaaatggaaacagatccagtgccacacaagccaaaaatatgctactcatgtcatccttactgaaacggggacaaaaggatctcaagcctttcaagacacgtcacatttggacaggaccagggctacaggcctagtgggctacatatgttagaactccaagaactccagactgatgcatgggttttctgataattaatttgcacctttgcttctctgctgcataattaagtaaaactttttttgctgaaccttagtactgtagatattagtagctaagtttagactttagtactgcatccgtacctacgtacatagtatatgggagtgatatatgaggtactgaagtgccaaggagtgatctatgttaaacctgattaaaagcagattagcatgtgcagagaaaatttgatgcaactaggcaagtagaaccaatgaagttaactgtgcggaatggggaccgaccggagatgctgtgcaagcaggcagcggcggctggtgtccggcgtgggctcgaactgatcattagccatccctactttatctctataggagtattatcctttcttaatttatttcggtgctctcgccggttggaccaagggctccacactcgccgtgcatatgcatatggttattgataccttatctggaaattgcgaatttgtgaagaaacattcgtcctcttggactgatttaaaaatcccatctgagctggaaataggatggctatcagatcgatggctgacaataacaagtgaactgtagcaagcgtgcaaaccaaccgggcagccgcagatcatagtacacaattttggtagtaagccccttgcaagcagcagtgatcaatagcatgcatgcacagtccaggatccgagttgcatgtggtccacagtgtgatacgcacgccctttctccgcacgcaaaaatgaaagctagctagctgatgtatagctttcccggccttgtttgctgctaattgagatcaatttacacatgcgcattttcatctctctgcaaacgatcagtcgcattgtgcaacgcacgtacttcacgtgcgcgtgtatgcaacagattctgcaacctgcttggatctgtacatctcctcaaacttaagggcccctttgaatcgcaggattgagaaaatataggaataggaaaaacgtaggattttgatagaaatgtaagtgtaaaacagagaattgcaaaacgcataaaaaacacaggaataaccgtttgattgaaccacgggaaaaacacaggaactggatgagagagatagactcaaaggaaaattagcaagaggttaaaactcttgctaaatttcgtccaaaatctctataggattgtccattccataggaatttcaaaggattggataatccaatcctttgtttcaaagggcttcataagaaattttcctataaaattgaaatcatctaaaatttctattttttccttcaaatcaaatagaccttatcgtctcatcgtctcggccttgtatttgccggagcttttagtgatcgacacgcgtccggccagtgaggccgacagcgacgtcaggccggagcagacgccgttgcaccggggagctcgtagaccgtagcctttgggaatacacaaagagcagaacaagtggatataatagataccggccggtgcttttgcttggatggcgatgcattctcggatgtttatattttgggtggaccgtattgcaactggttctggtgtatctttgggggagaagtgaagcaaaaggactatacgccatctggtgcatcatctttgctagatgccgacgtcactggtctttaatcagttttagcttaacagttatgtgatgaatttatcatgggtaaaatgggtgataactgtaatatataggactggttgcgcgttaacctcagtcaagtccgaccggcttaacacctcagtcaagtgaaccagccattggtctctctcttcttacgactgaagagcgtcttgagagttagtattgatgttactatttttttttaattttttctataactatttgagtcgcatgcaattgataggtgccataacacctatcaactagctatactttttacagtgaaacaatggcatctgactggtaacatacagtgcgacgaaaaggggacaggcaagcgtgaggcaaatggaataaagcctctgcaattcacctgctaattcttgcttgaactgtacactcgaaaccagttgcaccgtcacttttctatatagaccatgaccatcccgatgaagcgagagatgtgcatgtgagacactgtttgcagacttccatcatggatgaattcctgctggtcttatcaaaatcgaaaccccctggggcctgcccagtattccagtgtggacgtgggctcggcaccttttaaccgcacacatcatgtctctgctgcatacaagcatcaacaattcgacatgacagatggcatcattcgccagcagttggcctttccattctgaaaatttgccggggccaggaaacaggttcaggttcaggtag

SEQ ID NO: 81028 - DNA, 8969 bp, Oryza sativa
aggtcggtacattaccaatgagctgttgaaaaacatctcttaaagtcgaatcgggacgcaagtttcttttcggcccaaacttagaaagaaataaatcacttagtgatttcaaaatgtcttcaaatgaaagatttgcaaaacaaccttgcctctcttccaagcttgcattaaacacctaagttcccgtgacttgctgagtacgaaagtactgacccttgctctatataaatatatatatatatagttcctccgccctaaagagaagataaagtgaagtgaagattagggtttcgtcctggttcccagccgtcacctgtggtgttgggtgttagttcgttggttcctctgctgctgctgttgttggtgtttcctcgtccgtatcgtcagttgcattctcggtttgttctcagctgcaacctaagttaaggtaaataagtcctctatctattttaaggatttgcagtgattcataattgtcaccgtgggtaccagcactatgtcctgggactggtaccgagatcgcggtttcgtaggaagcggttcgcgccgtttttcctacgacacgctcctatcaggtgccgttgtgcggcggtgccggattggggtgtgacagatccatgccactacaaatatgcaatttagataaatgttaatactattcacgatatcgattacgtgccactggaatgtggggaaattggaatcgtgtcactccatcgcgttttccgtcagacccccagacgtgggacccacatgtcagttacatattccttcatcgtccccccttttcttttttccccatcttttcctccatcttccacaacttctatgaggggcaacgtggcggcggcacccgagccgtcccgccgcggaaggggtcgaagacgacagtggcggcggcggttcccaagccctcccgctgcagatggggtcgaagacgacggcgacgacaaccgatccctcccgccgtggaggtggtcgacgatggcggcagcgacgatgaacgccgtggagagagagagagaggaaggtgaagaagaatgaactgacagctaagtcccacatgcagttgaggcttacgaagacttttgacggaaaacatgacggagtggtatagttccaatttctccaaattccaatggcacgtagccgatatcgtgaataatagtgacattgatctaaaatagcttatttgtagtggcatgggttcaattaactctaaaaaaactgatgatggattggacaaaaacttattcagattcatcgtcataagttactacaaaatggcttatttgtagtacttctttttacggatggagtattgtatatgcatggtctgtataaaagagataaggacgaagaaaatatagcacacgttgatgtgacgtgagagaaatatgagagaaaatgaaggaacacacaacatcggtagagattgggttatcattctgcctccatcaaaactcatgttggtttgcaaaataaacgcttctattttcacaataaccaaatttcacaaaccatgctatgataactacggatatagttagagagaactttccagcgcctgtgtcgttctaatgaggacaacacaggcggcattttcgtccttggatacatcttccatgtgcctccatttttggattcttggatgacaactcaacttagctcttgggccgacaatggtgctgctttatgacgacatgtccttccaaaaggcatcattgtagaaatctattgttgtgttttagtagtttttggtctatcatgcctcgcgatggcatccacgggtagcctttgggaagtaattagagctaatgcgccaaggtgacaacgagctaggtaatgatgactcaaagttgtgtttggttgtgttgactggggatacctgtggaccagatgaatagtgtattggggtacgctagtacgaggatgtaacgctccgcttttcgtgagacgttaaaaactaattcggcaaaatcctaattgcgaaaatttcgttctttgtgtgcgagtctatgttatgccaaggatctcaattcaaatcccgttgttccctctcatcgaaatcaaaatcctccccctcatccaaattcctcttccgattcgagtctctgaaatcaaattctgaaattcaaatccttcctttgaatcctcgccaaatacttctacaaatccagaattattcaaatctcgccccgaatccttcccttgacttcaccttatgttcctaaagtcaaagtatcaaggttaaattccaaaaatccttctcaaattctctccaattgaaaccccccccccccaccaaatcagttctctcgaaaaaagtctaaattgcgtccttcttggctgtgggccgtttctccctggctcggcccatttctcctcagctccctccacctccacgtgcgctgcacgcgccgagagagagagaggcatcgcctctcttcttcctctctccttcctctctctctctgtttcctttctctctctctcacgccagcgctgccgccatcgccgcttcccgccgtcgccgccaccgccttcgctccttcccgcgctcgcgcgtggccgaccggccggtcgttgccgccgtcagccctgccgcgccctcgcgtccgcgcgcacgcgctcgcgcgtgggtcgccgccgcaccagccccgctgccctgccgcgctgcaccacgcagccgcacggccccgcgcgcgtgctcgagccgctccatgcgcgtcctgccaaaacccggaggccgagctctccctctccctcctactcccttcccgaatcggcttggagcgagcctctcttttttccccttctttttccctttcccgaccaccatcggcgtcaccgcctgccaccgcctggaccacgggcgcgaccgccagcccgcgctcacaacccaaaattcggccgtccgatccaccgccttcgccgcccaaagtgtaacgtcccgcctcccccaggccgggcccacttacatctgatagctttcataggtcatagactgccctcacataccaacacatgtcttttctgcacactttgtcctcactcgtgtgcacccgggaagaatttcccggtcggtcacccatcccaaattgctccaggccaagcacgcttaaccctgaagttctttggagattggcttccgaaaaagaagttgcaacttgttgatcgacgccccccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgataccattttgtaacgtcccgccttcccccaggccgggcccgcttacatctgatagctttcataggtcatagactatgcccccccgtcgatcaaccctaggccaggaacgtcctctcttggccacgtccatgtgtatgtgtccagtgccagcgcatgtgccatgctgtgtaaccactcccggtctacaccagccatgcgcaccatgcctgcgcaactgcgacacacgcgcgccgggcccgcttacatctgatagctttcataggtcatagactgccctcacaaaccaacacatatcttttctgcacactttgtcctcactcgtgtgcacccgggaagaatttcccggtcggtcacctatcccaaattgctccaggccaagcacgcttaaccctggagttatttggagattggcttccggaaaagaagttgcaacttgttgatatgagtattctattaattctattaagccctataggccgggatgttacaggatccaactaacattttttctacagagggagtacgcgtgatttcctgcccgacctcttgtttctctgaagcattacatatgccacgtttttgtttgatgtcacgtcaacagcatataattcttagaccggcacgcgtcttaccggtcgaatggtaagcagcggtcggtgggacaagtggccagaggcagccgccatctcacctcaaactgctgagatgggctgaggatcgatggaacgctacccggcctgccaatcgatcgagatgatgcgagcttttttgcactgtggaacccaagtgagaaacatcaatcattgacccgtgagaaaaataaaaagaaaactgtccgtaggcgctgctatgtctgatggatcgatcccgttcgatgcaatgtttgcaaaccatttgacgccggtggtgcgtccgtgcgagtggacagatgagatgaaaagctcacgtggacagagagaaagagaagagagagtagtagtagtaggtagtataagcagtgcagcttagcagtagacatttggaaatggttgcaccgttatatccctgtagatgctactagtgcactgcatagatcaatcacatcagctcccctccccggcccggccctccataattgcgaggcagcagcagccggccatgcatgacgctgctgctgcctcggcccagtactacgtgccatccatccgtccatacatccatcagctagctgctgccctgccttctctgcttgcccctgcctgccagtgccaccagtacgtagtacgtcaagcagagcagcagtgtgacgagtgtgacgaaaccgcccctagctcagctcgatccagcttacgccgcggtctctcccccggcctcccctcgcttgactggccggttcgatccatccctgcgctgcgcggccgccgcaggctttcgacgacagcccgcgcgcgcgcctgcgtggccgcagttctgatcgtcgctagcgctggatctaaggcgccgcggcacgctggaaacggcacagctgcgtgctactgctaagtagctgtgccgtgccgtgcagtgcagtaccgtgcccccggcagctcgcctcgcctgccattgcacgccgaacgatgcgtgtggtgtgcgtggcgctagctagctgcatgcacggagttgtatccatgcgccgagcgctgtctgtttgtcgtcgtggggggcatatgcgcgcacgtactttcctaccgatagagacccgtcaaacgccggttccgacccgcaggtgaatgaatggatcaacatgcatcttccatacttcttccatttcgccaaaaaaacgacctctagggacgtgactaacaccgaaaaaaagttgatccaactccaagtatacatttcaattttcccaagcaaaatttactttggtaattaaattaactgtagcaccaatatggaggcacggatctatgatatataaacgagtcttttacctccaattatttgacactccgtgtgtcttgctgtggccacggaagcatgcatacgtacgtacgtacgtggtatagtacgtgcctaggtagctaggctagtcggcgcgagcgaacagtcgcgttagcggacggatgcgtaaaggccagcttaatcttgggcccgtttgcaggcatgatcgaggtcgcgacaggccgggtcagagttgttgatcagggctagctgctgcatcactagtcatttcaatggacggagggcaatgtaccggaataacataccaagtccaataatacatcaatcacaattagtgggccctagaatcgatctcgcattgcagatcgtgccaaacaggatattcaatttgtctcgatttttttaaaaaattaagtttgccaggactgttcacaatgttcgtctatatcccaaaattattcaattagcagagatatctccttgggcttcattttattttcttttagttggctatactacatgaggcttagtcctgtacatgcatttaatactactcattacaatgtttgcgatttttattcgtaaaaagatcttgaaatgaaataacattcaactgaccacgtttcatcacatgtactgtactattacacttctaaaaactgtttccttttacatgccgtctaaatgtgcaaaactttatcttaaaacattataaatgtccatttaaaattgggttaggtccaattcaacccccccccccccctcagttgttttgaggcggtttggcggtacgtcaactcaaaagttaaaaaaatattgggttagagccagggttttaaattttgaaattgggttttatgccaggggttactgaaatttcggaaatttcaagccgaaattatttaaaaatttgaccaaattcacaaaaaaagcaaaaaaaacgaaaatttcgggtgagatttgagtatgctggtggggggcgaaatttcggaaattttgaaccaaaatttcaaaccctggttagagctttgcttataattacaattccgtagtttcgagaaataaaattgagaaccgtgcaaaaatatagttctattttcaaaatagacggaataattctttaatattacagacatatttttgacaaagaatatgctgctacgttgtcttattcgtgttgatatagtacgtatatattttttacataatagaaatattttatatctctagtctcacacaaccaaatgtgatgcgtgaactcgtcgtgtcataattcaaaacttttttttactgctggtccccacttatataaagagatcagtcattaaaatcaaatatatattatgctgccaatgggttcagttaaaccaagaatggtgaaaagggtttcaactccccacccctaaaagaatcagacgatttgatttcaaatgatcacctggtaattaaaccaaatcgatctagttatgtccataagatatataagaggcagcacgcacagctagcagcctctgtacaggcgaataggaataggaaaaattaaggggaaaatacatgaagaaactgagaaaactagaattacacatagataaggacttagatacgatcgatgcatgccaagatgccatgcatatggtgccatgatcgtccatatatagaggaacatttcagttaacaagcaaccggagatcatatctggagatcgagacatgcaggaccctaactacagggtgggacacaaagttttttttaagccagatcgtgcattgatctgaggcgttagaatggagtgacacccatgctagatgctgctgtggctgctgcagcggcggcggctgcagcgtagagaccgtccttgaagagcatgcattccccagctccgtcctataaaagcacaaaaaatactataattaagtctcggttttatattcatccattgacatcgattctccaccaatagaattagggtttagattttagggtccgtctttactctttacctggctttgtatgccggtcttcttcaggccctggtccggcatcaggccaaaatggatgtgtgggaaatgggcccactggtgcatgcacaaagatgagacagagtaaatacgaatttggtttatatatacagtggagtatgctgcacacatcacatgcatgttttttttatcaagaaattaaacggggagattttgtacgttcttggcagcagcgctgaaagcctccctgtgggtgatgtccggattgcttgccttgatgcgttgtatctcatctctgatattatacgtgtcataaacggagtgaagcacgagtagtttttgtcagatgatgtaattaaaagaggaaaccaaaattaaacgatgtgaaccattatcgatgattactcacttgatgaatcggttgtatgccgagggaaccctctgccgcttctctgaagctgcagaatcacaacaatgagccgaacataattacttggttaacagaataacagcgtactttgatgacactactgcagcactgctgcagttcaaagaccgaagcagcacggacgcaacaaggctagatcagttgaaagaccatatgtacattattagttcgcatgtgcaacctgaccattaatgttgctccctgtgagctcacagaacaaattagggactggttgccacgttacgttctgtctgtttgaagcagtattcgatctggagtttagaatagttttccatttgatctgtacgtgttctgttcccttttccttaacccctcttcctatttttttattgattttttgttttgtcaagactcaagtgatcttacctatctttgcactgtgcataattaacgtcgggatttgggaagaattcctccacggacaaaaggcactattgagctgatgtgaaaactattcgacccccttccacttgttcgaaaacttcattgaccatcgaaaagaactctcaaaaggagaagctcaaagaggagcatgctgtattcgtgccaccaagaacagtgtgtgctactgcagcgcacgcgcacgcagctatctatagccagcttctggagttctctcctagctatacacagcgttgccggaggatcgaggaggagaaggcgaaggaatgtgggagaagtgaggcacttactcctgttggctgacggcgcgttcttcggctgctgcggctctcgctgggtagccttgttggccgccgacgccatcgacgtcgccggcgcgttgttagcacagctgctgttgctgctcgtgatgctgctcacgttgggactcgcctgttcggtcattaggctcgccggcgcttggaatgacggcacctcatcctgcaagccgaaaatgattaagcatccggccggccggcgcagtgagcaaaaactaagtagaaatagatcgttgttacgtacaaggaggccgttcggtgaggtggggaagagcagagcctggccgaagggaagctggttggcggtgaaggcggcggccgggagcaggaggccgcggaggttgacggagagcaggttggcgcagtggccgcaccgcacggtgaccgtcttgaacaggctgctacacggcacgcccacctgcaaatgcaacggaacgaggctttattcaagggacgtaccggagtccggagctatagttagctattacggccggacagatcaacggcgcccggcgagggaac

SEQ ID NO: 81029 - DNA, 3412 bp, Oryza sativa
tatttttttaaatagtgaattatatatcattggaaagcttatgaatttagatgaatttaggttcaagtttcacttaaatcggagtaaaagtcgaatgcgaaagtcgattcctttttattacctttactatcagcgaactacggcaaacccaatttcgatttaaactattttgcgggtataaatattttgttgtcataagtttttaatttactcatcccgagcattatatccatataacaggttagaaatttctattacgagctaaatatcggacgaaatcttagaaatattatacaatttaatttagtctatgactaaacgattaaatataatacacggctaagattcctagtaattgaatccgaatttctaccatgaaccgatgacttatagagattatcaaaaataatctataataatctataagaattcatctaattgtttggttattaattatatctaaattactaccaattttaatctaatctgatcaagaaacatatatttataattaactcggaatttcgatcgaaataccattacgctcgaggaatttccaaaaataatctattattaaccccgaccatttttatttcctaaatcctcctaatttctcccccaatttcccttctattttctcctttccttctttttctctcttttctctccctctctttcttttcttttcttttctcttttcccttttcctttctttttctttctctccctttttcctttcttctctctttctctctctgtcggcctctcttttcctcttcctttctttctctcctctctcccggctctatctccctctctcggctctatctccctctctcggctctctcccacccgagcggcggcggcgatggacgcgagggagaaggagggcggctcaccggcggcagcagcggcgacgacggcggcggcgacggtggcgcacggcggcgcaagagcggcggcacggcggcacgggaacggcggcgcaggaacggcggcgcggtggcacgggaacggcaacgcggcagcacgggaacggcggcgcggcggcacgagaacggcggcgcggcggtggcgcacggcggcgcaggagcggcggcacggcggcacgggaacggcggcgcaggaacgtcggcgcggcggcacgggaacggcaacgcggcagcacgggaacggcggcgcggcggcacgagaacggcggcgcagtggagaggggagaggggagaggaagggttagatggggtgggggagaatggagagagggggggtatttgtagagaggggaggagcggcggggctcggggcggcttggtgtgacggcgatggcgacgcgacgatgacgcggcgcggcagcggcgcgggacgcgaggtggcgacgcgatgggcgagcggcgcgcgggtcgcggggcgcgagacggcgcgcggggcgcgaggcgacgggacggggcggcagcggcgacatgacgggcgcgcggcgatgggatgggcgggcggtagcggcgcggggcgcaaggtgcgatggcgacggacgagcggcgacgagacggtgcgcggcgcgatgggacggcgatgcggcggcgacgggcgacattggcgcgagacgacggcgacccgcggcgatggcgacagcgtggcagcggcggcgcgagcgaggcagcggcacggggctcgagacggcggcacggggcgcgaggccgacggcgacgatggcgacggcggcacgcgggcgagcggtgcaaggtggcgacgcgcggctcgggacggctagggcagaggtgggagagaaggggaaaggttagggaccaaatcgaacaccttgcgggcaatgaatagtgcactttcctattattcccgattttaggttattttcaatataaatttgatttcataatttctaaatcttgtataaatgaagtttatcccatatttgtgttatcctaactaaaattctccttaatttgatatcactcatattttgtttatataatttatttgagttttaattagggtaaattcttattctatcgcaattaaatttaattgatccaaatatggtcgcgataatattttatttattactacccatacctaatcttttatttttaatttatatttattttaccaatttatttttaaggtttattaaagattctataattttctaatgagaccgttattaacataatagcacattagctcaatttatctatatgttagtttattttatatggaggggtttaatatatcaaatttcaatccctaaatgcaattaggaacttggtgcaaaatcgatctacatatcgaattaaatactcctgtaattctattatatatacagagagctcagttcatttgaatgatcatcatttcatgtgtactcgtattatggcacccacctatattattcaaatattttaatatttgataaaataggttaataataacttttattttatttgattttaatatcttgcgcataattattcgtaggattaaatatattctcataaatcatatctattgcttaaatgtagttcttttctttaccttcttggtgatcatttatggtttggcaagcaataggaatcataacaaccagcatgatgcaaaagttttaaaaagttcgaaattttagtgattttttttattgtcttgaattttcaggatgttacacctagagatgctcccgccaccacgaattgaccccattctctcccggcgtgtcttcccccttttgctcgccgccggtggccgccgtcgaaatccgccgcctccgtccagttccggccacatccgagccgaggaatggagtctgcgtctccttttccctccctccggtggtctcccttcctcccgcctcgcctcgcggccgctccgccgacgcgcgccgccgcctgccgtccatctcccggtcggtctcgtcttcctcctctagccggcccgcgtggctgccacgtaggcgccacgtcagtgccaactcggctagaccgagtcaaaccggccagcctggctagccccctccgtgcgcacggaccacggtgcgccatgcggcggcacgtgggcctgtcacgcctcggtccacccggcgcaccaatcgtgagccgcatccacccgaaaccctaaacgccgcccgcgtgctcccatccctctgtgaaccgtgtcgccgacatgcgggccccacccgggacctcgcatggtgggttcggtccacccggaccgccccctctcccattcgcgcgcccctaatgggccgcctccttgcgcccgcgccggcccaatggctcggccgagcctctttcaacccattgggccatgcctcacgctcggcctaaaagtccatatttcctccctccgtccaagtcagtgtccatctctcatgagctaaaagtccatatctgctccctcccaattt

SEQ ID NO: 81030 - DNA, 751 bp, Oryza sativa
tgctcaggataatccctattctcgatataatcttgatcaaccttcacctcctggaagttgcagacgttgcctcacgactaaccgatacacaaagtctataatacgcgagaaaaaccaatattcaagcaacaatcaaatatgcacaacaaaatatatttgctgaggtcgaacctaaggttgctcatattattcgcgcttgctaatggactctaatcaagctaagagctagggtttcttagtctttctgttgtcatggtggtgcagtctagctaatggctaaggaaggattatggttacacatgcatctatctaaataggacggttatttactagaggttctgttgttagatggatttaggatcaatcaaatagttatagtgaatcatttgtattattattttattgatggaagctttactttaattatgaacatattttacttgtcacaataaattataaaaggttaataattatccatgctttgtatgttagagttgttcacgttaatcatattatgggtacagattatcccatcacataattttacaatgaataatcctaatttacagttgaactataattataattatatgaggtcaagatttataactagtatatatctaatatacatgcttgacatactctccctttaacttaatttatgccacacacaaattaatactataccgtaccactataatgggatgtataatatatgtgtaagcaacaatattttatcattggatcatat

SEQ ID NO: 81031 - DNA, 4032 bp, Oryza sativa
ggcataggataggttcccttaacagtgatagtatttagtttcctgtagtctatcaccaacctccaagtaccatctttcttcttaacaagtaaagcaggagaggaaaatggacttgagctgggttgaattacccctgactgcaacatttcagcaacctgtttttcaatttcattcttcaaggcagggttaaatctgtaaggcctctgactgacaggagctgctcctagaatgagtggaatggagtggtcacaatatctcttaggaggaagaccagtgggttcagagaagacatcttgaaaagagttaatgagttcctgaacatcagaaggtaaaggctccttagtcacaggatcagatgcagaaagctgtactatgtgcataattgacccctgtttcaccatgcccagatactgttctgttgatatgactgaacagtgagtggtctgtggtactatgccctgcaatctgacaacattaccatcaactgtaatttccatccatttgtctacccaattaacttgcatgggactgtattgttccaaccaatccataccaaggataatatcatagcttcccagatggagcagtctgaaattactgatgaaattaagtccttgcatccaccatctacagccagcaacttcatgagaacaagtcaaaaatccaccatcagccaatttaacagaaagttgttgttgcaggggttacactccagccattttcagtccaattccagcatccataaaagaatgtgtactaccagaatctaccagcatgagtagttcagagccttggaccaaacctctcagccgaatggatttagaagactcagttccccacaatgcttgctgagaaatagccatcagatcactgttactatctgaaggagtttcagggtctccatcaggggtctcatcctgtaatgcatccaataactcctgaacaacatgcaattgtacagctgaaccacacttgtgatccctactccatctctccccacaagtgaaacaaagccccttagatcgtctataagatttaagagcagctagtttctcttctctagctcgagcagactcagtacccctcttgtcttctgtatgttgtggagtaaattgcttctgtggtgtagcagtatgagcaagtgcaggagttttctgaaaactgcgaacaggaatagagctgtcaggtttcctgtattggttaaactttataccctccaaagcttcttcctggagtaaggctactgcacaagctgagtcaagatcttgaggtctctgaactaataccacaaccctgatgtcacttctaaggccttccacaaatttagtaacaaagtacacaggtaacagagaattgtcataagctaagagttggtgcattaaactgtcaaacttctcaacatactccgaaacaaaaccctcctgtctaatatgaatccactgacgtatgagagcctgctgtctatccttagaaaatctggtacacaccaactcacagagaccagtccaagaaattccacatatctgattcctcacagattgcaaccagaatgcagcattaccacagaaatttaatgtagcaattttcacccaataaactgactgtatgccataaacatcaaaatattgctcgcaattagccttccacatttgggggttatcaccactaaattgggggcaaatcataggtgggatggaattactcagattaaaactagcagatccactaccaggagatggggtttcaggttcagaaccaaaattaatgtggggaatggagaaattgtccttcataccaaacattggcgtcgcagttgcccccgacttatcagcagcttgatcctgcttggagttgcctggagctccacccgcggcggtgctgccgaacgcctccgacttgacttgccgcaacaggttgccctccaagtgatccaccttagcgttcaacgactgcaccgattctcccagtgtttccgccttcttctccacggccggtatccttgattccaccgttttcctcagctccaggtactctgctctggtacgctcctccccttccactctcttcttctcattgtcagaaatggttttgagcaggagatcgaacttagcttccaaatccatctcgagattccggatccaaacctcagcgctagctctccgaattcagccaaccagatcgagggagccgaaacttttgcggatcacacgccaccgaagtagcaggatcccacctctccccggaattttacagccaaatcaagaggattttgcagcgcgtgagggctctgataccagattgttaggggctctcaagaacacgcttcacaattcacgaatttagtggcaatatttgttacttctcagatccaacaggaccgagccgccgccgccaacgcctccagatgccaattcccgaattgttctagtgttgttcgtttgatttattacaaccaacccactctctctctctccggcgccagctcacaagcgagctgataccttacgccacccactctggaccgtggaccttcggattgggcctcctctcacggactggacgccgagttgcaacccaggcttgattgtcacctgaagtctggatcacctcctccttatcttctctgctaccagcttcatcagcaacttcaggacggcttccttcttcttcttctggttcttctgcagttgagccttgcgagatatctcctggatgatcttgagagtccctgacacatatgctcttctaaatttctgactctaatctcgagcagcacacgataatttaaaagtcgatttttccttccatggaagtttttatttcttccgactggagtagtattccatacacaatccgttagatccttgtaaacggccgtttgtgatatcaccacgatagaaaatagaccgttcacacatcacataattaaaccctggtggtcaaaattgatcccttctccgtacgactgaacgatccgttcgcgcaaaaaggaaataacattagcctgcgctgtcaattttcttcaagttgacttaacacgcgttgctttggtcgcatatggaaaaaaaatcaacagcaacgagataataaattactattcggaaactgagactgtgacggtggatcagttcgacttgggaaaaaatcacggtgctttgttttgacaggtgtgaccagccatgcaactcggggtgaagcgccggaaatctgggagagcctactcatcacgtacactgcaaagcttcacagaatatgcgccttattttatcgcgacatatagaaagttttgtcgatctagacgatgggtgaaactgtatcacgggacaaaatctgaagtgctgccagaaatttatccaacaacatcttgtgtgttgggcagacccagggacagaaagcacgcgagttgtggatcctgtcccagttgcacggagagttggaaacgctttgtcctgtacttgctccactccaaataagcacggcttcgtcgaaggcctccgagttcagagggtactaaacgacagcgagatttttgtttatttgatggattcaggcgacctcagatgtaccacaccactaatccactatcccactgagacacgtactcttatcaaaagaaaacaatactacacggcacctgagactcctgactactatagatgtcctggcacgggcttgcaccaagatacgcatgtgtgcatcaatccacgcctccgttcatcctggtagcctgcatccagctagcccttgcagtgcttgccgagccagccttcgcgtgacgcgtgccaaagccgccacctcggttcatgcctcctgggtgatccgagaacgatgaacctgctgccggctgcggatagcaggctcaggctgctgctttgtcgattgattgccggccatctgggcatctgacaccaaaaagatcaattagccgactgagacaactcaaattgaggacagacatgccaggacagcaagggggagcatgccatgtccgagatcatcgtgatatgaaccgcagcataccggcggtatggt

SEQ ID NO: 81032 - DNA, 1600 bp, Oryza sativa
ttcaattctaaagattgatgcattgcacatactccgaccggacgagacgcactgtctcatccgagtcatttgagaagcactcacctagtcgttttagaaaagagttcaaataaaataaattgcaaaaataacagtctttccttgaagcctgcaataaacacttatttcccctggcttgctgagtactcccgtactcacccttgctctatataaataatccccccccagttgctaaagaagctgaagcggatcctgctgatgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtactactctataataaagagacctctgatgttgtgatattctgtctccctgtgataccagcactgtttcctaggactggtatcgattaacaggttaaattggagcgtcacgggctagtcccggtcgggactagttcggggcgtgacaccaagagccttgctaatgaaggcaataggatgaccatcttgagatagaactgctccaatcccagtttcagatgcatcagtttcaacagtgaaaaccttttggaaatcaggaagtgcaagtacaggggcagaaaccagtgcttgcttaagatgttggaaggctgattctgtttcagagttccaatggaagggaactcctttcctaagcaagttagtaagaggtttgctgatcaccccaaatcccttgacaaactttctgtagtatcccgcaagacctaggaaccctcttaacttcttcaccgaaatgggaaccttccaatccaccacttcctgaattttgttcttatcagtgtgaaccccagctgcgctgatagtatgccccaagtaagtgagttgcctttgagcaaaggaacattttaagagtttgaccttccagtggtgtttgttaagcagtgacagtacttgagcaatatgatccaagtgcgatgaccaatcagggctatatataagaatatcatcgaaaaagaccagcacgaatttcctaagaaccgttttaagggtgtcattcatggccctttggaaagtggcaggtgcctcagtgagtccaaaggacatgaccgtgtactcatagtgacctgtatgggtttgaaaagctgttttatattcttcaccaggagccatacgaatttggtggtaaccagctcgcagatctaacttagtaaaccacttagcatgagaaagctcatccagtaactcatcaattactggcataggataggttcccttaacagtgatagtaccaaactatacttgcacttgagaaattagtgtataacgatacacatcctcatggccaaatgagtatagcttagcaataagccattttattggtttgcttgtcactgtgcgcacagtagcatgcatgcacacgtgaaacattagcgtgtgatgattaaatgccatagttgctgcagatggcgtgctcttctccaggcttggccatcggctccacggcagcccccggcaatgtgaattga

SEQ ID NO: 81033 - DNA, 4632 bp, Oryza sativa
gatttcaccgtgcaaatccatctcccccggtgacgcgacgacgcgcgccaaagcagggttgaaggtggagaggtcggtacaaagggacaaagtggcgacgcccgcgaggcaacaaccgagggaggcgcagccgtgagggccgcgtggtatggtgggatgcacggctttctcctacgaatgctcctactgtctactccctagcccgctcgcgaggcgaggccgttcgaaacgggcgagacactcacactcactggaccacggcgcgcagcgtcggcacgaggcagggcaaagcggtggggtggggccgtgtcgaccggtcagctgttgatacaggccgttcggcatacgcagcggacaaatcgacaggtggtactatctgtctgcttatcgtgagtacggagtactgggcttctaggtacgagtaatccgttagtacggaggagtagactagtagtactagggagtattatatactgtagtagtaaaaatttcgttggatgtcacaacatgtttgggaagagtcgtacaacggtactagtagtttagttatgaacaccgcagacaacgtagatgagcaggagatgcaaacctttttaaaaacaaaagggatagaacgcaccaaacatggggaaggttcgtcgtagatggccgggtaacctgggcacacgtgtgcagtagaattgtcttttctgtggaggacaccaagtcgttgtttcaagctgataaaggatcggtaaagatacatttcaaacttctgcctgagtaaaccaatatcagatttttttttcacatacatacaaggtagcctttgaccgatcagcctggtgacttggtgagtgttaacaatcttccaaaaagatgggccactcgataattcggatggaacggcttgtgtttgcataaataagggcctgtttagttggaaaaaaaaattttgggtgtcacattgaacgtttgaccggatgttggaaggggtttttgacacgaatgagaaaactaatttcataactcgtctggaaactgcgagacgaatcttttgatactaattaatccgccattagcacatgtgggttactgtagcacttatggctaatcataggctaattaggcttaaaaaattcgtctcgcgatttcctttctaactgtgtaattagtatttatttttatctatatttaatactccatgcatatattcaaatattcgatgtgatgtttttaggaaaaaaaatttgtgaactaaacagaccctaacttgagtatcagattactcagtcctctctgcttgtcccgtatactagaagcagccaatcctgtcactcccgtccagtatcacctacggcaccaaaagtccacatgagggcaattgtttggcgacgtgcacagaatatgactactaggtcctgtttagatttaaattttttttcttaaaactttcaactttttcgtcgtatcaaactttcctacacacaaacttctaacttttccatcacatcgtttcaatttctttaaaattttaaatttagcgtggaactaaatacaacctagagtactccttataaagatattctacgtgggttgtttgccttgttgcacggaaccgtacggtttcccatgcgtgggtgcctgaggtccaaagatcatccggatcctattccaagtcaacaaatattagtgtaattcctattccaagtcagctcgtttgtacgggaacaatcgttttctttgccttcacaatagtcagttcatgtagataactcaaaacaaaataccactacctctatttcaaaaataaagttatttctgatatagtagcttcgtccgaaaataaatatatttcgcctaacttcaaatctcaatccatcacaattattctctatttactctccctatcctaaaatataacaatttagttcaaattcgtagtactatgatatatctaatacggtcatatgttgttatattttaaaacatatatggtaaatgttgttcacttagtttctcttttgaaccaattacaacatttttcaatcatttctatttactttcttagtacacatgttcaacttaaaaatacttatattttagaaccgatgtgaggacatatccggtgaagacgagcaagtgttggaacttgtgaaaatcatacttaaaaattttataaattcatgaaaaaaaatagtagaaataggtgtagatatgaaatacattctcactgaatctcaagttcgaactcaacttcatttaggaggtgaatagtaacaagatactattcactctaaatttgtctttttttctccaaaacgaagttgattttggatttgagatttggtccgaatgtatttcatatctacacctatctctagtgttttttttatgaatttataaaacttttaagtatgcttttcatgagttttcaacacttaactcgttttcaccggatatgtcctctgatgtagcaggtggtacaagtatttgatcaaaacacttccaataaaattggagagcacaccaagtaccttgtactagaattcaattaacgtgctgttaatgccatggttgatttgatcatagaacgttcagactagagcactcaagtccttatggcataaccccacatgttactcagacaattagtactattgttgacagcggataaaaatgtgggctaccattcccatcgttagaaaaatgcgacttcgcactatagtcaatataagatcacaattaaaatattcaagtgcactccgagttcatcccgcatcgacagcaactgcaagcgcaagaggcttttactcgtcaaggagaacagagaaacgataacgcggtgccccaccgatcgcagcatcggattcctggggagccgtacactgaccgtactcacgtacgtgcaaggctcaaccatcaaacgatcgaacgatcgacggctcgacgcaagctgccgctgactttgaatgatccgtcgccccgccaatttgtctttagttttggtgtgaatggcgcgcggaaactaggggcttaatgataaactagaaagaaaaagacattaacctacgtggagagcacaaccaaccaaacaagaggttcttatcgttgcccagcctgattgattggctactatatctagtgcccgtcctactcattcattacatggagcttcaaagaaagtaaatttagggggaaactcatggatgcagaagctcatgtgtgttcagctgaggatatcctgacataagctacagatgcgcatatcctttggggaagatgtacgttatgtgtagccgcaagaatggcaatttggcacggaaggcctggttcatgagtcacgaatttttcattcttttatcaggctatgcaggcgtttgccacatatattcagtgatgtgagcagatttccttatatgcagggaaaactgtgtgaaattccttggtggccagttgcgtagtgtaacctttcctcccccacagagagaatacgacggacgttgaatgcgactcatctctccacgacgaacataatttggttctccctttttatttcctgtcacaccttacagatgcagtgcaatccaataatttaggacgttgaccagttatccgaccgctgtcataaacatctttggtcgttttgagtggtgtatgcatgcaggtgcgtgttaatgagtcttccctttcaatcggacatgattagtccatcatatcggctatccagtactactcctgttccaccaaaaaaccaacccaggcaacgatgagatataacctatgacgataaatctggacatgttcatgtccagattcattatcatacgttatatttctattcaagttcattgctatagattatgtcccaccgttgtctaggtttttttaaaaccaacggagtactacttcactgtacaccgcttgtagtcgagtaaaactgatgtgtactaggcatgcacgagtggacgtgaagggcagaagtacagttttactccttccgttccaaaataagctcggccatgaaattccatgtctaactttgaacgtccgtcttatttaaaatattttttattagtatttctattattattatattatgaaacatgaatattacttatgaatattactttatatgtgaacttatgttttttagttttttttaaaaaaataaataagacggatgattaaagttggatatggaaactcatgactgcgtttattttgggacggatggagtagtatatactcctttttttagttctttaatagaggcttgcatgtactccctccttttcatattataagtcatttgatttttttttcttagtttgatcaagtttatagcaaaatattccctccattccaaattgatctacatattttataggtacactaagaccaagaaaagctaataactctctcatactatatttactctagcaacaaactcaatgcatgcaacatccccactattgcatgtgggtaataaatacttctgtgcatggatgcatgtatcaatgtctatttagtacttcaatgcacaaataacgaatagacttaatgaatgaatacaaatatgtagatcatttaggaataacctaaaaaaactaactataaatttggaatggagggagtataagagtaacattt

SEQ ID NO: 81034 - DNA, 1108 bp, Oryza sativa
ttaggttataagattttctatcattggccacatttatatagatgttaataaatctagattcattatgtgtctagattcattaatatttatatgaatgtggacaatgctagaaagttttataacctgaaacggaggaagtaccatataaaaatcttaattttggtgggaatcgtcaatttccataacactttatccctattaatatacccattaatacatggatcgaacataaaagataccattttgatgaatgtgggaacaatggattttctgttgtctcccttccatagttccatggtatactcccctgtcacagaatataaacatttctagctattcctactagaagttattatatttttggacggaggtagtagtttttaggcatggatgaaaatccgttgttaagtacagttttatcccaagaacggttcataattagcttggatgcgacacgtgcgacacaaggtaagcatttggtaaaataaaaacacgtactccctccgtcccgaaaaggaggtcgttttagcgctgaagcaatatcccgcaaagagtgtcgctgggagcctgtcttcgtagttcagacctactctgccccagctcagctagtctgacgttctgccacatcactcaccgctctctcaccccaaaccaacagacatgaaggtgtagtactagtattagtaatgatagaagtataggcgccgtacaggttatttttacactgtcttgatactctcaccagaagttagaacgtcaagtttaaagagactgagggagtatatccgtgttcgaccgtgtcaatctcactcttggatttttgtgatccggagagcaatgattctgagaacgagaggcacaatatgcttccacagggtgtgtttagttcacatcaaaattggaagtttggttgaaattagaacgatgtgacgaaaaagttggaagttcgacccgagtttagttccaaactttttcttcaaactttcaactttttcatcatatcaaaactttcctacacacacaaacttctaacttttttgttacatcgttcccattttaactaaactttcaattttaacatgaattaaacacaccctcggccacaatc

SEQ ID NO: 81035 - DNA, 1932 bp, Oryza sativa
atcaggaagcggactagttagggggcacaggcccagcataaagggggagctttaaacctcgggtgggccgtgagcccgtcactgcctgggatggggaggctgagcaggctgcttttgcacggtttggttgcagaataagttcatttaaggtcccttaacttgtaaatgaatccgattttcgtcctccatccagaaaaccagatacaacgggtcgctatacttacaaaaccggtgcaaaattagtcctaaggcagtatgacgagtggttttgtctgatgtggcattttgacttgtcctacatggcattttgaccactgagttagcacaatcgttagggaataaatggggagcggtggattctcgcgcgttagtcgccattcctctcccctttccgaaaccctagcttaatccggggcgattcggagagcggaagcgcggcgatgggagctagaggagtgagggttcgtcgtcttcttcgcggcaatcgtacggctcacctattccctatcgggttgctccgttggattacaaacccgcagtgttgtgcagatgcagagtgaaggccgcgaggtgcaaagtgaagcacagcgcgtgacctcctgctcctctgccgccatgcggcattgagagcggtgctcggcgtcgccatcttcgcatcgaacagctgcagcacgctagcaattgtcccctcttcgtcgccctctctgtcgcctaggaggagcgcacctagagttagggtttgtggaccaaagaagagagaaggggcacacccttttttaaccctctggctgacttagcaagaagcgcccaacgggctgtgctgacttaaccgggcttaaccgcggccaacttccccctttggacaaaacaaccctcaatactgctttgggaccaatgtttgcaccggttttgatacttgaaggacccgtcctatctggttttctggtttaggaatgaaaatggattcgttgataagttaagggaccttagatgaacttattcctttggttgcagtccaggtgcatcaagaaggcccaacagggatgcacggtaatatggtatagcacacatcgtggtttgggctagttgccaggcttgaaaagatgaactttcgagtgattaccttaaggctgtgtttagttcctaaaattggggagaagtttgggaaaagttggtagtttggaaaaaatgttgagagtttatgtgtgtaggaaagttttggatgtgatgtgatgtgatggaaagttgggagttggggagaagtttggtgtgaactaaacagggcctaatactgggaacaatattttttagataatgggtaaaatccaatctttagtttaacagaagctactgccacttattacataattcttgactgaaaatcaagtataataatttctaacaaaggataaatagacaacccaataataaacgccaccatcaaagaagagagacacttattcaaagaacaattttattgttaaatctccattcaaagttgacaaaaaatttgcatagcggacgtctccaaattccaacatgcaacgtgaataatcaccatgtcctcttcacacttgtcccaaaaccgaacctaatatgttgctttgaagagtacctgcatataaaatttagttggtgttttgttaaaaactgtgtcatttatattcaaccatagagtctaacataaaacatatgttccaactaaaatatgttttctttggtctttgtgtcaatcccaatcagccaagtatcaaacatatgagtcaaattatgtggtgattgtaagtcaaaagagataaaaaatggttctccaaataaatttagggatggtttggtttgagacctaaattggccttaccaatttttgtcaatgataaattttggtaagttttggcatggctaattttggcaaggtaaatgatggactactgt

SEQ ID NO: 81036 - DNA, 5821 bp, Oryza sativa
  unsure (1)..(5821): unsure at all n locations
caaaatcagaactcaaaaaaagcaggaattcattcagatcgtaacctggtcaaattcttgtgagcaaaaatttaccttgggcacagaggagatcggcaaaggtggccaccggtgacgatgcggacgggagagatcaacgctagcggagcagatcggtgagcgaccgtcggtggcgatgcggacgggagagatcggctcgggcggaggcgcggaggaaatcgacgacgttggtgacgctggccgacgggagagggatgggcgttgttggcgtggcggcgtctcgatggcggatggcgctggatagggcgatggagcgatgcgagagagaagaggcgacgtcccgatggctgatggcgctggatagagcgatggcggcggcgtgagggtgcaccgtctgtggcgtgcgagagaaaggaggatgcgtgtgaagagcgtgatggggggatgcgcgtgaggaaaagggaaaggaggacncncgtgangaacgcgtgcggaagggagggtccgcaacgattttgaggcgttggatcagatgattcttgaccgtcggatttgatgaatggggtttgtaggagtgtagttggtgagttatagggtanatgtgtgtcgtgcatgctgcatattactctgtgctacagtacatatagagagcccttttacaacacacaagtttgattgagtcaatggttttatgggctcgtggcctgtgtgtgggcccaatttcatttttggtccccttatcatccacatccagttgaccagtccctcctagcccatacggcctatattgtgaaggccccagaccaaagtactgatgggccatgttcccaactctgtagactgtagtctggacttccacgtcacgtccacaattcccatttcacacatttcatttgggcctctaaagtagaaaggtctcaacttttgacgttccaccggtaaacagcagcagcagcagcaaggcacctactcctaatcgtctcatgtaacacgcgagttgatcgtgatcattcctccatcacgaaatatcatctcacgcaaaagcacgaagtccacctgccacggttctggagctccgctcctttttcccaaacacagcagagtttcagacttttcagcttcggtttcccttgtttctgatctttctttctccttcatcaaggcacggaacaatgcgatctccgcgcggtgttttgcattttgcaaccgaaatctcgcgaaaacccaaacccctcccgttcaccgtgccgggactgtacacgttctgcggccacaagccatgggatttccaaatcacgaagtacaataaatggaagaaaccacaagtttgttccacgcaatgcccccgcgtgatccacgcgaccacacttgcgaggagcgcgcgagcgaaagctgccgcgatggcgagacgacgtgccgcgggtcacgtgtcctcgtggcacgctaactcgggagtgtacttaaggccgcgtctcaccaactactcggagtagtttggctgcttgacctttgtactgtgcttgtgctgtggtcgcggacgacgatggctgcgcggtgctgggtatggggcttcgtcgtcgcgctcctggctgtggcggcggcggcggatggggaggaggaaggaggggaagtgggagccgctgattcggatgccgacggaggaaggggacgacgctgaggctgctgctcccgctcctgctcctgcggcggcggattacggggggacgaggtgggcggtgctcgtcgccggctcctccggctacgggaactaccggcaccaggtgagctcgcggtgatggagttgggtgtgttagggtctaggggcgggggcggcggtagagattagagactagtagaaaggaaaggaactgcctttgggggaaaattgaagcttttggcaaattcccctttcttgtgggcgtttttgcagcttgtttggattcgcttcccgattcggagaaaaatttactgttaacattcttgctgcaatgctgcttccaatttgtggtagattttactaattcctaaggcaacccttgctccaaggctgtatgttcttctaccaaagctcctgctatctgactactgaaatcggcctatggacatgttctatttgttcagaggcatggctatccaatccgtattgctacttgcttcgcttaaattttgaaagctccatacagttatgttttcgataagagaggaacaatctctaagtcaataattaggtgggaggcatattggttggcaacatcagttttgatcgggcgaagattttttaaattgctataaatatgacgactacgacactacaaataatttattgtccttcctgcatgatttatgtttgtttatcttctaatatattgacgtgcaatccttccgcgcgttcgagaaaaaaagatttatgtttgtttagtgtgtgattgatcaaatacgaacagttcttaagataactgaacaattatatgagtgcttgtttaatggacgttggtgtttcctggtgcattgcaggccgatgtgtgccatgcgtaccagattctgcagaagggaggagtgaaggaggagaacattgtggtgtttatgtatgatgacattgcccataacattctcaatccaaggcctgggaccatcatcaaccatcctaaaggtggagatgtttatgctggtgttccaaaggtagcattttcctttaattgtagtttcaagaaaaagagggtgcaagtagttctagtttcagtcttcaaattcgatttctttttctagtcatgttgtatggatctctaatgctagttttgtatataatttgaatgtgtctgtattcatgcaaggctgatcaacttaacatgcattacaggactacactggtcaccaggtcaccactgagaacttctttgctgttctcttgggcaataaaaccgcagttactggagggagtgggaaggttatagacagcaaaccagaggatcacatcttcatctattactcagatcatgggggtcctggagttcttggtgcatactccagcatatgatatttttcttagttaattttgtatggaacttagcttacaattaacatattttaggtatgcctaacctgccgtatctttatgctggtgattttattaaagtgttacaaaagaaacatgcttccaacagctactcgaaaatggtataagatcattttccccttttcccttccattttttataatccaaaatgatgtacttagactgaaattaaaccctaatttctgcaggttatatatgtcgaagcatgtgaaagtggcagtatcttcgagggcttaatgccagaaaatcttaatatttatgtcacaacagcatccaatgcagttgagaatagttggggaacatactgccctggggaggaaccatcacctcctcctgaatatattacatgtctaggtgacatgtacaatgtttgcttggatggaggacaggtaagcttcatttagtatctcttaggtgcgacatcttgtggatttctgttcttctatataatctttttcggtgtgtcacaggtatgccttaagggcttatgtaatttacttttcagtttgcaatacttacaatagtttataccagctacagtcatgactgaacattgttggtccactctatgatgtacatgctcagtttatctttttacgccctggaaatttgtttctgcgttctgatttgggaccactctcaaaagttgtctatttgtctttcaacatctgtacaaatacacagtacatgttttaatatctgtgtggtaagaagtactgccacaaggcataatgtatcaacatgtcttcctgtaatattagtcacctgactaaacataagtaatccacaagtcactgttcttcataatggcaacaaagaaaagcctgtaaaatataggtgaagaaaagtatcaattgatagaacaaccaggtgacaaataacaagtgcatgtattgctttgctgctttacacatacttttacactgtagcaattatgctgtgatgcttgattctgaaagtttttgtccttttgacagtgagactcataatctaaagaaggaaactatcgaggatcagtatgagctggtaagtcttgagtgcactttctcgatattgattcattgttttctactcactgctttcttgggcaggttaaaaaaagaacatcaaatgcaaataagttaaatgagggctctcatgtcatggaatatggtgacaagacattcaaggatgagaagctcttcctctatcaaggttttaatcctgcaaatggcaacatcacaaatgaattgatttggccagtaccaaaggctacagtcaatcaaagagatgccgatcttcttttcatgtggaagagggtaaattctagctgtcttcagtttattcatttccgtccttcctttctttagaagtccaaattgtatgtatataatactgagttgtcgtaaactagggttcttccactactataagttggtcggcgaatattaatataaaactagcatgttaactgaaacatgatcacacacaagttacatactttggatgaaacatatagattatgatttttattttcctttttcttgctgccgaatagaatggacagaggcatggccccttgatgcattgacatatattgcattctgacattatgttgttaggataatggtgttgaatttgctagagtagtttctttcatgttgatttggttgacatcgcctgtaagaattggcatcattatctctgcatcattatctcttttattgttaactggggctctcttgtttagttctgatctttattttctactagaacaaatgcccgtgtgttgcaacgggtgaaggctattttaatcttattattgtatacggtttaactaaggtgaaattgactgtgggaatttgattggatattttcttttttaagaaaatcatgagctgcaattaggagtctgcatgcaagattttttaaagagatttcttatacgactccttatgtatttctaaaagcaaacgaacttaaaatccaactcaaacacggatttgtatttccaaaagcgaacggactttgaaaaccgactcaaacacggatgacgtactaaaataccggcaaaaacatcttcaatttttataatagtagagattgctcatgaccttggatatttattctatggacacttcaccctttcttgcctctacttgtgtatggaaataatggaatacatttcatatttgaaagggtatagtgtgatatgcttcgtatttaaaaaggccatcacatggtgtacgtgtgacagctgatagcatgatactatgtgagctccatttccgagaacaggactaagttaagatgtctgaatttttaagccagaaatattttcagagcatatgacagtttcatgctaatgtctgtatttactttttcagtatgagcagttgaatggggtgtctgaagacaagctgagggctcttagggagatagaagacaccatagcacacaggaagcatcttgacagcagtatcgatttcatcgggaagcttgtgtttggttttgaaaatgggcctttagcccttgaggctgcaagaagctctggtcaaccattagtcgacaactgggattgtttgaagaagatggtgagtacaaggctcttttttttaactctgatataagccatctataaatatttcttgagttattgtcttcttgttgcctgttggccttaattgcacaatgctatccttggttcattgccaattgtcaggtgcgaatttttgaatctcaatgtggatcactcactcagtatggcat

SEQ ID NO: 81037 - DNA, 737 bp, Oryza sativa
ggggaagatgggccgagggaaaatcggcccatcgaacccgggggaggcaaaatagacttttgcggaggaatttgatttggagggaattggattcggaattgaactcgacgatagatcggggattgagatcttgagatggcacggacactagacaacaatcagagaaacaaatttcgcaattagggtttttaagagataattttttcccgctaggcgccacgacggaacgggcgctacacaagcgggtcccacccgggaccacgtgtggtgagcccagtccaccggctctctctctcctcccctcccgcgcgcgcacttgggccgccttgggccggccggcccatttaactcggccggtccgctccaattcccttgggccgcgccttagccgcccgaggaaaagtctataatccctccctcttttcttttcttttttttccaaaaaaggatttaattaaatccttttcctttagaccaaaaatccaataatcttagaaattcaatatcttcctaaccttcgatccatttgactccgttcaacttccaaaattcctcaaatctcgagatctatctaatggcacgcttagaggtcattattagggcttcattttcgccgtttgttgagttgtcccgtttcgcgtgtagtttcggagcccgaagacccgcagtgcgatgatttcgaggatcaagctccagatctcgagcaaggcaagccacctttgaacatcttgagccta

SEQ ID NO: 81038 - DNA, 743 bp, Oryza sativa
cccgttcaagaagagcagacggaatcggtgtaaaagtgaaagggaaaacgccaaaggtgcaaaacgaagtactagtatcgacatgttgcagagttagcagtgcattagattatcagtttagcacccaccacttcttgcaggtttaatcagtgtcggatggtccacttgggacagggccagtcggcagagccttatcgaaatggttgtgtgctttgggcctcacaaactgaccgaattaatgaaagcaatgcgacaacagcaaaaaacaccatgatcactgatcgagggggtgttgcgagaatcgaactcgcgacctctcgcacccgaagcgagaatcataccactagaccaaacacccagtttgattacttctttatcttgtattttcaaatcctaatacaatgtagcatgagtctgcagtgctcgcaggccgcagcttggtgtattcagagcccgggaatattttgagctccaatatatacagagtacagacgaagcagaagacggtacaaactactacaaaacagtgaacagcgacgtctttatgcatatcatgcgtcttctccggaacacgcatgcatacctccccgaacggaaaatgaaattgatgacacgagtaaaacctaaaaagagttgcatcacccacagcaaccactccgtgccgatgtgtcatgcagcacatacgcctcgcctcatggagtgacttcatcgctgatttgcttgggacctaccgatccaatcga

SEQ ID NO: 81039 - DNA, 797 bp, Oryza sativa
caaatcgcgcgcatcggcaagggaaaaaccgaccgacaataatgagcggctttcttcaagaccgctacattacttgagtagcgcgcgaattgggacgagccggttcgtttcgcctggagatgtgatgatgtgcatcggtcggcgagcgtagttaacgcgcgcatgatatgtcccatctcgactgccacggccgcacatccgcctcgtgcgccgcaaacgggcgagcaggattaatggaggagtgggcgcgagaaacgagggggcgagatagtgggcgcgggaagcgaggagccgggcatagcgtttggcaagggtataaagacgccgaggaagagattcgtttccttcctctcgccattattccccttgccttcgccgcttgcgctctaacttctcgtttcctgtgccctaccctcgccgcactcactcgctctcaaacccctcctccgccggcgttatggcacggggctccgcaccgctcgacggtagcgtgctgccgccttctcgcatcgtgagcgagaggcaagccgggctgccgcgccgattcatgccggaatctgccaccggccgggaggtggttgcgctgggtgagggacgcccggcgccacactacccggggcggtccgtattcttccttcccttcgcaatggcagggctggtcccgtcattctcttctttcttcatggatgttctggagctttatgatctccagatggcgcacctcacccccaacgcagtaatgacgttggccatcttcgcgcacctgtgcgagatgttcatcggggtgcgcccatctc

SEQ ID NO: 81040 - DNA, 9999 bp, Oryza sativa
ctccaaacttccaaaattctaaaaacaatgagtttttattgtacgtaaggtacatttaaaaggttaccagtcctgaaaactcaaaacctccagtgttatgtagcaccatccttgccactctcccattggatggctgagattcattctactgtttttgtccttttaccaatcctatgctcattatttactacattatgtggctctttatgcttgcattatcagattgtctttcacttgttaagattgttaccggtgaccagtattgttgtaactttgagaccactattatttttaattaattagattatgatgcaagaaattttaatagtatgcaatatacttcaataagatgacatctatttgtgtatttagatttttgaagaaaattgtgaatggttaaagattaactgtgaataccctgcaaaaaagtttaaatatgaatagtggttagtgataagtactaactctatcctaaaatatgagaaattttagagttgaacacgggtattaacaaagtaggtgaaattaaatgggggagttatgtgattgtatgagaagaggagtataagaagaatttgaagggtggaagattgttattggttgagaagagaatgtataggtggagaagttgttatattttgggataaatattaaatgttagaagttgttaaatattttaggatggagtgagtagtatacaaagcagtagtggaagtatatatatgatcataccgagaagaaaactaagctacacatagtgttttcttttttgagagggcacatagtgttttttctttaaaaaaaaactcattagatacacgtagttaacagcgacacaaaagagaaaaaaaataaatgtcactagccagatcgatcggtcggtcgtttccacacgtgcgcgcgtgcggcccggccacttgcgcgacgatgtgcgtgtgaacatggaaattaatcgctaatataaacgagtttctagctagccttcgcgctcgagccacactgtcgtgaagaaaaaacggttttaatttcgtagtaggttcatataaaaacttactctaacaataatatttctcacgtgaaaggtaaggaccacgtgccataattaaatcatgctaatgaataatttgtacacacgactgacttgtagtagtactgaactagctactactccagctaggaatagagtactggatagctactgcgtgaatatgtacgcgtcgatcgtcttgtgatgactaccaggtcgtctgttgactgatcgatctatagatagatagatacagtttgtttttgacggtcaatgtatacgtgcaaaacgccgaagaagctagtggactggtggttaaacttgaacaagcacgttgcttaattaattactccgtccgttcacatatggtatcctcatcatcccgtaatgtatgaaactactgcagaaaggatcttcacaaacggccaaagctagttttcatatcagggagctccactcagaatgtttttttttacttttttagacttttttatgttttagttttattattagaccactcccaaaagtattttcgaaaactgaatcttttgattaggcgtgccagcgatgtcctgccacgtcatcagtggtggcgtgacaagaggctggcgtggctggtatgatagagttatttggccacaccaaggggctggcgtggccaaattaatacttttggaaatggtctattaataaaattaaaatataaaagtctaaaaaataaaaaaaaattcctccactctcaagtaataggtgtgagttgtctacgaaaatcggtattttaacgtgcgagcatcacatccggatgtaacaaataattttcacagatggacatcctaaggaggtcattataaagacccgatttttccaagtagccaaataaggaagcaattatttttttcaaaaaataaaaaaaataaaagaattccaaaaccctagccaggtcatcgtgaggccaccgccgcagtccacacgcctcagctcctccgcctccattttaactacgctgcccttccgcctcctctccgtcgcgctagagcctgcgagcaatggatccgccctccccccctccccccgggttgggggggaggggagatcagccgctcttaagcctaccgacggtgctgtggtcgtggactcgtggtcactgctcttggtgccacggtcaccactaccgccccaagcccgaagtccgccatcgccattcagagaggcaaggaggctagtcgacccattgggagagagagaagagtagagaggaaaagtagcagtgagtgaggggagtgagagtgggagtgggagtgcgaaggaggaaataaaagagaggaagagagggaatgcaaaggggagaggaaaagaacaaagatattaggatgggggagcgtgcaacaggtaggaggagaagagaaacccccttgtgaaaatcaatttcgtagacatatctcttaatcaagagatctgtctatcaaaatagctattttctcaaaggagcctagtaagaaactcgtctgcgaaaatcggttttgacaaacaggccttgatcgaacatcatcaatgaatttttcatatggatcacctttcaaaataaagagaggtgtccgaaaaaatacctttatagttgttgcaacgtgtcaaacagaaagaaacaaggaacagagggagtatgaagaatcattctaagttaatacgaaagtataacaacatctccaccatcaaattagttttatattaaataaaatattaagtatatttttatgatatatttattttacgtcgaaaatatttctatattttcttcaaacctgattaaatttgaaaataaaaaattgaaaatgtcttataatatataaaacagatagagtatgagttacggagacgtctaaataacaaattctagagttctaacaaactcgatcggtggaacgtgacatgttctagagctcagactattcgtcgcgacatatattttaatcttttttaccgcattgctatttgccagcgagatcgatcggactatacatcttccgagccatagctagaggtgctggttcggcaagtatgtttacatgcatgcttatgatgaatgcgtcgtattatatataaacacgagcctatacgtacgtatgtatacacgttagtattcacactgcaagtgtggacatattttagtatttcactactagagaaaccatcgtccaaaatccataatagtcccgatttgaataggaaccgggactaaagatgatttttaatcccgattaaaaactttttgatctttcatcccggttggtaacactaatcgagattaaagatcatttttagtcctggtttaaaaagttgttgggatgagtcagggctccaattatctttaatcccggttggtataaacaactgggactaaaatatcttttgtcccggttgcttatacaaaccaagaagttcaccccgatctgcgcgcctcgttcttgatcagtcgccgtcaatcttatcccctccttcttcctctctcctcccctcccattaaataattaacaccctcttatctccatctcagtcatctcccctctcctctcaccttcttcctcccccttcccctctcctccccctccccgcctcctttccaggcggccgagcccggtggcggcagttggcgcgtcgggccgcgcgaagcacggcggaccgcgcggagggcggatggggcggcggcgtggccgcgctggcgagcggatgggagggcggctagagccggcggccggcagcgccctcccctctaccaaaggggaggcgggaggaagcagccggcagcggcaactcgattttgtttttttttttgaatttttgatacattggatctgagaatttttagaagttgtcatccattggatatgtgatgtatttcttttagaatttgtatgtattttttttgagaatttgtgatgtgaatctatgtttgtgatgatactttgattttgatttgaggatatgattggggatacagggagcaactcgatttgtgcggttacaacttgatttgggaaaaaataataaaaaaaatagtgactaaccgggattggcgttgccaccaaccgggactaaagatgaatttttaatcccgattattttacccggtactaaagatttcccggatactcccgattacaaaactgagagtataggggttatcaaccgagagaaaaaacgctttctccaatagtgattttacactttcgtgtaccgccgaaaggacgatccaggtttcagatttaattcctccaaattaactctgtacgtccttctaaacttgattttctcgagctataaaattctcttccataccataattattgcgacaatctttaagtatctccattagtatttttcagccgtagttcatgcaaatgagatgcgatggcatgcgaactaagcaactggttatgttcgtggatcagattatatttgtccgtgacaaatactaagactattttttaccaaactacaaatactagaattaattagtattatttatgtcgactaattatccatttaatgataggcagtatattggatacacaagctttaacggatagggtgcgtattattgcgagtagaaagtgcgagagagattgaatgaaaagagcgaattgagtcaatgcggtacattttatagatggggaagggatgacaaccgtagatgcgatggttgggaccatcgcgtccgttgccaaggagcgccgagtgtaagaggcgtggttgccttatacagatgagatcaccatgtagtttcttaacacgtatgtttacatgcgtaagtgtatatgcgcgtctcgttcatactgtggtatatcttttaaaaaaagaaacggagaaaacttgcgcccttaggcagcaaacttggtagctagccatttgaacacacccctaaaatcctcatgcaagttatttgattatgagacgctatgaaaattttggccattatttcaacacccgaaatgctgtccagcttttggatacttatgatgcccatatccaatttttctgtgccaaaatattttgcaccaagtcgtcaattaaacattgataatcgatcgattaggataatactaatcgccaacccgtaaattacacaggctactgttatttatgttataaagatttaaaattttaatttgtgtgaaatacatcggttattataattaactttcatgttcggaggacaaatataactgtttcataactcaatggctgtcatattatgatccatttaatcaatggctagatgtgtacatgagaactcataggaaatatccaattagtatttggtatatagtacgaaggctaatcggtgcagccgcgctagaagcacacactcattatattttgatttttttagacactcgtactatctaagagcagacactcgcttaagcctataagcacacacttcaaaagaaaatctttacatacatgtgtactatctaaaagcgcatactcgctagtaacaatttttaagcaatttttctataaagtgatttatattagattgaaatttatctaaatgaacattttagaaagttatttttgatatattttgattttttttgaagacttactcaaatggagtacaatttttctaatataccatttcaactgaaaggtcatttcaaatttaaaaaatcgagtaaaacttctactaaaaatttgataccttttaactcctatatcagaaaaccctaatttttaaactttcaaataaaaacttacaaactttcaactcaaattaaaaagttttaactcatgagctaaaaaaacccaaattttaaaactctcaactcaaaattcgaaacatttaatacaaaatttaaaacttttaactcatattttaatacttttaagtcaagccaccagtagctaagttagttgagtcaatcttgtccaagtgtttacattaaatttattattcatctttcattaaatttctttctacatatagcgaaactcgatgcaataacatttaagctcttgtcagcaattctatttgatggatctgtaaaaaagtgtcaatactatactccaagaagtatgtaattttggtaaagtccatagtgatgactcataatttataaaaaaaatcatattgatttggttaagcatgtacgtacaggggtagtttttacaacaaaactaacaaaaaaataatttatacagtgaaatgtcaaagtgacttctggggtgattttttaattttcatcctacataattcacataatatttcaatatatatctccatcattttttataatatcctatatacctacatagttcatcatcacttaattaatgctatttttctattcttttattaagccatatcacttcaattgtttatagcacttagatgattgatttatgatccaaatatcacccttcttttattgtctcataagccatatcacctcaattgtttctaactcttatatgattaatctatgatccaaattatatcccttcttttcttctcccataaaaccacatcatcttactttcatatttgaatcatcattctatatagtatttaaattatcataaaccaaatcaacttatataagattatgttgtctagatattttacacattatttctatttgttattatcatactaaactcacacaacaacttatgtagtttcacatggtatatacagatgtgctaacattgcttataatctgaagagaccgagggtatgttatttttttctattttcttttgcaattaaattgaaggtgacaccgggaaattataggatcgaacacaagtaaccaaacctactagaaatggtaaatggtagattacgttagtggaagtcaaataatcgaatcttgatagttcaaaacacaacccaatcttaaaaaccaatggaacacctgtccagtggtatatccgacctactagagtcggtgtgaccgaggcctggccagtctgaccgcatatcctctcgcggtctgaccgtcagcctaaaaaacagcacgacaaaacttatgtaaaaactcgatttctcttaagccaactgttggatcgagttacaaacttaaataaataaactagacaaaccaagaaacaacgccaccagagcgatttgcaaacttatatatggtttaagagaaaacaccctctcgaaagtcggctgtcttaaaatttcagcaaatctgaacaaaacctaaaacttaagcaaattcgaatttagcaagatccaatcaacaaagtattagaaagattttggatgaattaacttcaacaaaatcgtagaaaattgaagaataataattccaaaaccgtttacgaaaccacgtctctcgtgatcgtggcctgctagccatctaacaaagctaccatgcacacatgtacagcacacatacatcatacatgcacgtactgcatgatacagtaccttcgctacaccagtttttcttaaccaatttcctccgtgaacatagtatccaatttcgtcaccagcatccttgatcatctggactcaactcctccttgagtctagtcccgatctcaccgttgatcgaagttgacctccaagaaccttaactctagttaccttctcacatggtatcccaaccgtactagaactttgctcctccccgcgcataatcccggtcctcactattgataagtcacatgcacacaatcagacaaaataaccatttctgtgctcagatatcacaacatgatcgacgcacattacccacactcaccaacatccatgcacagtacattctcaaaacaatttcatcgaataaatcatttgtaaagccaattgttcatcacaaatattaatcatgataataatttttaaaaaaatgcataagatcattgtcatatcttgtctcatcttgaaataatatccgtggttaattaattagtctttgcccctcctcctgtaactaacagctaacgcacgtttccaatgtgtttccaagctctattgtattcacactcagctatctgctgcatatgtgttgagatatggagtagtccattagcctatacagtcattagcattagccattaagcttgactaaccttagatttttgttaaggcgctttcacacacttatatacgccctatcacactgtcactattccccttgtgcatatgcggatgaaatggataaaaatggccgaagacatttctaaactgcacctcatattctccttgattgattattactaaaatgatcaacgagtttcactttacccgactagtcatatgcatggatgcctgcgttgaaacggaacattaaaaccggttcaattttttctacccttcatcgggattttggggggacatggtttattttgttttctcgcttggttagtttttgatcgaggcatcgtttttttcctcggttagttctttagagcaagttcaatagtatagcccactactagctctaatttatctatagccaatctaatagccaattcatacaatagttgcttactatactattgatatatggtcccacctgtcatacacacattccgtcttggagtccgtactgcagctggctataaatctgtagcccgctgctcttctctcttatccactggtggagaaaccatctttgctcggtagcccaaaatccacaatagtcctggttcgaataaaaaccgggactaaaagatgatttttagtcctggttaaaaactttttgaccttaaccgggactaaagatcatttttagtcccggtttaaaaagttgtcgggtcgagttaggccccaactcatttttagtcttggttggtataaacaaccggttatttataccaaccgggatcaaaaatcaaccgaaccgcgcaccagtccaccgtcctctcctctctcattaattatcccttatcccttcgatcccaccgtcctccatcccttcgctagctaccttatccctctcagccttagcctcctccatccattctcctttccccttcctcccccttctcctctcttcatcctccttccacgtgaggccgggcggcggcggcagggaggcgggcggccgagcaggcggcgggcagccgggcaggcggtgggcggccaggcgggcgaggcccgtgaggcgccgggcgggcgaggccagcaaggcccgcgaggcgccgggcggccaggcgggcgaggccggcgaggcccacgaggcgccgggcaggcgaggccagcgaggcccgcgaggcggcgggcggccgggcaggcgccgacggggccggcgaggcggcgctccccaggtgggcggcggtgctcccggggcagcggcgcttccggggcggcggcggagcccgaggcggccgggcgggaggccggtgaggcggcggacggccggcgctgatctctgtgatgttttttttcttgatctgtgtgatatgtgcggccgatttgtgcgatgtcgatttttttttcgatctgtgtgatgtgtgatgtgtgaatgaatttgtggagatgtttttgtgattttgtgaatgatttgcgatgtatttggggataaaaatacagcttgatgtatttggagattttgtgaatgatctgtgatgtatttggggataaaaatgcagcttgatgtatttgggaattttgggaaggatccgtggtgttaaaatgatttgtggataatatgaatggtggtgctcgaaaacatgaaagcaggaaaaaaaagaaaaaagaacattagtcccggttgttaactctaaccgggactaaatctttagtcccggtttttaacactaaccgggactaaagatccatctttagtcccggttatttcaaccgggactaaaaataggtatctttagtcccggattcatagtcccggttgtataaccggtactatagggggttgcgaaccggtattaaaaagggtttgtccaccagtgatcgtttatctcattaaaaatatatttatagctgctcttatgca

SEQ ID NO: 81041 - DNA, 9794 bp, Oryza sativa
cccgtttttattttaatacttagaattggtgaggataggaaagaaggacgactgtgcttgtgctttaaaagtagtagatactacctccgttccattttaataatagttgtggtacccgtgcctaacgtttactgtttatcttatttaaaaaaatatgaaaaaaattaaaaaataagtcacgcataaagtactatttatgttttatcacctaataacaataaaaatacaaatcataaaaaaatttaaataagatggacggtcagacgttggatacaataaacccacaactgcatttaaaatgagatgatgttttttctttctggcatatagtattcggtatttcatgacagcagaaaaaaaatccatcttaacacagacagaaaaactgcatacatattgatgaattgtgcttagttttagaccacatatttccgttggaaacaaaaggatcatctacagattctgctgctccttcggaacacagaaatccacatattctttcttttttttaaaaaaaaatacaagtgtaattaatagtttttcccccaaaagattatcgcattaccaaaagaaaaatgctacgcataggatcattttcttatggttttgatacgatcaaatgaaacggcacagactgtaagggaacctaacgcgagttcacgcgcacggggcagtccaagagcattcatgggccctaaagctcaattcacctcttttcatctaactttacatctttctttgttgaaccctaaacctaatgttccctattccatggtttcatctaatatgcaagtctgcaactaattcagatagcatacgccatcctaagacgaaggtatgtcatcttatttgcttgatttccagcttgacaatcatcttctttggtgcactagtctctctcttttatgttcctaggcaatctccatggccataaaatgattgtatttttttattatagatttaatctgaaaatttgctttgcaagacatgccattattttcaatttaccagtttcagcaatgaagaccaacttgtctactaatgaagtacaagatgacattgccaaatctgatgtggatgatttgctgctgagggggtccaaaatgaatcagatgacacatgataaattcaatgttgagcaccaagtacaagtactatataagatatgattaggaagaagattgctttggttggttgtgcaatcaggacaacgagatagcagcccaaaacgtcgggagcttgtgtgacatcttggcccaattaggatgagacctgtgtagctcatgtgagttgtctgcgcatgtttagtaccaccttactagtttagcacgagtggaaccaacttataaggtcttttctctccaaccatgtcactcccaagttaacccttttacacgaagcgaggacgaaaatgtaagtggagttgtatgtgcaagtgggtccgcccatcggttgggctggctacgcggcgtgcgctatgcctgtgtgtcggttgggctggctggagggaaggctcttacagcttggactttttacacgaagtccatgtcaggttaacccttttacacgaagcgagtacgaaagtacaagtggagtggtatgtgtaagtgggcctaccaagcgaggacgaaagtataagtggagtggtatgtataagtgggcctgtccgtcggttggatgggtaagttggaccgacggggacgtcgggtcctttaaggaggggtgtatgtgacatcctggcccaattaggataaggcctgtgtggcccatgtgagctgtgtgcgcatgtttagtaccacattgctagtttagcatgagtggaatcaacttataaagcctcttccctccaaccatgccaggttaacccttttacacgaagcaaggacgaaagtataagtggagtggtatgtgtaagtgggcatgcccgtcgtttggtctggcaacgcggttctggttctggagggagggctgttacagcttggactttttacatgaagcgaggatgaaaatgtaagtggagtggtatatgtaagtgtgcctgtccgtcgggacttggactttttacatgaagcgaggacgaaagtgtaagtggagtggtatgtgtaagtgggcctgcccgactgttggactggctacgtggttctgggggggagggctgttacagcttggactttcgatatgggctcaacagtgaaaggcgatctgttttatcgaaaaaacattaggagagaaacgtttcatcatacaaccatcgtagaaaataatcatatgtacaacaatgctcttttctatgaaaataatcatacgtacaacaacgctcttttctatgggtacacatcatgtattagtgggactatttttgcccctaagctcaagtgccaactagatatggttgggctacacatttcagaaaaaaaaggggtatggttgcatttgggcttgttgggccttacggaggatcaaatcttttaccagcttgatacatgtagatagaaataacaaggttgattataaccgatataaaaagacgattaaaaccatgttggtacaatagaagataatgtatagggcaccacaagagatatgaacgtgtataagacattatctaccaataatgctcgacattattgaaacaccataaaagatatgaacgtgtatagggcactatctccaataccatggcaaatctacaagttggagtcaccagaaaaatcagtgatccaaacaccaaagctgttgccactgaccggacaatccgcaacctggtagacaaacattcctaagtcttcatcaatgatccaaatgcaaacatcaataaatagatagaaaaagaaagtaaaaaactctagacaatgctagcttcatagacatcataaaagaccaatcataatctaactaatatacctaaatcttctaaatactttatttggaagaaacctaaaaaccttactggagtaagtcgaaaaagggttccctccccttgtcattggccaaacactagagacaaaggagaaggggaacgaaggctaatggcagttgaggccaccctcagcgattacaagtaatgaaatcttgtggaaacattttttcttcaattgaaagtattgcacattttagttgaaaataatttgttttgaaggtgaatttagcatttatagttgaaggtggcatttgtttagtttgagttatgttgtattttttagttggaagtttcatgcagtttttgatatggaagatgaaattacattcctaacttctactccctctagtttttaatatttaacaccattcacttttgaacatccatgcaccattggtcttattcagaaaactagtgcaaatatgaaaaaaaatatgtcatgtttataatatgtttaataacaaaacaaatcacaataaaataagtaataattacacaaatttttaataagacaaattgccaaatgtatgtccacaagtcaacaacatcaaacattataaaaactggaagaactatattataagatgaactcaaccaaaagtttccttatgatatattaaattaactgttttggaggtatgtcatgaggaccttcgactaacctgccgaaaccacctaagccatcaaaaatatcggtcaagtcttttgggcgaaacccccgggcgaagccgtagggcgaagaccaaggggttcgtcactaagaatcgggcaaagcctggcgatgaagatcaatgggttcgccaccaagcttggtgaccggccgaaggcttaccaaggacgaaggccgtcaagcgaagcatgaagccgtcgtctggagtagaagatgccttcggctaaggtcccgagaggcctagtggcccatggaggcccttcaccacctaacggccagcccaggaagatcatctcggggcccataaagataaaagacacagtatacccattgtaatatccctatcataagggtaacaatataaaatcccctgtactaaccaaaccatagtgggtatgagcctgtactagaattataaatagccccatagggccatgtaatgggggaccccaaaaattttaaccaattaatatattgttttactattctaaccacccaacgggtttccacgtccttcgacatgacgcggttatcattcgacaacattaactaagaatggacataccctatcttagaaagaagagctaaaataaacaagcctccaaagcttccctcttgctacaaaatgtttcaaactataaaacctttattttattttgctacaaagccattgctacaaaaacatagcagtgtgaagtttcgtatcaagcatctctaacctttagcaataggtgatatctaataaaatgtatgttaatttatattcctataggatgtattttagtttttgaaaaatatttaaaactaaggctaagtttaaattaggtgtacaaacggttgaagacttgaaaaatgggataaatcactagcgtataactaaatgaatattaattataataaacttaaaagatggatttgttcgatttttttttaaaaaattatatatacaatttattttcataaaacacgctcttcgaaaaaagatgctaacgaataacaagagagttgctgaagccaatggaccaaacaaatggggcctaactcctacctcatgtttttgttatgaaaaccaaccccaacatctaatattgcctatatcagggtttacgattccgacgaaatctggttggatttcgcgaaatttcgacgtttcgatgaggctcaaaagtagaaaccatataagatttcgaagagtttcatccaaattcaaatttgaattgataaaaaagaaaaaaaagaaaaaaaatcttataaatactatgatattcatataacctattaggatataaattttttaaaaaatgatgtattatgtgtttactaaaacttagctcagaaaataaaagaataaagaatttaaaaaaaaaggaaaacacttacatgggccagaatacatgtactaggcccagttactgatcgaaatttcgatgatttcgatctgaatttcgccaaaaccgactggttttgagaacttatcggcaaactcagggaatttgtattcaaattttggtttatgaaatttgttcgaaatttaccggtttttcaccggatttcgcgaaatcccgaattccgccggtgcccgaaacggaagggcctgtcggaatcgtaaaccctggcctagatagcattttagaaaaacttgctataacttttatacactaaatgcaaaaagtcttgattcctagaattatgagaagcagctagttagtactttctctgttttatattatatatatctagattcattaacatatatatgaatatgagcaatgctagaaagtattctaatatgaaacggagggagtagctagttttgaaaaaccaggagagttcgtttattagattttattattatatcccacaaccatttcttttaaataaaaaacaagacaaaaccttaggttttggaaagtcttcacttaatattattacttactgtatactcccttcatctacttttgatagtcatatttcatcttggcacacagaccaacgataagtgattctacttatcatctatttaaacatgctactagtcattcctcgtgaacaagcgattcattaatattttcatttctcgatgcctatgtagccaatcttgtgtggaggaatagagaatcacgcattaaattcgagaaagacattaagatgataggttgttggattgaaatatacttatcaaaaatagattttttagatttggaaatatgactatcaaaagtagatggagggagtatataatagcaataacaacaacaacaataataataattaaacacaggtaaacaaagaaacaaaatcaaactccttccccccaaaatccttccaaaattcttgagaaaagctccaacctttcctcttcttcctcttcccctccctctcgctgcctgccgcctctgcttgctcagatcttctcctctccttcccggattccaccctcagttgttgtctcacagtctccgaatcgctgggcggtggagccattggtgctcacccacgggcacgggcgatgggcgccgatggcggcggcggcggaggccggaagagctcgtcgccggccgggaagccggcggaggcggcacgggcggggagcctgctcgccggactcccctcgcggggcaacttcgtcgccgacagcatcgcgtccagcatggtgcgttcgttcccccccacccctaaaatggaccagcctttttcttggcatgttagaagggttcttgtgaaaagccctctgatttttatgattttttattattattttttgcgcagggaggcctcccggtttatgtctgcctgcacgacaccgctcctccaggtttgtttgtgattttctaggataatcaagctttacttttattattgtgatgatgctaatttgttgttttaggaatgagggctgattgtagtgctagtggtgtgtactgtggagagacagatttgaagtagaaggatgatcctttctactagggttttatgtagaattttccttgtaagaacgcagtcatcttgcctaggttttgttctttcgattggcaatgctgttggcatcatgcttaatttgtggttactgaatttgttttgctgatgttaagagttggaatttctatgggtttactcagaatgtctcttgcaggaaagctaaagtctatatttgttctttggatttgtggtggcactgttgattgttgtcatgcttattttatggtttcctggagtagtttacaggttttcggagtgagaattgcaggtgtttgtgaaatattgtactgaaccattctttggtggttaaatagatttaaatcttctggatgtaaagtgtaggagtttagtagcttggcaatggggataaatggtttgctttccattcaatgaaatttagatttagtagtgtttgggagtgaattttactgcctttgagttttctagtgattacctaaagtgagctgtccctaaggaaaaaatgaagctacagagaagaatttctgatgttgctttttttttcttcggatcgagtgagacattgtgctgctgtcacaaaacttttgccatgtgtttcttgggagtcttatcttttgaatatcatttttggacgtatatgatttacattttatagtggcagttgttagtatatgatctattgtcagaccatgatcttttacatattttcattacttatgttcttatgataaagctgattactgatgacacaaacagatcattttaaggctgttttgttctgttcattgactgatcaccgtttttgtcattttagagggacaagttatagacacagacaccacaaacattttaatcagatctctccagttgagcaaacagaaaaatgaggcaaaagatgtaggatcaaggactccaggagaaagcagcaaggggaaaaggtacatcgctcttacgacatctttacaatattgaacctcatttttgcaatgtacaatgttcagttttagagtttcaattaacagcttcagattattttcttcatgacatggttacttgtgaactgagcatgtccctcctgaaacttttttgatcaaataatcctccctggaacttgcttcttaatctagcgttgtttgtcattttcctcacttgatattaagctattgacttactgtcatttttatcgatctgttgaacagaaattcatccatcatagttattgcctgagcagaatgtagtttagctctatttttttgagcaaaaaccatctgcagaaccttcgtcaaatatcaatggaaacattgttttgcatgaaggccatcaatttgatacaagctgttggatgattttggaaacttgtttccctttaaaaaaaaatctatgaactaagtaaaatccatatcgtagtctcttggatgatacaagtgctaggctacagttaaaactgtaagataggcaattatcagacgaactctgaaaacatgccttgacctgggattaacttggggaatgccctagtctatttaattgaagggcggtgtgctactgccatttgcattacaaaaaagttatgccagacaaacctattgttctcctatgttttttttttttttagattttgatttggtgccttttctgtcattggaatttttgtgccatttagattgcttgtgatgccagctagtaggacaaaaatcaactcttttcaattgctgacttgtagagaagttgtctcctaaaacttcttgcaattgtcagttaaattttatcctccatgtagcttatgttccttcttttttatcaggtctgcttccagacttttagatggcaagaatccatctaaaagagctaacactggcagcacggcagggtcatctgcccatggtaactatttgattcttctctgcaccctttcttatatgagtagtcatgcatagttttatgagtaatatgtgcattgaaggaaaaggcttatcagtaatttatttgttgctgttgtacgtttgcagtgttaggtaaataatgttagttccttggaaaagaaattgctgttttccctttgttttcttggtctttaaatttggagttgtcaaacttaggctgtgttcttttggaggggttgcgaacccctccccttcgcacggaaaacggagcgatagattaacacgtggttaattaagtattacctataaaaaacttgaaaaatggattaatatgattttttaaagcaactttcctatataaactttatgcaaaacacgtaccgtttagcagtttgaaaagcgtgcacgcggaaaacgagggagatgggttgggaacccatgggaaagaacacaccttaggccgtgttctttttatgggattgttttggctgattagctgcatgcaaaatgagaaacataattagcatatgaataattgagtattaattattaaaaacttgaaaaatggatttattttttttaaagcatcttctacatagatagtttccgcacgaaacataccattttttttttgagatgagagaaacataccatttagtagtttgaaaagtgtgttaacggaaatcgaggaatagctaagtttaatcagctctttagaacttgcccttaatttgggtgagaagttgaagttattataggacaaataaactggtactctactttgagtggtacttttctgtaaaaaaaatggcactgagggcatttatgaaactatagctgatgcagatagcaaaaattgcgtgattcattgtcgctttgctaacttttatgttgctattatatgacctatttcctgaattttcagaagcatttagacagttgtatacatattttgtttttataatacgatgcaacatttgtttctttttctgactacagtgatgcttctggccagcttagttatatgaagtaagaaatcaatacatcttaaattgaagtatccaagtataaattccaatatggctactacgtcatatatcaaaatcttaaaatataaataacattatgatagttttgttggtaaaattgattaatttgagaaaccaatgatgtggttttaatactgagtactggtagataattaaaggaacgcactgccaaataccacgcaaatgtcacataagctggagaataacatttgctgtgatattttccatccaaaggcctcaaatgaacaatcatgcaggccgaactattttcttatttccttcctttgatgtactccatgtaatgtgcccatcag

SEQ ID NO: 81042 - DNA, 7585 bp, Oryza sativa
tgcaattcacagattttgcaatggcatttaccagcccaagtttgcagtggtattttccaagttacccttctttgagatggcactagcaaatttattgtgtatatccctttgtatatgatctgaataaatagtgaaactcagataatttcagatgattaaagtctgctctaactgtgcaagcctagttttcttgtaccaaattagaattctgaataacaataagattccatatgtttttgaaaaaaaagattttgacctatattgtacatagattattcagttaacacctttttttaggtattttccctcatcatctgagcatcaatattatcttgagaacaacataatccacaaaattctgagcatcaatcattttagtactattgaatataatatcaactttgatcttgcaggggaattgggatctgttttttctgagcagacgctccaatcatttacggtggagaagttgcgtattcttctgaaagagagagggctctcaccaaaaggcaaaaaggtaagtacagaaaatgcttaattttgtaactccctctttcagttttaagaacttgcaaaatcttgtttatgcctgggagattgctagacgtttgacacccaagggtacattgttctgctgtctcatttaaatctagaaaattttaatagtactttagttttctagtcataaatttatgactagtgagtcccagtgtgaatatttctgttgtaaatatttttttcattatattaataaagcattaacagcaggggcctcccctgctgtgttgtctttttaaaaaaaaagggaatcatacatgtgtggaacacgctgcttaaataaaaaatcatatgtttggaattgttgataatcatatacctgaatttcaagaaatattcacatctttttgattgatcgactttagcaattggaatttcgatctctggtgactggtagcctagcggtgggtcatcaggtagagcagtttgttatatgcttgggtgagggtgtttggcttcatcagaagcatgcacaatgtactgttggcgactgttgctgtggtgctgaccattatggtgttggaattaaagggaaggaaccctcagattgtggtgggtaagagatggtggtagtggaatcatatcaaagtgtggtgctattgactagagaaaagttgatgcaggaaggaaaaaactggagattgtggcggagggttgggtttggtttggctttggccggggataataaatgatggagctgtagcctgtagaattaggccttgtttagttcccaaaacaaaaacttttcacccatcacatcaaatatttggacacatgcgtggagtattaattatggacaaaaagaaaaaccaattacacagtttacgtgtaaattgtgagatgaatcttttaagcctaattgcgccatgatttgacaatgtggtgctacagtaaacatttgctaatgacagattaattaggcttaataaatttgtctcgcagtttcctagcggaatctgtaatttgttttgttattagattacgtttaatacttcaaatgtatatccgtatatccgatgtgacaaccaaacccgaaaatattccccaactaaacaaggccttagatggacttgagaggggtggattttgcttagagggtatacagaagggtaatgattacttgaatagacatggtggagaggatgttggtttgggtgcgctgacgattgaggatatatactgaaggttttagatatgatgtgtgcaaaccatgcagaaggagacatgaccatattggacagctttggtgggcattcaaatttttaatgcaatatgatatctaattggcaaatggtaatttgtatggtgatgaaatcacaaacacacaagttacagaaatggaaatacaattgttttgatgtttttagggccacagttgtgttttcttgactaactatgattagtgaaccttgtaaacaaataaacaatagcatgagaaacagaaccctcaccccaaccatgatcagcactgtttgcacctacggacactggatttcacagggaaactggaatttgaaatggagtactttctttgatgagtagaaaggcatgtattgaaaggctaaacaccggctgatagaagttgtcaatatatggagacaatagtcttatattcgctgcccattaaacaaaataatactccctccatcccaaaatgtttgatgccgttgacttttttgaaaatgtttaaccgttcatcttattcaaaagatttaagtaattattaatttttttcctatcatttgatttattgttaaatatacttttatgtatacatatagtttacatatttaacaaatttttttgaataaaacgaacggtcaaacatgtttaaaaaagtcaacggcgtcaaacattttaggaaggaggtagtatgaaggatatcacacgttcgaagggttgttcactttactgtctatcttttgaacatttagttatgaaccaaaaaagaatagcactcatttattttgagatcactcatctaattccttttcttgctaaatcaaacttttgtcccttgttgcaggatgaactgatcgcccgcttaattgagtcctcggagtgatctgaactgcgatcggaacctcattttgttggatgttgtaccgtagtgacgatcatacaccatgcaagtgaacttctatcgcagacctcatgtaagcatatatttcatacagtgccgaaatgaaagatctggctgatagtttccacattgcaccttgttcgatggagctccttcaacgtttgcacgacgtgttgtgtttaacactagtgttacccagggcaccaagtctgtctacgtccgattccctcttggtgaatctgaatctcctattctgacacttcgtttcgcatcgtgtcggtgcctgggtacacctgtgcaccctcacctcgtttgtactccgtagctttctgggtgagaaaggctatttagaccattcccaacccaagacactagacatagtttttataaactccgcgtcattatcatcaagaaactagtactaggcactattcttccaatgcaaacacaactattccatacatacttatcccacacgatgtcttggatgttgtgtagaaattatgtctcatgcaagatatggttttcttctctttcttcatttattcgccacatcatttttcgtcctaggtggcagcttatttaatgctatggacatcatcctagttattgggttgggaatagccttatgttcctacggaagcgtctttgaccgctgcgcgacgaggcctctttggatgaggtgcttgcggaatttgtgggccgctacccccgcaaatcatcgcggcgcggacgacaatcttcgaccttgacgcggtggtgggcgacggaatcatcgacctcgtcgacgtgcaacaaggagcaagctagcttcgcatgcttgcgtgtatcctcattctactcttttatgttgtcaactatgctatgctgcagaattacttcttactactatgtcccagaaaaaatcaaaccctgggtttgtgtgtctagatttagacctagagttcgatttttttttttgggacggatgggtacttttgttgctccaaaaggactcatcgacaccgaacggctgcgtccatcgggtcacagagcatacagctcatgtaccgcgctacactttgcatatatttcatcagctcatgtacaactcaagtagcgcgcgtggtacatgagctgatgacggaaacgacatgcgacctagcttgtttccatggaaacaatgctgcgaggtgactgccagcgatagatgacggtcaggcaaaatatctcggaggatacaagtggacagccacacaatgcatggaaccagctagggggccacatcctgcttctttggagctctggtgtgatcgaagttcgcgacatcagactaagacttctcaatcacgaccagaatcacactactgaacagctcggataaagcttcctcctgtaggcggtttataggcccacgagccatagaggaaaggaatacttccttcaaggaattaggaggctaaggctgtgttcgttgctcctagttcccaacccctctcgctcgtattccgcgtgcacgcttttcaaactgctaaaggtgtgtttttaataaaaagtttctatacgaaagttgcttaaaaaatcatattgatccattttttttaaaaaatagcaaatacttaattaatcacacgctaatagaccgctccgttttccgtacgtattgttccttttgggaactggctagacgaacacagccaaagccggaggatgacgagctgtggctattaattggtttcaacatgatttataaggcaaacgataaaaaataacacgaacctcaacttgaggtgaatgagccggttccgtgctgctcttaaccactgtgagctcaaagagatccaccttcaaaataggaaaatcacttggagaaatgagagagtttagctgacacttgttaagatggacagattcttctgcaacgaggaatgggacctcacctttgggcatcacatcctccatgcgttgtcttttggaatatctgatcactaccccttgcttatctccaacccgggcaggccacggagccgagaaccttcaaatttgagaacttctgggtaagactatcatgattcaaggaggtggtcctgcatgcttggactcaacaaacgacacaccacgaacctctacaccgcctagctagcaaacaaaatgagacgtcctatgattgctttaaaaagatgtgtaaagggcgtttgctcaaatatcacatggcattggacgtaatccaccgatttgacgtggcccaagagggccgacacctaattaacacaggcagaacacaggctccgcgcggccctgaaaagaaggctcctaggttttgcggtcattgaaagagcaagggaaaaacaggctgcaggtaacaaacattacagagggagatgcaaacatgaagtacttccacggcaaaatcaatgcacgcaaaagaaaaaaccacatctatcgtttgcgcaagcagagtggttgggccgtcacacataaagaaaaggagctctccatcgctgagcacatccaacacgtaatgggccggcctgaggctagaacacacgatctcaactgacctttcctaggaatcaccccgctagacattagcagcctagaagaaccattcacggagggcgaaatccagaaggcgactgtacgacgtaagaaacgtgcatctaaatcttctcaactctacaaatgtggtccttattccaaataaagatggagcggaggaaattggagactatagaccaataagccttcgtcaaaatcttatccaaagtgttggccatcagattgcagccgctcatgcattcgatgatctcgacaaaccaaagcgctttcatctgaggccgaagtatacatgacaatttcatgtacgtcatgaacatggtgagaaagcaccatagaaaaagaagatcgattctgctcttcaaacttgacatctccaaggctttcgactcggtgcaatgagattacctcctaaccttagtgcataatagggggttcccatagagatggaaaaataggataacgggcattctatccatttccatatcaaatatccttctcaatggaattccgggccaaatgattcggcatggaaaggggttgcagtagggtgatcctctatccccgcttatgttcatcttggcaatggatcccctataacgaatgctcaaaaagccactcaaatagggctgatcagtaagctacgaggcagagcagtacgcttttgcacgtccatgtacgccgataacgcgactgtcttcacaaacccaagcaaagaggatgttcaggccttctccgacctactccaccactttggacaagcaacgggattatgtacagacctgcaaaagtcacaggtggcaccgattcgatgtgatagcttagacctggacggcatccttgatggcacgccagctacgcgggcctccttcccgatgaagtacctagggctccttcttaccacaactaggctatgaagaagggacctccaaccgctctatgacaaaatcaatgagccggattgcaggatggcgaggaaggcatgtgggttaacccttattggaaatcaagaagcgggttagagattatggttctaatcatgacttagtagataaaaattaactgatgcagcactaagtatgaaaaaaaacataatatctagacaatcaaggatttgactgattttcagggtggtagataccttagttaatctaacctggtaaagcgatttagccgataccgacataaaccctaaaacgaatctcaaccgatataagtaaatcgagctatcaaactagttaactaagatatatgacaaacaggtgcttacatttacaagattagagtgttgaagccctagccgtgccgatgcaaacagccatgacaagtataaactcgtcgaaaaactagaaaagttaaaagggtggcaaatttgtattgatcgtggagatagtttacaatgaccccgggtgtacatatttatacccatgggtagatacgagtctttcttgggcaataaagaaactttcctaaagataaaaggaaaacataaagtccttataagacattaaacacactttcctaaagataaaaggaaactagcagactcttactaattaatagataaactgacatatcacatcctgcttgaatttggtctcttctagataagcttcctttaattgattaatttccttaaccgaatatagtaagaatacgactattggcgacttgataattctcatcagccgattctaggactttgaagttgatattgactctaggcagatgatgacttcagggcttactaaatttcactgttaacacatatagtattagatagtatctaattgctatattttgaatcgaagggaataaaatttagttgacaacgctgtcgacaggggatacccgtagactggatatagagggtattggggtacgctggtacgaggatctacgtagtacgacatcaagcaaacaggaaacagggattatactggttcaggcctcttgataggtaatagccctaatccagttgatatgggattatatgatggaaaccacagattacaaagggaataacagaactcgatgatgccgacgagaccatagtcgagttggttcgactagatcacccggcgatttggctcctgtaggctccgacttcgtaggctgtggtggatgtgttggcggtgagattcgatgccttaggtcctcccggggggtcccttttataccgcggatcaattgatctctaagtcgaactcggagatatcggaccccacacgatatggtaacgacccagtcttgtccgcgtaggagttctcccatgtatggattctatttctgccacgcgatagatttccttaacgtatacagaaactgcccgtatatgcacaggtataccatattggtatacaacatacatccaagggtagagggtataccttattcgtaaccctgaca

SEQ ID NO: 81043 - DNA, 19825 bp, Oryza sativa
atgtagacacgaatacggatatttttttcccgaatacgaatatggtatcggggtttctgtcggatacggatatccgatgaatagtgctattcggatatccgcagaagccatgagacataccatattttttttatagttcaatgacgttcaatataccttttgaaattttaaaagtagtctatcttttaacattagtccctgctactaatattatttaattttttaaaaaatataaataatactatatttttataaaaaatgagctaattatatatgatgatatttgtttctactagaagttgagttggttttcgtgttctaagataaaattgtttccgtattcgtgtccgatcatattcgatttttattcatattcgagataatccgtatttgtttccgtatccaagctattcgtgttcgtttctatatccggtaaaaaaaatgaaaatgaatatggtatgagtattatccgtccgtatccgatccgttttcatctctaattcatatcaatgatgagcaaattatatctattcaatactcttttgcaaaatccaaatgctagctgctaatgctataggattttaagaacttaactatatagttcagttctattgtgcagtgaagaaacactattttacaaacaattaaacacacgggcattaattttttctccagagaatatgaaatgaattcagggacatttctgaggctaatttacgcattattaactgctgcttcgcaaaaccactgtttttggcgcaggaggcaaaggatcaaaaactaggggcgcaactcactgggcgatatgtgcaaagagtctagaactaagcataatctatagcgtatcacaacaacgaaaggccgatcctgatctggacaaacgatgggaactgcgtttgttttgttctttcctgagacataataatttaataatggccacacgcccacctgctacctaccttgtcatgtttgctctggattgtttgtcagtacgagcatgcagttctttgctgtgttggtgactactagaaggctagtgtgtagtgtgtgtctatgtatacatgcacaagaacgaaggccgtggcgactacgagagatattatgttaatttattataccatttcagtcttgtctagctttgttaaacttgggaagcttgaacgaagaataggaggggctattatgctattttgtgtaacagtacttcaactcaatatagtgacttatggacaacataatttttcaaaaacttagagtcggggacatgacaatattgacctcgatgagctttgccacttactcgacaacccaggctgccttacttctcccattctattttccgactgctcctaccatgagtccgcgtgtatccaagagcgtcaccgacatcctccaagcttgtcttcaccgcccactttgaacgggcattagtgttcctgatggatggaggttgacaaaaatcatgaccgagaggcatggttggaattttttaaaatttcaatggcacgtagtaggtttcgtgaatggtaatagtatttttttaatatgatatatttactatggcacgatctaattaactatttaaataatttaaatgggttgtttatcaatattttcgtagctagcgaagctataaagctgggtgcaacagaagatccagatgaagttagtcagtacagtgaacggcatcgggaaatgcaggcagatgatgtctgtgatgacttcatggagcactttacaagtcacacttgacttaaaaaaaaaactctcaatatgcaaatgcaagcacacgcttctatatacttatgttagtatgtcgtgcaaaactcttgcaacttggaattcaatgataattagaaacataattccaattgttagctaggatcaactaattataacacatgctggaaaaggaattccatgatacagaggcacatttgcatttaccaaatacattcagggttgagagagatgtatggtcagctaatacaaggcaaacttgactaggcttttatagagtacctgtagaacggcacaaatgcaaggcacaagtcaaacaaacttcaaaactgttgaagatgattggatgaacatatatgtgcaaatttgcaaaaatacagtggaaaatgaacgatggcctaagtcagtattttgactatttttaaataaatcaaataaaatactctctccgttgtatattataagtcgttttcacttttccctagtcaaactaatttaagtttgatcaaatttatagaaaaatataactattttcaacatgaatcaagcatacttttaaaatgtgttaaatgttagttttgatgaaactagtttggtgctatagtaattactaattttttctatatatggtgggtcaagtttgactatgaaaaaaaattaaaacgacttataattttaaacgaaggaagtacatcttaaggagtttaacatgtaccagacctatacatttattaaaataatatcctagttataactttccaacctatacacacatatcctaataagaacatttataaagtctgttagttacgcaactacactacaatagaagcaggagaccactctgttttggaggatgtaaaaaattccaactaatgcactaatacttgacaaataaacttcttccacataccagacataaaaggaacgagtatcataatgaacattaggtgtgataatgctatctactccctctatcccaaaatataataatttttaagtggatgtgacatattttagtacattgaatttggacattcctacctcatccccgcagaaaaacaaaatcaaaactttgtactttaaagttaccaagaaaatttctttttatttttttttgtctcctcacaaaaaaaaagaagaaacaaagtcttcttgttaagtttgtactaccatcgcaccagagagagagagagctggaaatggatcccctttaaaagccgttgcgttggctctgccgccttggcaacaacatccaatttccaaaccaagagagaagcagcagcgatggcgatgcggcagggagcgctgcgaggcccctccgattactcccaggagcccacccgccacccctccctgcgcatcaacgccaaggtgccggccgtgatcgcagcagcaagaatcgcatcttcttccttgagtttctactcgtacgtactcgcgttgagttcttttgtcgcgcaagtaaaatgtgttttttggggggcgatggatgcgtgcaggagccgttcaatgcggaggcgacgaggcgggacctcgtggcgtcctacatcacccccgtggatctcttcctcaagaggaaccatggccccatccccatcctccacgacatcgacaggtacggttcttgatttgtatttcctctctttgcctgatttatttttgtcaccttcttagtttcaacttaaaatggtttcagtcttttgttttgtggatttgcagctactatgtgacggttgccggtctgatagagaggccagcgaagctttatctgaatgacatcaagtgagtcgtgtgtcagtcatcgtggctgtgctatgcatgccttctgtttgatgatatgcctgagaggtgatcgagttttttcgtgctttctttgtgtgcaggaagctgcccaagtacaatgtcactgccactctgcaggtggattttggtgtcctggtggactggtggtgtgtgtgtggattcttagggccgaattttgtgtgacatggtttcgattggttcagtgtgcagggaacaggaggaccgaaatgagcaagagcaggaaggtgagaggcgtcggatgggatgtctgcgctctcgggaatggttagtgtgcttcacttctcaatcttctttgtgtcttactattagcgtggtggaatacggcaaaaggaagaaagaaagaaaaaagatgcatggacattctccagttaagtgtgtataggaagttgtcatcactcaccaatgtaataaggaaacctgtcttatatgatcttagctgcaattttgaatagaagtgagttccatgagattgataaaggatgtgctgtaaatgtttaacttaattcttctgcacttttttactgtcttcgatgcataatcatcatattcactgtcactgaatttatgtgcttcattttagcgacatggggaggagctaagttatctgatgtccttcagctcattggtgtgccatatcatactgaaattactccatcaggaggaaagcatgttgagttcactagtgtagatcagtgccctgtgagtttcttgagacttcatttatgaaaaaaaaaaatatatatatgacagctttagttattttttctataacatctttttcaaaatattattaggaggaaaaaggtggcccttacaaagcatcgatttctttaggccatgcaacaaatcctgcagcagatgtactggttgcatatgaaatgaatggtgaggtaggaccataggagataataataggttatatcttatataccatccttacatccatctatcaggatatttggttatttcatatatctgtgcatttttctaatcatatccctattatgtgtttttgttacaaaggtgctcaagcgtgatcatggataccctctccgtgtcgtagttccaggtgtgattggtgctcgttcagtcaaatggttggacagaattgacataattgaggaagagtgtcaggtatgcattatctaacttcttgtcaatatgtaaatatattttcagtttgccaaaaagatttttgaaactcgttcattttcagggtttctttatgcaaaaggattacaaaatgttccctccatctgttgattgggacaatattgtgtggtcaaccaggaagccccaaatggactacccagttcaggtgttaattcttaaccgtcttgtttccacacagtaagagcaagagcaactatagcaaattgagcaattcagaaacaaaaaacatcatgttcctaaccatgaaaagtctgagtatacaaggaatttccagtatacatcatttcgatacaacagcatattggaatgaggatggcatccgtattttgtgctgcttatctaaatatcacacagtaaactacatgaagttctgtttccaatttacattgtcatatattctattttgccatgcaaaaccttactgtaacagtaatttcctctagtaatttactgtattgcataatattgaaaaattgtgtgcactaattaccttttggaccgactctgatatttcagtctgccatatgctctttggaagacacaaatgccatcattccaggagaagtgagttcagcttcttaactgggcttttttatttccattttgcttcatgacttacccctaacgctttgccttattgtgctcttcaggtgactgtcactggatatgcgttgtcaggaggcggccgaggtattgagagggtggatatatccactgacggtggcaagacttggttcggtgctgtccggtaccaaaaggaaggtgtaccatacgtcgcaggtgacataagtagtgacaagtgggcttgggttctcttcaagactgttatcgatgtgaaaggtgacacggaggttatcgtaaaagcggtatgctatcttgctagttcgtcctacttgcaattcaatgttgttttttctgttccattttacatattggctgcaggattgttcattctaatataaatgtactgaatcttgtggcacaaactatgcaggttgattccagtgcaaatgtgcaacctgagagcgtggagaccatatggaaccttagagggatcctgaacacctgctggcaccgtgttcgccttctgacaatacacaaccttagaagccttttgtgatgatcctacacatacacctaactagtattatctctttaaatttaccgctctatgttgcactgtcgttccgctttcggatctgcattggagaaaaagagtcaagagggaccaataatataatgctggctgacttgcttggatgctggaataaaatcccgtgccaccttgttatcctattctttttgagtaagaaatatgtgtgtatgaaataatgggcacaggctagatcaacctcatttaagagtgcaaaacagtttgcctctttgttttatttggatgcaacaattggtcaacatacatggaatggtttcagatttgtgtaaccatgtagagaaatagtgatctgaagatttttcatatgctcgtttggtactgaatcatcataatttcaatcttttagtattattactcctacattttagacaaaagctggctgaagccgtttaagttacttttcttctttttttttttgaagcggaaaggagttctgtcgttttatattggtagagggacagaaaaacagttatgttactcatacttagattaattaatctatctatttgggcttctgatccatgaaaatttgcattccgtctctgtttattcaatctgtaatctcaaacatttccaagaatgtgtgattgaattgcagaatgagcttggtatgcttactaagtacaccctccaactaaaaagaattaaacttctaactgtgaatatggacataaaaaaagatggagtgggtaaggatttgtaccaagataagagggcaaagtgtttatttatcctcttttctccttgtcagcatttatcaaaactgaatcaacattacaagcggtgacaggatcaaaagagcaatatttatgcaagtttggatgtattttttgattgcatgtaagatagaagcatatgaggtgatcatgtttaaaggcctagcttgtgatcgttgaattgtggtgggttgatggcccccccccccccccccccgaaaggccttgttgggtcaattccatgagggagggatttgaggggatttattccagatctattgtggtgtgaaattattcctcctcaatcccctccaaaccgaacaaagcctaagtgtttatgaaaataaattggtatagcccttatatatatgtttagatgtcctatacgttcagcacaaaataatattatcgttcaatatatatagactaaaagaaaataaaatttattaaacgcaacaatatgtagaagcaatcacaacaaacgggattttcataatccatggcaacgccattagcattcaaaagctcttttttttttactgacaaaatcagatggtctaaggcagtttaattatgactttttttttggcaccttctgtttctgaatttcagatgcccaattccactttcccaaacttttctgcatatattctggctgtattgctgataataaatattagaccaaagaatcaacaaccgtagagttatatagaattgaaggtacatggcactctccttgagcacatttgcagatatatatgggcattgaaaattttgctggactctaggagtgacgatttaggtatggaaggcaccaggacggatcagtgggcaagtgaggtggtttatgcaaccacaaggccaccagtgattttgatcagtgagctgtagtgtactaccgtttataatttttatcctaatttgcaatcaacacctaatagtacttctaatatgtttgaaaggtggctatatggatcaaattttggtttgggacaacagctatttcttgggctacatggctaagttgcaatgacatggtgttgataatgcaaaagcgtgttatcctatatgcaggtaatttcaggtccacacgctatgttcggcattagattttgttgcaaaaagaggagaaacgggattatgcaagaacatctaaaaacctacagctatgtaaatatgtaataagacatggctatgtgcatctgtcggtgtggaggctggggtatatttatattccattatctagaaaggatgtgcatgtgtaggccgcagttgataggaataacataaacaaacactatagttgttgatcatgtattagtcaatgttataaaaccagccccgaaatcacatcggaaaccaaacgcggaagaaaatgccatagaagatccaaacacaatgacgacaccgaggtacgatatttaataacggagttcagttgaggcctacatctccggggtactgattacgggcgctccttccctatccagcatatacagcgtatcagagttacaacgactcacggccggtcaccgccgccagctgctccctctcgctatgctaagtcgccatgcggtaacaacaggcacgcgccctctatttatgagagattctagaatagagtctgactcatactctggtcctaatacctattacaactttgagtcctaaactgtaaccgactacgtacacatattcgacacaaactctatcaaactccattttggcaaatatgccacagcaacctgaatttgttccttgctcgaacctccatgtaccaggacttgagttggttccttttcgctgctcacaccgagccgccccgataagccttcatcaggctcaccgtaaacaagagactccgctatccctgtaatttcttcttcttgactccacctgcaacagtgcttcaccctatctcatatcaccacagtcgtcttgccaagccaaattggatccttcctagctgtcacatcatacacttcccgaagactatgttcaactccatctaccgtcttaaatttgacttgatctaatccatggtcagataacccgcgttatcaccaaatagataaatcaaactcacctacaagtctaaacttgctttaaatctagtactctattaattgttgaaacttgtctgaaattgggctgaacttgttaactgtggtctggaatgaacatggtctgaatttgctgttgagattggtctgaacttggtgtcaaattggactgagcttatattgcatttgctgttgaaattggtctgcatttggtctcaatggtcagaaattggatctcgtacgtcaccattagtctgaactttaatttcttgaattgaaaaactcggaacatcatgtaaaatttatcactttttccacgattgcacaaaatcaaaattactgattgtaccataatgattgcacagattaaacaacactggataactggctaactgcagttcattgcatgcattacaggaaaacacattatgctgctagattactactagtacattatagttccctaagatattggcaaatgctataatattacaaacggagttgttccgttgttgacacaaaattaccctaaaatacagtgtagataggacgaaacaattggagtttcaaccggatccaatcgactgaaaccttaccattacatcccaatccaaattaagccagagttttcgcgggaggggactggggtctggtgtgtgtgccggggggtgggggtgagggggctcacctggagggcgtgcctgttctgcttgaacttgaggaacctgcggacgcagaagaggacctgctcctccgagagcgggcacctctcgcggagccatcggccgagctcctccaccattccacccgacggcagctgcgccgacagcctcgcgtagagcgcccacctcgcaccatccagcggtcgccgctccgggctcgcgtactggagaccgcgcgcctgactccccggggcctgtgagaggcgccactacatcagagacctgacaacatggtgttctgcttcttctcgtctcataattatgttggaattaatagatgggctaaggcctattcgaatattaattctttggaaaatcacaaaagcccacctcatgggatggcatacatgtggagtttagtaccactttgcttattctaggagaggggacctccttaaaagggaggatgccctcctagccacttgaagcatgtgtggtggagagaagagggggaacacgcgcttgcttgctcgccttgcctagcagggcagaattgactcctcacccttacacagatgcagccttcttttgcagttttgttttgctgcaggaaaattcggatttgttttgttgttggaaacattccggaaaatccggtgcatgaaaacggcgtggagtccggatcagttacgcacgacttatccggtttggttacgcggagtggagatcgtgcgggcgccctgatcaagcgacctatctctatataaaccgagccgctgccttcacgcaacacacgtgaaatcaatctagggtttgcctcctcctctgtgctgcgccgtcgctcgtagactactccagttttgttttgctgcaggaaaattcggatttgttttgttgttggaaacattccggaaaatccggtgcgtgaaaacggcatggagtccggattagttacgcacgacttatccggttcggttacgcggagcggagatcgtgcgggcgccttgatcaagcgacctatctctatgtaaaccgagccgctgccttcacgcaacacacgcgaaatcaatctagggtttgcctcctcctctatgctgcgcgtcgctcgtagactactccatcccgctggcagggcagaattgactcctcacccttacgcagatgcagccttcttttgcagttttgttttgctgcaggaaaatttggatttgtttcgttgttggaaacattccgaaaaatccggtgcgtgaaaacggcgtggagtccggatcagttacgcacgacttatccggttcggttacgcggagtggagattgtgcgggcgccctgatcaagcgacctatctctatataaaccgagccgctgccttcacgcaacacacgcgaaatcaatctagggtttgcctcctcctctgtgctgcgccgtcgctcataggctactccatcccgcttgcaggcgtgcacctgcgatcggaagagcaggtttccggaacctctgccttcgacgtcctgcaccgggagaagcggcagtaaggtttttgggaagcgcttcacgcgactgctccctgtttgtccgcgacggctcgccttcctcttcgttcgcgtgctgcgcgccttcgtcgacgctcgcaaccgcgagtagttcctgccgagcaaccggtctttccgccaccttggtacgtgttcgacatgttgcgcatatttgatctgtttatgttttactgcttagtttacatgtgtagatctaatgatgcgttaatgctagtatacatctgtaatgtcatgatttatttatggaatatattaaatcattatatgcctatattctcaacaatccaaaaaccttattataggcgctatgattttactatggctggttttgccgatgcactgaggccggataaatttaccggtgtgcactttaagagatggcagatcagggtcactctgtggctgacagctatgaaatgcttctgggtgagtactggcaagcctatgggcgttcttaatgctgaccaggagaaagaattcgatgaggccactactctctttgtgggatgcattcttagcgtgcttggcgatcgtctggtcgaggtgtatatgcatatgaccgacgctaaagagttgtgggatgcactgaatactaaattcggtgctactgatgctagcaatgtgtcacgtcctgataaattcatcccgaaattaaaaatcattttctaaaaggaataatagaattaattaaaattcgaaaagaaattggcaaacactaaaatacgtacaagaaaaattcaaatgtggcccggagaatttttgttaaattctccttggtctaaaaggagccctcaaattttacttgaattttcagagcacaaataataattaagaagatataaacaaagttaaaatggttttataaaaataaaagctctaaaaagtcccttttcccccctctcctcttgggccgcctcggcccatctccttccccctccctctcctctccccgctgcccattcggcctcctccccgcgcgcgcgccgctgacgggcgggcccgcccgcctccctcgctgacgggtggggcccacccgtcatccccttcatcccgccgctcccgccgcctcgcccgcgccctagcgccgccgccgccgtgaatcccgccgcccccgtccgccccgcgtgcaatcaataggggggaattattccccgggatcccctccccctttccccccatttttccctctctctctccctcggattggtttggaaactcctcccctaacctcgccggcgccattaatggcggccgggactcccgcgcccgtttccccctcctccggccacccctctcactcccaaccctatataaaccctccccgtgcctccctccaccgtttccgccactcgccgccctcattccctgtcggaatcgagctcgcgccgtcgctctctctccgccgtcgccgccgagctccggtccgccgccgtcgtcgccccggaccaccttccccctcggcgccgcctccttcggcttcgccgcatcctcgccgacctcgtccacccctccgtttcgctcgccgaccgccggagcaccgccgaccccgtccacccgagccgcgccgccgccttcctccgctccggtcgccgtttccgtcgtcgccatcgacccggggtgagccgtggaccgccgcttcttttccccccttcccttcccctccctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgccctcgggtgcagctgacgcgtgggacccacggcgccggccggtgtgagcccgggtgcgcccggtccaccgtggaccgtggggctgccgcgtgggccccacccccgtggacccggtccgcgcgcccctcccctcggctgacgcaataaatccattttaaattaaaaattaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacactgcagcttcggaggatccgctcttcgtggaagttgaagccggcgtttgggaaagcgagcaaggcaagtcacatcatccttgaacatattgaatcccagtttataaaattattttaatttaaattaatgcattatcgctttatttaaattcccgcgttaccactgttttatttagccatgcctatttacctttgttatgaccttattattgttgttattgttattattaccttgttcaccctagaataaacaaaaccccaactagtgggtactctattcatggttccactagtatgaatttaggtagatgcttcgctgattaataggacaacattaggtggttttataactttagacttggggaatattcatatctcttggacactatggaatggttggcttatggtggaattggacatacacctctcttcctctttcaaaacccctaaaacctgttttccggtggggtttgggtgcatgccagtcgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcggaggtcgatggacatctctaggacaaatgaaggctacacgagctgcggcccggtagtcgagatgtcatggcacagggccggtgtcctgctgctagggggctcaatcctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtaactctaggatcgtcttataaaatggctttgggcaactaagtgacttttaaatgctgttttctgcaaagcttaacccctatatttttaccccttgtacccccttgcattaatcatgcatctgccggtgtggcttgctgagtgctgtggttgtactcattcttgctcaatcttttccccccccttcagtaagagaagcttaggagaagaagtcttaggtggagtcctggcttataccccagttgagcgcctgtgaagatggagccgtaggcccgcaagtccgctgctgtttatgttgtttgtcaggcctaggtgcctttgtaataatgtaaatattatcgatataataaagatgtgtcttttatatcatgtttgtgtggtgtaccccggcttttcctgggacggggattaatacactagcgttcgggaaaaggcaattttctcggtcgtgacaagctggtatcagagccatctcgactgtaggataagccaagtggataaaacctaaggacatattttataaataaaactatttgcgaaagttccttttttctccttcccctaatgctatttgcaaaaggtttactcccttcttcctttttcggatttccactagtacttgatggttagttttgcaaagaagaagatgtcgtcaattgtctgccgaagctccagaaggctgcaggatccgctagtgaagtgagggaagcagtgaagccagcggtgaagcaggagtgaagatcttggagaacccgtcacagaacctaagccaccctctagggtagagtcgttagtcgtgtgtttccttgcttgtgtgtgtagcgcgtggtttgcatcagtgggttgtgatgtaaccatgctaggttgtttgcttaatcaacttgcagaataagtgaaacaaacaacacatcagcaagaagagttagttcctttaaggtcctgtccctagttctggtctattctttcctggcttgtttcctctctcacctcaatccctatcacagatgtttaacagagaaaaaggaaagaatgtcagcgggtatgcctctagtaacttaagtttccaactcaatccaccactggcctcaagagagttaacaagggcacacccttggtccattccaagcatgctgcttagttcacagctaccattggttggaagtcaagaccaaaatcggtatgtgtttgatcgagcatttgccacccaggtcaatgagcttccaatgccagaagagcatgtccccttttgtcatgattgtagagaacaaggacactatgccctgaattgtccatgggtatatgccaaagaagccccttcctttggtttagcagggcagacatcgctaaaccagcctcctcacaccaagtcaagcttgcagcctagtgtgcaaagtagagagcccaatggagagaatccattgaataccgggaaatgctttcctcctagcctttcgcaccacgtggggtcacgtactaagcaagccaaaggcaagaagagtaagaatcagaagagaaaagcaccgatgcgaactgaagaagaagtacgtaagatgactattaccaacaccgaatggcctccagcagggataactattcctagacgtcaaagaggaaataccttccgaggtgcacgacagttgacccagcacctcttaagccatggcggcagagtatctgatagtgaagggtcagatcaagtctccttggattatgaagatgagtctccccgacatgtcggcagggatgagatggaatcaaaagcatgcccccattgtggagaaattggacatgttgctagcatgtgtctcacactctgccctcattgtgaggaagaccatccaccaggtgaatgtcccacccgcaaggtgacatgttttctgtgcgaaggtacaaaccatgtgcccaaggattgccaactcagtgtgttgttgaccaagaccgcagaaatccaacgaacaaccctacgattgtctcatcagctagtcagctccaacaacaacatcgacgatatcatccacagcaccaatgctcctcctgctgcacctgactctgcaataaatcatagcaataataccttcagcaccaaccattctctgcaccgacggcctcagcaaagaattgtcgtcgatggaagaagttgtgtctctccccgacctactccaggccgagcaaagggcaatcaacctcaggagggcgataccaagcagaagaccgttatctgcttcgaatagcaatcagaaggaagcttctcctgtgaatgatagcaatatacagtcctatcacatcatcacagaaccaatcaaggatgcagtcactagaacaatgccagctatatctctccagaatcagaatgagtatccatgtttgtgatttttagttcgctacttatcacgtgttgtcgaaagtttgcagcaatcatgtaataaataaatatattcatgtctataaacagtgagcttgctatgtttatggatgattcctgttgaggatacaatgtaccgatgttaagcaccttccctttttgtttaaggcagggccttgtattcgtgtaataagggagaaatgtgtaatacagacaagttctaagaggattcttttggaagatgcagatatgtgatcatgtgtataattgtttactgacaaaggagacctagggtctcgtgtcagaggaactatattctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcggatatacctacaaacagttaagaagatccaggggacatcaatatttgagaacatagtagtcgatggttggtaattagtctatcaggtatcagaaaagggtcaaaggtgatatggcagaagaacaatttggatgctccccatctcgaggaagcactaaagaggatcatcggcaattaaaccctagtggcatagatacagatagcaagcaatgtatttccctgaaggtagtcagtgcagctttttgacgaaccacttcaaggtttctctgaaagacagcacgcccaaggacctcattgccccagaagcatcctcaacacccggagcgaagagtacctggttgagaaaggtcgaaaggtgattaatggaagagatcggaaaagatgtttggttactgggaaaagaagtagaacgaaaggtgattgataaaggataacgagaaccatgatttgtgtcactcgaggaagactcccgatagcgatcaaccctacaacagttgccctgtcattaaagtaggtgaattcacgagtaagagagatgaccacaggtagaagtacttctatggggacaaggatggaaacttttgtgacatgaccaagaagtcaagaagtaaaaccggaacagtggaatctaaagctcggttcaaccttgggctttgtatcagatgctactagaataaaagcacttgcactagtatcgttcaacgcactttcctagcaatcgatccatcgagaaagaacacatcaaggctgaaggtgtaaaggaatacgttgaatgctaaatgataacaacataaagagaatagtgggaagtaaactaaatgtaaggaaagtgaatccgagctgcttgttcgtgagagccattcccagttatggaacaagtgatatgtttgaagataatctatagaggtcagatcaaaatcacatctaacaacgaagcttcagatctggcaggatcacgatcagacaataacaagtccagcagcaaagtcattcgggaagacgtcaaagcatgtcaagtgggataaattggttctcttgggaagcataacttatagtaagagtggttgacccttgcatcgaatagcagaagtacctagcaccggagaccaggaaagctaatatgagacagttaatggcaagttgtcaatcatggtatccttagtaagcgggatatcatagtctaaagcatatggtggtaagctggaaggaaacgccaagcatggtattctcatgatgacaagcatggtatcctagtaatgacaagcaggttacgacacatgacatgaagttgataacttgtgtgaggttgacgccgaagatatgaatcgtgagaagttctggaacggaagcatcattaaactaccgcaacctagtctgcgtcagctaaaaggtgcaccctggttcgagtcaggtgaaaagaagattccacctgcaacaggagatcgagccaagcagtccagagtggagaagttttgttaggcaagtttgttatagaagacggagcggaagaagtcagacaagaagagaagaccgcccaacctatcttcttgctaacctcctcgaatctcggagacgagattcttgtaagcggggtggatttgtcacgtcctgataaattcatcccgaaattaaaaatcattttctaaaaggaataatagaattaattaaaattcgaaaagaaattggcaaacactaaaatacgtacaagaaaaattcaaatgtggcccggagaatttttgttaaattctccttagtctaaaaagagccctcaaattttagtggaattttcagagcacaaataataattattaagaaattaacaaagttaaaatgattttataaaaagaaaaatcctaaaaagtccttttttccccctccccctcttgggccggctcggcccatccctccccctctctctcctcttccccgtggcccattcggcctcctccccgcgagcgtgccgctgacgggcgggtccgcccgccaccctcgctgacgggtggggcccacccgtcatccccttcctcccgccgctcccgccgcctcgcccgtgccctagcgccgccgccgccgcaaatcccgccgctcccgtccgccccgcgtgcaatcaagaggggggaaatattccccgtgattcccttcctctttccccccatttttccctccctctctccctcggattcgttcggaatctttccccctaaacctcgccggcgcatcaatggcggccggatcttccgcgcccgtttccccctcatccggccgccctctctcactcccaaccctatataaaccctccccgtgcctccctccaccgtttccgccactcgccgctctctctccccgccggaatcgagctcgcaccgtcgccctctctctccgtcgtcgccgccgagctccggtccaccgccgttgtcgccccggaccacctctcccctcggcgccgcctccttcggcttcgccgcatccccggcgacctcgtccacccctccgtttcgctcgccgaccgccggagcaccgtcgaccccgtccacccgagccgcgccgccaccttcctccgctccggtcgccgtttccgtcgtcgccatcgacccggggtgagccgtggaccgccgcttcttttcccccttcccttcccctccctcggccgccgctccgccgtgcctatggccgccgccggcgaccataggggcgcgggcgcgccgcctcccgggctgcagga

SEQ ID NO: 81044 - DNA, 7027 bp, Oryza sativa
atgtgatcatgtgtataattgtttactgacaaaggagacctagggtctcgtgtcagaggaactatattctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccttgaaggtagtcagtgcagctttttgacgaaccacatcaaggtttcactgaaaggcagcaagccaaaggacctcatcgtccccagaagcgtccgcaatccacattaaagaataccacctgttagagataagctgaaagatgattgataaaagagattggcaaagatgttctctagcaggaaagaagtaggccgaaaggtgattgataaaggataaacagaaacatgctctgcatcgctcaaggaagacccctgatagtaattgccccgcaacagtcacctggtcattgaggcatcatgaagtaagcaagacgacctaggtaaaagtgtttctttgaaggcaaggaatgaaatctttaactcggtatcagatgctacacggagtgaaaagtgcaagcaccggttaccaggcaatgccatgtcttgggagatgatccaatgggaaagaacacatcaaggttaaaggtgtaaaggaatacgttgaatgctaactgaggacaacctgaagataatagtgggaaataaactgaatgtaaagaaagtgaatccgagctgcttgttcgtgggagctattcccagttatgaaccaagtgatatgttcgaagatagtctacagaggtcagacaacgaagcttcagatttggcaggataacgatcaaacaataagaagtccagcagtaaagccatttgggaagacgtcaaagcatgtcaagtgggagaagttggttcggttgagaaacataattcaaaggcaaagttatcgacccttgcatcgaatagcagaagtagctagcacccggagagcaggaaagttaatatgaggcagttggtggcaagttagaagtaaatgacaagcatggtattctcatgatgacaagcatggtatcctagtaatgacaagctgatatcgacgcataacgtgaagtgggtaacttgtatgaggttgacgccaaagatatgaattatgagaagttctggaaacggaagcatcattaaactaccgcaacctagtctgagtcagctaaaaggtgcaccctggttcaagtcaggtgaaaagaagattccatctgcaagaggagatcaagccaagcagttcagagtggggaagttttgctgggcaagcccgttcaagaagatgcaacggaagaagtcagacaagaagagaagaccacccaacctatcttcttgctagcctcctcgaatctcggggacgagattcctgtaggggggtggatttgtcacgtcctgataaattcatcccgaaataaaaatcattctctaaaaggaataatagaattaattaaaattcgaaaagaaattggcaaacactaaaatacgtgccagaagaattcgaatgtggtccggagaatttttgttaaattctccttggtctaaaaggagccctcaaattttacttgaattttcagagcacaaataataattaagaagatataaacaaagttaaaatggttttataaaaataaaagctctaaaaagtcccttttcccccctctccctcttgggccgcctcggcccatctccttccccctccctctcctctccccgctgcccattcggcctcctccccgcgcgcgcgccgctgacgggcgggcccgcccgcctccctcgctgacgggtggggcccacccgtcatccccttcatcccgccgctcccgccgcctcgcccgcgccctagcgccgccgccgccgtgaatcccgccgcccccgtccgccccgcgtgcaatcaataggggggaattattccccgggatcccctccccctttccccccatttttccctccctctctccctcggattcgttcggaatctttccccctaaacctcgccggcgcatcaatggcggccggatcttccgcgcccgtttccccctcatccggccgccctctctcactcccaaccctatataaaccctccccgtgcctccctccaccgtttccgccactcgccgctctctctccccgccggaatcgagctcgcaccgtcgccctctctctccgtcgtcgccgccgagctccggtccaccgccgttgtcgccccggaccacctctcccctcggcgccgcctccttcggcttcgccgcatccccggcgacctcgtccacccctccgtttcgctcgccgaccgccggagcaccgtcgaccccgtccacccgagccgcgccgccaccttcctccgctccggtcgccgtttccgtcgtcgccatcgacccggggtgagccgtggaccgccgcttcttttcccccttcccttcccctccctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgcccttaggtgcggctgacgcgtgggacccccggcgccggccggtgtgagcccgggtgcgcccggtccaccatggaccgtggggctgccgcgtgggccccacccccgtggacccggtccgcgcgcccctcccctcggctgaagcaataaatccattttttttaaattaaaatttaaatgaagaaattcgcaaatattcatttaaagagcatataaacttcaaatggccataacttggccatttgaacttggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttggaaaagcgagcaaggcaagtcacatcatccttcaacatattgaatcccagcttataaaattatgttgctttaaattattgcattatcgctttatttaaattcccgcgttatcactgttttatctagccatgcctatttacctttgttatgaccttattattattgttattgttattattaccttgttcaccctagattaaacaaaaccccaactagtggacactctactcatggtaccactagtatggctttaggtagatgcttcgctggttaataggacaacattaggtggttttataactttagactttgggaatattcatatctcttggatactatggaatggttggcttatggtggaattggacatacccctctcttcctctttcaaagcccctaaaacctgtttttcggtggggtttgggtgcatgccagttgtgggaagtagcaccccggccactataaggactaagctcgggcctctgttgcaaagcactaccgtactaccacatgtctagtgggtaaggcttagtttgtggctcagtctggttataaacaaaagtacacggatggagatggatgaagtcgggggtcgatggacatctctaggacaaatgaaggctacacgagctgcggcccggtagtcgagatgtcatggcacagggccggtgtcctgctgctgggggcttagtcctgcctacctgtcccgggggttccggccgtaggtggggttgggtcggtactcttgtttatggctaggatgggttgggaactatgacacgtcttccgtccgtataccgtggtggtatgtggcacatggttacatgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgctagttcggtctgaatcatcgtaggccttgggctaaggcaggctcgtgtgggttcacgaccttgattaataatactgtgtagctctaggatcgtctttataaaatggctttgggcaactaagtgacttttaaatgctattttctgcaaaacttaacccctatatcattaccccttgtacccccttgcattaatcatgcatccgccggtgtggcttgctgagtactgtggttgtactcactcttgctcaatcttttccccccttcagtaagagaagctttggagaagaagtcttaggtggagtcctggcttataccccagttgagcgcctgtgaagatggagccgtaggcccgctagtccgctgttgtttatttttgattgtcaggccttaagtgcctttgtaataatgtaaatattatcgatataataaagatgtgccttttgtatcatgtttgtgtggtgtaccctggcttttcctgggacggggattaatacactagcgttcgggaaaatgcaaaattttctcggtcgcgataggtattcaggtagcagatccaagcagctattgaaggaggcaaaatcaagtttgacgactctaagaggccgatgaatgttgatggcaatccttttcctgttaatatggtgcatacaactggccgaacagccgatgggggccgtgcaatgggttttcaggtcaattcgactaagattatcaattaatatcagaggaagtatgacaagcaacaggagaagcattacgaagaagatgacgatggctttgatcctcattggggttgtgagttctttagattctgttggaatgaaggtatgaggctgccatctattgaagactgtcctgggtgcagtgatattgccgagagttcaagccaatcatatataaggggcaatcggctaaggctgatgagagttcctgttcatcaaagattgggtccagtgagtcaagatcgtggccagaaggacagcgaaaatagaaaaaatcaatggtgtccatctggtatctctacgaagaatcaaaagagaagggttcaaagattgaggaacagggagcgctttcaggaggtcgagcaggaaattaaccatcggctaaagaaaacaaagccgacgcaggagtggcgtgttaagaatcaagttcctgtagccgatgaagccacggccgatgagccaaaaaggttggctaaaggaaaaatcgttgtagctgcttcggtcaacatggttttcacattgcctgccgagtttgggatcaagcaagccgatatcgatgaagttgaagaagaatcggctaaattaattttgtcgccagagcaggcagtttttgataagccagaggggacagagaatcggtatcttaagccattgtatataaatggttatgtcaatgggaagccgatgtccaagatgatggtcgatggtggggctgtggtaaacttgatgccttacgctacattaagaaagctgggcagaaacgatgaagatctcatcaagacaaacatggtgcttaaagactttggcggcatccatcagaaaccaaaggagttttgaatgtggagctgacagtcggcaacaaaaccatccctacaacattctttgtcatcgatgggaagggttcttacagcttgttgcttggaagggattggattcatgctaattgttgttttccttcaaccatgcatcaatgcttgattcagtggcaaggcgacaagattgaaattgtgccagccgacaggtcagtcaatgttgccagtgccgatttagctctttgggagatggatggtcttgattgtttatctggaaaagtttgggatggagattttctaaaagtgttcgattctaatatacgccaattgaagatggaaaacacaagctattattttgagggcatcgtggagggttcagatgtctacaacaaggacacagtagatgatctcaatgacagacaaggacagggttttatgttggccgatgatttagaagaaattgatataggtccaggtgatcgaccaaggccgacatttattagtaagaatttatctgcagagtttagaaccaagttgatagagctgttaaaagaattcagagattgcttcgtttgggagtattatgagatgcctggactcacccgatcaattgttgaacatcggctacctatcaaaccaggggttaggccacgtcaataatctctgaggagatgcaaagccgacatgcttgaacctatcaaggctgagattaaagggttatatgacgctggttttattcgtccttgccgatatgctgagtgggtttctagtatagttcatgttattaagaaaaatggcaaggtcagggtgtgcattgatttccaagacctgaataaagctaccccaaaggatgaatatccaatgccagtagccgatcagttggttgatgctgcgtcagggaacaagattttgagttttatggatggaaacgtgggatataatcaaatctttatggctgaagaagatatccataagatacttttagttgtcttggtgcaatcggcttatttgaatgggttgtgatgactttcggcctgaagagtgctggagctatatatcaaagtgccatgaattacatataccatgatctaatcggctggttggttcaggtttacattgatgatgtggttgttaagtctaaagaaata

SEQ ID NO: 81045 - DNA, 12081 bp, Oryza sativa
ttaattccgttttggtaccacgtaccgttctgtcactaaaaaatatacacaccaggtggcatactgttatgttttttatgatatcatagttattaagtccggattgatgaataaactaaacaagctctctgttagctggtcaagtggttagatagtcggtaataaaatatttgctaccaacagaagcgatgagacggtgggttagctagcgcgcatctctcagcccctgcgacctgacgatgaatcccaatggttaggcatatgcgccttgagaattgaattggggcctcgaccagccagaccaacaaagaggctccggttattgttgaccgttggtccagtccaatccccttcaggtcttgaagtgagtagcctagaacagagcgatgcttttctaacacatctttgaggttggaggtctcgtcagtagacagcttgtcgctgatggtgacgggcgactccgtatcaccatgcaagaaggtataaggaaagcctgaaagaagagatttgagctcatctggaggtcatgaatgtggatcagttttgggtaactcgatcatctctctatgatcgtcctagctcctcgacgaatgcattggcatcattttcgaggagggattcgggggcctcaaaaggagagatagccatcacttcctcaattggctcggaatcaggaatgggttccatcatagaatttttcaatcgcaagatcaaaatgaaaaacaccattttcccgagtttaatgtcaaggactccggtatgcggcacatcaaggagaagtttctctatgggatggccaacgaaaagatcgaaataagagactttcaaaacattgaagtcgaggatagcttcgacatcattgtgctggatcgacactctacgaagaatcccataaccttcgatgatgggactagaggggctccagaagtttttgtttgttggcgcaaatagttcgcccccgaagcaatttaatgcaaaggttgtagacataatgtttgcaccaacagtgggattatatagagtttgcaccatggcctctctcatcagatatggaatagttaaggactgggagctaatatgaattacttcagaagaaacctccatctccattaaccactcatcactcatgatggtagttaatttctgcaccgtctctttgaagagattctcatcgagtggtgcgggagaattacacgggaccggtggtctcttttggtaggaataatttgaggtgtttccataatgttcaaaaagatcatcatcaaactggaatgggaatttcaaaggttgaatttcttctaccttcagttctcgaggtttgggtgagaattcaacggtcgaatccaatatcggtcgtcgatggttcctcacgtgtattctttattttcaagacggtttcacaacgaacgaaggaggtgttctctaggatacaatccaagagctccctactttctaacgtcgttttgtgtgcgaacgaacctccggtggaagtattgagatacatggcagactccttatctaaacccgagtgaaagtgttataacaacgcatgatcgggtgcagacaaatctaggctgtcttgagttaacaagaacaaaagagcccatactgcaccattggatttttttctcattctgtcaaaagttgagaacctccttatgtatagagactacacgggttaacaggaagaaatcaaggtagaacctaccttttgattcctcccattcaccatgcagttttcttccggtatgggtgtaccattgctttaccccctctataagagagaagggaaacaatttccaatttaagcttgtttgtgtcatgcccgcgattgtcaagcatgagtacaattgctcaaactaacgcagatgatggtagggattttcgatttcacgtcctaagaaggattgttcccgaaccatggctataaaatcagtatggaatttatagctagatgaatggataggttttgaagaaaaaggtgactcacataacttggcccttggaatagaaagattttgaaaagaaaggtgctccatggtaggtaagaagagaaatgaaaagatacgaggatgaatcaggttcgaatatgatatagcaaccgttccttggcaacggtgctagaaatgtttgttggtatttgatacggcacaggtcaatccgcaagcatatggagaccgctgtagcacttgacctcagagtattttaagggtattgaatcacagggaacgtgtgtgtatatgtaagagtagaattctattcaaggacaacaactaatgatgggctaaggctaaagaggattcctatgggttaatttactagactggagttaaaggtaaaaccctatcgattgctttgggcactggctctcccctagtctgtcaatctgagttcggcctatgactctatgatgtaactgaacatggagggatgtaaaggacggacaaagctgtcaccacctagcacctacctcactttccgtggaccacacaacaaatgaatgtaaccgctaacctagacaccatgcctaagttattgattactactctagcctcgcataggaagttaggaacttccttctttatccagagtcctagtactagagcacttaataattcaactaagcgaggaacccataacgatgtgaatatgtctcactcaagcaaataaattagataccataaggagatctcgaatacttattttattaaaagaagcatccgtcgaggaacaagcttgacaagaaggccaacaacacatgcgcttctctagaattccagtggaacaatgtcaacgaacccggcactcctccggacttcccagagagaacgtcgatatttgggacactccttctagagcttccccttactatctacctaattccacatactaaagtgatgcctaaaatatgaaattgagttgtacttcacttgagttgtgtgttttggatgtgagttgagcctctccttttatagcctccatataacggttggaatgacagttgtggaggttggtgcacccacaaccaccatcaacaaccaatagtgggtcgccaagtgcaaggaggtggcggggagaggggaggagggtggtgccaaccttggtttggtcgaacccctcgttcgatcgaaccaggcacaccgcatctagccacccacattctctagtgtatgccaggtgagtgattatggcggttggcaatggattagctcaaatttagtcgattttgactgacatgtgggctctccgatccttgtgcttacgtatgattggtcagaggtacatttaatcgcatgacgagtgtgttttccttcagaaatcaactacataccactatttaccaagactagaggaaatagttagtaataaacccctaccaataagtttgatattatatttggtattcttttatgtaggagttgatagtgaaagttcgcacttaatgaccatcaacaataatcacagatatccaattaaacaacccaaaaccgattccagtcagaaaccagccagttagatcgtcaggctggtcggtttgaccgcacaacacacgccggtctgaccggcctagtctatccggcctgaccagagcacataattagcaccaaaccacttcgccaataatctccaaatatcaaaaccaataacctaccatgccaattgttcatcatcaaaatataatcaaaacacacattgattttacaatagaatcatgtcagatgatacaaattgatcgatatagtgagatgatagtgtgcacatgtaggtaaaaattaactatactacgcaattaggttaagaaaccacaataataaaaatcataaacttgttgtgaaaagatactaatgaagctaagatcataggggttcactaatatgatcctcattcaggcagtgtgctgaacatatgacatgcacatctgaaaatatttccatggaacaaatgtaacagaaaattgaatcatccgacaacatatggttggatctacaaagcaaagaagaaacaactaactttaaacaatcaaatggtcaaatcgaacagtgtaaacaaaagaagcacacatgagcactgcaaattaaggaggaaaaggtcattggaggtggtggtatccgaagcttagcgtcaacatatatggctactgtctgttagcaataaggtaatgcatgttgttttttcatcaggccagtgccacaccacgtgcgaggcacgccagggcaccacttgccatcaatggagaaaaccagctgcctctagcaccacaactccacaaggagaccctactaatcaaagaagaaaccctaagtacttcacgtggtacatgggcctcatgtggtggctattgcgttttgttcatccaacgcctaaaatgtaatctaatctagtgatccaacggctgagaattgatgatgacgtggaacattgaggtttgagatttagggtcttaattgcatttagtgtgtcataactttataaagaagggatttagtcattggaatattatatgcacacaattgaatgtaataatgataaatgtctgttattttattaaactctgaaatggcacatcgatatcggtttgtctcagaaagttccatccctagaaataaatcagaatagcctccgaaatgggaatgataaatgttgacagtcaaaaaatggaagttcttgctagaacctttggctgcacaagtggggagatgcccttcacttatctaggtttactaatggggaccacaaaaccaaagattattgactttgcccctctggttgacagagtggagagatggctcccatctatagctgcttttctcaatcatggtcagagactaacaatggtaaattttgttctatatgctccccctaatttctacatgtgcactcttaagcttcaaaaaaagtgattcaacacatagacagagcaagaagacactgtctttggaggaagtcaaatgatccaaacactaagatccactccttggctacatgggacctagtatgccagccaaagaagaaaggtggtttgggcattataaacctggaactgtaaaacattgcccttctgaccaaacatctggacaagttcttcaacaaaaaagacctgccctaggtaaaactaatatggaacaagtaatactctttgtctgactctcctcatgctcacacataaaaaggatccttttggtgtaaggacatttttagattgattcccatcttcagagcagtctcaaagatcactattggcaatggggacacggcccttttctggaaagataactggtctggcaagtttttacaagatgaaatgaactccctattctcttttgctaagaataaggacatctcctgtcaaagctttttagagctcgagagtttagaacaggcttttcacattcctctctctgttcaagctttacagcaatggcatctcttgtccaacctcattcaggaattgcgcaacacacaatgtttggatcaatggtcatatcagtggaattcgcagcatttcctctccaggaaattctataatttgttctttgctcaaatccagcatgctgcacccatctcttggatatggaaaacaaatgcaccctaaagctgaaagtattcctctggttacttttgatggatagattaaacagcaaggacctcctacaaagaaaacatttcaatacccaaggaaatgatagatgtgtaacttgcaactccttgaccacagaagactcattccatctgtttttcacctgcagctttgctcagcaatgctggcacaacattggcattaatgggaattttcacacaaccttcatggacatgataatagaagcaaaagagaattttcaatttcctttcttcatggagacttttgcaatctgctgttggaacatttgaagcagaagaaatgattttatttttaataatgttccagtcaattttcaaaggtggagatctgatttcaaggaagagtttactctacatatgcatagagtaaagaaatctgaacaaaccctctggcaatcatggattcagccttttgattaattatttcccttccctctgtaattctcttctgtttttttctccttttgtaaattgttcccttggtttcttaacaaagcacagtaagagcctctcctgttgttttacccgtaaaaaatgggagtgataagtttgatcactcgacaagtgctatatgctcaacggctcttaattacagttttacttctgtttaaaacaaaatttagatccataaaaactcatgcaatttctagatataacagtattttaaacagtcatttttagacaagaaaaaaaattgaactttctttaatgtgcatgcttggatgggggaggagtggcagcgggggagaaggagggaggacggtcgagggggtggaaaagcggtggcggagtggatgttgtgcgctcggtcaaaaagataaagaggaggaggggcaagatgcctaccggtttttttaaaaaaccgacacctatgcatactttataggtgtcgattctattaaaaaacaataactatagtattggtatcagttttttctctataactgacacctataatataagtataagcgacgattcttttaaaaaaccaacacctataatattgttattaattttttctgtagaaccgatacttatagtatttaaaggtgtcagttctatatttttttcaacatgtgaaagtggaaataggttcataggtgtcagctttaaactgacacctacgaaggattagtagtgattggctggtgtggctgatgcgttatacatcaaaagatgtatacgcgcgattaatttaactggtcaagcccatgacagctaaaaacaaaacctttcttggacaatagaaaacgaaaacatccgcctctgccatataaaaacttgaccaaagtcaggcatgattatgaagcactaattagtgcacatgatctaggtgtttggtctccctaatctcacaaaacaaagacatccacgaccatgaacacgcaaaacagctcatgcgacattctgtccaaacaacattatacacgcagacagcctatgtaccacatacacacatacaggaaagcaaatcatattaattagtcacggatgaacaatcacaacatcgacccctgctgatggtgatattttacatgatggccatctttcagtaacttcatctacaggaaattattatttttatataatttcatgaatggaatatatgcccccagtccccagatatatatatatatatatacacacacacacacaatgaaaattgttttttataagattgacaaacatggtacaatattaatttgacatccctataaaattttcaagtctaatataaacacacttctactcacaactgaattagtcttgtttgtgtggtgatagattccccacatagatcagaatccattttccatgaagcacaggtgctgattcacatgattttccatataggatcgagcatatttctgagcaatcaaagatataaagatcaaaaaaataccctgttccccaaacccaacaactacgtaaatgcatgtccctctcaaaacctcaaattaaaattgactcacccctaaaagttttccagccccctcagtgggccccactacacacgatcagcatgaagtgaacacatgctttcacacaccatagtctctctatatacatctctctctatatatatacgcactaacaccaatagctaatgatgcatgtaaaatacataaccctcacttgatcatcatcaccaataattccccatttgcaacacacaccatggatttggagagctgcagctacgtgctgccattgctgacgtgctgcctcttcttgctctactccataacctgctatgccttggcggcggcggccggcggcggcggttcttgcggcggctccgacgatcacgccgctccccggagctacccgctggtcggctgcctgctcgacttctaccgcaaccgccggcggcttctggcgtggtacacgggcctcctcgcggcgtcgccgtcgcagaccatcgtcgtcgaccgcctcggcgcgcgccgcaccgtggtcacggcgaacccggtgaacgtcgagcacgtcctcagggcgaacttcgggaactaccccaaggggaaggcgttcacggacgtgctcggcgatctgctcggcggcggcatcttcaacgccgacggcgagcggtggttcgcgcagcggaagctggtgagccacgagttcagcgcccgcgtgatgagggaggcggtgggcgtcgcgctggagcgggaggcgcgcgcgaggctcctgccggcgctcgacgcggcggcggagggtggcggcggcgtggtcgtcgtcgacgtgcaggagctgctcaggcagttcgcgttcaacgtgatctgcagggtggcgctcggcggcggcggcggcgaggtggcattggcattgccgctgtcgaggctggccgcggcgttcgacgccgccgcggcgatcagcgccaggcgtggcgcggcgccggtggccgccgcgtggaaggtgaagcgcgcgctgggcgtcggctcggagcggcggctcagggaggaggtgaaggtgatacgcgacgcgatcatggagttcgtccgtgacagcagcagccgccggcggcgggagcagctgctggcggcggcgcgcggccgcgacgacctggtgtcgcggatggccgcggcggggtaccccgacgaggcgatctgcgacatggtggtgagcttcatcatggccggccgcgacacgacgtcgtcggcgctgacgtggttcttctggctcatgacgcgccaccgcgacgtggagcgggaggtcctggacgaggtcgacgcgtgcatgggcgacggcggcgatggcggtggcctcgccggcgtggacctcgagggctcgcgcagggcgcgggtgctccacgccgcgctctgcgagacgatgcggctgtacccgccggtggcgtgggactcgaagcacgcggcggaggacgacgtgctcccggacggcacgcgcgtggggcgcggcgaccgcgtcacctacttcccctacgggatgggcaggatggaggccatctggggcgccgacgccggcgagttcaggccggggaggtggcttgcggcggcggcggcgggcggcggcgtgtcgccgttcaagtacccggtgttccagggcgggccgcggacgtgcctcggcaaggacatggcgttcgtgcagatgaagttcgtggccagcgccgtgctccggcggttcgagctccgccccgtggcgccggagggctcgccggagttcgtgccgctgctcaccgcgcacatggccggcggcctcaaggtgacggtgaggaggaggcagcggcaaaatggcacgtgcgagacatgaagccaattttagtatttttcttaataggttcttaatagatgacgctgttaacattcgaatatacgtttgactaattatctttttaaaaattttttaatgtaagtgtataagatatgaatcatgcttaaagtatttgtgaaatatattgtatatggtagttagatattaatatttgagtcataatatcttatactgcgaatatttgactcattgtggattccttcagttcttccatatctgtaatttttctttatcttcttcccatgtactcctatatgtacctgcctccgcaggcttaatacaataagtcaaatattcacagtattcctttcttcctataatattcaatatggtatcagagtgggcgatctagcgccgctcgaacgcttccgccactgctgcccctcctccccggcgaggagtagcgatctccaagggcggccatcatttttcctttattttttccatcgtctgcaccgttgcctggaggaattgattagagtcataatagaatatgattgatttgtgtgtggactccttcatatatgtaatcttttcttatcttctcccaacatacttctatatataccggccctataaaggcttaataaaatgggtcaaatattcgtggtatttctctcttcctatactattcaacaggataaaataactcacaataaaatagataataattaagtaactttttaataagatgaatgatcaaaagtgtgttaaaaaatcaacagtgccatctatatttaaaaattgagggagtacttattgtatatctatacaaatattctccattgttttgatttgaatagatatatgtacctatggtgactttaagttgaatagatatatgcattattttgattaaatttaacgaaatttctactttttattttctgaagtgccgagtatttctagtaaaatcattgggttaagtattacgatctttttaaaatagagtaaattacacctatggtacaataagtagacaggtgggtgcgatttagtacaagaatttgagaatgggacgtttaagtgcaataacttggcaagggtgcgctttaataaaagaatttggtactttagtattttagtacaataacttggctagatatatgctattttggttaattggtgctatgtatgttttttcacgatgttaatttgtcatcacgtagcaatcccgaagtattatcttataatgtttgatgtaatctataagaatatattgctcaactaatttgcaccatcgatttagattattttttttcaccgtctcaaataccaaatagaaaatttctacgcagtatgacaaaaaaaaaagtatgcctatacaaatctacataagtatgtcaataactgaataactgtgtgtacgtaaaaactgagttcatatagttaaaaattctcaaaataattaaatttttacaccacttctcaagtagttgtacccatacgctcatttattaaattcttatactatgttgcacccacttatcaagttgttgtactaccatactcatttatcaagttcctacactaaattgtatttacttgtcaacttgatgtaccatgaatatatataactaaactattcttttaagtatgtgtattatttcactaaggagaaaacgatggggagtggcttaaatgacgccaaagaaaaacaacagacagaaagtagaagataatgttggatagtataggagaggagataacaccatagctaagcattattaacacttacgttatgacaccaatatctcaattttgtagattttccattgacaagatcgtcatgcaaaagccagtggcggactgatggatgttattgtgtaattttcgctatgttttgccctagtacatatgttaaatgcttttgtgtacattttttttctaagtttgaaaatctttatctttatttgtaaatattcctcaaatcaaaatttattcatttctcgtccattttctaggaaaagagagttaagtttggtctataatgtaggatatataagaggagcgtgatgaggttaaatcatcactggaagggtgagaaaagcgatcgaccaacgtaacctttttttcaagtaccggaataattagacatacgtagttcaaacagtattttcaaagctttaaaaattaaaactctatatgtttaaaaacgtggtatccactttatgacccatattcacttcaatgtccttcccacgtactccctccatactcgtaaaggaaatcgtttaggacagcgacacggtctctaaaacataactttgacttcttattgctataaaaatatttattgaaaagtgatatatgtatacttttatgaaagtatttttcaagacaaatctatacatataatttttacattttcaaactcaacaacttgagagttattcatgatttatattcgtaaggtttgacttaaacattgtcctaaacgacttcctttataagtatggagtagtatggcggtagctccacatggccaacatttgccctctccattatgaaaatactccccctggtttgtatgtcaacttaaacacagttaaccacagtgacggttcgctaggatgtacataaagaaagggcttaagagtcgagtcttgggggagcctaatacactattacttagtttaactatttaattagttacataattatatgtgttat

SEQ ID NO: 81046 - DNA, 855 bp, Oryza sativa
ttgcctaaccccgactccgaacagttgaacacttgacctcacatatgtcccctgattaacgatttcattcattttcactacccaagcccccgtctcacctcattagcaatgctacacagtgccagataccgctcctaaacctagaggcttaacctcaccgggacactaagattgccctcgaagtctcgaactgctagggtaaatcgttcatcaatcatcttgtctgtgtatccataatatccataaaagggccaattcaacaagagaagaaccgatgaaattataagcacaaatggataaggcactggttactaacccatatgttgcagttgcacagactactgttattgattttataaatattgaaattttccagtaaactaattttctagtaaattatagcgcataaattaaaataagaatatactttacttcaattacagctttctagtaaactaatttcgaatttggaatacactaataaaatgctaaattccaagtccaacccggtataattaattttaaaattgttatgttttggaaaagactaatctaaacggtccatgctatcttggcgagaatacacttcctccatcccaaaatataagcaatattagcatagtgtcaagtgatacttttttactttaactatttatagaaaaaaaagatcaatcatataaaattgatgttattagatttatcttaaacaaactattataatatgaaaactctttttatttaaaatatcttatttttatatatattattgatcaaaatagcatatcgaagactgtatcgaagttaaaaatacttatattttaagacggagagagtagagcagacgtcctcatcata

SEQ ID NO: 81047 - DNA, 32971 bp, Oryza sativa
  unsure (1)..(32971): unsure at all n locations
aatcaatgcacacagcaataaaattgaacagatatcacctaacttatcgagttgcctgcgttgcttttgctaaatgaaaacacatgtcaataattgagaaaaaccattttggagtcatatcacctaacagaaagcacttgtctctatcacatgattcacgccttgtgcatatttttatgttgtgtctatgcaagcgtgtgaattactgttgggtaggccatgggagtatgatagagatgctttacattgtggtaaaactaattcatgcactttcacatataatggtaacgagttagagttgctaccaatgagccctgctgatattttgaaagatgattatgagagagtaaagattaaaaacaatgagccctaccacctgcaagtctaaaattatatgtataaaacctatgctggaaaacatctcattgcaagtattctctgatttagcaaaagcattggtttcccctcatccctcacttccaattggacctcacaggccccatggctcatttggcatccacccagcaccccctagacccatatggcagtcacaccaccgccctcgacacgtgctggcgttagaacgcgctagcacaccctgggcttggccacctccaccttgacccgatgacttcgagaacatcctcagaccatcactccacaccgtgtctccatcatccctggttgcgttctagccattcccgctgggagataaagctcttagcaatcatttccacctcgagatcttcttcgggcataaaaaagatgacgtcctcccttacaaatgagtcaagattttccctatctctttgttccctcttctcctcaccacacctaacaacttttgtttttgccttagttacttttgacttgtgggtcaatggcaacgcaacatgcgttccagcacacatgaagagtgtggccgtgggcgtcaaccctccgctgtgatcacatcgggcctcccctggacaagccacaagtcctcagagaatatccctcggttatgctgagtgaggagaacgccctttgtattccttggctcggccatccagattagccttccgtttctccgcaattgttgagcaatagatcgatttgttgcatgtgtaacttcctagtattcctgctaacactatgcatgcaccttcttgctagcctgatggccctaacttgccaacgctgtccgtgcaaacccatcgccgcggccaagccctgcccggtatgtagacatcgttgtccaagtttcaccaagccccgtgtaaccctaggtgagtctactagtacaacccagtcaccaatgcatgcactggtttgactcgatttgagccagagcatgaaatgcataagcatgccgaaacaaccaccgccacctcattgcacaaaaccacaaccccacagttttgtacattttaccttttggtcttgaccctatctaaggtatcgttcaccaccggtgagggctacaaatattggacatttgtattgagccttggaggtcagtatacaaggaaggtgctagagataaggaaagactctaatcaaatcaatcatatcctgaataatggtgcagaacaaaattattagtggttggatctatttcttgcatggggacgattgtgtcggtctaaccggcagtcagaggtgcggtcggaccggccagatggccggtcagattggtagtctatgtggtcagaccggtctgatggttggtcggaccattggtctgtgcggtcagaccggcatgatgaccagccatatcgacgataggagagccggtctgaccagtaaaaggcacggtcggaccgcccgcagaactatggttatcttcgctcccggcatattgtgttgccgctccatcagttgtgctatagatgtgattaacatagacttggctagtacctgcaaccgaattaggttacaaattgcctgtgagagccgaattcggaactcataaattattcaattcttttataaaaataataactcatagcatactcaggtttattataaaagtagcggtaaaggattcatctacggaacttgctacaagcttttgagcaggacgagcaatgtcatcaacttttacctcattgacggtgacttggggtgtaaggccggtgttggcggctattaaatgccaattttatgccgcccatacctacataaaacataagttctaacacatccaacatagtggtagggtttaattttgacagattccacgagtgttggtgtatatttggatgcgggtaataaactgctagagtggggagcacatctagacttaaatagagaagaactacatcaatataagaattgggctcacaacttcatcgaaacattagaaattgagcccaactaatatagaaatggaccgagggagcagatatggaggtccaggaaaaaagcccacaggctgaggagctagccagggttcagccgaaccctaggttcggccgaacccaaatcttggctattggcctcctcctttcacatggatgctctagatgactccaaaatgacagttgcgtggcaattcagacatttccaactgtagagccatcattggaagcctataaaagggcctcactcccttactttacacacatactccgagcttgagctgaattataagaggctctattgtactttattctatactagattagggagagaataaggtagaagaaatcggagaaattccggtgttgtcggtaatcttttcttactttttataccttgttaattactctgatttaataaaaatattcttctgagtaattaagattttgctttgtgagaattatctcttgtttagttcctattagcattcgggatcattgttcgctacattgaatatatagtgtttactttagtgaattataaacacgagagtagtaactaattgcttaaacgtggtgtttaggtagttaattttcagtgattgctgcgtatcccacatatcgttagaggttggtgtagaggtagtgacaacccttaagagcaccgtagtcctccctatctgggtacggagtaaagcgtgttctggtagcagcgagcaagccagtgcctgatattttcttataggattaaaccaagctttctatagacacagtttctcgctaggaaatcctctctaccattttcctatctttgcttcgtgtccttggttgaacctagagaagagttgaacacacatgttccttgtggaaatcgataccttggaatactcccgggtgaagcgctacatcggtatatccgtgcgcttgcggattttatatgtgaccttaagaaataccaatagtcgagcttaccaataactcgttgacgagtcttgacaaagcatcccgccaaaagggcctcttgcgtcgcgatgtctgttggtatttcttaacgacattactagaaatataaatcccagcaaaggcgcataaaaattcgtggtatattatggttatagagttcatccgcaagtgcacggatataccattgtagcatttcaccccagagtattcaaagggtatcgtatttatttaatcctgtgagaagatcatagtagagagaacctgactaataatttatatgttacttgtaataatcatagactaataaaagcaggggttaagataatctaagggtagagtgacacacaaataggggactactcattctcatactaaaatatctaagctaagtggaaataaaatagaaagagaatctattcctatacttctagtatacatagtatacatacattctagttatctgacatactagctaataccctctatccgatgcactcctggtacttcgagaagccactcctgactatcgagttccttacgatagcctgtcataactatacaaccggggctaaatacagaggagtaccctccacaggaaattaacttaagactatatacacgcacggaggaatacccatactaagctgtcaccatcagcggcccacctctcatccacagcatataaccccaaataatgatatcccgtaatctagacaccacacctaaactaccagatactactctaatatcatcgtcatgatataaagtaattgcataagcaaacactatacccgtaccaatgcatctcccaaataagctagcagtacaatcagtataacatgaacataatgtaaagttggcattcataaactcggtaagtatttcaataccataaatgtataaggaagagtattctaataaaagtacaaagcttacaaaagagaagagaagagctactagggccatacccgaactcttccgaaggcttccggactccaatttctactctattcctatttcactagcttgagaacactaaactaactcgagagaatataagagacctcttgcttaaggtgtgtgactgaagtgagaatgacaactccttttatagccttccaatgatggctgtgacagttggaatggtcggaaataccctccaaccgtcttgggggctaatccacaccatccaggcgaagccctggatcggatggcgctgaggagcctggttcggccgaacctggggctggcccaactagcccatgttttggctggcggcctcctctgttgcttctcttcgcagacctgtgtcaattctgagttcttggtccattcatacataagtctgattctcaacatcgtccgattgatttttcgtttgatttgatgtcgattctccgccactttatggttattctctacaaaatgttagtgatcctactagtggaatattattattctaacatggatatgcattgcaagcataactagttctcctctattttggtaatattgacgggcgaaacttatcgcaaacgaccgtcaataacgtcatttgatctcttgacattattcctcatccaaatcctccaaagtgatggggaggaagttgcttggattcacttcatgcttggccatgatgttgatgaaggcattccccaacggagtcgccaaaaatcgtgttggcaacttttatggcaagaagaaaatcacgatcgggacacttaaatgccttgtggtgatatcgagccaccaatcacttcaatctagtaaaagctagatcaagttaggggttttgatagattaaacaggctagcggagccaatttggagaaacaagcaataaacacccgtcttgtgtacgaacggaaggtttacgggatgtacaagggatttcgcactcccttagaaaaggtggacgatttacagtgcaaatcgacaaagatagatgaactaggctagacctagacaaaagtagatgcaatattgaaaaagtgattcaattggctaaatcgtattgggagtagattctttttccaattgaaccagccttgtcccatttaaagggttggtcttgcctcatacaggtcctcctccacgttcaacttaggatagaaaccactacaaacccgaaacatgcctccccgagcaagaaatccagagacccgacgaaaacagactcggaatcggacactatcgatctgatcgaccaaacaacgccggtcagaccgacccacaagtagcgatctgaccggttcacagttgacggtcactccagctccgtgaaggaaaccgatgctcttcaaattttggcaatattttcctaattcgactatagctaccaacaaatcgaagcttctattgctacataaagcagacactcggatgtgaattttttcttcttcttttttaacagattttcatataaataaaaaaaagccagtttattgtgtagtaagttatcaacgataagtatcgtccactttttgtgtgcgctatggatgactaaggtcatgaatacggttactcaagatatcaataaattggtaaataatgggtcaaaggtgattactagcagctattgactaatattttgattcaaaattttgattgaaaaatcctgtttttattatactacctccgtttttttcatatatgacaccacagacttttcatataacgtttggtcattcgtcttattcaaattcttggggtaaatatgtataaatatatgttaaggttagagttgctttgatgataaaataagtcaaaaaaaaacaagcagagagtgtttggtggctattgatttgaacgtgtggcaaagtacaagcctgatgatgaagacgacctcacctgccgacttgctgagctcaaggcccgtggctgagggatttcagtttagctgataccgaattggaaaagaagccagctgtaacgctccgcttttcgtgagtcgttaaaaactaattcggcaaaatcctaattgcgaaaatttccgttctttgtgtgcgagtctaagttgtatcgtggatctcaattcaatcccgttgttccctctcatcgaaatcaaatcctcctcctcgaaatccctattccgattcaagtattcgaaattcaaatcctctcttgaaaaccttgcgaaatatccgcccgactccaaaaatatccaaattcccattttgaattcaaattcaaactccatatcaaatttctatccaaatcagatctcccagtaaaattctattttgcctccttctaattttggatgggtcggatccccctctcctcggcccatctcctctctcagccgtccctcccctcccctctctccacacgtgcgttgcgcgtgcgccgcgctcgagagagagagcgctcgttctcttctcatccttgctccctctctctctctccgtttctctctctcccgtcgaagcttccccaccggcaccgattcccgccgccgccctttcaaatttctgccacgccctcgcatccgcgcgcgcgctcgcgcgtggccgaccacccggtcgccgcccgtgcccgcgctgccgcctgcgtcgcgtgctgcaacccgcccccactccctgtgcgcgtgcttccaaaacacggagctagagctcgcccccccccctctctccctccccaaaacggcatggtcaagcttccgttttccccattctttttctctctttcccaacctcaaccaccgcacctccaatgccgccgcttggccgctagctccgagcacgaccgctagccgagctcccatgaccacctaagtcggtttcctcccccaaaaccgctcgcgcccataaaacccgagccgagctcctccccctctatatccctctcgtttttgcctgccgcaccattgttgccgcccctgccctgcagtcgccctcgccgtccggcaccgaagcaccagggaaaccggtgcgtgcggggacgcgagacgaggactccgggcacctcttcttccccttccccggcccaaggccggagagctcgccccgcgccgtcgaccgtccatcactgcccgcccggctcggtagtgccttccttctgttccttttttctcgctcgctctcgcccctccttggctcgcgttgtagctcggctagcctcttgaacacgcgtagacgctgccgctagccccgccgccgcccggcatggcctcgccgccgttgccgcccgctcccggaggccgccgttcatcgccggccctcctcggtgctcttccaccccatccgacgccggaaatggactccttgaaccccggagatgctcccacctccttgaattgaatcctcgtcgcccctccgccgtttcccccttttctcgccgccggcgtgcgccgccgcgattcgtcgtcgccggcccctcttcgaaggatccaagccgttggctcatcccctcccgtggccccccttgtaccggtgaactccctctcgattgaatcgccgcgttgtgcttccggtgaagtcggccgccgcccgccgtccattttccggctggcctcgtcttcctcctctcgccggcccgcgtggcagccacgaaggcggcacgttggcgccacctcagcatggaccgggtcgggctaaccccggtcagccgcctccctccgctcccgctcgcacgcgcgcagtccaccgcgagccatgaggctgcgcgtgggcccgccgcacccgcgtccaccgcgcgccgcgcccctcccccaaaccctagcgccacccctcccgtgagcccttccttcggtgaacccggtcactgacaagcgggtcccactcgggaccacgcgaagtggacctagcccaccggctccccctccctctctcccttccgcgcgcctcctgggcggcctcttctcgggccggccagcccatttggctcggccgagccgcacctttctctcgggccacgcccatgccgcccgagggaagtctatttcgtatccctccttcctttgtcccataaatcagtgccttattccaaaattccatagaccatttcctttggtcccgcacgttggtgactgtcaataatattcttgagaatattatttctataaattccagaaaccattcctcttatatatatatatatatatagttcctcggccctgaagttgaagatgaagtgaagcgaagattagggtttcgtcctggttcccagccgtcgcctgtggtgttgggtgttagttcgttggttccgctgctgctgttgttgttggtgtttcctcgtccgcgtcatcgattgcattctcgggctattctgagctgcaatctaagttaaggtaaataagtcctctatatattttaaggattgcaatgaatcatatttgtcaccgtgggtaccagcactatgtcctgggactggtaccgtgatcgcggtttcgtaggaagcggttcgcgccgtttttcctacgacacgctcctgtcaggtgctgttgtacggcggtgccagattggggtgtgacaccagccagctagcctggcagccagcccaaacccaccagcctagcattgctgaaaccctaactctcgaacccccatccccagccgcacttgcccgtccgccgcttctcctgacgcgccaagccgacgcccgcctcctgccctcaccatgccaccttcgcaccaacagcctcctcctccgtcctcctgtcacgcatctgttgccgccgatagtccttgtgccgagctgtcgactgccgcctctactttttttcccccattgccccgctgtgccggtcaaagcctcgcggtgcgtgatgactggtgtgtgtgtgtggacgaggtgagggcatggactatgagcagtaccacctcagtaatgtttaccatactgtttttttttttggatttatgtgattatttttgggattattggtttgttgacgtttgatgtcacggttctggtatttgcatagtatggggatcgtcggtgctaggatatacgcgagactgaggtaaaagagacagagaagaggatttttatacaggttcgggcccctgagttgtcaggtaataaccctacatcctgttggccgaagccggtcgttgatcttattcaccataatcacaccagtacaatatttggggtagcctatctaattgttgtcgacatggcagtctgacaatctgactcgtagtcaacaactgggtagccttcctcctcgaatccgtgcccggcgagatcagagagagcgctttcgtctctcctgacagtatccggagacaccgtaggggactagccgtgcttatccctgaagtcgatatccggcggcgtgtcttggcttatgttcgcttctatgttgtggcttctatgtcgattgtgttctatggtgggtgtgtcccctctcctcctagggggtattgtatttatacacataggtgtccccttgtccaagtagaactagggaaaccaatatggatacaatccgagtagtccttgtcgttttcatgtagaactctggttatttttctttattcggaactccctcctatatccacaggttgtttccttataggacatggtatgtggtgtaccctgccgagatttggtcaactactattaggtatgtggtatccataacccataaccctgacatggttggtgtagttctgatacttatgctcgattggtttgttaaccaatctttgatttctttttattcgtccagcatccgtgactaggattttgtattgatgtctaattttctttttctttgatgtaattgctcgtgtgtggatggagggcgctgcttggtcggattgacggaaaaaaaattatcgtgacaattggaaatttataaacttttaactagttattaaggtggtgtttggatccagggacttaactttagtctctgtatttagacactaatttagagtattaaatatagactacctaccaaactaattacataaacgaaagctaatttgcgagacaaaatttttaagcctaattaatccataattagagaatgtttactgtagcatcacataggttaatcatggattaattagactcaatagattcgtctcgcgaattagtccaagattatggatgggttttattaatagtctacgtttaatatttataattagtgtccaaatatctgatgtgatagggacttaaaaagttttagtcccatctaaacagggtctaagatatagagtttcttctcctttcctcatctgcatggcccaaaagcccgtaatttggctgtacagcgcagcttgatggcaaaccagcccatgcatcaggttccgttttcctttggaataagcccacttggactaccttcagtggtggtcgaatctaatccgtatcccttaagcacagtaccggatatctggacccatcaactattaaaaccggtgcaatttgactcgctcagcagttttggagggtggtttcgctaacatggcgcctacgtagccgtgttgacctggtcttcgttccacatgacgttgatgtggcgcttatgagcattagaattaaaaaatatatgagggacccatttgtcatcctctctccgccccacatgtcatcctctctcctccccttctttctcctccctctctttatcccttctcagtttctctgcccatttctcttccccttcggactcacacggggagcgggggctggatctggcggcggtggcggcgggcggggcctttctgcgagccgtggtcggagctgcacgtctacgggtacaacagcaacagcggcggctgggtggacccgacgcgtgcagccgtgcaacctcgagcggagtggcggcgaggtggcctggacgcttcacggcaccgagaggcagagaagccggttgttctcccctctccttcctgccaccacggcgacaacgttgagatgacggtcagcccaaatagtggcgcaggcggtagagagaagctagcgcccagacgacgaccttcatctgctccacctagacatcaccatcgtgtacaccgactggtatggcggcacgtcttccagcttaagggtggacgtggtccaggtatacccacgggcctcgttggcccgtcccacgattttggcatcaatgggcagatgggtcggtccaaacaaaaacaatcagctctacagggtacccgggtcggcttcattaggacactgaacaggctgagcgcgacaccccttcctctggcggtggtggcgcgagcgccccttcctctcaccgtctcacggcggcggcgaggcgcccatcaagcgcggaggcggcgaggttcagcttcctctcatggtggcgccgctccatcgtgcctgtcggtcccccttccccactagcaccagcgtcaccgctggccgagccgcgcctcttcactaccatcctgtcgtccaccaacctccttgactccctacttgctaccctcctttgccacctctccctgcgcctatctccgccgcctccttcatggcgatggcgacacgacctcatctagcctcgatggcggtctccatgtcaacagttcctcctgtgtctggtgatggtatgttccaactagccaacaactcctcttttattgatttcaatccaagaaagcatgtttttcttcttaatttcgatctactgtttccttgccaagtattggcggattgctagctaataattctgtaattcttttgtaacgtgggaataagttcatacaaattgaattttcagtttcagcagaaatttttacagttcagttttagcagaacacttagttcagtttcatcagagagtttcacttcagtttcagaagaaattttaagttcagtttcagcagagattttatttcagttggctgatttcttgacaaatgtgcagaccagagctctgcacaatttcttcctcccacccttctgttccttttttatgctccttctgtgttttctatattcggcctggagtcctcatgttgaatacaagtgttatcttggtatgagattctaaagttttgtgtattacatctgtgatttgtatggattgacagagttgtgtgtattccatgtttgaaattgaatattcggcacttggtagaatctgatgatgctttgttgttcatcacgtgttaattacaaaaatcaatgatagcacatactgatgggccgacccattctacccaatggatccaatggacaatgggtcgacccactcggtattgttataaaccatttgggtaacatggtctaagtatgggtcgacctgtcccggaccacacccacccatgttccagctttgtggatgcacgagctcattttttttctttctttctacatatgcagtggctggctggttgctgccgtgccgactgctactgttgtgcaccagtagcatttcgtttgaggcttttcagctgcctgagcattagaaagaatccacatacgcccggtgctcgtttgttggttgccttactttactggactatggcgacgagcggagtggcgtctagctgcaggaccttgaatccttgatgcaacagcggcggccttagcagctcgaggcgcagctacatcgacagcgcggctgtggcaactcatccagcttcgaccctgtcggctgcctccagcttctgcctccgcaatccgctattcgctgccaggctcgaatccatcggcaagtccgcgcgccgccgcatgcccgcattcacggccctccggccacgaactgccgaggagccccaatccaggatgccattgacgccctctcccaggaagggctgagtacacggaggcgaatgacaaatgggtcccacgtaattttttcattatgatgccacataatcgccaaatcaacgccatgtggaacgaagacaaggtcaacactaccacgtagacaccatgtcagcgaaaccgcccttcaaaatcaccgagggaggtaaattgcaccggttttatagtttaggggtcgagatatccggtattatggttcagggatacgaataagattcgactgctagttaagggagtcgatgtgaacttattccttttcctttcccatttttttggtgtgctgtccagaatccagattgatcaagaggccgaaccaggcgcgatgatagctgcacaagagacaagctaaatcgacagtaaattactgcaccacgtgttccaatcaaattatggggattccaccggctttagaagataagactagaaaatctacgtgccaactaatttgcaccttggtttttccatatacaatattctatttacgtaaaaatcatacacttatcccttaactggatcaaacgtttagggatggatcgatgtatggtactccctccgtttcaggttttataaaatgttttgactttgattgattttaaactgctttaagtttaatcaaggttataaataaatatagtaatatttacattatcaaattagtttagttaaattagtaattaactatgtttttataataaatttatcttgagtcgaaaacattactattttttctaaacaccggtctagatgattctttaacagtccatcgaaatactgaaacggattaactaatttaatggacttttaaaactaaatattcaagctacatccctcacacccacatggaccaaactctgcaaaccgaataaaaagccttctgaccccttgagctcttcggctgattttgacttgttttaaattgtaccaaatatatcttcggtcatgttctcatattttctggttgttgttcatgtgtgtgccccagcttcaacaacctcttcctgaactgatgtctattatacactcacgtgcaccatcctctaaatcagatgcagcctatttttggacctttagacttcagcacccaaactttcttcctcggtgaactacctcttccttgtacaacagattgattcttgctagacggtcatccttgccatgtgactgttttgcaaaattcaatcgacttacattaatagccgattgtattttctgataagtattacaatcactagtagaatgatcaaacaaattatgccacttacaaaacttggcatatttatgaatattttggttgtttatatagtactattttaacttggcaattctactagggaattatttttataattctatatatttagctcttctcttatgtcagttatattacctaatagatataattaaatattactaaataattcatataaagtctaaaagatgtaaactcgtgtttatgcttcaactcaattatattgaatgcacgtgttggaaacttagactataaaatcaatactcctcatcgaaaaatacatgtacgaggacaaacttgttattcatccctactagtttatccaatattcctcgtatttgccattcattcttcaattgccagtggccgataaaaactgccaatctataactgtatagttagaacacccactaaaacataatgtataccatactaaccaactatataggcgcatgcaaggataccaattacatctaaaactcaagatataagtatgctaaatctcattccacatatcattttcacatctcaactccatataccatttgtacaacatcatatagattcatgcatatatattccacagtaaagcgcgggatgttgtccattatatataaaaagttacaccacacttatttatttggaatgatcacaattaatcacaaacaacccaagcgagcacacacaattttgtctagtttcacaacaataaatatacatgatatagactagccaacggacgtctgctcattgaagaatgagtaacaagttcaaggatagacctcgatgattgacctgaagcccatgactggcatgatcttgtagctactaaatccagcttcaacgaaaagtttcttccactcctgttcatctcgctcaacgccattgacaaacatgatgagcgcgtcaaacaagatctgcacatctctgtgcttttggtcagatgggccaactccgaccactatatccatgattatcacctttccaccggcgtctctagatgggatggcttttttgcagttccgaagtatcttcacacagtcattgtcactccaatcatgcataatccactaaatatagaggaaacacatatatatgtatcaataaaatctgtatgtacatgtatacttctattgataggacactttaagaatattccaattttgataaatggtgaaatagggaatatttttagccataaacattagtgggaccaaactgtaatgtcttaaaataaaatttagagtcgatatcaattacaaattgctgattactattggactagtcatcaaccttaatttgcacccacaagggaaacatagttttgtaagataaatttagagaatttcagtgtagggatatatggaattaattgcggatatgtattttgagagtttagggatctagatgacacaccccttcatatatgtgtcaattagtgataaaataatttacaacaaattaaatgactgattaactccgtagatagaagagatagaaatatacatagatagcaactacatagaaaaaaagttggctaaagtccagttaaacatgtggttcgatatttttagacaaaaaaaccaaaatatacttgagagaatttcgagccagaccagtctatgtaccttgaggaagacagcattggctgctggaatactgtcaaacatgtcgccggcgatgaactcgacaccggtccccctgggtgcgtcggcgacgacgtgggcgaggtccatcacgctacatttcacctcggggaacgccttcgcgatggcccgcgccgccgcgccgttcccgccggcgacgtcgaccagcgagctgatcccctggaacacctcgccgtgctccctgaccaggatgtccatcatgaaggcgctgtccgacgccatcccgtcgttgacgaccgtgttgaacgcggcgtcctcgttggtcatctcccagaagctctggccgtgcgtgtgcttgaacatgcacggctcaggcagctcgagctggagccagtcgctgatccggaagaagggggcgatgaagcacgggtggagcagcatggacatcatgtgtcgttggttcccggcgccgatgaggaggcgggacaccggcgtgagcgtgtacatgggcgcctcgtcggcttcggctgcggcatcgccgggcgccggcttctggacggcgaagatgccagagagagtgagcacgcgcatgaggcggcgcaggcacgggatcttggaggggtggagcgtgaccctggtggctatctgggccatggtggcggcgccgccgtggtggtggatggcgtcggcgatgccgaggtccaaggcggccttgagagccatggacttgatgacggagaaggtgttgccgtagagctcgctcagagcatcgagcgagctggtggcatgttgcccgttgctctgaatgggcgccatggcactaccaattaattttgtcttccttttagtttggaatgggtttatgcacaagatgcactataaatagaggtctcaaattactgtatcaatgcaactcgttctggaaacatagaactactatactaggttatcagagaaaatgaggaaaaatgtactagtttcagggattccaaaattccaaaaacaaccagcacaatatcctatgcaattatgtaaccaatttttaatttaaattatgacatttggcaaaaatgtaaatgcacattaaagtatttgctgttgtttctattatttattgtgttgcttccatttgtcaatatagatgaaatgaaacaaacatgtccgctagaaggatctcgcggcatcatctcgctggagactttgcgtattaggatcatccaaacggacatcaaaacattttagtaacaaaaagtgacaataaagactgtttcgtcatatgtaactttacaaacatttataactaaattagacatactttaatcccctgttgacctaatttaagttattaaaaataaatatactctctctattttatattataagtcgttttgacttttgcctagtcaatcttttttagtttttactatgtttagagaaaaatttagaaggatctcaaaaaataaaattattttcactaaatgtaaaattgaatatattttaataatattttttattgaaaatgatattatattttttaataaacttggcccaatgtaaaaaagtttgactaggtaaaaattaaagcgactgatagtatgaaacgaggggtgtactgaccatattctaactcttacaagtcatctaagcccatctccacactactttcgaagaaatcagttgagacgaccgtgaatgaaaagataagttctctttaaaataagtcaaatcaatacattgaaactgaactaaggctgtgtttgagggagagggaattgagaagattgggaagatacgtaaaactaggtaagccattatcgcatgattaattgagtattaactattttaaacttcaaaaatggactaatatgattttttaaagtaacttttctatagaaattttttttaaaaaacacactgtttagtagtttaaaaaacgtgcatacggaaaacgagatacaatctcccctttctcatgtgaacgaacgcagcctaagtgaagcacaagtggaaaccaacggccagcatatggcctagcaacgaacaacttgggtgtgttcgtagaacaagttaccatccgggacagtgatcacggaaaacggaacaatctattagcacgtgattaattaagtatttaatatttttttttaaaaatgaattaatttgattttttcaagcaactttcgtatagaatttttttttaaaaaatacattgtttagcagtttaaaaagcgtgtacacgaaaatgaaaataaaaggagatgggctgagaaaagaggcatcacaacacagccatatatgcgaagcttgatgcggactcttggcttagccagtagccacatcctagtgaagcattattaatggctcacaaccatcgatgtacaatgtggccaatgggtgctgaccagcaactattggccaaagggtggtgaccagcaaccattgagcatggaaaaaaggacgacaagatggcaatagtaatagaattatctttaatattataaactctaattaagaggacgacatgatgggagaaatgaaatttatattactagggtactataagtatctgtttttctgtggttgataatggaagccatcaacaatggcattgtatttggcagtggtagaattagaatggttcatattgggattattatgagcagagggatgagtcctccactactgttaaggagtttgcgaggtcatttggattgccaaaaataaatactatgcaaacaccaatatttcttttgaatacacataatatttggttctatgtttcgttaatattggggaatgcaaatcattataaataaatatattatacgattcatattatgatagaatatattctcggtattaattaataattcacataacaaaattagactaattcaaaccacaatcataaactttagtctatggcacttcagctgttacaattgctccgcacataggaattatattacatagttaaaaaataaacaagcagatgaaaaagtataaatataattccaagatatgctagctaactagccacacagctatgtggataattcatttgcttacatattatatacatatgtgtgagtgtatgtatgtatgtatcaaaggtccataaaaaggattttgaattacacaattaaagtatacatagtatgaattgttagaaaaaatatgcaatcgtgtctaacttttagtcgttctgtgaaccaagtgacattgtcccatgacctgcaagtcaaaaaattacaaaattgtgagtttgagaactcacaaattggtgtttgcggaacttaaatcaagtgagagcagtgtgtcagctaattcttcttccattagacctccttgccgcagcatcatgccaggcaccgcctggctcttagcaaaagtaagggaacatcgtcaactaaacatgtcctacttgcagtgatagtaagaacccaaagatccgcattattcctggtgaaaaccaactatgaaaaatataaatgtgcatatagcagcatagccaagcttctcctccttccactgtatgtgttctgaaggttcaatcatgtatatatacttcctatttggaaacaatgaaagttcatagctacttgtgccttctttggttggtttatagtaatttactgtttgcgcatcatttagttaggctcattatgtcacctccggaaattcaatagcaatttcatcactaatttgcacatacaattaatcatcgtccaaccatcaactgaggtatacacaaatcgataattcaatatagatccaagataataaaaacattaaattcttatataagaggaacttagtcctcacaaaaaagaaaacagcgacagaaatacaatctagcggtggattcagctcaactcccatgggcaactcaactagattataagccaagcgtcttctcgttcataatcattcttcaactgaggttgataattattgcaagaaatgtacatgcaatacttccacaagccacataacaattatgcaagtgtaatagtatgacaaaaggacatcatatgggggttcattcgcaaaagcagtatttagcaaatatttgacaatactaaaatagttgagtaattaaacaatattatatcacattgcacatcacaacaatgttgcacagttccaaccattttgaacaaccaagcccggttgcacagatctaaccccactcaaagagctaataaattattattaccaatttatttctcattaatgagttattgtgagagcaatcacgaaaaatattgttaggctctcccataaccactgccatggctatttgatcgttttttttaactctgaccagaggtgtacaaatttacccacaatacatgattccacacatcttttcatgtcctgaaatacccccatagtactacaaaggaagaaattgtgacaagactctttgcataacacgtcaaacaaaatatatacccactaattatctgtctccggtagggatagccagatacctagacagggagactacttagcacctaaacaactgtgaacatattatctaccgcttgttgacttattatctgtcaagctcaaacacacaccgtgacaccttccgttgggacatgtcatactacagatccaactattaaccatgttggcttatggttagtacgattaatacttcataacagtagctcacgaatcgatctttaattgttatgagcacgatcaacataaccatgtgctcacaactcaccattagttaagttttagttgaaattatgaacaaccacaaccgtcatcgtgatctttcattaataaccataattaatcatgaatgaatcattgtggccatggtcttgaaaatggcgaatgtgagagcatctggctagcgagcttgtggcatgagatgcacattgctctcagtgagcaccatggcactactggtttcgttttccttttcgtttcaaatgagttgatgcacgacgtacactataaataaaggacaaagggctcaaactattatcaccacagttggttctggaaatatggaaaaaaaagtattttttttattcttgggcaccccgggagtgcacatgttaaatcgtgtacggattgattgatacagtttggtctatttattgaaatagaagctagatgatatgtcaaatcaattctgcctttagcatttataaataccgctaattgcctctatattactagtagccaccaagtcgcattgcgcgactctaattaagtgcctacatgtcttcatttatatttatataatgtgtcgttgtagttgcgccactgtctatttgtgctgaatttctcatgaattcatgggcatgtttcatgagtaccatggtgaatgccagatgccgttatgtttttcagtaccgagcatataaaatttataaaattgacatcattgacagcattttatatattttcttaaagctacatataaaaaaggcttgaatggtggcttactataaattccgagtggcaagaggcaacatatgaaattgcatatagacttgatgtcccattattatatttgtaggtgtgtgtgtataatataattttgaagaccgaatagtaacagtagtacttgttagattgatctccctcccgttgagccgttgggctcaagggggacttgacccgcgccctgatcaggggcgcccagcccaatggctggtgggcccctatcaccctgcgccatataaagaggggtggaggccggggcggcgcacgacatcaggttcgctaccgccgccaactccacccacaaaccctgatccgatcgagagggggcgcaaccagtgacgggaaaacgccaccgccgcgccacgcctcatcgccacctacgactcccactgctacgaccaccgtcgtcgtcgagcacactgtcgccgccgtcctcgtcaagctgagcgacggcaacgacgatggccggcacttcctcctcatccaacgtgtcaaccggtcacatccctaaacccttttcccttaatctctattgttgttcaatcattcaaccaaatagaaccaacctgactagatctaaacctaggtgatcctagagagaatactaacaatggtatcagagctaccctagcgcatagatcggtttggggagagaaatccacaaagaaaaaggaaagaaaaagcaatgatccgctcggatcaaaagatcgaaaccttaacccttgaaccttaccttgtcgccggccgaacgttgacgccggcaaaggggtgaaagggggagggcacagggcaccgccaaggagcctctcgatggccgtgtgcgcacccgcaggtgcacgcgcgcgccggcgaggtggcccgtggcggcgcatcgccgctctctctctctccttcacttcacaggtggaggattagagacggtgggaggagaacagaaaagtgggcgcgccacagcgcgaggtcaccggccatggcgcgccggccatgatgcggcggcgcgaggcgcagcggcagtgcgacggcgcggcgatgcatgggccgtcaacgcagccacgcgcgcgaaagatagagagagagagtggagaagctagggtttcggctagctggcggctggggtcgggtttttgtccctccgatctcggcgcccggctgtctgatcgaaaccctagtgattggacggccggcggcggctggaccaaaatcggcccatgtggggagcgcatggcgggcggctttcccggctcaggcccaggttgcggccaagggaggggtgagggagcgcccgcgcgcatgcaaggcggcagtgggccgaccggcaaaggctgaaagagtctattttaggtccctcggggccgaagcaaaagaaaagaagtccattttttgtccttgtttcagaagcatttgcaattatagttattaaaatgtgtttatttctaagcaagttgaacccacgtgaaaattgtttagagaatagataaatgtgagaaatgcttctgaacatgtattttgtgtattttcatgcaaatttcaatggaattttgtatcgattttgcatgttttatatctgtttaaaatttgatccaaagtggtagtttttttacagagagtgaataacagaattttgttactgttcatatgaattttatatagatcttccgctgcaaatagataaaattgttaaaagttgtgtttttaaaataaattttgaaccaacgggagaatttaattttaggaacattaattttgtgctatgatgttgtaattttctgaccaacgttgataattgcaatgttatagttatggctctgtgttatatctatttttacccaacggtgatgtaggtctaatgcataatattttaatgttaattttgttctcacagctactccttgattggttgcattaaagatattccgacctgaaaggagataactacgaagaatggaaaagagaactcgaccttgcttttatcttgggagaggtggactgggtgttgactaccccatgtcatatagaacctgctgaacttgacagaggtgaaaaagagtcagatgctgaatggcaaaagagagagagggaccatgttcccctcatcttgtcgtatgacattgagcatgcgaaatggtccttagccaacaagaactgcttggctgaggtaaagaacacgattgagccaaccatattgggctcaatcccagagtgtgacaccgtctctgagtacctcaaaagtataaagagctagcttactagttcttcaaagacttatgcgacatagctgataaagcagcttgtgatagagaggtaccatggaggtggtgtaagagacgacatccttaggatgagcaacatagcttccaagttgaagccaatggatttgggcatctcagatgactttctggtccatctggttatgacctcattgccaaagcactttgacaactttattgtcaactatgaaataagtccaaataaatggaatttttaaagagctcatctctaattgtgtgcaagaggagaaaagaatcaaagagaccaatggtggctccattaaccttgttaaagataacaaggataagagccataggtcaccctcctaaaaagcaaaacagcctcagcatctgcctcagcaacaatagttcacagttgagacaggatcagtgtctccactgcaagaagacaagacattccaagaaagatcgtcctgacttcctgatagtgatcatggcaaagaaatgtgagaacattattacatttgtaaatgaatctcattatgattggttattctagatccacatagtggatttattctggagcaactattcatgcatgtaattgtttaaaggcattccgttcgacgaggactacgcaaagaagcgaaagatccattagagttgccaatgaagcaaaagttgaagctgttggagatcttcacctagagctcgtgaatggcttcacacttttacttcgagatgttttttatgtcccatctttgcaaagaaacttaataagtgtatccaaattggattttgatggatatgattgccattttggaaatggcaaatttgaactatggtataataatgcatgtattggtcttgctgtgttgagttcctccgcgaggggttttctcgttctcggtgaacccctgtggagatagatggcctggcgaagtcgatggcgccgctgacggagaaggtcttccagtcgatggattggcgttggccttcctggtagttcccatgtcctgtgtcaaatgtcttaggaaaaaagtgtaatatagttatggattttgatgggattgtaagaaatacttgtggaatatctaactaagctttcttactctggatgtagtgtgtatgagtgtcttctcacttcgcgactttgatcagtcgtttgagttatacactctccctagcccccagccttgtcatcggagaattcttctcggaagataaggctcttggacctttgacctgccttggttgaacaagcactgatcctagcccccagccgtgaagttggaaagtttatttccgattacacggcttggttaatacacacggcgagaactcttacacgaccagatcttacatggtctttcgtctctacaggatccgacaagaccttatcggctctgggcgtccccagccgaagttcccttaggttcctcggaggccttgtcaagacggcgtaaagggacatgaggataggtttcaacgctaggtgtcatctgggtaagggatcatcgggaaggaacactttgattgtagtctatacctgaaaaataggctttattgaggctgtaagatgtcttacaagtatggatactattgacttatacatagaatttacgtaattgatcaatgttccaggaatttgccaactcgcgaccatcgctgtctgcgattttgaatgcgcctggccgcagaacttgtgtgatcgtgtacggtccttcccatttgggtgagagcttgttgcgccctgcttggctttgaacccgtcggaggacgtagtcgccgatcgaaagtgtgcgtgctcggatgcgcttctcgtggtaacggcaaagggcttgttggtagctggctgctcaaacggcaactcgttcgcaatgttccttgaatagatttacatcgtcgtatcgctgctcctcctgatcctcatcgaagtacttctgtactcatgtactttgatgtcgtagctcggtggggagcatggcctctgagccgtacacgaggaagaagaatgtctccttgttggaagttgtcggtgtggtacgcacggcccatagtactgatggaagttcttcgacccacttcttgtcgtgtgacatgagcctgtcgtagacgcgggtcttgattccttgtagtactatgccgtttgccctctagacttgtccattgctttgagggtgagaaaccgaggcgaagcagatcttgactcccagcctgatgcagtaatcctggaaatcggcactgatgaactgggagccattgtctgttatgatacggtggggcaatccgaacctgcagaatatccctctgatgaatttgatggcgttgtcggccttgatttcccccgtgggtatcgcttcaatccacttggtgaatttgtcgatcgccacgaataggaacctgtagccgccctgtcctcgtgggaatggcccgagtatatctagcccccagcacgaaaacggccaagtgagagggatagtctggagtgcttgcgctggcaactttgtgtgtttactgtggaattgacaggcttcacaccgctgaaccatgtcgcaggcgtctttgagggcggttggacagaaaaactcttgttggaaagcttttccgactaatgtccgaccggcggcatgttacccacagatcccttcatctatgtcgaggaggaggtgtctgccgtcgtcggacgagacgcattttaggagtaccccattcgttgccttcttgtatagatcgttgccgatcatacaatagacttttgatttatgggatattttctcggcttctgcgtcatcctcgggcagctctttgctgcatatgaatttaatgagtggggtgcgccagtcgtctgtggtatcgatatcagcaacggcgccctctgcctctgtagcccccgagctgatgttgggggcgtccgggctatcttcgccggttgcctttttaactgatggccttgttaggacgtccagaaaggtgccaggttcaagtggttctcgtctggacgcacgtcgtgctagatcatccggtttattgttgtctttgcggtatacatgtcggacctcgatcccatcgaaccttttttctagcttcctgacttctgcgagatacttggataactcgggctagagcacttgtaatctttatgcacctggttcgcaactagtttggaatcccctttcacgatcagtcgccttactccgagtgcagctacaactcttatcccggcgagtagtccttcgtgttcggctgtgttattggttgccctcaagttgaggtgaattgcatgcttgaattgagtgcaataaatgcctcttcggcctcctgtgtccatacaaatttgtcttgctttttcagcagagcgaagaaaggttgtcctcgctctcccatcctagcgacgaacctgcttagtgctgccatgcatccggttagcttctgtacttctttgagtcttgtaggcgactccatgtcctcgattgctttgatcttctcgggatttgcttctattcctttgctagagacgaggaagccgagtagcttgcccgatggtactccgaacgtgcacttttttggattgaccatgaggcgatatcttcggaggttgtcaaacgtttcccgcaaatcgtcaattaatgagtccctttgcttggccttgacaacaatggcatcgacgtatgcctcaacattgtttccgagctggtcgctaagtgcaccttgaaccgtgtgcctgaaagtgtttcctgcggttattagtcccaacggcatcttaatgtaccagattaccccgaacggcgtgatgaatgttgtcttctcctcgtcctctttcgccatgctgatttggtggtaatcggagtaagcgtcgaganagctcaacaactcgcaaccggctgttgagtccaccagttggtctattcgaggaagaggaaagtgatccttgggacacgccttgttgaggtcggtgaaatcgacacacattctccatttttcgttggccttccgcaccctgactggattggctagccactctggatggagtacctctctgatgaaaccagctttgagaagcttgtcgagctcttctcgtatggcttgttttcggtctggtgtaaatctccgcagtttttgttttactggcttggcatcgggtcgcaccatgagtttgtgctcatcacctccctgggtacccccagcatgtcagactgctgccaagtgaacacgtcagcattgtcatggaggaaggtgatgagcgcgagttcctatttctctcctagtgatgccccgatcttaacggtcttgttggggttggcactgaagagtggaacgatattgattgcgccgtctggttttggcgtcttgtttgtcttgctcactttcttgggtggctctgctgtggcaggcgggctgggcgtatgctcgaccatgtcgaggctccgcttgtaacattgtactaccagcttagcgttcccttgaatagtgattgttcccttcagtcctgtcatcttgagcacttgatacgcatagtgagatgcggcaatgaacttcgcgagtgcagttctcccgatgatggcattgtatgctgtatcgaattcagcgacatcaaaggtgatttgttccgtttggaagttgtttgcttggctgaaagtcacaggcaacgtaattttacccaatggtttggacgatgactgaggagtgattccatggaagggttgatcggtgggcatcaactcgcttcgtaggatccccattgcgtccaaagtgctggcgaagagaatgttgattgagctgccgcagtcgatcaagactcatgcgatctttatattacgaatagtgggttcgaccatgatcggatatcgccctgggatgatagcagtcttggggtggttctcttctgagaattctatcttctgctcggaccacttcatcttgggcgcagccccctgccacgtcgaacagacttcacgttccgctttcttgtaatctcgctttgaggagtatgccgtggaaccttcgaagatgtgtgagacatggagatcggaatctgggtatgctgagtccgattcctgagtaggcacctcaatgtccttctcaaccacgcgtactcgcttgcatttttccgatgccatgtgttttgcaagcgactttttgaagacgaggcaatcttctagagagtgtctgtccgacttgtgtatagggcaccatgctttcttcgtgtcgctgccttgtgggtctgggcgcttaggagggtccgcgtattctgttgcgagaacttccgattgagctttccttttcccactcttgcgatttttcttcttgcttgactcaggtgcgtacttggctggtttcttctctcctccggtctttggtttgtcgttcttgcgtctcagtgcatcatccgcatgagcgcattgattgacaatttcgaataatctccgagtagtcgtgacgcgccttgttgccaactcttgagtagtatagcgatctctgacaccggatttgaaagcgcgaattacagaagcatcggtgatctcggggattgtgtttctgcactcgttaaagcgccgaacataatccctcaaggattcacctgggttctgtgtcaacgcatgtaggtcgtcttcgatcgcatggcgcttgtaagttccttggaagttggctacaaacttgtgccacaagtctgcccatgaagagatcgagtaggggagagatgcatcagccatgaacgtgcagagcctttcaatgcggttggtaagtaattcaccaacgcgttgtcgcccgctccggcagcgtagagtaccgtggagtaaacttgaaggaactcttctgaggtcagtgctcccatcgtatttctctattgctccaggtcggaatctttcaggccatcgggcatcccgaagtgaacgaccgaaagctctacacccagcgctgggggcggtggattgtcggctatcatacgtccttcgtggatgtctgtctgatgatgaagatgacgaggatgatgacgatgacgatgggtcgcttggttccggcgtacgattacgaggatgtcagccgggttctcgagaatcctgttgtcgtctcccgttgttgtctcggcgccgatctccatcatcgtcatcattatggcgacgtcctcgaccagtatcgtccagcacctgccgttctcgatcgtcgtttatcacggtcttggtcttcgcttgaacggcctcctcgatcttcgttatcgtgacgctgtgaagagacatgacgccgggaacggttctcgttgtctcgtgtgcgtcgtgcctctcggcggccgttcaggtgatcgcggagatcgccggtgccgcgaggtggaggggtggctcgatgaggcgattcccggcgttcagggttttcaccattagcaacgctagttggtggctgttctgggtgcgctgcggcagcggcctcttcgaatgcgttgctgaggttggtcattgattcccgtagtcgttctgtccaatgtgcgagatcgtcgttcagaatgggatcgtaaggggtttccctcagtattgcgttgacggctctgatgtgctgggccggagtagtcacttgattctccgcttccgcattggtgcgcgctgacgtgccgacatcgtcgatagccaatacctcacgcggcgtactcgttgttgatgatccatagtcttcgatcaggtgcaagactgatggttcgtggggatcgatgtcgattaccccaacaaatcgatctgaaatcggcgtcactccttgttccttgtccttatccctgatggggatgcgtgactgctgtaccttaggaggtggcgtcttcatggcgctgagaaagacctggcagctcgagaggtcgtgattctttgtcttgtgaataggacaatagacatcatgagttggagaggtatgttgaattccacgctctttgcaggcacgaatttcagcatggacgttgagaaagacccagcaggcttgcagggagtgtttcctggttttgtggatagggcaccaggaccttgtcacctcggaagtaatccttgtcagttcgtgattcctgttggaaagacaaggcttggccgcactaggatccttctcgggttcggatgtcgccgacgtttcgatctccgcttcggcgggaggatccttcgacacggagtcgccccgggttgtagccactgcgttttcgtttcaggccattggcggaccagttggaatcgacattattgtgtaaaccggaaagacgatttcgccgacttgagtccacaccagtgttgttgaaataggaactccttggttgaggttggtgttaacgctgttgtcgacgaagctggatgtcatagtagtagaaccttgagcaacaagtccccctacctggcgcgccactgtcgacgggggatacccgtagaccagatatagagggtattggggtacgctggtacgaggatctacgtaatatgacatcgagcaagcagaaaacaaaaattatattggttcaagccccttgataggtaatagccctaatccagttgatatgggattatatgatggaaaccacagattacaaagggaatagtggaactcgacgataccgacgagatcgtaatcgagttgattcaactagatcacccggcgattcggctctcctgtaagctccgacttcgtaggctgtagtggatgtgttggctctgagattcaatggcttcggtcctcccggggggtccgttttataccgcaggtcaactggtctccaaataagactcggagacatcggacccgacacaatacaatgacgacccagttctattcgagtaggactctttccatctgtagactccatgatggacttccttaacttatgctgaaaacgtccgtatacgcgcaaacataccatatcgatatgtgacgtatatcgaagggtggaaggtataccttacttatgctgagaacgtccgtatacgcgcaaacataccatatcgatatgtgacgtatatcgaagggtggagggtataccttacccgtaaccctgacacccccattaaggaaattcgttttattttttgttccaccaaaaatgttgcagtgaactgaaacattctttcgctatttatgaaacattgtttttatataaggtgaaacaacacccgatttaaacgagggaaacattttcaatctacttagtaaaacaattacgatatatctggtggaacatcgtacaacatttaaaaataattcaataataagctaaatatttttttcgtcggaatatatccatgtgtggtattgttttgaagatttaattacaacgaatttaatggtgcaatcgaatcatgatttggataaataatttaagagaaaaatcagtttaaattagttttgcacgtaaatcggacgctgagacgtcagcgcccgattttcccctacccatggtagggtgcccgatttgtagaggtatatacatttaaaaagaattgatgtaaacatatcatagtcgtagtgcaaacctgcaaactcactgtggcgctcagccgctcacagtcgcttgatcggtcggtcagtaaactcgctgccgcgccaaagttcgcttggatcgacagtgaactggctgccaaattaattgctaatgaaactaattaaagaaataacgaccaattgctaatagcgcaagttaattaattgtgcgagtttgctccaaagggatgcgaacctgctacatgtatctattgaagtcgcgcgctccccgcgcgaactcgcgatgacacatcatgaacacgttacaaaaccacacactcaccgtatgacctcactgtgaattcgcaccccattcgcgacagtggtatacttcaaccaatttctttcaaacctgtatattgctataaaaccggtgaaaagaaaagatagcaaatcgtgtgtggcacgatcatatgacacaagaaaaaacagcttttgcgatgcatgcactaggagagacatgatctttagtactagttctcaacccctattaattccagttgtagcaaccgagactaaagatcttgatttttagtaccggttgaaagaaccagtactaaagatatgcactaagtcaaaaaaaaaaaatatgtgggatgtagaattcaaactcaagatttatcatctcaaccctcacgcgcattatcatcctatttactacacacattttttaactaaccctgaacacatctttaacaccggttggtaacacccgtactaaagagtttttggtaacaccgggactaaagatatttttggggacttgggcttttagaaccggtactaaagagtttttagtaccggttcttaatacatccggtgtatttatggtttggggcattagataaaagatgagttttgt

SEQ ID NO: 81048 - DNA, 2271 bp, Oryza sativa
agcttcatcttaacctttcctgtagctggagctcagctaaacagtttcagcttcacctaaaatgagagcagagctgggtggaacgctatcataaaataaacaactccactttagacttaagctaaatttagaagttggagttctaccaaacaggtctttgaagctgaagctaaatttaggctgtgtttagatccaaagtttggatccaaacttcagtccttttccatcacatcaacctgtcatacacaactttagtcacatcatcttcaatttcaaccaaaatccaaactttgcgctgaactaaacacagccggaggagctaaatttagaagttggagctctaccaaatagttccttgaagctgaagctaaatttaggagaagtggagagtgcatttggcagctcgcctgtagaaatagtctagtagtagcgagtagtgacactgtagatgctgctggcttagtgcaaactgcttcttcattgccagtgtgtcctgatatgtgaagcattaatcagtgaagctaatctggacgtgacgcttgaaaagcttcaatgttctgctgtaatgcacacagtttcataatgtttagaatctagtacagttctgttttataatcgcagttttgttttcatgaggcatgcgtctctagctgccctttgttttgatctataggatccatttttgttgaaaagaaaaatgtttttctatttttttagataaaaatcggacattctattcattagcaggcaagtttacattcataatcagagtacgggaaggaattgagaacccccaaaaatgtttactagcgtagatacgctggaggcttcctcatacagatatcaaaatcttttgtttgagcagagagcacacttcataactttgtaggccaaatgatttttgatatttccatcagagcatgtaactaccactgtccacacaatcaattaattcgtacaactgataatgccaaacagaaatggctcattccgtaacaccgttatttctgatatttcctgttacaccatactgttatgctagcattcaaaatgaaaccagaaatgtagatgtaaggcagtgtcatacattagaaaggatagttttactttgtctgggaatcaaaagataatcagaaccaatatagctaagattatttctgagatgcagctttagcagctgaacacgagcaaggagaactcttcagaggtagcaatcaaatcatttgcccatttcccagacaatggcactgtcctctgcatcagcaagtaagaagagtaagtatatgtacaaaaatatacaggcaacaaacaaaaaggtgttacatgctttcaattgttcaacccaacattatccaagacaaaagaagagtaatgctttcaattgtataatacaacatcataagttttcaagaaaacagttactttgcaagaacgtaagttgaagagcactgctacacgtactaattttttcttactaaatttgtactaacaatcatatcaaccgtttgatttaagcagatggaagttataaaaaatctagatggactcatagcatgacatgtcagtgttagtaaaaatttagtaagaaaaagttagtacgtatagacttttcctaagttgaatggcccctcctgctaccaaataaaacaagaatgcacctttgatctttttgtttatccaaacctcaagcagcatccctgcgccaactccagcagcacacgcagcgccatagattgccaatgcagaaggcaaagatcgccgaggcagaaaatagcattcaggaacttgtctgattttcttcgggagacgctttttaacaactggttggcttgggtcggtgctcaccgaaccaccaactgttttccagtccacattcttcagcatatcttttgtgtcctcactgcccatcctgaaaacgcctgtatgcatcaatgttaatcagaaccaagctccaaacactatctgagaaagtgagtggcagctccaaacaccacgtcccactaggcccgaaaaccttaatccgcgaatgtctgaacgcggcaatgggggtttgggtttagggtttccgggggagaggaagtgggggatggattccatggtcttagagggatggcctgggaggcagaggaccggcggcggcggcggcggaggggcggggcgaggggatgtggaggaggaggaggaggaggaggcgcggagctgacctggatcgcctcaccgtcggggaggtcgagctcgtcggcgtcgtcaggaaggtcgccagcgttgttg

SEQ ID NO: 81049 - DNA, 7410 bp, Oryza sativa
gtccctggtttcgtttgacgtggcaaaaaaaaaaaaactaggacccacgtgtaagtgactgttcgactaaaaataaactatttatagtgggacccacgtctcctccccaatctcgctgtctcttgccgtctcctccttctcccaatgcggcgacccagcggcgggatccatgcggcggcggccaacctggcggcgggacgatgagcagtggccggcggggaaaaggggcagagcgcgccgacttggagacgcttcggcgacatcgtccacctcgacacgagcggtggacgcggcggatactcctcttcctcctcccctctcttggtcactggccagtggtcaccgctcgccggagaggaagacaaacttgtggtggtcgtcggccgattggcaatcattcggcaacgacgaccgatgctggttcagccgccgaacgccgacgcccagcacactgacatccccgacggccgctccttcctcggcgtcccccgctactaccgccacagcctcaccgtcctccagagagccgtccgctcctggaatgcccacaaccacaagcatccaatgacggcggcggtggcgccgtccgcttttgtgtcaacttcggtgacatcgtcgacggcttctgccccaaggacaggtcgctgctggccgtccaggccgtcgtcgccgagtttgaccgcttcctcgacgcgtacgacttcaacgccgtgggatggtcgcgcgaccacccgatggccgcggcagcggggagattcttggacaagaggaacccgaacacggacaagaacaacccgagcggccttgccggcgtggccaggcggttcgtgatgttcaacggtgccgtctgtgaggcgcagctgcggtggctcgacggcgtgctgcggggtcggtgctgtggcgggaaactgcggtggtgtgcaggcacctgccgctacacctcggcgcggcatcactgtcagggctgatgtggaactatgagggggtgatgcgcgtggtgcaccggtacggccgccgctccgcccacgttccgccgccgctccggccgccgcccgccccgcttcgcccctctcttcctccatccctctgctctgccgccgctccggccgccgcccaccacgctccgccggctggagaaagagaagagggagagagagagagaggggatagagagtagtgaggatgacgtgtgggcccacgtgggtcacaccattttttattacgattttgctatcgattttgctatatctcactcgaaagattttttcttatctctcactcgattttcttactcaaatttacagtgcattttcttgtaagttacagtgtaatttatgaaacttacactgtaacttttgtaagttacactgtaatttttgaatcttcgcatgtaaattttaaattttgtattggatttggtctttttattgaggatatggtaatttagtgtccattatggtgtttcttaattgctttttgctttttattatatctatcggattttaatctaaagattaaaaatctgtgtgatacgattataaaaatctttcgaaagatgtatagttactcccttttgctatatctcactcgaaagattttttcttatctctcactcgattttctcacttaaatttacagtgcattttcttgtaagttacagtgtaatttatgaaacttacactgtaacttttgtaagttacactgtaatttttgaatcttcacatgtaaattttaaattttgtattggatttggtctttttctagaggatatggtaatttaatgttcattatggtgtttcttaattgctttttgctttttattatatctatcggattttaatacaaagattaaaaatctgtgtgatatgattataaaaatctttcgaaagatgtataggtactccctttttattattttgtatgtgcaactgacatgtgggtcccgtaggttttattattttttcggatctaattgacacgtaagcgccacgtcaacgacatgtcagataagaccgaatcaaattagccacgtatgcgccatgtcagccaaaaccgctatcaaaaccgctgagggacctcgtttgcccggtttttgtaagttgagggacgtgtcgtgtaacgccccgattttcgttcgggattaaaaatcaattaataatgcatttcctagaaattaaataaaagttaaagcaatttaatcaagtgaattaatgggagaattaaaatttttcccttaaaaatcattggccgggaatattttgtaatattctttgtgccctaatgtactctccggaattttccgtgaattttcggagctcaagaagtaattttaatggcacaaagttcatcgaatcaattaaaataaaaagaaaagaaattaaaatcccctctttgtctttgggctcggcccattctcccttccctccttccctcctttctccgcgtgggccggcccagctcggctccccctcctccaagtccacataacccccagcctcctccctcctcccctcgccgacaggtggacccgaggccccacctgtcatcgtctccccccaaccgtctcctcctctctcctttcccccgaggccccacctgtcgggtccttcccccacctcccgccgatcccggtgcgccgccgcgccgaaaccgccgccgcacccacttcctccgctttcgccgcgcccacgccacgtcgccgccctctccccgcgtctcccggccgcgccagcgcacgagaggggcgggattcgattttgaatctcccccccaccttctctctctcctcccccacgtcgccggcgaaatcggagcgcctcccggccacgtccgcctccccctccgcctataaaatgctccccatgccctcctctctcgttttccgctctcaccgctccatcccgtgccccctaccgagctcgcaccgccgccacttacgccgccgcccgtcgccgcactccggccgtgtgccgccgtcgctagagccgccgccgcactaagccaccgccaccactagcttcgccgccgcaagacccttcccggccgctgctctgcgtcgccggaataccaccgaaaccccatttccctcgcgtcgtcggtgagttctctctcccctccgactccggccggcgtggatggtcgccgtgggggttttcctccgccctaattcctctcctctctttccctaggtgtcgccgtcgctcgtccgcacctcggcatcgccggtcttcgccgcctccctcgtttttctccgccggccattgccgcccctccggtgaggtctccctccccttccttcccttcttttttttttccccgtgcgccgccgccctcttcgcgcgctcgccgtcgctggcggtcgcatgcccgcgccgccgccttgccatggccgcccggccggcttgatgccgggcctggccggtacatcggctcgtggagccggagccgtggggcccgcttgccagccgtgcccccccttgagccgctgccgagtgggcccgtgtaccagcgccctccccctttgactcgctgacgtgtggggcccgcctgtcggcgccggccctttgctgacgtcagcggcagtccttttcctttgagaaaataattattaattgcgcaataattcgataataattatagaaattcattaaaatggctcaaaaccttctaaaactcatatctaattcattcgaactccaaattgagccattcaacttgcaaaatccatctaaaattgagttctacatgtttgtttactttttatgtactgtttccttggtttttattagagtttttcctcgttttgcgtgccagcgtgtagttcccgtcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctgtcctttgtcaaccttgggtgataaatcgactagcttgtgttacttatgtgacctagctagaactatatgcttagccatgcttaattaccactagctcagtcgatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacctaataaatcgacccaatgcactgtagtacaggtgggttggttgggcctgttcaacgtggtgtagcgttgatcagtggagattttaatgttacttaaattactcaacagttttactgtttgctaaataaaatgttttacaaccgcctttatgcaaatagccacaaaccgtccttgtgttccctttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttgggactgtttattacttgtcgttttgtgtaccctggctggtcctggacagggatttaatacacaaaatagtctggaaattttgggctaaatttctgggcgtgacaaagtggtatcagagccaactcgactgtaggttgagccaaatggtcaaaccctaaggacaagctttctgaaaaccctatttgaaaaatgtctcccctcgcccttcggcttttctttgcgaaacagtttttcaaaattctcctccctgtccctccaattcttatagttgttaaaccgtggaggataaactgtcagcttcgtgtctgttcggaagtcaagtcaagcatcaagcttcgtgcagcaaagagcgagaaggtcggttcagagtcgtcgttccgtgaagatcaagaagagttttcccgaagttgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacaacatatcagtaggcaagtggtttagtaccttatctttagcaacccctctcttccacctctcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagctcgatgcaaggtcaagagtagcggaaagaactccagcagtagtgtgttgcagtcaagagtcagtgtgttcatgagctaaatgagagtcacttttatgtggaatttcctatcatcaactaaggcttaagttccaaatcttgtcgggatgaaagtgcatcgccattgcttcaatttgatggaccgatgaagtttcagtcttcaaagtcagggcatctgtaaatccgagaaatgttggtcattttttcgaggacaacagttcaaaggttctcagtcaggcgaaagtaagactacccactgtaaggggggtaggtctcagagatgagttttggtttacctcgtcggcatttcacttgaatgttcaacccagtgcagcaatttggttagtaattaaaggagtccgttgcgagccactagcagagtctcccaatctcaagtcaacaggttcaattctaatgtacacccttgaggccaggtcaacagttcagcttagagaagtagcatcgaggatggttgcagttcagacgaaagacaggtcaagcaggtttttctggaattacttgttatttgaattgggaccagtcgaagcggacatagggtaaatgatttataaatgccagattccattttcatcctcttatagctagcgtggtgaattctcaggttaccaaaattgctaacctcaacagttcagcccaagctaagtaagtttcaggagcatccgcagtcctagactgggtcagttcaagcaaaaccagtcggtccagttttggcaaagcaaaggaacagaaaggtcgaatccagccagttcaatcgtacaggtttgatcaaccagtcaatcaatcagttcgaagcagaatgtggcagttcaaggtgcagatcagtcagaccgcccatcagcaccggctttctttctagccatcccagaatctcgggacgagattcctgtaaggggggtagatttgtaacgccccgattttcgttcgggattaaaaatcaattaataatgcatttcctagaaattaaataaaagttaaagcaatttaatcaagtgaattaatgggagaattaaaatttttcccttaaaaatcattggccgggaatattttgtaatattctttgtgccctaatgtactctccggaattttccgtgaattttcggagctcaagaagtaattttaatggcacaaagttcatcgaatcaattaaaataaaaagaaaagaaattaaaatcccctctttgtctttgggctcggcccattctcccttccctccttccctcctttctccgcgtgggccggcccagctcggctccccctcctccaagtccacataacccccagcctcctccctcctcccctcgccgacaggtggacccgaggccccacctgtcatcgtctccccccaaccgtctcctcctatctcctttcccccgaggccc

SEQ ID NO: 81050 - DNA, 2790 bp, Oryza sativa
  unsure (1)..(2790): unsure at all n locations
ttttactgtttgctaaataaaatgttttacaaccgcctttatgcaaatagccacaaaccgtccttgtgttccctttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttgggactgtttattacttgtcgttttgtgtaccctggctggtcctggacagggatttaatacacaaaatagtctggaaattttgggctaaatttctgggcgtgacatgtcgtacccggttttgcggttcagggacgaaaatcagactggacgacaaatagagggacctaagtgaacttattccaacaaagaaaggggagaatctatataaattggcaaaatttgctacaggacatctaaaaaaacgtgtaattagttagaagacaccgcaagaacgcgtttttgctgtaggcaccaaaaaaatagtaattagctaatggatacccgtgtgattattttattatatcgggaagaattgaagagagaaataactgtgtaattatgtttctaccctttgatttttttcttttccttttttttcttcattatctttttctccctctctcattctttctctttttctctctctacacccaaccaccactacgttctctccttccgctccttccgggaggacgaggtcaggcgcctcatccgctccatctccgccgagagcagcggcggcaccgccgccttcaaccttgcccgtcgtcgccgccgcttcgcccgttgtcgcggggctccaaatccacctgtgtagctcaaaaccaaagctggtcctggggttttgggggcctagggcaaaaacttatatggagtcccctatatatacataaactaatatatatatatatatatatatatatatatatatatatatatatatatatatatatatatatatatttatttatttatatagtcttattaagagaaaaaaagatagagaaattcatcagataagatgaattggacttggaggagtgtaggaccttgaaatctgatgaattggaggagtgtagtccaggcagcaggtggcaggggcagcgagcaatgagcagtagcgagcaaagaaggcgatcggtggacgatcgacacaaacgagcatggctactggtgagccgcgatttgccgacttgccgttttcgtttgcgagacgctaagaagtcgccgagagcgcaggagcagcgagcgacgtgagtagcatgcatgatgtgatcgaggcgaagcgacgggagtaagatgaagatcgcttcggcttcgctgaaacaaacttggcgatggactaaaattcattttctgtgttgggctatttagctgtctaacttaatataggcccatgtcccaagaactaaaattatacaatacataatatatatactatatgtgtacgtataaaggcccctagattttgagggactcgagcggccgcacagcctgaccccccctagggtcgccctgctcaaaacgacgcacaggcagagcagctagcaaccaaaagcaaagcaaacaatggagctgcgactgcgagcaagaggggacatgatgcggtgtagccgccgcctcctttgcagcctcttcctcgccatcgcagcgctgtgtagtgtcgcgtcggccgcggcgacgactgggacatcagctaccagttcacgtcctggactacgtccgcaagctggccgtcaccatcaacggccacacgttgggccccaccatccacgccgtccagggggacaccatcgtcgtcaacgtcaagaactcgttgccgacggagaacgtcgccatccactggcaagacatccggcagatcggcacgccatgggcggacggcacggagagcgtgtcacaccctgaagttctcctcccaagcctaaaatttaatttataaatgaccctaagaaaatgccggtgcaaatcaagagaaaaccctaagaaagtaatacaaataataatcgaatctgacatgtggaatttttcttgagttctacatgtcgaaattcactaacaggatttttagtggaattttcagagccctagaaataattttaatcaattaaaattgagcacaggcaatatttaaatccctggaaattcctttctttctttttccttttctttctccttttcccttagtgggccgccggcccatttcccctcctctctccccgcgccttgctgggccggccggaggccacgccctagctcagcccgcgccccctcctctcccggggtcaccgacaggtggggcccacctgtcgggtcctcccccaacctccagccgctcgccgccgcgcccgcaaccgccgccgcgcctcgcgtccgtgcctcccaggccacgccgtccacgtcgccctcgcacccacgcctcccgcgcccacttccccctctctcccgctcgcccgcgcttccgagacggccgggattccattttngaatcccgcctctctctcctctcccactccccccacgttggccggcgattcccgcctctcccggccacgtccggccccctctctccctatttaagctccgccgtcatcctctctctctttttccccatttcgccgaactctcccgagctc

SEQ ID NO: 81051 - DNA, 9856 bp, Oryza sativa
aatagccgtgctcacggttaatgagcaccgggacatgtattacacttggctagactctaaattcttaacttgtgggggatgggatattgcatgatgaattttatgctgatggagccatttcccgagaggagggaaggtggacatcctcagaaaaccatgacgattcaatggcgggaagctatccttgggatcacaatggatggtggacagaaccgtcgttgtttgaagtgaacactggtactaaaatttgatcagtctatgctaggtttcaggcttgtgaaaagaattgtaaaattagctttatgcaaaagaacctgaagccattccttgaaataccctctatcatatgcattgttgttgtggtggcttgctgagtatggttggtactcacccttgctattcatatatcttttaggagagtgttgaagagaagcccttgtcggtacgcttgtgtatccaacaagatgatcggagtgcggtcttgttctaggtctcgtttcccagtcgactgcctgtggcatgttaaccgggctcttatattattttgtcttccgctgttgttctctgatagttgttggcctacctggccctaatgtaagtatttaactcttttagcctaaattcattcgtgatatgttgtgatccaactatgtatgtgtgtaccaactactgatccagggattggtacggataaacacagaagatttccgatttccaaaatcgggggtcaacaaccccctaccgtgtcgcccttcgacctcatcagtcctgaaaggcaacttaccagagcggccccacttggccagcctccttgctctcctcatcgcctcgctattgtcacgcccggaatttctatccgaaattccaaacgcttacatgtgtgtgaaccctcatccaggaatcagccgaggcacacaataacaaattgataatagagtacaattattactctaattaataagcgaataaaatgtcattacagaggtagatagttcctctcaatcaataaagatctaagcagcggaaaaaagataaacgacgcagacggctccactccacaggcagcttgaccagggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaacagttaagtaataattaaacaatattaatccaacgctatacaacataccctgttgtataggcccaaccattctgaacaaccatcccggctgcacagttctatctccaaaccaggaatataccattccaaaccaggagctaatcaaattattaccagttatagcatcttttattatggtgagaagtgtgagactaatcacgaaagacattgttaggcccgcccataaccgcgggcacggctattcgaatagttttactctgatcagaggtgtaccactgtacccacaagacacagccccacatcatgtcactatgtgcctcaataccaccacggtacctcggaaaggagctgtgacaataccccttgcacaacacaatccactacagcgcacctttcctggttcataatcacccccttataaacaaggcatggactccccagcgacccctgtgggcttatctccaccacttctcagtctggtgctccgcaatgaaccatgctatacaaaaggtaaagtcgttgcccacgctggcttgtggttggcacggttaatgtttcacaaccgaaactcgtgaaccggtccttaattgccatgagcacgactctcaaaaccatgtgctcacaacccaccattatcaagttttagttggcaaataattaattaaccaatcacgattgacaatcgtgatctatcattaagccatcattaaatactagtgaatcataagttatcccaatagtgtgctaatgtttctaagcatggctaagcaatcacatctaatatctagctgaaccaatatatatagcccaactagtcaagttataatcacccaaggtatcaaggaataaagtaatcaagaacaaaagggctataacaaacaataggttaattccacccaatgacattcgaaaataaatgcaatatttgaatagaaacaatagctttaaatgggatcaacatgctcaaagggttgtttgggatctgtgtgacttgtcttgctggccttagaactcttcaaattcttctcctgcgaaaacggacactccggaaacgtcggaatctaaacagaaaagagcaaaatcaccaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaaggggtttattgcgtcagcggctagggtttgcggtggaccgggcgcacggcagcggctcacgggaacgaacggccgagatcgatccatccaaaacggacggccgagatcgatcgggtctacggcggctcacggcagacggaccctgatgacgtcagcggtgacgtcatctccggcggcggctcggcggctcggacgcgcaagctcgccggcgaacgacggcgcttcggcacgaacggagggcactaggacgatgcgggcatcgcggcgaactcaccggtgatcaaagcaacggcggaggggcaacggacgacgtcggcgacgaggtcgaagcggcggagaccttcggcttgacgacgacggcggtgctccggcgatctacagcgacggcgaaggggcggacgaggacggcggcgacttggcgaccacgatggcgacctccccgagcgacgacgacgaccggaacggcggcggcgcacggctggagcggcggcgacgactgcggcacgagatccacggcgctagggctcttccgacgacgagagacgaaggcgagggtggcggcgggtagcggcgagcttggggatccttttataggggcaaggaggcggcggcgaaggcccacggcgaccggcgacgcgaaggaaacattggggttcggaggaaagagaccgatccgattcgacctcgaatccacgaatttccaaagcgatttagacgatgattccaaaagagaaaaggtagaggagatcccgaagatcatttcccctctattgatttcaccggagaaggaaaggggcggccgaatttgggaagcggcggcggcggcgcggcgctagggtttcggccggaggaagacgacgactccgacaggcgggacccacctgtcagcggcagcgagctcgcgcgggcggctgcggctgcggactaggccgacttgggccggggagagagagagaaggttttgggccgactttcggcccaaagccaaaagagacttttaaaaaccttttttaatttaaattattcatgaaatgcaattccatttattaaaaatacttccttagctcaaataaatcccagaaaaatctaggaattatagaattaagcaaagtatttaatgaaattttatctgaccccattttatattggaatttattaattaaaattagatcttctcttctagacttttaaaaataaattctaataattccatttaaacaacaatttatatatttaggatttttagggtgtgacagctatgcccccgccaccaacgtcggcccaccgcctgctaccgacctcgtggcgtcgtcgccgcctcgccctccacccttgttcaccacccattgtcagtccgctgcccctagccaatccctctaagtctgatcccccactttcccctccctagttccactcactccaccaccaaagttctaacgctaatcttaagttggggcttgtcgttatgtggatgggacgcgtttgtgagatggacatctcgcgagtgtttgcgaactagtgtttccacatgccaacaattcagtagaaggcagaagtaagaggcaaagtgagagtatttgctgctacccagtggtcactagctaatcgatcaatcggttgtgcctaatttctaaataatgaatatgaattcaaatgatgatggaggcttcaaataagaaaagcagtgatgcgctacccgatacgttccttcatgcttcaagcttggccagtgtttttttttcttggcaagttgtctgtgactctgtgtgctacgccgacggctatgatgattggtcatctaggtcattgttgacccccactagtagaggataactttttccatggagctattgatgggatgaaaacagatatagcaaagatagtgatgtttgattatatctagaccgtagataaaagacaatggttgatattggctcaaatccacattgtgaagttaccaactctaggagatccgcacctatagtattactctcggctgatggaaacacgtggtctgtggccccgattgcatcaattatgagtggattgtctatctagccatttgattttgtttaaaaaaattactttttgaaatttgaatggttagaaattctttaaaattttgggaaactcttataaactaagggtgcacccatactataaacctaacctaatccctcctttatcagttggccactccctttgcctgatccgtcaccgccgccgccggcctatctcccatctttgtacctctttgcctaattcatcgctacccctttctaacctcctcacttccctatgcccgatctgcttccctcctctcttcccaccatgctaatgcacaccgttgccatatgtttcgtctcctccttcccgcctcccctatctcttgtcctgccctcattttccactctagcacgattctccctatcccgcatctcccccatctctagcggctcctatcatcaggcttgctacgatcaccagtccaacaccctcctccctcatggttgaggtgatctctgcctcactgcggtgtgtagtcggagagacgccagaactatggagggcgacaagagcatgaatcttgtgcatggttcgatggtgagtatattcgaccggtgtttttaatattttcagtcacctgatgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccatatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaggcatatagtcaaggaataaataatccaaccaaccgagtggttttgataatcgtaatcaaccaagtgacttgatatcaatatatagcatatgcggtgtgaaacctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccatacctggaaatatatggcatatgtggtgtaaaatccgagtaaataaactcataaaggatttaccaaccgcctagaaaatgacaacaatatataatcagcctaagccataatattggtcaataaaaatgcacacttacgtggcgaaaagcaatgatattgtatccaatcaattgcttgataaacccaaacagcaccttgactatataaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcctgagtaataaatcttccgggtaatatagaccaggtgtagctcatatgaacagtttctgatctgagtgattatcccttaggagatactccaaaatatatataataattgaatcccgactggcgcaagtattcggttgatagcccttacggggaataataattggtccagtctttgagcatagaaaatagacccatgatcatgaattcatgttgcatatatccggagcaagtccaaattgaagatataatacttgtatttgagctagtaagcccctgagcatgtagtcacaattgttcattgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcggcaacagtcaggtcagccatcaatgaagatgaaggcgcccagcgataaagttgtgtagccatggcagcgaaataatcagtcggtgacagacgaggcagatcaaaggcgatgacgaaatccaccaatcatgaagatgaggaaaatagtcggcgacgacaaacgtaaccgacagcaatgatgataagcatcaacagagatgatcaaatatgatgacgaagttgcctatcaatagcagtagagtaagctatgataaagaggtttgacaggatgttgatgaagatgacgatgtcggtgatccagtcaatagcggtgtaatagccgatgataatgacgaagacgctcatcagcgtttgcatagtaggtcaaccgtgaaggcggaatagcaagttggcaaagtcttagtcatccattagcaacggcggaatgtcagagctgatgaagcagatgtgctggtgatgatgtcagtgacaataatccatcaaactgttgtagatgcttcacttggaggaaagtatatgctgttgttcaactcattgaatctgatatgagttgattggttgatgactccaaactcccagacatgtaaatttaatcttgacctactgctctgaagcgaagacaaaattgatgactcccagagttgacttgttggctgattaattgattgcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagccacttgttgtagtaaaataacacggcatcgcatgccgagatatcgagattcacaacaacgtcatggttggtgatgtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaagataaaaacaccagtcgacggcggcataaccagtcggcgacggaagatgatgatgtccatcagtagtggtagcggtataaaccagacgtagaggcgagggcactagtcaacagcagacgagatgaccggcggtgaagaagataaggccaatcaacactggtagaatcatgcagccatggaagtgcagaaaccagtcggcagccatggcaaacgtaggcagcttgtgttgaagatactgatgcctattagtagtgacagcaatgtagccagccgtgaagaagatagcatcagttggcgttataacaggccagccgtgcaggcggaaacaccagtcgggggcggacgaggcggccggtcggtgaagacgtagacgcccaacaacggcggcataaaggccagccgtgcaggcggaaacaccagtcggcggcggcgaaggcaaaccggtcggtgaagacgtagacgcccaacaacggcggcataaaggccagccgtgcaggcggaaacaccagtcggcggcggcgaaggcaagccggtcggtgaagacgtagaggcccaacaacggcggcataaaggccagccgtgcaggcggaaacaccagtcggcggcggtcgaggcgagccggtggtgatgttctgactgatccattcctggagcgtaagagataagcttaaagccatgaatcccttttatgcatatctggatctggatcctgtagaacaaacatataggatgagtagtatctgatataaatataatactcgagaaaaaaatcaagtattttaaaatatttataaatatgtatttctcctcttgtcaattttgatttccccgagcagatgtttcattacgtttaaacgctctgcccaactagtcatagccaccaagcactgggagtcggcctaagcacttcccaagcatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcggaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcagcgaaggtgagccaacggtgaggatgtagacatccaacaacggcggcataataggccagccgtgtaggcggaggcaccactcggcggcgacggaggcaagccggcggtgaagtcgtagacgcccaacagcggcggcataataggccagccgtgtaggcgga

SEQ ID NO: 81052 - DNA, 9553 bp, Oryza sativa
ctagatcccgtgctgaatgcggactcagatgcaactgacgaagtaggccatgctagcacatcatgtgctatgctagcgatagttggatactttgagtgattggtcttccaccaatttaggatgtcaaatttgttcccaaattgctggatatgattctatttgaggtacatatccaattcagtatcaacttgctcagttaattgtttagtgatgtgttgaacccaatcagcaataggatcattttctgagatagccatcacatgttcagcttggcgcagagagttagcattgctatccttgagtttatataagtactccttaaacaacatgttcaatctcttcgtaattttgtcaatcctttctttagcattttcaccaaaggcttgcccaagccgaaattccacaaccatgaatttgaatcttgggtcaaaaatgacaggaatgcacagatatttgtaagacttaagccaatatttgtcaaatttatccttcatctttttagccatacttcccacttcagtgtcatagttagaatgttccttttggtgccaaatttttagggtcggcccgtgaacctaatgggccgatccctatgcaggctgaatcccatgcttttagttcacaaccacaagttgatagtgcagctattcccagtactagaaaaacgattttcacaggcgaggttcatgttactatgcatggcggccgaattttcgaccccaaacggccaccagcattattgtggatcgggggtgcaatggccatcctgtaacaccccaggtaaccacgtacctagagtgccacagcaaaaaatacactcaaaatcactaactctcaaaattattagaaatttcggtagactctcccctaaaaatacggacatccatgacagacagtgtagcatcctgaaaatgtgtcattttctaatcctgcatcatgccgcttcttatgttcttaataattacctaagcctaggacaatataattagagggacctcctagaactaactcgcacaaaacctctcaagtatttaatttattttgtgtttttcatttaaaaatatagatttggttaaattgaggtatttcttgatttggtttaaaaccttcttttgactaaaatttttttatccaaatttagtttgaaaaccccttttttacttttatgaattatggtccaagaaaatcctccaaaccaaacctttcctattccaatttggaatttattgttaacccatcctttgatattaaacctatgcttaattctccttccaatattccaatattcaaattccaccttttgatctagccaccaatttaatccctgtagcttgatttcctcttcggcacaagaatagcaatattataaatattcgtatgattgctcttgtgctaagaagaatagatttttattttatcctcctcttccaaatcaatttcctttgagccacaaataattttctagaatccatgccatatattttacggctcaaattaaaatcttttgcctccacctattttcctaccacattcctacaaatatatccaaattaggagccttattattcatggtattatttctatttgagtgcttccaaaataatttccctcaaattccactctacctctaaatttactgcactcaaataaatttgaattcccttaccttcaaatttatctccacatataaattcttttcaaacttagccacccaaatcccttctaaaatttagaaaaaccaattatactcaaactgggccaaaaccctttccctcctctaccccaagtcggcccagccaccacagccgaagccgctcctttcttctcccctttgggcgccgccactgtgcacgccatgggcgtgccgccgcccatggcatggcgccatcgccgtggttctcctcctgccaccgccgccaacttgccaaccacgccaggtcgttgccatgccgtgcccttctcctccaccgcccaactctaccacggcttccacgtacgcgcgcggcaaacgtcgaccaatcatactcgaactcttccgaagactcccggactccgatttatattctattcctactccactagcttgagactactaaactaagcttgagagaatatgagagagctctttctagaggtgtgtgaagaaatggagagagtgaggggttcggctcgacggctaggattgatctccaatgacggttggtgggtattaccaacctttccaaccgtcataaacatcattaccagccaagtctgcatccatcggtgctacggctggtttggccgaaccctgggctggcccaaccagcccagttcctagcaggcggcctccactcctgttcttctccgcaaacttgtgaattttggcccaatttgttgtgtcatttctgagtttttggcctattcatgcataaatctgattctcgacatcgtccgattgattgatcgtctggtttgatgttgattctccttcacttcattgttattctctgcaaaaggttagtaaacctaacactagtggaatatttttattctaatataaatatgcattgcaagtataactagttctcctctatttttggtaatattgatggtcgaaactgatcgctaacaaccgttaacaactctctcggttcaatctctctctcgcacttctctcctgttactggtacctccctctgttgctgtgctgctactctacttccctggttctggtctcctgcgcgcataggagatcaggacgagcagggccttcggaaccttgccctcctgacgatctgcacgggtaggcgggaaatcagggttttggggagccttcttcaacgcaactactcttctctgcatcctcaccatgtcggtggacaacaccaatggcgcggatgggaagggtacggctggacaggatggtactggaggcttcgtcaacggagacaattctgcctcacaatcccgtggagggccattcattgggtataatctctctatactgttgtttactgcgttctttcttattgtgtttctgtttagcgcaatgtttttgatgcattgccgtatgatggatgtctatggttattatatattaagcatgatccgttcgttacatttgtttaacaattgcactagtttattccttgttaaagtcatgattattatcttgataatttggattaaaatatgccgaattgtgaccatatatccaacatcaaggcccatatttggtccggtcattgggttgcaagtttaggctaaaatccatacatattagggaatatccaccttgcgcaaacggttctacctgcgtatggagccctgagaacgcatagggcccccaaggggcggatcaaggctagggatctcctgtgtcatctccattgaaataaaaagcagtataggatagcataaatagttaacctgaataatagagttgacccagctaacctgggatttagaaaaagaagaaattaatgttatccctcaaaatccatgtatatattgagctttatgctttagaggtttctctgatttgaggatgctagacttatggcaggcccctgcccccttaaagttaaatatatttaatggcttccaagcacagataggattcagccagcggttgaaccgcaaaaaaagaaaaaaattggtagtgctctgacttctgtaaattttgtggagatttagaaccatcccaacatattgttttcaattgccccattgcaaagtttgtttggtgtatgcgtagagatgccccgggcgcatgaagccccctctgattttgaacatttttacaagctggtaagaggtagagctggagtaaatcagaatggagttataattacattactagcaacagtgaggtgacaactttggttaactagaaacaatatgatggttttctagatgtatggttcttcgaggtaagattatgaattttcccttaataattaattatctttcaaatggtgtttcttctcagtcgatagaagaccctgtaaagcctcaataaattgaattcatatagaggcagtgacgctgaatatattacaggtcaattctcaacttcaggcctacactagaacggataccctcatctcaatcgggcggtaagccccatgtcaatcgggcacagcgtccatcacaggctagaagtcactgatgtgaagagttatctcaattgggcaaacggctgtcacgaatgaatatatctcaattgggccctaagtaaagcccgtcatcgataactttgacccagacaaccagtcaaactatagcccgtcacagataacctatctctatcgggccacaactagcgcccgtcacagatgactactaaccttatcgggcctaaactagagcccatcacagatgatactcatctcaatcgggtctaaactatagcccgtcatagatgactgatgacctcaatcgcgcctaaaatagagcccgtcactgatgactactgacctcaattgggcctaaactagagcccgtcacagatgacaactaatctcaatcgggcctaaactagagcccgtcacagatgacctcatctcaatcgggcattttgttatggcccgtcacagatgactataatccaaaaaaaaataaattttgttttttggctagcctcaggcctttgctagccatgcccgctgcaaaaatgacagaaacaatcacagatatccaatatccccagctccccagcatcacccattcatatacatatgcattcacatacacaaacatcaacatatttcacacaaccacacattcacagccatctcatatttcacatccattcaaatatttattatatttcacctgcaaaaccgagttaattggataaaatatttatttagcaagtcttaacataaacatatgaaatatatacataaatatgaacatcacagttacatcatcacagttgcataataagtgttcatcattgcctaaacataaaagttcaacattgttcatcattttagtttaagcctaaacattcctttggggttaattatttcgcggaggatgaagctggctatctcctcgcgaacctcctcaaagctggtaggcagagacttggttattgtgccctacattgtcataattccagattagttgatcgatcatatataagtactaaaatgtagttagtctatcacaattgagaccaccgacctcaaactcagccaaagtcttcaccttttctctatacagaaggcgcatgttgtggtacatatggaattcgcactggtcacctatttgttgcttcacctggaagtcttttttgtggatgaggttgtcatgtcctgtcttcctgaggcctcctcttcgcacgtattgggcccacgcttcatctatcgctagttgaattggggtccaatcatatgcgttcttatcaattctggagttcaggtagtgatatgtactccacttaggtgttatgaccagaaggatccaatgggcactgcggcattaatatagtgaaagttaattaagtactcaaggaatgtgtcatgctgttgtgtatatttagttaacacacttactattaattataggcgcacataatgtactccttgtctcggtgggaccacaaggtgtcgtagatgtagttgaccattccttgacggtcattctggagatttgtgacagtgaccacttttggatcaaggaaggcaacttccggtgcatgcttctaacaccattgccaacttaacctacacacaggataaacgatcttgtaagcaagttaaaccgattgttattaccagattgagttgggcaacaattcttacaaggagtagcacttaaggaggcttgtgtccaccgctcggagcctgtagaggtcgaaaagatccttgaagtcgaccacgatataatttttggaccaaggaatggctttccatcgtgctctccaaggatatcggtagctttattcagcttcctggcgttagatttctccatgtagtataagtgaaggtccttgcaagtggtgcccattgcggcaagcacgccatctccaaccaatggcatgcctagttggaactcctgtggagcgacgtattttttcttgccctctttgcccttagtctcttcctgacccttgccgagatctagcttccttggagctagaagcgaggcctgcacctttcctccccttcctctcccctttgcttcgggtttatcgagagtaattctttgaggggaagagtgtgccttcctgctattcttcatcggtgggggttcatgaatcgccttgctgtcggcctctgttcggtcctccccaaaatccgtgtcgtactgcaactacacatcgtaagattgtgcatgacgatcttgagaaggaggtgctgaaggagcagaggcgggtctctttggtggacgaccgcctggtgcagtggttggcctcgctgtaaccctgatctcaatgtggtccttgggccattggatgaaggtatcacgggcatttcctagtgagaggacctcgtcgttcggtggatacttcagagggaacagctcgtattcgggcttcaccgagtcgacttgaacttttgaacagtcggccctgagttgcgctccatgcactcttgtctctggggtcgacttgtacgcaagtccctcggctgctggaaccatgaaggtcggcatcaccctaactgtgagggtgcagctcgttggttcctgcgatagattaatcaattttttttagaatattatatatcatatggattcgttatgtctttcatgtattgagtaagttcacggttaccgttatgtggtcgactgcactgtcgaccgatgttggattttccgccaactcagtcgatgcgcaactgctgcgttttttggtgggacttcctaactcttcgtgtgcaacagtagcggcggcctgggggttctgttgctcttctcggatctcttgcctaatcttggccctcatcaactcgggcttttcgtcgaattcagatgtcagctcagctcttatcgacgcctggatcttggcttcaaggcttgtatctttctccgccttgttggaagtccgcttcttgtactgccacgcgtagtctggaaatccatacttccagggcacagaagacccaacgccctgtgtgcgtccacggtgttccttgttgcccaacgctttcgtggggaggtcgtcctctcgtctttgagagcaggcctcttgcgaggcttgttgctcggcaaccaactctttctgcattacaatttagtggggttaaatagactgcacgataggaaacaatgtgaacatctagtttgactagacacttactatagcttcgtatagtccttgatcttctgcatttggcatgaagattgtgccatcatcattcttctggtacctggccctggcccagttcctagcccgagggtgtgggatatcgccaaacacgagcggtgtgcacgattcttccgcttcttcatcctcacgctgccattcctcttccttaccggcttatccggcggtgccaagctagtgcggatgttggttcctggtctagagcaagcgatatgccttgcttctagctcttgactctagggtcgacttcttcacatggaatttctctcttggatctggattcgccgggttgtagatgaactcgcctactagcttagtcttgaagttcttctaagcattgcccataaccttgaaagcagcccgcctgagacggtcctcatgctccgcaggataatcaaaactctccttgaacgttagccaagcaatgtccttctctgcggcgggcacgaacttgatgtcatcttgtagaatactgaatttctgcctccctatgaccccgcagatagacctaaatcggctcaatattttccttggagttgtcggataccctacggcgtccaccactgttatgcggaaccgttccttagggattttgttccctgtcctaggagtaggtgcccttgaggacccactagttgtcgtcgatattggttcgccttgctgagacatcgtctactttttttcaaaataacaaaaatacacaattgagtgctacaatctattacaatgaattgaatgtcacttataaagataaatgaaacatataaataaactaaattgcgcatctcacagtaataaaatgaaccacatttcacatatcatccacatccacatttcaatgacatgtcattcacagttagcagagggcggtgcgatggaggactcacctgaggatggccggtggggctcggtggaggcggcgccgggctcggtggacggcggtgccggtcggtggagatgccggtcgggcaggtcggcgccgggtggtcggcgtcgggctcggtgggggtcggcggcgtgcgtcggtgaggacgcgggcggcgacgacgaggaaggccgacactggtccggtcggtgtagaggctcggtggtggcggcggcgggcttggtgggggtcatcgttgaggaggcggcggtggtccgaatggaggaccgaggaggttcggtggcggcggccgtgggctcagcgtcggttgcgacggcggcaggcttggcgagggaggatgacggcgttggcggcgggctcggtggcggcggcgccgggcatggtggagggcgtcgccggtcggtggaggtggcgccgggcttggtggaggcggcaggctcggtggtggcggcggcgggctcggtggcggtctcggtggtggtggcggcgagggagacgacggcaaagtaggagttggcggcggcactagggttctaaggaggcgggaaactgtagcgggacattgaaaaatgttcgatccgatctgagaaaccctagttatagtagagtgatgagtcatctcaatcgggctttgccgtagggcccgtcacagatgactcatcggtgacgggttccatactaatgcccgattgagatgacattcaggcccatcacggatgacttatctgtgacgggccctaagataatgcccgatagagatagattaatctctatcgggcttgaactaaggcccgtcaccgatgactatttttctatttttccagataagtctttatatttgtgagtacaaaatatatagctgctatataataatttattttattagtcataatacattttcagatagtaaatgatttcaaatcgaaatatggtcaataacaaaattgtagtggttatcaagatctacaacttttattttggtcacttgtctatataactttgtttccaacagcttgaaattgactttgacaatatgataaatctaaacagtatttgtaaatactaaatgatttcaaatggaaatatggtcaaaaacaaagttgatcctctcatcaggatctacatcttttattttggtcatttgtctatataactttgtttccaacagcttgaaattgattttgacaatatgacaaatctatacaacatttgtaaatactacatgatttcaaatggaaatatggtcaataacaaagttgatcctctcatcaagatctacaacttttattttggtcacttcttcatccgacaaagtgatagttatactatttacaataatcacattt

SEQ ID NO: 81053 - DNA, 10603 bp, Oryza sativa
  unsure (1)..(10603): unsure at all n locations
gatctgacccttcactatcagatactctgccgccatggcttacgaggtgctgggtcaactgtcgtgcacctcggaaggtatttcctctttgacgtctaggaatagttatccctgctggaggccattcggtgctggtaatagtcatcttatgtacttcttcttcagttcgcatcggtgcttttctcttctgattcttactcttcttgcctttggcttgcttagtacgtgaccccatgtggtacgaaaggctaggaggaaagcaattctcgggattcaatggattctctccattgggctctctactttgcacactaggctgcaagcttgacttgctgcgaggaggctggtttagcgatgtctgccctgctaaaccaaaggaaggggcttctttggcatatacccatggacaattcagggcatagtgtcctcgttctctacaatcgtgacaaaaggggacatcctcttctggcattggaagctcattgacctgggtggcaaatgctcgatcaaacacataccgattttggtcttgacttccaaccaatggtagctgtgaactaagcagcatgcttggaatggaccaagggtgtgcccttgttaactctcttgaggccagtggtggattgagttggaaacttaagttactggaggcatacccgctgacattctttcctttttctctgttaaacatctgtgatagggattgaggtgagagaggaaacaagccaggaaagaatagaccagaactagggacaggaccttaaaggaactaactcttcttgttgatgtgttgtttgtttcacttattctgcaagttgattaagcaaacaacctagcatggttacatcacacaccactgatgcaaaccacgcgctacacacacaagcaaaggagcacacgactaacgaaacactagagggtggcttaggttctgcgacgggttctccaagatcttcactcctgcttcacagctggcttcattgcttccttcgcttcgctagcggaccctgcggtcttccggaccttcggcgaacaattgacgacatcttcttcttcgtaaaactaaccatctagtactagctgaaatttgaagaaggaagaaagagtaaacattttgcaaatagcacaggggaaaggaggaaaaagggactttcgcaaatagtttcgtttataaaatatgtccttaggttttatccacttggcttatcctacagtcgagatggctctgataccagcttgtcgcgaccgggaaaattgccttttcccgaacgctagtgtattaattcccgtcccaggaaaagccggggtacaccacacaaacatgatataaaagacacatctttattatatcgataatatttacattattacaaaggcgcttcaggcctggcaatcaaaaataaacagcagcggactagcgggcctacggctccatcttcacaggcgctcaactggggtataagccaggactccacctaagacatcttctccaaagcttctcttactgaagaggggaaagattgagcaagaataagtacaaccacagtactcagcaagccacaccggagatgcataattattgcaagggagtacaaggggataataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcctagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccatgtgccacataccaccacggtatacggacggaagacatgacatagtttccaacccatcctagccataaacaagagtaccgacccaaccccacctacggccggaacccccgggacaggtaggcaggactgagcccctaacagcaggacaccggccctgtgccatgacatctcgactaccgggccgcagctcgtgtagccttcatttgccctagagatgtccatcgactccgacttcgtccatctccatccgtgtacttttgtttataaccagactgagccacaaactaagccttacccgctagacatgtggaagtacggtagtgctttgcaacagaggcccgaagaccgatccttatatggccgaggtgctactatcaaaaccatgcaccctgagccttgcctaaaaccattttgagggttttgaatagagggggaggtgtgaatccaattccacaataatccaaccattccatagtgtcaaggtgataagagtattcccaaagtctagagttgtaaaaccacctaatgttgcctaattaacgagcgaagcatctacctaaaatcataccagtggtaccatgagtagagtgtccactagttggggttttttttaatctagggtgaataaggtaataatatcaataacaataataataaggttataacaaaggttaataggcatggctaaataaaacagtgataacgcgggagtttaaataaagcgataatgcaataatttaaatcaaaataattttataaacaaggattcaatatgtacaaggacgatgtgacttgccttgctcgctttcccaaacgtcggcttcaacctccacgaagagcggatattccgaagctgcagcgtctacacgaccaacggaaaataatagggcttttactctaataaactccatataacaagtaggaacaaagcacaaaaatgggttcttgacttcttaaggaaaaattagagacttgaacggtccaattccgagttcaaatggccaagttatggccatttgaaatttatatgctctttaaatgaatatttgcgaatttcttcatttaaattttaatttaaaaagtgtttattgcgtcagccgaggggagggggcgcgcggaccgggtccacgggagtggggcctacgcggcagcctcacggtccacggtggaccgggcgcacccgggctcacaccggccggcgtcgttggccccacgcatcagccgcacccgagggcgcgggcggctgacggccgggccccacgcgggagccactcggcgcgcccgagggcagccatgccggtgcggtcggcgggaggcagcgcgtccgcgccccgatggtcgccgccggcgaccaccggcacggcggagcggcggccaagagaggggagggaagggggaaaggaggcgacggtacacacccccggggcgacgacggcgacggaggaggcggccggagcggagggaggcggtggcgcggctcgggtcgatggggacggcggcgctccggcggtcggcgaccgaaacggaggggtggacgaggtcggcgaggatgcggcgaagccgaaggaggcggcgccgaggtgggaggcggctcggggcgacggcggcggcggaccggagctcggcggcgacggcggagaaagagagcgacgtcgcgagcttgaatccggcgaggaggaagggcggcgagaggcggaaacggacggaggaggtgcggggagggtttaaatagggttggaagggggagagagcggccggaggggaaggaaatcggcgcgggaggtccagccgccatcaatggcgccggcgagatttgcgggggcaaatccgcccgtttgaacgcaagagagagatggaaaaatggggggaaagggagagggaatcacggggaatgattccccccactttattgcacgcggggacggcgggaggcggcgggatccgcggcggcggcggtgctagggcacgggggaaggaggcgggagcggcgggaggaaggggatgacgggtgggccccacccgtcagcgagggtggcgggcgggcccgcccgtcancggcgcgcgcgcgaggagaggccgagagggccgcggggagaggagagagggagaggggggagaggagagatgggccgggccggccgaagggagggaagggggacttttagggtttttctttttataaaactttttcaactttgtttatttcttaataattattatttgtgctctgaaaattccactaaaacttatttacacattttaggcttttaggaaatatacaaaaatcctctaagccttgtttgacttttactttgcacattttaatttttggaggctttcacccggattttaattattctagccataatttaaaagaatatattttagggtcgttttgggacgtgacagtggacaacacatgtaatcattgtttcttcttatccgatcctcctccgcggcgttcatataatttattacgccctttctgtacttcgtagaatgacgtttcaaatttttcgcatacatccaacttcgatcaattgctacaaaataaaaaaacaaattagaggcacatattataagatcagtattgcaaaagtaagacgtgatgaaattgttcaattaatgattaatattactcacttgattgatccattttgatcacttttgggaatttaatttctgttttcattggaaaaaggacaaaaaatcgccccctacagcctcccaccaaaatagtgaacagtgggatacagttacactaggtggtggggggtatttatactgtgcaacaaatatctgtaacggccctaaaacaatcaaccgtgacgggcatacaagtaatctctatcgggccttaataaaaggccgtcaaaaaaaagtgtcatctatgacgggcactaaacttatctcaatcgggcctctagttagagcccgtcacagatgaccctcatctgtgacgggcttcttttagggcccgattcagatatggaaccctcatctcaatcgggcctcaactatagcccgtcacagataagtgtcatccgtgacgggctttagttttatgccgatataccatggctgtgcgaccatatctcaatcgggtgaaacttcagcccgattgagattactttcttgtgtcggcccgcaaattccagtcttgttatgggccgtcacagatggaaagatctgtactagtgctataagatctggaattggatagtcccggcgctagttttcctttcctgcttgtcgagttcttgtttaaggtttggctcagcttcatggtgtttgtctggcctctatgattgctataagcggtttgttgcttcacagacctgcttcggtgagtttcttaggttaccttatgttttgatgctctgtatggctagatggagtcctcaacatgactttttttataccctctcgatattacatggcatccttcctcaatgtcctacgtgaatggcagtatttttctatgctttgctgaaacaaaattatcatcacttttcaacaatcatcatcgaccatagagcattttatttgccctagaaagaatctagattctggtctccaatgccctctgtggcccgatttgcttataccacttttggatgagcatatctcagttgctttaatttcggtttgcttgttataagccatgtgagtgttcttccaagaggagttgaaaattgaatcgaaacaactatgaattcttatcgacttatcctattatactttatagaagataatattgtttagtagaagaaatcactacatatataatggtatatcatggaggggtgagctcacaacaactttagcctgaggccaccccaatttgccgacaagaaacatatataggctttggaactattgggaagtttcaaagcttttagcactgttctatttagtagacggtagtatatttccacgtagaaaattgtgtgtggccaaaggctattctgcaagcaaacctttgtaaaaacgaatgctaagcatgctgctctgttatctcttgaaggtgaaaactgcaccccatgcttcttggtctcttggatgccttctctaacttgccatgcatagacagattacctgcaaccagttgtacaacattattgcatggataccataatctcagggcatcagtcacacacgcacatatcaacattggaaagaaagctgcaaaaacatttgaactgagttgtctcatagttgtgagttgtgactacccaaaacattagagacatgagacatcataatttaaatagatcgtggtcaaaatattgacaaccatcaagagaaatggggaggaaaagaaggtcaagtgtcaagtgtgcggatgaccggcgagtaacctatcactactggagaagtgatctttgcttggtcagccaaaaatcacattagtcctggttcgagtaggaacagagagtaaaaaatatctttagaaccggttttaaagcctaggggtacgggactaaatatcatttttagtcctggttcaatagctattaggtccccaacaaactttagttccggttggtatcaccaactgggactagagatcagatctttaatcccggttggtgattccgaccggggctaaatatctctctcccacatccgctctctctcttccttatcttctcctctacttatcatctcctcctcttctctctctatctaccttatcttctcctccactccttcccttcccctctcccctctccagcgggcaccctcctccactcctccctcttccagtgggcggcgtctatgttaacggtcattatcgatcagtttcgaccgtcaatattaccaaaatagagaactagtgatgcttgcaatgcatatatatgttagaataataatattccactagtattaagattactaaccttttacagagaatgacaataaagtggaggagaatcgacttcaacacaaacgataaatcaatcggacgatgtctagaatcagacttatgcatgaatgggccaagaactcagaattggtacgatgaattgggccaaaattcacaagtctatgtatgagagcaaaagaggaggctgcctgccgaaattgggccaggtcggcccagcccatggtttggccgaaccattgggttcggccgaaccccccgcagcgccgtttgatccaggtttctcctggacggctgagatgactccccaatgatggttggtgggtatttgttgacgtaacacgaggcctgggagatctgcttaactccagtgcaggtccaagactcgccttcgggtatgcaagcgtgccagttgatttgatcctgcaatcaacaagaaataaagacgaagaaactgcggttaaacctataaacgatagccgatcggctaggtgccgatgacatatcatttatctttgagccgatgtcatatgtaaattgatcggcagttataaatagataacaaagaactaaatctactcgatcggctgtaggtatcaacaatatatagttcttatatcgatatatacttaaatcaagtgattgggatagatcggtcaccatgccgagacagtataaatcacttaggtcgaagtatatattaataacgggactatatgtgtttataacatagccgatcagatagatctagcatgtatcggctaatactccgatacaactctatgttaagatattaaaacaagcagaatataccaaacgaaagcttaatatgcttagatgcgataatatctttacataaagggcagatttaacatgtcaacgaagtatatagagcaaatatagttaaatcagataaaatcggctgaaactccgacactaccctaattggcaaccaagaagcaggctagagattaatattctaagtacgacttaatagatcaaactcaactgatgcagcattaagtatgaaaagaagaacaatatctagacaatcaagccactggaagtttcatagagtggtagatatcctatataaactaaacaacgtcattgtctaacctaatcggctgccctcttccaacagatgttagccgattgtaggttagatagcgatattgccaaagattatgtaagatatatgataactcgacggattacataaacaagattagagtatcataaagatggaagcactaatcccgataacacaagccgtcataacaagttttacctcttgttgaagatcgaaactgatgcagctcaacccgaaaacaagaactcgtcgaaataaatctaaagcaaaagggtggcgatgcgccgaaattgtattgaacgtgtgtgttaattgattacatggggttcggggtctatttatacccgaaaattacaaactatgtccataccggacacgactcttatctctaaaaaactctaagataccataagtctttgcggcaaacttttgcccaaacatatctctaaggaaattacataaaatatcctaattaatagatacagttgccttctcagtactctatccatgtacagtaatcatcttgaagtacctcaattcaacccgatgtcaaacaccaagtcgtattgttggaatcgtattgtccgactcagacccagccgatcctaatcgtagccgatctagagtccagcagactcttgctctgttcacgaatcgatctccgccttcgaatccacttcaatctaatcttcttttccgatgccgaaattaccaaatttggttgttaacacatgccccccaagtccgaaatatttggtaatgtttcggatttgctatatatcaactccgagcaattctcgcactttgccgttttccgaccgttattcccgtgctttaaatactaaccgccaccctcgagaaatcttcaccccgttacttccgttttcaccgccgaagccaaccttctcctttctctctccggcgattccttcgacgctcaaggcgatccccaagcgatttcgtctccggttagatctccgcccgcagcgatgtcgtcttccgccagcccatctaccgcgccatcagcggagtacgctgaggtaagttctcatcggctagatcccttttcctcgcatgaaatcgatttcccccttcttcatcttgtttttttcttctcgattcctttggatttgcagcacctttcccatctagttgtggttcccagcctgtcacatgaaaaccactatttccttggtccaatcggcaatcttgaccccactaattttatcattggtgaaaccaacagaatcctttttagattagccaaccctaatctgggtcattggaagaatactttcaagttgtggccatctcttgagaaaaccacccctgagaagagttggaccacatcgtaccagtgcgtatcggctactaagaaagttcactgggatgagatttggatcagccaagtgcttgccctcaccatagctaattccaccaaggacaaacctctgatggctgctgccacctatttctggtcccacaccatcaatgccttcttgctcaaccaagggccgatgactccaaatttgatcgacattaccatgatcaccggtttagatgtaacctcatcggctaatcccatgagcatgaacaccaaaaatcagtttgattttagaaccaaaagcataggtggttggtctggctatgtagcagcatatatgggccaaggatccgttactcctcgagaacatgtagctttcttaccaagtggctagaaaaattcctcttctatggatccagctgtggccctacaaccaattggcaatttgtagccgaagctctagaatcagagaaacaatttcccttgggcaaaatcctccttggctatctataccaaacattgaacaatgcatcggccaagatagccgtcggctcagtagttggtgcaggtggaccatggtgtctgctgcaaacctggttgaacctgatggtcatgaaagttgtcaatcggccatctgtgacagaagctgagttcccattcccagagccgattgtaggagttgatggaaaagaacgcactcatcgcagatgcacatcatacggagaatatgcatcctcaccaaccgatcctggagcaaagctatcggctgagctactcaaggattggttctgcagcttctatgaaggctttcagaaagacgcccgggtttggttcccttatgaggactcagcagatcttgaacttccatcagactttagatttgaagatatcaatcacgaaaagtatcaaaaatccagggaagttcttacagctgcaatcagcccatgcatccttcctgtcggcattcatcagggaagaaatatccaagtttcttatgagttctaccacccaatgagctcagctagacaatttggactaggccaactcccaatcggcttattctttgccgacaagatctagtgccgaggagaaatcacatcaactctaatggtggatcgactacttaacctcccaggagcccctctgggcagcattgacaatattgagttggtaggatttaacagcagaaacttcaactgatggtggggtgaatggaagctgcacttgtttcatcaatcggcttcgatgtttatgacagatctattccctgatgtcataccccaggtaaatctcatcattattaacttgaatgttggtt

SEQ ID NO: 81054 - DNA, 11263 bp, Oryza sativa
gagcgcgagggggcgcggcagtggcgcgcgcgacagcggcgacgtgacggcgcgcggcggctcgaggcgcgaggcgcgcgcgggagggaagatgggacgggcgcgcggcggggcaggggcgcggggcaggaggcgacgatgtgacggcgacgacgatggcgcgcggggctcaaggcggcgacggcgacggcgcggcggcgacggcgacggctcgacggcgacggcgatggcgcgcggcgcggggcgcgagctggcgcgcggcagcggcgcgggcgacgacgatggcgacacgagcggcatcgggcaggagaaggaggagggctaggacggctaggaactaaatcgaacacctagggggctaatgaacagtgctagccggctatttaaccctattttagcctatttcctatataaattttattctataaatcctaatttttacacaaatgaagtttactcaatatttgtgttattctaaccaatggattcaccctagattaatattacccatatttatttatttatcgcacaaatgaattctttttagattaatttgagttattggccctaaggtgaacttatatatttttgaagactttggggtactattaaatttaatataacgacttgtcatgattaatacattagcagattggttaagtttagttgtatagcaatatattttacacggataggttcaatctatttattctataaatagtaaattgagactcggcacaatattaatctaattatttaattaaaacctcacaaaattttataaagcttaatttaattatacgaccattatttcatgtgaattggtttagctttatatagaccattagagtttagtaatatcccattaattactcctagtgaaactatgtcatagatagagttccattataaatggtcatcatttcatgtgtatttagacgtcatgacacgcaacacatggttcacgtatttagtatttaatccataatttaaattagtaattaactttccatttgtctggctttgttttcttgtgcgtaattatttgtagggttaacaatattatattctcgtaaatttatctattacttaaattttagatccttactttactttctttgtgatcatttacggtttggcaagcaatagcaatcataacaaccagcatgatgcaaaagttttaaaaagttcaaaattttagtgatttttattgtctttgaattttcaggatgttacaggggtggcggtggaaaaggagctgaccttgttgcttgacaatctcattagaggaagctcgccggagggaggaagagggagctcggtagagagaggccttcgccatcgtcatcaccagaggagcaccgctccactgtgtgccttctttttcattggagggagctcaccggaggagggggcttgccgaaggatgtggagtgacctcgccggagggttgttgtcattgcagccgccgttgtcgctcgcggtcgagagaaaaaggaaggtgcgagacagagagagagagatagagagagagagagagagttgggctgggctgctgggcttgcccattagaccaacccactggtacgggggctatggccatgtgtcgcatctatgagatgtgctttgccaatgatctacacgatgagatcgagaatgatgataccacaaagtgtatcaggttgcatcggacattgggatgctcttgctcgagcggtcaactagtgatacgaggaagatgagtgacgtggcaatatcaagtccatttgaaagaaatgacggttatgattggctcaaactagaaaaatgcccatgcgttgtaacgggaaagtcattttttcagcgatacaacaactattagaagccgagcaataaattgaaatattgggatcaatatacattagaattgaaacatttaataaaaatcctaaaactgggattgctatacattacaattaaaaaagttaataagaattcatccttggttttggaccgaaaacccattcaatgtttccttttcagccctaagccaaacctttacctccctttgctcggcctgcctcccttccgcccatctcacaagtggagttgcaggtccaacttgcacagccgacaaccgtcttcaacctctcgaacatggtcccatgcccgtatgatgccaaagcagatcttccccatcaaatccggtcgaacatttctcgatctccaaaaattggttgagggcttttgatcccttcgatatcctctttccgttcttcccaaaatcagagtgtaaaacttgagataaaaacgatcgaggaagatcgcccatcgatcatcatcgcgactgttaaaatgaagattaaatccagtgaattaaaactgaatcgaaaggggaaatcatttagaaaatgatgagggacgaatggggaatcgatttttataatcaattggaggaggaaatgcacgattgacatgacggcggtgcggcactagggttcggcccgtggaaggcgcggggttcaacaaatcggatcggatctaaaaacagaaaacacccaaaaaccacacataattactaaaaattatcattaaaataaaattaaattccaataaaaagctttagagcgtgcgcacaaaagaaactctttcgcgtgtaaaaaaatgataggaaaaaataccggcgccataaaaaaaccgaacagacaaaaataaacataaagctttgcgtatttttttattaggtatatataaaaaccaagtaattagctgtttaattaaattaaatgtaaatgccttacagcttatggctggtgaaaatttcgaaatcgaaggacacgcataaggaatcatctatactaatataaaaaggaggagttgcaccctccaatcctacgtctccaatcctacgtgtgaaatcatccggatcaatcctaccgtccatccgcacacacgatttcactaccgcccgatttactgtcgcgaagactactctccatccacgcgcgattgcgcgaagacatcgctcctcctctctcgctcactcctcgctcctctgtactgtatccgaggtccccttccgccgccgccggatcctaccatccgccgtggccagctccatacgctgcggccggcgctcctcctcctcactccggattactgccgccacgcatcctcctctctccggattactgccgccgcatcctcgccggagccgcttcttctccgtccgccgccggagcaggtcccattccgccgccgttggatcctaccatccgtcgcggccggccccatccctcatgtgcgacgagccgtaatccgccgccgccttctccctcttctccaccgcttgccctaccccgccgctgccgcctcctcacgcgctcgcctcccctgtactcgcaccgcgggcgtgagaggccggagagacgaggtcgccgtcggccacctctaccgctgtcgccgccttctccctctctaccgctcgccctacctcgcctcctcgcgtactcgcgccgcgggtgtgagaggcagatcgccgtcggatgcctccaccgccgccttctccctataccccgtgctcctcaatcctctatagcaagtcctcgatccgcgcctcctcggatcctccgcggcaagccggcaatccccacacccctgccacttttgtcgccgtcgtcaacatcctctctgcccgagcccgaagcctcagatctacgctcatgccgccgccgtcattgtgtgactccctgccatggaattgtggccacgccacctcggcgctgttgtccataccctctccgcctgagcccgaagcccgggatacacgacctgaggtcagcgtgcacttctgcctctgtagccgagcctggcgtggtgctgactctgggagaagacatctagtgtagatggctcgacctcttgctgcggcctctgtccagtgcccgatgccaggtacccagcagccagcaacctgcggccggtatctttgcaccgtgcgactgattttgtacaactattggaaatctttacttttggttttggtttggtccggcatgattcaagatgtatgtttctgctctcattcttgtgtttatgtgttttggtgcagttgcaggctggaatgtggatcgaccacatcgtgatgattgggagcattcccaaggacagattggtattggtttcgaactccttggggttcaaatcatgttggtgatattccacgttgttattttgctttgtaatatagtatccagctggacatgttttggccagctatggaagaatacatcaaataaatatcaaatgctctctattttgtctgtacatggagtaagtggttcttttgatgcttcaatgattcattttgttaccttcaattttaaaaggaggaatgcctataagtaaaggcatcagattcaatcccaaagttggtccttttgcttcgaaaggtaactagcataatttcttccaaaggtaactagcataatttcttccaatcctttaactggaacattaatcttttctattcatgaactggatgcccatgagtcagtacttgggttgatacatacgtacatacatacatacaattgctgtaaatatagctttttatctgaatatatagtgaagtataaaatttcactatcctggtgatctttttactctacaattgctgtaaaagcctggacatcccacttttcaccgagtatttctgtacaattctgttggagagagtacaactgcaggtctaattctgtgtgctaaaaaggtagattttgatttaaccaaattttggcttgatctatgaatatatagtaaaataaaaggatcattttttttcttcaggaaagtaaggatgtaaaatcaaggaggccagctgttccattttgcttttgaacagctcacccaacttgcacttgatgcaacgattcgattttgctgctaaaagacatgttcaattgaatatattttcattctagagctgcaagtacatattcaattaaatgtcattttcttttcattttgctgctagaaagccaggttcaattgaataccctatctaatcaaattttctatttgttcagatgtctgtacctattaactccgaaatgaacatggtaggatggtttaggtttggagactattttttgttcaagacttcatgtacctattaacgtttgcagcaacaaccgtattttctgatttaggccaaaacaaccgtattttctgatttaaacagaaaagcttattttctttgatttaaacagagaacccagtaagaaatcatgcacatgcaaaattacaggccaaaatacccatattctcctatatatttaaatacaactagaaatattggcgcgctacgctgcgcccggttgacgttcccattgactttgaaggaatacccattataagtaatgggtccgacaaatgtctgaatgtcattcacccgaatcacatcgatcgcacaagaacataaacatgtttgcttcggcatgtaatggttgaagtaggatagaagaacttctacgaaatatctttacacaaagtggtgtctgaaatcaatgtcaacttgcaattacgttggtattagaattaggcagaattaactaatgtatggagagctcccatgtttggccatggccaggacaccataaaaacaaaaggtaaatatttgctctattatccttccaatcgtgccaatatcattcagcaaggcatcacctatcatacaattcgatagaacatataccggtgttaccacactaatagattgaggatagtatcaatggagaaaagggaaagatgcaatgcagtgactgattccgtaaagatgggtaaggtaaggtacatataaacagagaagatgttgacctagtgaataaagcaccaattattagtgcagtcaacaggagagaaataactcaacaaataaatgaattaatcagtgactaaatatagcagtttctttgtgtaagtcaaaactaaaacctatggatatgctatataacttatctatacaaagattaaatcatatgtaatcatgtaaggacttcacttgtcaaatgtcaatgcttagctaagttaatgtggcataaagatgtaaccaccatttgagagcatgaatacaacacaatagaacttgattacacatgctatttgggagctttgctcaacaactgattactaccaaatggttaaattctttatttgtagtgcagtttggaataaactaatattaatatgaatatataatatggacatgtaactttataaagggttgaataaatatgtttcaggttataacagaatcctgaaatgcaataaaggtaactgagttttagtcaagcaaatatttagagtgaatttattttatttgaacactacaataaaaaatgtgtgtggtaagaaatatctacaactactgcttcaattggttgtgaccaaagcactgttgaagatgaattcagactttatgaattattgcatgtaaaggaattaagaccccattttatatgggcaaccaacgtatctgaagaatacggtacatgcaaattgcgggtttaagtaagtatgttctctgaagtgatgtactagttgtaagccttagttctggcaattaactgttaactgatcttgtcaagtaacaacaactttatagctaagttaatgaccatgtaggtaagcctaattacccacaagccatgtctaactgtactaatgcctatctttttactatttaggtcaaatgaaacacgccaattttggacatttgttatgagtccacatttttcctaccagcaggaaagaatgctgaaatgactgttgttgtttcatacagatgctgtaaaaaaagagtaagaaactataaccagaaatgtgataaattgacattaaagaatgctaagtataaccagaagaacatgagaacctaacactgttagatttgtgctgcagcagaacttgcttcagcgactgatacttgttgaatacatcaatgaggtttgacaaaaagaaattgcagttaggagcaactgcagagaaaaagcattgcagtcaacctaaaacttagtgccactgattgggataccacagttatagcgcgctcactggcaatgctctggccaatatgaaatgaagatgtaattatgagaaatcagttctgataaattgaaaattactttgtcaaatcctaaatcattgtacattgctctagaagaagaatgcacttctatgaacagttgctgaaggcgcttgtttgaatgaaacattgtgttgaatcctctcaaaagtgaaaatttttctctattatgttaatgtaagataataattgacctaagaaaaatggttaacttaaattaataagcaacggactaactgagctttcaacgcattatctccatcatggattaatgataaatagttcatttaaatgtgcccatcttgtagagaaaaaggataggcaaacaatcttgttatgaataagcacaaaccaaggacagtaatgagcatatacaaagaaaagcaattagaaaatctattatcttctacactgctattgggaagcaaaattcaatgtatatagtttagagtttacttaactttgtgcagaattggctacttgtgtagatcatgtgctcgagaagatggcgatctgagtctgtctgcatcctattttctctaacaaaaggaaatagtgtatgagaagctagaaccaaatgtattccatgccaaactaaacaatggagggggaagcagatctcactaaaagatatggctaattgagacagaaaaaagcaggaaacgcgaacacactatagaatcattgatttgaatattatacctgattaccagagcagttaccataccagaaaaggcaaggcagtgatgtattcagcagttacaactgcaattaagaataaaatcatgcacacacaaattagcatagtaaacatagaacattaaagataactaacaaagagatagaataggatgccaacaaaagtaggatgggtgagggtagcatacgaccaaaacagaacaaagacctaatcagcatggcacaagcagaagggagagaagccccactcgtactgacctatggtcctctcgcataatagcagccatggctgttgcttcacctcagattgtgaggctaggtccccgtgccgtgatgcagaccctggtcgtggctattggtcaaagatgcgaggatagcgtccaggaaggtacctaagggtggaggaggtgaggattaccatggtcaccaatggaagaaaggatttctagtgaggagggaggggaaaatcatatcagcggcacaccatattgtggattttggaggaggcgaaggctagatgagagaggtcggatggaaatagggattggagcgatgggatcggaggtaatctagaaggctttcattggatcaccttcgcagataaagtggaggccctagggcctcccgaccgagcacatgcggccgaccaaactgttgaggcaagtagctccgatgggaaggcaatgcgcagccgaacggtgaaggaaaccctggggaagaagaaaaaaaagggagaaatcactggattagactgctactcagcaggaagaaagaggaaaaagaaaggaggagaaatcgccggcgacctcaccaagaaaaccgaagaggagagaatggggagaggagggatgtgcgcagcagccgagaagagacttcaccaagcatcctccactaccacgtacggcggcaggagacggtggccaatccggcgtgcgctgtacacggcaagcggtgtttctagcgccgctccgtgtggaacagaagcacggaaacacggaaacagaacgtgggctgagcaatgagaaagggaaaagcccatgtgcaaggaagggccggcacaggaaaatggcccaatagaaacgcatctaatcctgtgctactaaaaccaattaaaacataatctaatatatcgctgcgcactatcgctgctaattgctaaatgcatatgcgcgttaattatccgaaccaaactgatgacgtggcgcccctaaccttccaaagatcccatggggtttaagtaatctaatataagccagttagaaaccatgaatatgcagtagtaatgtcatgtgataaattcgttgtgggggtaagaatgagtctttccaattggtaatttgtgacctttcacgaatcacgatggtttatattccaatctgctagaacatggtgccactcatatttttacatgatctgggttagaaaattttcccctttgtagttcaatatatgttgagtgcaacctaaatactttttattggaaacaacatggaagaacagttgtgcagatttataattacttcaggcacatatttgttttaatggtctgctggtgctgggtgtatgtattaattattattacctgatgcgtgtatattgttgacctacaggattaaaatttgcgtggactacaaaggcggtaagttcatcttaaccgcttatctctatagtgtgtatcatgctcacttgcagaggtgcttccataaggagcataatacttcagcatattaatgttttcaggctttgtcaattgctcttcctgttgctacacacttcaacagtgttttaatatggtcaatggtcatggctatgctactgttcggagtcacctatgtgattatgaggtttcataaagtttcataaattatttgtgattcaacgcaacaaggtatcgttgtcattaacaggaactcaacttttcctttcatttttgtagaacatcgtcatcttccaagggctataagcattaggaatcttctaaacatgattggtttgggcaaatgaaaaatacaaaattggactcagaggtattgcctccaaatagttgttactacttttaactaggtatgcaaaaccaagttatgaagtcttctaagctttcctgtatatatgttactgttgtgccaatttatgcttgttagggaatcttagaaaactaaactatgtagttatgcccaaatgcttgtagtgcctaatcagcttagatggtcatgtacttgatcttgaacatctacactttctcagacaaccaattttacttttttttttgctttttaatggttgacacaattagccattacggtaagcaatccatccatgatcccagagtgccttatcctttcccatgctatcatcctcgatttattctactgctaactgcccttcgacatgttattggtgatggacttgctatagaagtacattggtgatgaagtgatgaaccagggggctaaaatccaagttgtgatgtgacgatgaatcaacgatgggaattggacaagaacccaagcaggcaagtaggatatgaaagtgatgcaagtaattatgatagcaatcatgtccgatcaggcttctcaatataatccttttaggaaagggatgagattagcagcattttttttactcttttgattgagattttgctgccacaaacaacaattcctaatattgaattgtgccaccacatgctttggatgattctaaaggaatatttggccatgtttttttacacttaggaaaagagaaatattgtttcaaatggattatattgtattaactccatctaagaatataagggattttgcccatgtcatttgaagaaccgtgggataatagatccggcattaaggaatttatccttaaatttatctccatgatattctcgtgaacttctgcatcttgtctcacaaaatgaggttgtaatagacatctctcaattattttttaatctttctggcgtgttgaaatgaatgaattggaaaacatgaaagtgaaaatgaaactcaatttatccttttagatggaaacagaaacaaccaatttcacgtggctctcgagaatatattttgatacaattgagaaattttgcattgaaagaatgtaaattgtgaaaacgtgcattgcacgtgcacgattactagatatatcttgacaattgagaaattttgcattgaaagaatgtaaattgtgaaaacgtgcattgcacgtgcacgattactagtagtggtaagtggcagactgcctgatttggtggcagcagtttgacagtgggtgctttttatttggcgggtactccagctaaggccatgtttagtttctaaaacaaaaattttcatcttgtcacattaaatatttggacacatatataaagtattaaatatataaaaaaccaattatacagttcatcaggaaattgcaagacgaatcttttaagtctaattg

SEQ ID NO: 81055 - DNA, 725 bp, Oryza sativa
ggaaataccagtcggcggcggtcgaggcggccggtcggtgaagatgtagacgcccaacaatggcggtcataataggccagccgtgcaggcgaggacaccagtcggcggcggcgaaggcaagccggtcggtgaagacgtagacgcccaacaacggcggcataaaggccagccgtgcaggcggaaacaccagtcggcggcggacgaggcggccggtcggtgaagacgtagacgcccaacaacggcggcataaaggccagccgtgcaggcggaaacaccagtcggcggcggcgaaggcaaaccggtcggtgaagacgtagacgcccaacaacggcggcataaaggccagccgtgcaggcggaaacaccagtcggcggcggcgaaggcaagccggtcggtgaagacgtagaggcccaacaacggcggcataaaggccagccgtgcaggcggaaacaccagtcggcggcggtcgaggcgagccggtggtgatgttctgactgatccattcctggagcgtaagagataagcttaaagccatgaatcccttttatgcatatctggatctggatcctgtagaacaaacatataggatgagtagtatctgatataaatataatactcgagaaaaaaatcaagtattttaaaatatttataaatatgtatttctcctcttgtcaattttgatttccccgagcagatgtttcataacgtttaagggctgcaggaat

SEQ ID NO: 81056 - DNA, 1968 bp, Oryza sativa
acgaaggaataaggggtaaacaataatcaaggcatggcataatcacaagtaggatgtttatcattgcatgcaattttatttgtaaacaaaacaatttcgcaattgggatcaacatgttcaaagaatagtgatgacttgccttgctcaggataatccttattattgatataatcttgatcaaccttcacctcctggaagttgcagacgttgcctcacgactaaccgatgcacaaggtctataatacgcaagaaaaaccaatattcaaataacaaccaaatatgcacaacaaaatatactattcatgtctactaatggattccaatcacgctaggggctaaggtttcttaatctttctattgtcaacgtggcctatttaggagttaaccaacatagcatttataggatacatatatatttggctaatcggtggtttagtctatcaaatggctatggaaggattatggctaagcatgcatctatctacataggacggttatttactagaggttctgttgttagatggatttaggatcaatcaaataattacagtgaatcatttgtattatttattttatttatggaagctttactttaattatgaacatattttacttgtcacaataaattataaaaggttaataattatccatgctttgtatgttagagttgtttaggttaatcatattatggttacagattatcctatcacataattttacaatgaataatcctaatttacagttgaactataattataattatatgaggtcaagatttataactagtatttatctaatatacatgtttgtcatacactccctcttaatttaatatatgcaacacgcaaattaatactataccgtaccactataatgggatgtatagtatatgtgtaagcaacaatatcttattattggatcatatatttgagtagttgctttttactgtaagctatacaatacatgttgattttaagatggctctgtttggttaactaatggatatcaaccgactatatacatatattctacttcacatgacattgtatcgacaaacttttaagtggtccaaatacaactagctctgtgattactctcctaaacaagttaaagattcatctatgtgtgtttatattttagttacaaaatatgaggctaaactttatgtaaacaatttataagtcatggatttagttatatttggacatagactagtaaatggcactaatattttcctatacacccattaatttgaaggattgattataactaatttatttagttgctacagtgacaagacatgttaaagataattatgctactgtacaatatccatttttattcattggcacactatttaggttaactattatctaatcatttgatattaattaatttataattataaatatattttgttaaatagtgaattatatatcattggaaagcttatgaatttagatgaatttaggttcaagtttcacttaaatccgagttaaaatgaataagttatgctagtgtaaagattcaaatttgaattaatccgagaaattgcgaaaagctactgttcataaacgatttatttttaatccaagacatatccacagccttgtaccaactgacaagtgggaccccgggtttatttctttttcctaccgaattattttctaaagggaaataggaagagctaatgacaagtggggcccacatgtcatagactcgagaccataaaacttctataattagatttttaaccacccggacccacatgtaatagacactactaataaagattaagaagagggttactattcaccaattacgtggggcccactaatctctcctctccttcctctctctttcttcttttctctctttctctccctcccggcttcttctccctcctctctccctcggctctctggcgacggcgaccgaacaaggggaggaggcgggcggcttactgac

SEQ ID NO: 81057 - DNA, 1233 bp, Oryza sativa
tgaagtcgggggtcgatggacattctccagggcaaatgaaggctacacgagctgcggcccggtagtcgagatgtcatatggcagagggttggtgccctgctgctaggggctcagtcctgcctgcctgtcccgggtgttccggccgtaggcgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgtttcaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggattgtcttataaaatggctttggggcaactaagtgacttttaaatgctgtttactgcaaaacttaacccctatattattatccccttgtactcccttgcattaattatgcatctccggtgtggcttgctgagtactgtggttgtacttattcttgctcaatctttcccctcttcagtaagagaagctttggagaagatgtcttaggtggagtcctggcttataccccagttgagcgcctgtgaagattgagccgtaggcccgctagtccgctgctgtttatttttgattgtcaggccttaagtgcctttgtaataatgtaaatattatcgatataataaagatgtgtcttttataccatgtttgtgtggtgtaccccggcttttcctgggacggggattaatacactagcgttcgggaaaaggcaattttcccggtcgcgacacaaacactaataaattccacataacagcagaaacaaagcacaaaaatgggttcttcacttcttaaggaaaaattagagacttgaacggtccaattccgagttcaaatggccaagttatggccatttgaagtttatatgctctttaaatggatatttgcgaatttcttcatttaaattttaatttaaaaatcgaattattgcgtcagccgagagagagggcgcgcggaccgggtccacgggagtggggccc

SEQ ID NO: 81058 - DNA, 8850 bp, Oryza sativa
aagccgatggaagtgaccccgagacgggaggaagtccggagtgacgacgcggcgaaccggaggtcgacggcgacggcggagagacaggtggacgtcgcgagcacgtatccgatggcgagagcaagcggcgaacggcggaaacggaggagggaggcacggggagcaaatatatagcgccgagagggggagagcgcggccggagagggaggaaacggccgcggagatctcggctccattgaagacgccggcgacgattgcgggattcaaatcggacgaatccgagggagagagagagggaaaagagggggaaacgggagagggaatcgcggggaatgattcccccctcattatggcgcgcggggacggcgggatgcggcggaatccgcggcggcggcggcgctagggcacgggcgagcggcggacgcggcgcgaggagggagatgacaggtgggtcccacccgtcagcgagagtggcgggcgggcccgcctgtcagcggcgcgcgcgcgcgggggagccgatgggccggaggggaagagagagagagggaggggctgggccgagccggcccaagaaggaagagggggggaaaaaagacttttagggatttttctttttataaaccttttcaactttgtttatttcttctcaattattatttgtgctctgaaaattccactaaaatttatttacacattttaggcttttaggaaatatacaaaaatcctccaagcctcatttgacttttatctttgcacattttaattgttggaggctttcacatgaattttaattattctcggcacaattttgaggatgaattttagagtcgttttgggacgcgacaacggtcccaggatatcgagcccccagacagcaaatggccatgaaagtggtatgatctgcagggcctgggccggttgatggatttgcttggcgtggaattgacacgctctgcatcgccggaccaggtcgaccgcatcattgagagctgtcggccaatagaaaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcactcccctcgggtcccgaggcctggactccgacgggcctcgggggccggtcaggcgcgtccgtctcccctaaggggtcgggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgccgtacttggcgtacgtaagcatccatctgcgggtcagagcaccggtactccatacagacctggttaacaccaggaggcggcggatccccagtccagctgccaccctaagtcccgcaaggagtccctcgtactctgccatattattggtcgcccgaaaatcgaggcgaaccaggtatctgaggatttctccgctcggcgaggtcaacgtgacccccgcaccggcgccctgaagagacagggagccgtcgaactgcatcacccagcgggcggtgtgaggcagctgcgaggggcccgagctggcctcggggagtgagacgggttcgggagccggggtccactctgccacaaaatcggcgagagcttggctcttgatagcgtgacgtggttcaaagtgcaaatcgaactcagaaagttcaattgcccatttcaccacccgtcctataccctctcgattatgcaagatttggccgagggggtaagacgtaaccaccgtgacccgatgcgcctggaaataatggcgcagtttcctcgaagccatcagaatagcataaagcatcttctgggcctgagggtatcgggtcttggcgtcccggagggcctcactaacaaagtagacgggccgctgcacctttcggtggggccgatcctcttcgccaggggccgcatccctggggcgctcttcgtccaagcggcctcgcggggcgcactcgtcttctgtgccgacgacctcggggtcggaggacgacaggcgcggccttcccacagtggcctcggtgccgtcctgggggtcgggggctcctggcatcgtcggacaagcgggcaaagggccaactccggtcgtcgggggccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggggcctctcctccctgctctctcccgggccaagccagcacagggtggggatgcgcggaatgaggattgtcctcatcgcgctccacaaccaacgccgcactaactacttgcggggtcgccgctaagtagagtagcaagggttcatctggctccggggcgatcaaaactgggggagagctgagatacgccttcaactgagtgagggcacgttcagcttcctccgtccaagtgaacggcccggagcgtttgaggagcttaaataagggtagcgccttctctcccagcctcgatatgaaccgacttagggcggccatgcaaccggtgacgcattgcacatccctaagcttgctgggggcgcatccgctctatagctcgtatcttctcggggttggcctcgatgcctcgggcagagaccaagaacccgagaagcttgcccgcaggtacaccgaacacgcacttatcagggttcagctttatgcgggcggagcggagactctcgaaagtttccgccagatctgaaagtaaagtttcttggtcgcgcgtcttcacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgtagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagtttgccattcgccttgggaacgaccaccgggttcgccagccactccggatggatgacctcgcggatgaatccggcctccagaagtcgcgccacctcctcgcggatgaaggcttgacgttccggggcctgccgccgcactttctgccggatcggccttgcgcccggccgtacggcgagacggtgctcaatcacctccctggggaccccgggcatatccgccggtctccatgcgaagacgtcagcgtttgcccgcaggaaggagacgagcgcgtcttcctatttgccatccagaagaccaccgattcgtgtagtcttggacgggccgtcacccagggcaacctccttgaccgggacctcgtcgcatgtgatcatcctctgcctcggggcggcgggaacggaggtgccaagcctctcgtcgccaccctcgggcttggacgcagcggcgaggtgatccgcgcgctgctccatacaagcaagcgcgactttgaggtcgccatggacagagatggggccaccggggcccggcatcttcatctgaaggtaagcgtaatggaccgccgccatgaacttcaccaacgcgggcctccctaggaccgcgttgtagggcagacttaggtccgccacatcgaagtttacccgctccgtgcggaagttgacggatccaccgaaggtgaccggtaggtcgatatgacctaacggccatgtgtgccccggggtcacaccgataatcggctgggacggccagagcaccatccccggggccttgatggcgtcaaaggccacgggggaaaggatgttgagggctgcccccccccccccccccgtctatgaggacacgccccaacttcacgttgcaaacggtgggggaaaccaccatcgcgatctgtcctccccgggcaacacacggtgggtggtcggtctggtcgaaggtgagggcaacctccgaccaccgcgcccgacgcgtcgcctcatgagtgggggccgcggccagaagctctcgcttcatggccttgaggctccggcgagaaacgtgagcacacgctcccccatcgacagtggcaatggtggccccaggctcctgaaagcctaggtcatcatcgccgccatcgatgtcctcgacgggggccttctgcttggcctcacttcgccgattgccggagggtaccgccggggacttaccctctcggcgctcctgcctcctctcctcctcccactttctcgtccgctcagccaaacttttgactgcgcggcagtccgcgaggtcgtggagggaggtgttgtggacgatgcaccacttgccggttgggcgctccctgctgggagcgccggcctccttctttttgtcgctcgcaggcctcccctttcgggtggcccgcgaagcgccctcgacagtgaggacatgaccctcgtcgtcggaatgggctgacctcttcttcctcctcctgtcacgtcgccctgtctgagcagcggacccgggggcggccgaagttgccacaccggaaccggaggggttccaggtccaggcctcctccttacgagccactcggtccgcgagctgaaaaagctccgcggtagtctggggctccttggaggcgatcttttcgagcatgcggttgtgccgcacacccccctgaacgcgtagatcaccgcgtgtgcagggatgcatggtatggtgttgcggacttgacagaaccgctgaatgtatgagcgaagtgactcatcatcccttcgctgtactgcgtgtaagtccgcttcttcacctgggcgcggatatgtgccttgaaagttcatggtaaactgttggcacaaatcctcccaagagtggaccgacgcgggtggcaagttcattagccaaccccgcgcctgtctcttcagggccatgggaaagaaattcgccatgaccctgtcatcacccccggcggcctcgatcccggtcgtgtagacctggagaaactcggcggggttgacgctcccgtcatatttttcggcgatggtgggccggaaccttgggggccaacggacgttccgaaggctcgctacaaaggctctacagccgacaccaccaaccgggggcacggagggctgatccccgcgtccgtgttgaggtgacactccggacgaggaggcaccctccgttgcgtgggtagcacgtcgaccattacgccggcgctcgataccgatgcgggcatctggccctccacgctgatcttcccgggtcagaggtgctgacgagggagtggcagccgaacggcgagcaacagccgccgctcgccgcgccctccgccttgacgacacggagccggtggtagcagcgccagaggtcttggtggctgtcacgaccggaaataacccaacgggcattccttacgtgcgtgcatgaatccttgtcccaggaggcaaggtacaccaaaagttgatacaaatcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacacgatcttagaactatacaatattattaatcaaggccgtgaacccacacgaacctgccttaacccaaggcctatgatgattcagaccgaactggcaacccgaccctgggtcccagctcgtcccaagtcaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttaggggattttgaatagagggggcggtgtgaagccaattccacaataatccaacaattccatagtgtccaggtgatatgaatatttcccaagtctaaagttataaaaccacctaatgttacctaattaaattgcgaagcatctacctaaatttaaactagggataccacgagtagagtgtccactagttgaggttttgtttactctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaagatgatatgacttgccttgctcgctttcccaaccgacggcttcgacttccacgaagagcggatcttccgaagctgcagcgtctacacgaccaacggaaaagaaaaggcttttacactactaaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaatctcatttattgcgtcagccgagggagagggcgcgcggaccgggtccacgggagtggggcccacgcgtcagcctctcggtccacggtggaccgggagcacgcggctggcggcggtcggcgccgtgggtcccacgcgtcagccgcacccgcgggctcgggcggctgacggccgggtcccacctggcagccgcgagggcgcgcccgaaggcggcctcgccggcacggccgaaggtagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaagcggaagaaggcggcggcgcggttcgggacgacgaggacgacggtgctccggcggtcggcgagcgaaacggaggcgcggacgaggtcgacgggaacgcggcgaagccgatggaggtgacgccgagtggggaggaagtccggagcgacggcggcggcgaaccggagcacggcggcgacggcggagagaaagtgcgacggtgcgggctcgattccgacggggagagtgagcggcgagtggcggaaacggaggagcggagctcggggattgattttatagcgacgggagagagagagggcggccggagagaaaggaaaccggccgcggagttctcgggctccattgaagacgccggcgacgattgcgggattcaaatcggacgaatccgagggagagagagagggaaaagagggggaatcgggagagggaatcacggggagtaattcgcccctctttatggcgcgcggggaaggcgggatgcggcggaatcggcggcggcggcggcgctagggcacgggcggcggcgggcgcggcgcggggttggggatgacaggtgggccccacccgtcagcgagggtggcgggcgggcccgcctgtcagcggcgcgcgctcggggaggagccgatgggccggaggggaggagagagagagagggagggagagaagtgggccgagccggcccaagaaggaaaaggggggggaaagaagacttttagggatttttctttttataaaccttttcaactttgtttatttcttttcaattattatttgtgctctgaaaattccactaaaatttatttacgcattttaggcttttaggaaatatacaaaaatcctccaagcctcatttgacttttat

SEQ ID NO: 81059 - DNA, 4535 bp, Oryza sativa
tttagccattgggctgaacaggaaaagcttggcgcacacgaaagagtatgagagcttagaaaaacacacgcagaaccccctacatggcgcgtcagatgacggagcgtggggctcctcaccgggagaccgcgcaggtccccctttgccggttcggccgggggccctgggtgaggttctaagctcctagtctgtggaatgttcgcgaaagtggaaacacacaagacacgggtgatgtatacaggttcgggccgctgagaagcgtaataccctactcctgtgttctggtagatctgtgtacgaagaagctacaaagagctggagaaccagagagctcaaactctagaaacccctttcctcctttttgcctctcgtgggatcttctcctggatcctccgggagtctccaatctctcctcccctggtcctctggtccggatcccctccctaagtgggcaaggtcctccttttatatctcaaggggataccacatgcaccacttctacctatttctctttttggtggggacccatcctcttttcactaaaacttggctcgcctttccttcataaatgggcggagatttgtaatggttgccgtccgaatgaccttctgatgggacggcccatacctacctccactttcgccggaagcaggtgcgacgtgggaacatggctgtctgccgacgacatgaccagtgtcagaccggtcacaaatcggtcattcttgtccaccacgcgtcagtttatcaatctgcatgttcacccttcttcatacaatgtcttgcttgtaacggttgggatgaagcctggcatatatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacatcatgcttcccgaagaaaccatgatgaatttatcatggttacaacagaaacatccacatctacataatggtagtactagtattgttctattctgcacgtattacattctgtgtgcggaactcaacacgtactgctcgagtacaatttctgagcagaggacagggaaatgaaaagaatgcctaccaggtatagttaagttaagggtgtgtttagttcacgtcaaaattggaagtttggttgaaattgaaacgatatgacggaaaagttgtaagtttgtgtgtgtaggaacgttttgatgtgatgaaaaagttgaaagtttgaagaaaaagtttagaactaaacaagggttaagaagaaataaaataaaactatgaatatatctgctagtattgtacagttatgctacgagatgttgaattcaaatctcacatactattatttttttttacttagtatgcatctttactacatgttgtttcaattggtactaattaaacatcaaaaagtttagtctcgattactagtctcgaacaggtattaaagatcgtttctcgtgcatgagcaataaaaactgatataacaagaggaagctccacgagaaaagcaaagaagacggaaagagaatctcatatcacctgtgccatggattgatgtcacaaaatcgccgttgttcgctctgaatcgcccgttgacaacctgatttatcgatcagggctgtcgagagggatttatatgcgagctcaacattgtttcgattttccgattaccgcggacggaaatttgtccaccgcgtgtggatccggtaacgggcttcatcggggcttgcttcgatggacggtcaataggagcgggagtatgtactccctaggagtacccattttcatatatatactgtactcgaaaaattggctttgagttgaacctgactcttattttgttcttctggattttaatattttgtaaactattttctcaaagataatttaccaagttgagctatcattcatagcaagatctctcgctgcaacacccagggtccttttagagaaaattgcaatattgggacaacaaacattagggcttcgctgtcttgacactccgagtggatgacaaatgggtccatatgtgtctatgaaatatgtgtccagtatcattatagcaaaggtcaatgtttgcagtgtcattattgcaaatctcccgtcatttttaccccgtttcatagaaaaatattatatcttatgaaattaaatcttataaaattaatagacgagatatagctacattggtgtacatctttaatgcatgccatccaattttagattaccatattactttcgaacgaatggagtaagaaatgctcatctggttggcatcaatattttaggcgactggtgatatggaagatgttctccggggttgattacagccgtagttcctcgttccatgtcgtagacacacagcgctttcccattgaaccccgagtagtagatacagttccctctcaagcctgttgtccgtgcatcaagtgacgctccaaaacagcctatctgaacgaagaacactctgccacctagcgaatccaccttcacccacgctgatctttgctcctgcgtcgtcgccatgctcagcctgtaaacgccaacaccagcgacaatccgatcacatccaatcgggtgagagaagagaatggagtgcagctccccgttcgattccacaaagatgctggtacgtttcatgtacaccgccggcctcctgtcgtcgtcgtctacggcggtcacggtgaacgccggctccagtgagaactcgaggacggcgacatggtcgatgagatcggtgtagaactcgccgtccatcgccgtgagctggcgtaacgccaggatgacgatgccgcggtgctcgtggtgaggcggcccaggctggaggtactggtgctgatgcctcttcacccagtggttgtcgccggggcggcaataccagagcaccgtgtcggcgtggtcgatgacgagcacgacgcagctggccgggtccatgggaccgcagcacgagaggaggcacctccggcgatggctgctgccttcggcggcgaggacggtgccgtcgtggtcggggggcagcccgacacggcggccggtgaaagggtcccacaggaaagtgcacggcgagccgcggcgcgccatgagcagccagccctgcgccgtggtccaccaccggtggcctctcatcatgtcgtcgacgccgccgtcgcccaccctccttggcagcagtgctctcgccggcacgctgtacagggacgtggcgtcgccgtggccgaacagaagcagaggagcaagcttgggatccagtactgctgcagatgcatcgcctgcctcctccatgattttgatggccgactgtcccacaggtaggatacggccggtcaattgaaaacgaacgaatttggcggtgctttataaacgaggagaggctttgagcagtgcaattactggcatataggaaagagaagcgaagaaatctgcacgcctacgacctacgattactagtaccaattaggacatgaattcctacacgacatcaaaattcaaacaaattatagtactagtactttgggccggtaaatcagtaaaaggaaacagtaatctgggccggggataaagagggatcaccacatatgcatctatggagattggatagcaaccaacaaaaaccaaccgtgccgggtatacaaactacaagcagaagcggaagccgacctatatatgagtccggaggaaacacgtcaagaaagcagagctccgtagcagcacaaaacgcagcgcgccaagcaggccattgcggtgcacgaaccctcgagattcgccaagcagatagatggaggccactgcgacggcggcgcagggactacgggactggtcgtctctcccgttggacatgctcgtgctcgtcctggatcggctcgggtggtcgacccacccgagcttcgcattgacgtgccggcactggcgctccgccgtgtcgcccttctacccggcgtggatcacgcctctcctcctgagcgccgccgacatcggcgtcacgaacgtcaggtactacagcccctactaccacaggtgtttcgagatcgccgacacgctcctcaaggtgcccaaaattgcggctaggatctgctgctccagtggacaacacctcacgctgtgtctacctagattgatcctccaagccgatctcgtagccggcaccatgtatgagctgccaga

SEQ ID NO: 81060 - DNA, 2930 bp, Oryza sativa
taaaagtttgaccaaatcttgtccaaaatgtcaagttttgctggcctagcaaagaaatgtcattttttttatgactggagtggagggagtagtcattagtgaggacatgaactatttatgaccagagggagtagtcattaatggaaaagagcaaaacccataacaccatattcgcaattattactaccaagcaaaaattggttcttttaaagaacagaatcctctacacgatggaatgatgacatgacaagcaagcatgatatgctattttcacccagttggcactagcttcatcagtggctggcggtaacaaccagataaaagtgagactgccagatcagggaaaacagaactctgagcaagacagaattactaaagtggaaagtcccattttggttctccatcttcgcactctgttcctccctaaaaaaaccttattcaaaaccccaagcacctcccaaggtgacactaccatgtgggtctagccatctaggctccgcatatcaatgacagagaaaatcgagaggcttgtaccaattcttactgagcgtgcctttttaggacattgaaacagaggacccttttctgatcatacaaaaaagctggagccaaacttttcccttgctaaattcacacgcctaatttcctattctaggtagtcagttccacttctcaacctcgcaacacaaattcggcaattttttcctcattaaacgcaaacaaattcaggaatttcactggtataaaaacacacaagagacaatgttccgtcagtcacctaccttgaggaagcggcctctcttgttctccccaatatcgaagtagaacacctgcgcgcgagcgtgccgcgaccaaaatcagcaaacatagacagcgccaaaaaaaaaaagaaagaaaaaatcagcgggcggcggaatcaatcgcgaccttggtgtcgaggcggagctccttgctgaaggcgtcgcgctcgtcggtgcggatgtagtagtcgaagaggtcgaggaaccaggcgacgccggcgacggggacgatgatggtggagcgcgtggaggacgtcttctcggagatcttcaggtacctccccctcgggttctccttcagatcgaagtagaacagcttgtgctcgaactgcagcgtcttgctgacgagctccacgtcgcccccaacgccgcctccccctcctcctcctccccctcccgcgacaccgggccccgccatgacgcccccgcctcctcctcctcccccgccgccgcccatcgccgccgccgccgccgcgaactagggttttgagctagggtttgggtttaaactcgctctcaaactcgagtcgtcgagtcggggagaggtggggatgtgaggttgggaattgggattagatctcgcgaggtggagagggggtgtgggggtttacccttttggggattcctccacgtcactgacgggtggggccggggtcaggtggggcccggggttggtgggcgggggtagggaatcggtgggcggggggaagggggggtgctgaccgtgtgcggggggtggtggcgtggcgggatgtgattggtcgggcgaaggacgctgatatgaccggaaagggtaaggtttttgtactggtacgtgtgctgctacagttgcggtttgggggtagaaattgtttggacaatgacaatcgtgctattactggagtatagtccctttgtaaatttcagtttacgtaggatacgagtaaatggtttggacaataactgtcgtgttgttaccaagcatactcccttagcaaattataatttgtgtagactagaagtaaatgatttgaacaataaatgttgtgtcgttattgaggtactccctccgtttcataatataagggattttgaagggatatgagtatacgacacatcctatgacaacgaatctagataaactcctaaccagattcgtcgtcttagaatatgtcacatccctccaaaattccttatattatgggacggggggagtatactcttccgtcccccaagaaataaacctaagaaatagatttttttaacgactcgcaccagacagtgcgaaattcatattgataagtaggaaaaaaattataagattacaacactgggaggtcgtaattaggaaaacaaagaaaattataccaccacccacgcaccaacagcaccaacacacagaccctggagaaggctagcaccgaaccggccgccactaagccaacaaaggatgtacaaccgagattgtccaaaactcaaccctaacaactaacacagaagcctactctatccatgtctttgggattgagtgggagagggtgagagagaagaatggaaccgctctcccccctaggccctccaacatggccaacttgcataagctaaggcgccgatataagagaacaggaatctagagcaagcttgcaacgattgtttgggaggtttcgacaagggagctgcttagacgatgtctctagggagataacgacaaaagcaccgctgccgccgtccgtcaaggtcttcaaagagaacagtgactaggttttcacccggtagccccacaagagaggatgggatagcacgacaacaccctcaagaggaagtgacgctctgaacgcaatcgttgccagctcgaccaaggccggactaggttttcacccaccgtctgccgcttgccaatccatcgctgacacatcaatgctccactgttgtctaacctccgcggacatgtgggcaccgctgcaccgacgccccacgccggctatcctccgcgtgccgccaccctcgtcgcgtcgtgccgaccttcgctactgaccgcacctcgcaccgcgccgacctttgctgccgggccgcgcctcctcgcctttgtcggccgcacatcccacccgactgcagctcccgccgtcgttgtcgcgagctctgccgctgccg
